United States Patent 9,487,797 (GENOMIC PLANT SEQUENCES AND USES THEREOF) - sequence listing, part 86

SEQ ID NO: 79978 - DNA, 6449 bp, Oryza sativa
agattaggtggagtccttaagtcaattgtaatcaaggaatgaatcaaaatatactcaggcaacctttaggcaaaatatgaatctcttgagttcttctcgccaacctttagtcttcactcatcccaaccaagctcgggtgtgtgggtttcctaccaacctttactcaggactctttatcctctccttaatataatgatacacagatctcctgcgtgttcaaggcaaaaaaaaagccaacgtcgtctggctatcttaccagcggtgtttatcccccaataaaaccttgcctataacacccactatagtgttgtggatgccacaatttgacgaaactactaatgttggcttatttgcatcatcttagatctcgacacccatgtatcaccttaagtttaacgaagcaaacaaattaagtatttacaagttttcatgcctaaatagcccaacaagatgtgaggtcatcagacacatcagatgctggacagaaagggtaggattgtgacgagagggagctgggctatttgtttgccgaggctgcattgtgaggagtgctcagcgcgaccgagcagattgcttggtacagtaaagaggtctcggcgcttttagttcggggtttgattgattggaagttatgctctcaaatatacagctctgcttttattttgtcaccttctgttgtgttgtcaattattatgcttttgaaatttgaaaatctaattagctagcacttctcaactgaatgtcatccaactagaactgatttattttatttcattttatttatctagttatggtagtgcatgttctacatttgttgttgatagaacaaatagtccaactgcagtggacactgtttatgattttgaacacagttctgtcctgattcgttgtactaggatgtgttacatccagttctagattcgttttttatgggacggtgagagtaattgattttgaacactgtttatgatttatttatgatctatacgcctatacctagttaaacatgtatctacttcacctacaaagtaaaatggaccgtactaatcttaactttttaaaataacttaatcttacatgtatctctatctcagagcaatataacttgaactacaaacttactgggtcttagcctgcggaactcctaaaattcctccgccatcctttgatgcaagaggatttaatttggtttagtagttatgtcttttgaaacaaaaatgggccgtcacacaacgctgaaacggttaataatactatttgtttgacttattctaattttttgcagtttcaagtagcatttattctacgtgatcgagattgagaaacgagcagtagggctccctctctgcggttctatatcatctcacacggcaccaataagctttgcaccctggtgaacattgggctatcgttctatggcccttgctgcaaccagagatgggggatacagacttgcttctgtttatccaatgtaaaactgatgatgatgagttctctaactgtatagtatatcgcaataaggccggtgcttacagaaggcactgtgtgcataacattgttttgttgctcaatcggaatattttgaagtattgcttgggtccggtcgtccggagactccggatatgttcacctgtttgaggtttcaccgttttggttggttcgtctcagctctccttcagactactgtaagttctcgacaaatgttcactgatataaaaaccaaatacacaacccccctaggccaagcggttcatgccttcatggtttctgtgaatcatatgacgcagatatcctcatcccattgcaaaatatatttttttagtgaaaattaacaaactagaaaaaccaaattgaaaaactataccctacaaaacacgtattctttagatcccgttgcaatgcattccaagggcatagccacatcgcactatattcaaatattagtgttctacgataacaaacaatgcggggatttagttttttgttttgttaactaaatctatgatagctgaacggtcaatgcggttgccttttttttttctggcctttttttttctgtattgaaaactcatgtactacctccgtttcatattataaaactttctagcattgcccacattcatatagatgtcaataaatctagacacatatacatgtttaaattcattgacatatatataaatatgaacaatgctagaaaatcttataatatgagacggaggaagtatttatctatgctttctatataagtgagaccacaaacaggcactacgtctagtgacatcatcaaaatagttttaactgttggatcgacaagtttttcaggattaaccgttagacaaaagtcccctccacttcttcaccaattaaacaacgtcattaatcaccaccctatctaaatgctatatatttaatcaggtactcaattggacaataatacaaccaagatatcatatcatatttactattcccaaccatcattcaatcaattttatatacatatactaatagaaatatatgtatatacaagaaaatagaaatgagaattgcttagtaatttccgcaggaatcacttagttcaatatatagtattgagtgatttaggcctctctcaaagagagattcagttgctcttagtagaacaagcaggtagaagtataacacaacttgcaaaagattcttgaaatatgcagataaggactccaaaagaaaacagaaaagcaatctagcctcgtttcgcttcttctcctgattcagtgacctagacaatgaagccgacaacggctacggcgaaaacgaggtcgactgcaaaagattgcatcgagccgcaatacgggccttgcaaaatcggatgttgaagcgaactctatgaacatgagaactttcggtcgaaccttggagatgcctcgtcggagacaacacatgcccaatagtaatcgactaaactcggtagggtccaccatataccaagtcttatatagaaccgcatctcgtatatagaaggagtttccgataagaaaggacaaatagagttcaagttagaaacgaccaggactacttggatcgtatccatatttatctctctagttctacttagacaaggagacatctatgggtataaatacaagaccccctaggaggagaggggacacacaagccagaacaaaccaatacgccgccaaacatcgacatcagaattagcctagacagacccaatttggtgcatgcggaggccgacaaggggatctagcgctacctctaatctcgacgagttcgtacttgaggaggaagactaccctgtcgtcgactatgtgttggtgatccatgccgccaagtcaacgacagctagataggttatcccaattattgtacttgtatgattcggatgaacaaagagcaacaccggcttcggccaataggagtagggttgttaccttcttgtgaaggggcccaaacctgtataaaaatccttgtctatgtctcttttacctcaatctcacatataccctggtaccaacgacccccataccatgcaaataccataatcatgacctaaaatgtcgacagtggcgcgccaggtaggggaattttggtgctccaaggttttgacgagatgggttcaagagatggattctctgacaacaaactagtcgacgacttcggttgccttcaggtggtcgagagatgcctactcctggttttcgaccagtcggttgtagtgatttctctccacctattagttctctttaggtgattcagagatgcctcctcctagttttcgaccagtcggttgtagcgatttcttgccacctatcagttctcttcaggtgattgagagatgcctactcctggttttcgaccagtcggttgtagcgatttctcgccatctatcagttgtctataggtgatcgagagattcctactcctggttgtcgactagtcggtcatagcaatcttccgccacctatcactcaacttctattagtctagacgatgactacaactggtctttcgaccagtgacgtagcggtcctcgcacctcaactcctagtggttgaggtatgattacagctggtcttcgatcatcagcggcgtagcgattctcccactacctctatgatttattgaatacaactacacactcggtcttcgccttgtgtggtagtgacctcatcaacccatttgcgtcaaattctgtaagtgtttgtatgtgcaatatttttccgttgatccccttttcttatatcgccctatcttgaagtcgtcctattattcctttacgctattctaaatgcatattaactaagccgtgtaatcgggaattggctttcccaacttcatggctaggggctaggattttgttagcttcaacttggtttgttataagatttaagctgcctttgtggaaaaatgacttttccataaagacaggtgagggctaggaagtgtaccatactccaattattgagtacagctttagctagaatactcttttattgtcacatgcaaattcaatttattttcaattttcaaattcatattatatcgtgttacccttgagcgttcgctcgggggctatttgtatctaacaatttgttttgagttttgatttcaggaatgtcagacttcagggctttgtcgcggactttataactactcgattactcgagaatggttggtggagttcgacaaggattacggaataaagtaacgctgtacccgctgagacaaaattttctgacttcaatccaaattcttgattacggcaagataaggaattaagtcacattctcctcacctcctcggttgtccgagaatggttaagcgagcacaaaaactgatattccaaggtcttcggttgagaacatcaagtcgatcatttgcattgaagtcggaggcttctatcagggttatgaatagcacatatccaatagtaatcgactaagctcagcagggcccaccatataccaaatcttatatggaatcgtacctcgtatatagaaggagttccggataaggtaggacaaatagagttcaagttggaaacgataaggactactcggattgtatccatatttatctccctagttctacttggacaaggggacatctatgggtatgaatacaagaccccctaggaggagaggggacacataagccagaacaaaccaatattccgccaaacatcgacatcagatattagcctagacagatccaatctggtgcctgcggaggctgataagggggatctagcgccacctctgatctcgatgagttcgtacttgaggaggaagactgccctgtcgtcgactatgtgttggtgatccataccgccaagtcaacgacagctagataggttatcccaattattgtacttgtgtgattcagatgaacaaagagcaataccagcttcggccaacaggagtagggtcgttaccttcctgtgaaggggcctgaacctgtataaaaatccttgtctctgactcttttacctcaatctcgcatatactctacctcaatctcgcatatactttagtaccaacgatccccatgtcatgcaaataccgtagtcatgacttaaaacgtcgacaacatcaaaccagtagcaacaaccccaccggagatgatttgaaagaacggcgccacttcatcgttgtggaggaagaagagttcccaccacaaggcaaatctgtttgacatgtggatccaaacaccagtacaaacctccatagcaaccctgcgaacagcacaaagctccgtttaacttctttcgagttgtatacaaaaggggaagaagaaaacctagaacgagataaactcgatatataggctgcgttctttcccacccccaacagtgctcacggaaaacggagcgatccattagcacatgattaattaagtatctgctattttttttaaaaaaaatggactaatatgatttttttaagtaactttcgtatagaaactttttacaaaaaaatacaccgtttagtagtttgaaaagcgtgctaacggaaaacgaggagtaatagcctgaaaagaacgcagccataatgggtataaacccgatagcacttggcaaaccgtgacataatataatgcatgtagctctaggccaaccacgtcataaaaatgataccaaattacacctgacttctatggagaaaaaaccagttttagagaagtcatgaaagcatgctattggccagttttaaaaattactgtgcatagcaatgaattttaataaaaaagttcttttttgcagcgagcaaaggaattttgaaggtattaggttaacacagtgcatatatcacaaaaatgagtatgcttaagtccctataagacatacagctccaccacacctgaaaacttaagcgtgtagcatgcattttaatctactctcgagtgacaaatctcccggatggtgtagactaagtgcatcttatccg

SEQ ID NO: 79979 - DNA, 2124 bp, Oryza sativa
cggtgcacgccggcgagcgggatggaatagtctacgagcgacggcgcaacacagagtaggaggcaaaccctaaactgatttcgcgtatgttgcgtgaaggcggcggcttggtttatacagagataggtcgcttgatcagggcgcccgcaagatctccactccgcataaccgaaccagataagtcgcgcgtaacttatccggactccacgccgttttcacgaaccggattttttggaatgtttccaaaacaaaacaaatccgaatttcccgtagcaaaataaaactgcaaaaggagacttgcatttgcagaccattcgacgcgtaacatcgtgcatgcgcgccgcctgccaggcgaggcgaggcgaggcgagcgcgtgtgttcccctcttctctccaccatacacgcttcaagtggctaggagggcatccttgtttttaaggaggtccccctctcctagaataagcaagatggtactaaactccacatgcatgctatcttatgaggtgggcttttgtgatttttctaagaattaatcttagaatgtgccttatcccatctattaattccaacaatatgcaacggcaaagccagctcccagctgatcaggcggctgctcaagctccgccactggcatcaatactgccaattggcagaaactcctataaaagttgtcagcagctaagaaatgctctacatcgaccgggcttaagagtgctgccggccctgcgactgttcatatggtataacctatgcctttggttttctgattagtggattctgcatgtgtaggtacccacagtagatggaaagtcactgataaatgcatgcctatgggtgatccagccaagaggtatcaacaaaataaaaaaaacattaattattcagatcagcacgaatctgatttcaaatcaattcaagaaggaatgtagtaatgtcttggttttttctttctgcataacaagtttgaagttcaatattttaaatttgacataacatcactactgagaaccggtgcctaaaacctggaagtctggaacaatataggtgagctgggtgaataagatttgattttttttccttgcttacatttgataaaaagaaattgaagtaagtagatctgatatactatgaagtttattggaatatggagtgtgcagatgtaagtcacatcacactgatcttattgtgtgtaatgagtaatgagacaagatatctaaacatggtttccactgttggacttcaagcttggatctctctttgtgcaaaattaaatggcataccaaatgtgtgatctgaagtttggttaatacagtacattttgggattggttgggtcgaatcaacccaaccacaattgtccagcatgagccatgttaaacacctgggtccagctaggccagatattcacaaaaaagaaatacttcctccgttcacaatgtaagtcattctagcatttcccatattcatattgatgatatgtctagaatcattagcatcaatataaatgtaggaaatgttagaatgactttaattgtaaaacggagggagtagtaaactcttgggcatttcttaagtctgccaatagtggctgtggaaaagtaaagctgtaaaactgaaccgcatcggaaaccagtcctctgacaacccaatcgctcacatccccacaaaaaagtggagaaaatagagctgcataatcttttcctgttggaatttagttcattaaaattgtatctagctagaaatcgcatttccatgttgattttatggattgtgccaagcatgtccaaccaaacaatatttgtttgattcctggctacccagttcggttattttgcatgtttaccatgctaaacattagtaaactaaagtaagaactagtttatccaagtgtttcttttttcagcacttatagcaaagtaaggacatgtacactataagccacggtagaagtagcctcatgtagaccataccgtctaaggacacacataggaaactttacccccaatagaggatacttttcaaagggttcttacaaatttttagagtattatatgaagatactgcagtccacaacaggtgtcccagcccacaaagttactaatgttgttttccccttctaccccc

SEQ ID NO: 79980 - DNA, 517 bp, Oryza sativa
tacgttcgtgcaacgcgcgttagcgtacactgtacccggcgcttttgctcgccaagccaaacgccacgagcgcacggggacgcgcgccgatcgagtccgtgtgttgtttttgtgggtgggtgatcggtggccagtgggtggtggtacaccagtatccaaagtgtaccatgatccaacgcaacgcaacggcgtacggtgcatccgtacgtacatacatacatatatatatatatatatatatatataacattaaaagacagtaatactgctaaaataattcaactaagagatgccataactaattttggaaataaatatacagtaagattgcctttcaaagaaacactattcaaaaacactattcagtttactgtttaaattactgttcaatactgttcacttcgagagatattttaactttaggatctttgcagggtggcgaatcctatttagacagcctcagaagcttgtttcagagcaaagcttctaagcgcgctctcaccctccattccaccat

SEQ ID NO: 79981 - DNA, 4876 bp, Oryza sativa
tgcaaaggctgtttaggttttgttgagatgattggtttttgaacagtcattctctcggcatgttatatgcttattttgattatgacgtgagtcatagcctaggtatttcgactcattaattgtcatgatatcatatttataccacatttgatggatctttgaaagtttttactcagattcttgtcatatgtgctgatttatggaccttgagagtattttttactcgggcctctttatatcttcgtttttggtatattaaagctaaagcagtcggctggatgttttattaaacgttgcatatgcttatctgtatgatactttggataattcggttgtaaaaccactcggatggatgttatttgcactttgactatatgtttagcctttagctactcacatagtcgggggctacacctaatgaggtgcatctatttgatgcacccgattatttatttttagcccttcacagtctttgattttggtactcgggagatcaatgcagaagaaattgaaacactcggattatcattttgcactacgagagaaggctattttatcgactgtaaaggtctcaggggctactgtgaagattatgtataccccatacctacacggcatgtatagttcgactgggtatggggtgccatgtatagatagaatatctttaaagggactcgggttaaattctaaacttgtatgtcaagcaaatacccgagatcctagtcggttacgattgtattttatctgtaactacctattccgttagggatatggactgtattttgtaatacggaccccttcccctatataaggaggggtccgggtgcctctaggggcacaatttttcacccagatcatacgatcaataatacactcgtcggatcaatccccggataggattagggtattacttcttgattaagaaggcctgaacctgtataaaattccttgtctctaaacccatccacttttctagcttgatagccacccccttttagtattgccgaaatcttgtttcgacaggcagtgatggcgggctcaggaataaaagttcgatctcgagcttttttagtcggcgacctggttttgagaaaaattcaaactacacgagatcggcacaaattgtctcccttgtgggaaggaacgtttataatttctgaagtcactcggccaggttcttaccaactcaagcgtgaagacggtactcatattgacaactcttggaatattgaacatcttcgtcgtttttatgcttaggcattacttttgtattttcctctttgactgttaacatcaagttgtcccttgagttatcagtcgggggctactataataataatagagtgtgatttttatcaattcaatttgcttacttgatttatcattgccttgtttgattttttggcttagccaatgaggactgagtttttttaaaacttttgaggtttctaggctcaataaggtttgataaaaacttttaagaaatctggagctaagtttaaatcatcaagcatagcataaatttatcagtattgtacaaattgtgcctccatcatcatcatcatccttatcatcagaatacacaatcaattagattcagttctttcatcatcagaattatcagacccagtcggcttaagatcgttgtcctggaatctctcaaccacatcagcggctatcttgtcagcggccttttgcgcatcactaataaggtcaagggcagcctcttcacttgtcccgtctgcaaagccgtcaacagcatcaatatcaattttcgggtacaaggacttggtcatcaccagcgctaggcctgctcccatactcccagtttctttgatgttcttaaaatatgtatctggagcagctctcagcttgtcgaagatttcgacagcatcaagtgaactcggaccgttgttattgaaaaacatcacctagacgagtggcgtagcggcattggcgacttcatctctggctccttcaagcttcttgattttattaactaagacatcgaattgggcctgggatttgatcttgtggtctacatgaataagtttacatcaatgactaggcatgaagattagagtggtttttgaagtattagctaccagtaccttcgacatctttcagagccgagtccctctgtttcgccaattcggccttgtctttctccagagcttggattcgcttctctagctcggatatcttggaagctttcactgtattgcctttcattggtcagttgcacatggatagcaacatgaagcaggtcagacagagacgatatttaccttttgatgaaccgctcagctcaaagttggagtcttgaagctcggcgatccgatctctaaggtcatgttcagtcttcctagcaagctctttggcttcacgcagctggtctctggttgcttcaagggttccaaggtggggaactaatttttcaagagttgcagtcttcgcctcattcctgagatggattctctgcaccacaaatttatccgtatttaagcatggtggccgacaggatgattgaagccatatatagggagacttacatttacaaggtgagtagcttggccgagtgtcttttttagcagacatacttcctcgtcctctttttgtttatttattacgatcccctgcggctgcatttcgtcatcccaccacttgactaatatgggtgggcgagaatcttcagccgattgtatccggaggacctcttcttcgtcaccgatcattgcaccttatgcattcataaataatggtgggactattgaagaaagtttgtcagatcaaagcagatttcagagagttgtgtacctgttataacttccggtcggggacgagcaggcccttgtaccctaacaggagagctggaccctggattgacgttggcatcctttttaggagggctgtttgcttgagcctctacttccgggatgtcattattttgttctgtacccgactggtttccagtcgagggctcctgattagcaccgactccagcttcgtccgactgatttccagtcggggtctcgttgctggtttctacattgtcggttgctggatgattgtcactcgggcgattttcgacagtcggcccggtttcttttcaaggacccatctccatatcagtcggctcagggtcttttccataaggatctatgtcagatggcttcctacaaatttgagttatgctatcagtgctatttcaatagtgagtgagcagcaatacaaggaaaatggccaaatgatttgtacctggaggacttactgattttcggcatgggacgactggatgatttcttcttcggattagcttgccttgattgttttccagtcacccctttgctgccagccttttcagcatcgtcattttcatcgtcactcagaaccaaattcctcttgcggaagtctgactagttagccgattgagaggtgttgggttgagtgtcaccctggatttttggtcctccgccagcttgaccagtttaccaccggggtgagcagcattgagcaattgggggatctgacttcatcaaggcgaattcctgggcatgatgatccaagttttcaatcaactttatagatgataaaagcgtgcttttgagaaaggctgagatattaaatacataccggtggaggggggttgaaagcattgtacggcaccactggcagcaagtgcgagtagctgactacgattgcatttgagaagattttatacattctctcgttcataactttgaattcaagagatttaggatcttcacggttagggtcatgcttgccatcgaattcaaaggccgcgcgagatctttcattgattggggccagccggctcttgatgaaatgccgggtgatctgttctccttgcagaccctgctccttcagcttcagcatacgatccatcagggaaagcgcttgagcagcttcatctccattggaagtgagttccaagtatcttgatacactagaggaaggcaggagtactcgggaagagctggttcgggattttgtacataaaaccaatttgcatgccaacccttattcgaagttttgaaaggcatggagaagtatttttggcttaaggttcccctcagttgaaatccagctcccccaactacatggtttgctcttgtttggctgggatttgaggaagaagatgcgacggaacagggcaaaatgcggtcttatacccctctcaagtagttgagtttgaaaatgtaaaaattatatgaatatatttgtcttgaaaaataatttcataaaaatatacatatatcacaaaccccagccaaacaagaggaaaccatgcgtagttgggggagctggatttcaactgaggggaagaagatgcgatggaacagcgcaaatgcggtcttatacctaggaaagactcgcaagcataaataaaattggcaatgtggactatggagttggggtttaggtgatgcaaactgatcccgtaaaactccaaaattccccggaaaaatcttgaggttggaagagaaaatccgccatagaagaaatgagaaaataccacgacttcatgtgtgtcaggggttggaaatgcttcgccgcacgccgcacgccacccgatgatttccttcgccgcaagaacaccatgcgctaccatttccttcaagctctcctacgtgacgtcggaggacgcccattggctctcgaagctctctctcctccaccatggatgtgaattggatgatgcgatttgctttggaaatggctgggaatggatgggggatcgatgcggtggatgcgcggaagatttctgtggagttttggaaggcggatttgagcgaatcggtgaaccctagttccgctggtgtggttttgcactgtagcggggaatggggaaagt

SEQ ID NO: 79982 - DNA, 853 bp, Oryza sativa
attttagactgaaatcagctctaagcgcaaaatgtgtgttggagatgaagtacatcaacaaagcattgcacatattttcttgacacttcgctctttctttttaaggaattgcttattattcattgttaacaaattttagacaggttatgcaagaagctgctaggttcacatttgtaccttttggacttcgaaatgcactagcgtactgtcaccacacaatgcagtgcagaactaactttagtaaaattaagagttttgagctccatctgaactccttttcaagagaaaagctctgtcccaagcaaaggcatggtagagtaatcattgcagcttaccatcaaaccaggtgcattctccatacaatgacaatggattatgtgggctcggtgaaggtggtggtctacatgttcagtacaaagcaaggcattggtatgcaaggtacaaaggaaggcatggggtcaaagacatgagcatgttctacacatacacattttgtcttacaaaatcaatctgcaaggctttgatcataaccaggacaattagcgccaccattagatgattctatatttcaccatctaaacttgttaaatctatcttagtcacgcacaagcaataaatgagggagaagctattaaataacctttagccagacccttttttttgctatgtagttacaacttacaaccaagaagggcttattttcttctccattctcaaaattataaccttgcagctgtgtcgtcaccaatcacacgcatttaatgctgagagatgattgtacctcccaattcataaagctaatttaaaaaaaaatagtttcctgtcatctactgttatcagaaatatatattca

SEQ ID NO: 79983 - DNA, 1161 bp, Oryza sativa
catgcaaataccgtagtcatgacttaaaacgtcgacaacatcaaaccagtagcaacaaccccaccggagatgatttgaaagaacggcgccacttcatcgttgtggaggaagaagagttcccaccacaaggcaaatctgtttgacatgtggatccaaacaccagtacaaacctccatagcaaccctgcgaacagcacaaagctccgtttaacttctttcgagttgtatacaaaaggggaagaagaaaacctagaacgagataaactcgatatataggctgcgttctttcccacccccaacagtgctcacggaaaacggagcgatccattagcacatgattaattaagtatctgctattttttttaaaaaaaatggactaatatgatttttttaagtaactttcgtatagaaactttttacaaaaaaatacaccgtttagtagtttgaaaagcgtgctaacggaaaacgaggagtaatagcctgaaaagaacgcagccataatgggtataaacccgatagcacttggcaaaccgtgacataatataatgcatgtagctctaggccaaccacgtcataaaaatgataccaaattacacctgacttctatggagaaaaaaccagttttagagaagtcatgaaagcatgctattggccagttttaaaaattactgtgcatagcaatgaattttaataaaaaagttcttttttgcagcgagcaaaggaattttgaaggtattaggttaacacagtgcatatatcacaaaaatgagtatgcttaagtccctataagacatacagctccaccacacctgaaaacttaagcgtgtagcatgcattttaatctactctcgagtgacaaatctcccggatggtgtagactaagtgcatcttatccgagtggcttctgatccaagtggttatttcttgtgggatataccgaagtaaatgtgataattgaatactgactagtgcaaatactcggctagtgaccctcgtggggcataacaattgattgaaagcttgagtgtaggagataggctcatggccatgaattcctattggcagtagtagaggaaacatatggcaaagacgaggtcactcataaacagtagcggtgtcggccaaccatgagggcaaagctatctgttggcggtgacgtaag

SEQ ID NO: 79984 - DNA, 2340 bp, Oryza sativa
atgggcttagatgacggtgggagtgatggttggagcgggatcggcggcggcaggttcggcctgcacacgcggatcctatgtgtgtctagactccataggatttgaatctttttggaacagaggtagtagttctgtgagaaatttagtgttaaacatatagttttgtgatacgtcatcttaaatatgtacaactccgtcccaaaaaagataaaccctagcacatatgtccaggctcgtggctaggattgagtttttctatggaggggtagttttgtaataatttaaatatatgtagttttatatagtttacccaaatgtaatttaaccaacggcaccggccgaccgatttttaatccaaggataacttgcttacttaccaattatttccggcccccaagggcccaatccgaacctcctgtgctgaggcgcgcagcacacagaaacaggggcaagctagcttacctagctagtgccctgaaaaggtcacctcatcagggtcaagtgatagtagtgatttctgacaacaagcatagctaggggcctttcttttttttctatttgtgacactggcttaggaagtgaaaaaaaagggacgaaagccccgcaggtattgaagcgagcatttacaaaaatgtttcccccggaccttttaaatcaaaagatttcatagagaaattttataggatacaaatcatatgcaaactttttccatttgaacctttgatacaaaggattggaggatttcaaatcttatgaaatttctgtaagttgactcattgtatgtaaatttcagactaaacttaggctgtgttaattcctagtggttgggaacactaccctccattagcatatgattaattaagtattagcttttttttcaaaaatggatcaatatagtttttttaaataactttagtatagaaacttttacaaaaacacagcatttaacagtttgaaaaacgtgcgcgcagaaaatgagggagagaggttggaaaccttgaccttcgaacgcagctttagtaagagtttcaacctcttgaattttttttctctcttttatctgactcttgtgtttttctctgactcaattaaataattatttatgtctttttttatattttataatattttgttttacatttcatttctgttcatttctgttagaattctctgttttttttaattttttttcattgctacaataaaaaagccctaagaatgaatgagattacacacgatcgaccgagcagggaaacgaaaaagcggatgaagaaaaatgtaaaacaagtaggagtagccagcagctgagtgagagcaaaaatggagaaatgcgcgcgcgcattgcgttgtgtgttgccatttgccaatcccatcgaacgcgatcgatgttcgtggcacgaacgagcgtacgatggcgtcttcttcgtcgggcgtcctggaaatgcggcacagggaaggtggaagggaggggagcgacagcggaatcatgacggggccacggtctttttgaccgatcgccgagaaagcaattatgggtgtttgattctgacactacaaaatttcgccattgatatacaaatcaatctgccagtcctttctgttgcttactctgcgtatgtgcgtgccctgcgctactctgcatgcatgctatacttacccatttctttctttctctctctctctcctactactctttctttctctctctctcttcccacgtccttgcggaggaaagagggggagggacttatcgatgccttttttttttttaacctctgccatgcatgagggacgaccgagttgatcgccatggacgctttattttttcgctccctcgtcagtgtcatcatatgctcaattcatcaaaggagacgagtagtgtaccctgagacactcagagagaggcctttggtgaaggattcgagcataatgatgcatggcaatagccacacggtggtcccttcattttctctctcttgcactcaatcgattgcctttctttcccatgcaaacagagtaaacgaaagggaaatatagctagaaagaagctaacgtgtttatgtatgttgtgtgggttcgctacgtactgttgcatgtatgtatatagttgcatgcatatgcattctcattaaggcctctcacagtgcaaactatggagcccgtaccctcagtccaaaaaattggtcctaagacacccatcccatagtgcaagcacccatatatgtgtgacttaatcggatagaggtactggtaaagggtcccaagcctacagtgggcatgaccctagtttctggaccagtagagcgaacgaaaatttatttcctccacttaccccttcta

SEQ ID NO: 79985 - DNA, 650 bp, Oryza sativa
tctgtgatgtgtggcagtggggttactgtgcaaatagagttgttttagccaggagtttggttacgttgtttggaacgaaattatattgcaaagacctcatctccctctctacaggaccataaatcttaaagcagacctcattaactcccctaattgattagatgccatgcaacagtcatggaattaatcaaatcatgatagcattgacagattagaacatgtcgacttcatcgtttgtatagtgaggacctgaaaagctgaaaaatactatatgctgtaaaaagtttgatgttcgtagtgtcagattcttgccgttttagtcaggctagtgagctgcctttggtatacatctttttaaatgtgggttagaaggtgcacccttcgacatgttcccagggttcactttctcgccggtaaccgcgcggtaaccgcggttaccgggcttaccgtggagggtcggtaacgaaaaccggcggtagggtttgggcaaattttgctcaaattcaaaaatttgaaaaataatcgaaaaaaataaaaaaaaatcatggatgtaaagcttgttttgtatgttgttatggtgaaaaaatttcatcaaaaagatgcaggtaaattcaaatttgagcgcaaaacctattgtgaattataaaaaa

SEQ ID NO: 79986 - DNA, 911 bp, Oryza sativa
gcgacggacggatccgcctttcccgacggcggggacggcaagggcggcgggaacagacggcagcgaggacgaagtgggtgcgggaatagtggactcttctgtgattcctctttgtgttcttatgtgattcctctcttctttgtgttcttgggtgattcatcttgtgttcttgtgtgattggcaacgaaatctgtggcgggaggaggggatttgggcgcgacttcttgctgaattttcgagggcgaataggggatttcgctaggggaatctcgcgcaagagcaccgggcggcgagggaacgactcccacagcgcacgcgcctcacatcgattcctccgcgcgtccccttttccaggcgaggttttgcgccccctagtttaggcacgagcgccctagctgagacgcgggtctgagtgacacggcagcaaaaatccaacgtggcgcgactaagacacagtccaggtcgacgcactgtgagaggcctaattgatttgcattgttgtggattgagagatggagaccgttccttgaggagcggggagacagggctcctctctgtacaagtacactgtagttcaaaaactgcaccatcgtctcgttttctctttaatgaacaatatacaactacagaatcagagctctcgctgcctgccctcttacagtacacgttgtggctgtcaggggatgcactttaagatagagaagagttgaagtctctcgtttcgccaggaggtgaaaggttggagaaagagaatcctatcgaccgaccgatgccgatcgatcagagttagcgtagtggtggctactacactgatggcttagctagtcgtatatatgcaatgcaaagcatccatgatccagccaaggcatacagcgatgagagagagacgatccaagtgaagaagaaagtag

SEQ ID NO: 79987 - DNA, 1119 bp, Oryza sativa
ttttagataaactttggaggcaaataagtacgaggtttcacctcatattttcttctgagttcttgtgttttcatacgtgccaatcaaatgattatatttaatttgtaacttttatgtgtcttaaaattgtagaacccaatgagcataatattttattactatgtatttttttcaattaatgtatttttaacaattaatgcatttcgaagctgctcttatcatgtacatggacgcagactcgaattgttcatgagccgagctaagccgttaaggcgcggatcgaggcatggaaaaaccaaaaagacaaaaaaaaaaaaaggaaagtgacaagccaaaattacacatgcctcccaaatatctcgccgaaatgctctctccacccccaagactcctctataaatccactcccctctacctccttccaacaaggaaggaaaaaagagaagcaaccagacactgcacacatcatcatcttctcccccgagaccgggtaagccatccccttctctctctagatcttctctctctcatcaagaacaacaagagtgaattaatgaacagcaagaacaacaacaaaaaaaacgcagaggagaggatgcatgcatgatcaatcaaattaagcttcaaggtagctagctagcttgctagctctaagctaaatacacatttaattaatttgctacgtataaaaaacgttgcaggtgatcttgggttagcttagctagctaaattaagctgcgtgcagcatggggctcctcgaccagctctgggacgacacggtggccgggccgcggccggactccggcctcggcaagctccgcaagtacgcctccttctccccttcctcctcctcctcgacgatggcggcgtcgccgtcgcccatctcggcggcggcggcggcggccgacgcgccggccgtgacgcgcagcatcaccatcctccgcccgccggcgctgtccgtgacgtcgccgcgcggcagcgagtcgggcccctccacgccgtcgtcgccggccagcgtcccggactcccccttcggctcaggtggtgaccaggccaccataatctcttcttgaatcttgatctttttgcacacgcatatatcgtaatctcgatcttaat

SEQ ID NO: 79988 - DNA, 688 bp, Oryza sativa
cattttagaccaaggagaatttaacaaaaattctccgggccacatttgaatttttcttgcacgtattttagtgtttgccaatttcttttcgaattttaattaattctattattccttttaggaaaacgaattttaattcggaatggatttatcaggacgtgacaaatccacccccctttcaggaatctcgtccccgagattcgaggaggctagcaagaagataggttgggcggtcttctcttcttgtctgacttcttccgtcgcgtcttttataacaaacttgcctagcaaaacttctccactctggactgcttggctcgatctcctattgcagatggaatcttctcttcacctgacttgtccctggttgaacctttagctgacttcgactgggttgcggcacttgaagatggggcttcggttccagaactttgcatagttcatatctttggagtcaacctcatacaagttacccacttcacgttatgcgtcgatatcagcttgtcattactaggataccatgctcgttatcatgagaatatcatgcttgtcatttacttctaacttaccactattcacttcatgttgtcctcagttagcattcaacgtattcctttacacctttgaccttgatgtgttctttcccgatttctcttatcaatcacctttcgacctacttctttgcctg

SEQ ID NO: 79989 - DNA, 1787 bp, Oryza sativa
tctttgatgaacaggaactcttgtttgccttagccaattgcctctattatacgatcggcttggactttctgcaacattactgcacccaggacagtcttcaatagatggcaacctcataccttcattccagcaaaatctaaagaactcacaaccccaatgaggatcaaagccgcatcatcttcttcataatgcctctcctgctgcttggcatatttcttctgatatttattgataattttagccgaattcacctgaaaacctctaccacattgacaggaaaaggattgccatcaaccttcatcggcctcttggaatcatcaaatttgatcttgcctccttcaatagccgcctggatctgctgtctgaagactttgcaatcattggtagaatgagacccaaaattatgccacttgcaatacctcctcttgcctaactcctcagccgatgggattgtatgaccagtaggaagttgaatctgtttttccgaaagtagcaaatcaaagatcttatcggccttggtgatatcaaagtcatacctctcttcctttccagaactcttcacccattggcatggtataaccttcttgcttctaacccattcggctgctgctatttcggagtcatcatcatcatcatccgatccatatatgtaaggacagacatgattaaccttttcaaagttcttcctggcttctgcaaacctctgttcatgcaaggttaccttctgtgcaagatgtgacaaactatcaaagtattgggacgagaacttctccctgatcggagctatcataccctgaaaagccaaatcggctaactgggcatcagttaaactcaagctgtagcatttattcctcatctccctaaacctttggatgtaatcttgcacaggttcatcatgtctttgcttaatcgccgttaaatcagacaatttcatctcatgaaccccactatagaaatagctataaaaatgcttctccaaatcggcccaactgttgattgatccacatggcaaagaagaaaaccaagtgaaagccgatccagacaaagacaatggaaataacctaaccctcaaggcattcacagccgatgcttcaccacaccgagctaagaatcggctaacgtgttcatatgttgaagcactatcccgccccgagaattttgaaaaatctggaaccttgaatcggtttggcaatggaactctctcaaaccactcagggtatggatgccgatacagatttccagcatcctgaggcttaagcccaaactgttctctcatcacatctgcaatcatatcggcccatggtcgttgctgaggcacccctgtgcttgttgtggcacgggctcgaattgattgtattgaggagtgaactgagactgagccgatcctccttgctgatattgaatttgcggcgatggaggctaatactgataattcaaattgcccccctgataattctgaaagtttggttgtatattgcgcaccaaatgttcgggaataacttgaggtatcaccgtttaatctggttgcacattatgaaccaaatgctctgggacaacactattcacagcgtgctgccttagctgattgtcaggtgttccgaacccagccgatgcattcatcaaaccttactgctgaatcggctgaacaacctgttgtctcggtggcgtttgctgaatcggctacacaacctactgtcttggtggtgtttgttgaattggctgcacaacctgctgccttggtggcgtctgttgaatcggctgttgttggattgggtcaacaataagct

SEQ ID NO: 79990 - DNA, 4840 bp, Oryza sativa
  unsure (1)..(4840): unsure at all n locations
agcgatcgggaggagagggggaggagggagagggcggggacgcgcgtagcgcccgggagggagagggagatgggccaatcagagtgagggatgggctggtgggaaggagggggtatagaatagttattctaagggagggatgtataataatgctatatatatatatatatatatatacatatatatacatatatatatatacatatatatatatacatatatatatatacatacatatacatatacatatacacatatacatatacacatatacatatatacacatatacatatacatatacatatacatatatatatatacatatacatatacatatatatatatatatatacatatacatatacatatatatatatatacatatatatatataggggtaagactattctacaccccctaacctttatcatcggtatcctcccatcctcctccaagcctccggattccccctctttngcttcacctccctcccntcatccggatatctctcttcttttttcccattttttctgttttttctccctaaaacattttttctcttttctacttcctccgtttcacaatgtaagtcattctagcattttccacattcatattgatgttaatgaatctagacatatataaggatggcaatagggccccgagaacccagttggggacggggacggcgaaaagtcagccccgaggccggggacggggacggggagcggggctttttgaagtgtccggggacgggggcggggtagcactatccgttggggatggccccgttgccatccctacctgcaagatgtgttcacgatgtggccgaaggtttggatttgagaactactacggttgtaggaggtactgcaaaaggctcatgaaggaaattaattagaagaaaatcatgaacagaaacttcaagaggcacataattaaggactaaccattgtgcctgttgtcccaattgattttagcagtttctatagtgtaattgctcatgattaagagggagctagaggagcatacaggatcaagatgattagggtgtgggttacaagttaaggggaatggagagaagcaaggtttaaggcatgggttgggaaagacgacgagggaggggccggttgagatcaggcaaaccttgatgtccatggtgggtaacctggcagctggagccatctagaaaggccagccgccttgccctcccgaactgtgtttcacaccatcgagcgtcgaagcgtgttccacctttctcctgagccgtgtgatagaccaagctttcgcccgccgttgatcgagcaccaggtcgtgtgtcacatagggctccgcctatcggccgtttcagctgtggccttccccaaccatgctcgccatgaaccaataccataaacaccggtacaattgcaggccatgtacaagaaaaaaaaatccaattgcagttatgggtctcaacttttttcgttttcccctatcccatgtgctatgtaattttccctattattaattagcgtagtaagaacctctcctactggtttctatatataaaaaaagacacttggtgggcttctggtgcacaagaacactactggaaaatggctcttctcttcccggtattaaccccctatattcccgggtattccaccgcaactgggaataaaaattcatttttaatcccggtggttaccgggagaaaaaattcatttttagtcccggtggtaacaccaaccgggactaaaatgaagccaggctaggtccagttgctcctttttttttcattatttttaacattgaatattgatttcactccattcccaaatcatcccaaacaaatcccaaattgatcatcacatcatagatcaaaaggatcctctccaaatcctcaaatcgatcatctccaaatacatcacaaattcttaaaaaaattacatcacaagttctaaaaaattcatcacaaatacataatatattcatcacatcacacacaaatcaaatacattgcagatccgaaataaaaatctcaaaaaaagagaaaaactcagaggtgcttcccgcctgccgcaccggcccgccgctgccgcgccgcgcccgtcctccgtgccgtgccgactgcctccgccgatacgctactgcctctgcaaggaaagagtagataagagcaagaaaagaggagaggataagagagagaggagagggagagaggaggaagatggcagtggcagacacaaccattaggtaggggggtcggccgacccagctacggtccgtgtcgcttcacacttttcaaacctcattttagtcctatttctaacacattaatcatcaatctactattgaataatcaggtaaatcaagtattttaagtaggaacaaaaacatttatgaaaattcgtgtataagtagtaccaatttgactgtttctgattttggccatacataaaatttgattttctttctatttctttagcgtataatacagtttacagtaaataattaaattggtaaatatataaaaaaatcaattttactcacttgaactattttgacgaagcacttaaacccctacataatttttcatctcgttttatacctacgaactattgaaagtggttccccttattgtctaacagtatttctcatttttttatctctctacatacaagtcatatacatttgttcgactatcaatctttgttattaactttctcgatgttcgtgctgtgcgcttttgcgccaatgccgtgaaccagcgactatggtttgtgtgtgttgtgccattacctaattaaggctagctctgtcgccccatctgtattttaaacctgcatccgccactcaagatggggagaaagactttccgatagaggatttgaggataagtcctagggattatatactactgttgatgtaaaaacacgaggcctgggagatctgcttaactccagtgcaggtccaaaacttgcctttaggtatgcgagcgtgccagttgatttgatcctgcaatcaacaagaaacaaagacaaagcaaccggtagttaaatccataaacgatagccgatcggctagatgccgatgacatatcatttatctttgagcccatgtcatatatacatcgatcggcagtcgttaataagtaagaaagaactatatctacttgatcggttgtagatattaacagtatatagtccctatatcgatatatacttaaatcaagtgattgggatagatcggtcaccatgccgagacagtataaatcaattagatcgaaatatatattaataatgagactatatatgttcatagcatagccgatcaggtagatctagcatgtatcggctaatactccgatactactctatattaagatattaaaacaagtagaatatatcaaacaaaggcctaatatacttaaatgcaataagatcttacataaagggcagatttaacatgtcaacaaagcatataaggtaaatatagttaaatcaggtaagatcggctgaaagtccgatactaccctagttggcaaccaaagacaggctagagattgagattctaatcacgactcatatgatcaaactcaactgatgtagctacaagtatgaaaagaaagacaatatctagacaatcaagccgttggatgtgtcataaagtggtggatatcatatataatctaagtcaacatcagtatctatcctaatcggctgccttctactaacagatgttagccgattgtaggttaggtaacgatattgccggagattatgtatgatatgtgataactcgacaattacataaacaagatttgagtatcataaagatggaagcactaatcccgagaacgcaagccgccataataagttttacctcttgttgaagatcaaaaccgatgcagctcaacccaaaagcaagaactcatcgaaacaaaacgaaagtaaaaagggtggcgatgcgccgagattgtattgaccgtgtgttagtttgattacatggggctcggggtctatttatacccgagaattacaaaatatgtccatatcggacacgactcttatctctaacacactctaagataccataagtctttgtggcagacttttgcccaaacatatctctaagagaattacataaaatatcctaattaatagatacaactgccttctcaggactctatccatgcgtggcaatcatcatgaagcatatcaacctaacccgacaacatatgcaatgttatattatcggatccggcttgatcggctaaccctgtccgactcgaattctgccgatcttagtcgtagccgattcggactccagccgatcttcactctgtttccgggacgatctccatctcgaactccatctcgattccttcttcatctccgattcttagattaccaaatttggtcgttaacaactatgggttgaattttagtcccagttggtattaccaaccaggattaaggatctaaataatctttactcccggttggtacaaccaaccggtgtaccaaccgggactgaagtggtgatctttagtcccggttggtactaagatccttggccccctgacaggcctctaacagttggtaataccaaccgggactaaagatcaaattttttttaattgggactaaaaccaatttttggtcccggttcttattagaaccgagactattgtcgaaatcagccgacctagcaaagatcacttttccagcagtggatggagcaatctatgggcctcaacttggggtgtgctggatgtttttccttttttttcatgcttaatctcattgattctacggcggaaaggtgacatgatctctttgatccaatggctca

SEQ ID NO: 79991 - DNA, 652 bp, Oryza sativa
ccgtcaagctttcgttgcttacaacattacagacaaagataataaattaaaaatcacttagccctttttttcgctcattctcttcccccatgtgtattgtaaaagtttctcaagattgctcccaaaaaaaaagtttctcaaattcttatggaaaagggattaatcgatggtgcctttaattaatgagattgtacccccttatacttgcagctattgttagttgttaactctaggaacagagctacatataagagagggagtaccaggaacccggtcaagaatttttttcaactattaattctttatatattttcatcatatgtagtatgtataccaccttcaatgtaaatttagacatcgatattagcctaaatttgatccaaaataaaacggatgacacctccttattttgttctaactctgttcctggtcaccatgcaccaaacaaggccaccatttttcgtcgctggctcgctcgctttctcctcgcgctgtccgatcctgcggccaaccggagacaaacggcgatccacacatgcatcctctcctcccccatccgtccaactcaccacgccgagacaaagcggccacactccccccggggccccacttgacggtcctccccactccccgacacctgggccccacccca

SEQ ID NO: 79992 - DNA, 1899 bp, Oryza sativa
tgagcgacccaagaaagtgagcaaaacaaacaagacgccgaagccagatggtgcaaccaagatcgttccactctccagcgccaaccctgacaagactgtcaagatcggggcgtcactggatgagaaataggaactcgcgctcatcaccttccaacacgacaatgcagacgtattcgcttggcagccgtccgacatgccgggggtccccagggaggtgattaagcacaaactcatggtgcgacctgatgccaagcctgtaaaacaaaaactgcggagatttgcaccagaccggaaacaagccatacgagaagagctcgacaagcttctcaaagctggtttcatcagagacgttctccatccagagtggctagccaatccggtcatggtgcacaaggccaacgggaaatggaggatgtgtgttgacttcaccgaccttaacaaggcgtgtcctaaggatcactttcctcttcctcgaatagaccaattggtggactcaacagccggttgtgagttgttaagctttcttgacgcttactccggctaccaccagatcagcatggtaaaagaggacgaggagaagagagcattcatcatgtcgtttggtgtattctgctacattaagatgccgtttggactaataacgcaggaaatactttccaacgcacggtccaaggggcacataacgattagctcgggaacaatgtcgaggcctacgtcgacgacattgttgtcaagaccaagacaagcgactcattaatcgatgatcttcgggaaacgttcgacaacctccgaagataacgccttatgctcaatccaaagaagtgcacgttcggagtaccatcgggcaagctactcggattcctcatctctggaagagggatcgaagcaaaccccgagaagatcaaggcaatcgagaacatgaagtcgcccacaagactcaaggaagtccagaagctaactggatgcatgacggcattgagcagattcgtcgctaggatgggagaacgaggacaaccctttttgctctgctgaagaaacaagacaaatttgtgtggacacaggaagccgaagatgcattcatcgcactcaaatgctacctgtcaaatccccctgtacttgttgccccccaacctaatgaagaattattccattatattgccgccacaccatattctgtgagcgtcattattgtcgagagagaaaaggtgcaaagactagtttattacgtcagcgaagctctccacgacgcaaagacaagatacccacagatccaaaagctgctttatgcagtaatcatgacatcaagaaagctacgccactacttccaagcacacagagtcacagttgtttcctccttccctcttggtgaagtcgtgagaaacaaagtcgttgtcagccgcatcgcgaaatgggtagtcgagctaagccaatttgaagttcactttgtgccacaaacagccatcaagtcccaggtcttcgccgatttcgtagctgactagactatgcctgacaacaggtcagacggtcagaccgacaacgagacatggacaatggcgttcgacggcgcactcaatagccaaggagcaggggcagggttcatcttgacgtcaccttcgggagatcagttcaagcatgcaattcacctcaacttcagggcaaccaacaacatagccgagttcgaaggactactcgctgggataagagcagcaatcgcactaggagtcaagcgactaatcgtgaaaggggattccgaactagtcgcaaaccaagtgcacaaagattacaagtgctctagccctgagttatccaagtacctcgcagaagtcagcaagctagaaaaaaggtttgacgggatcgaggtctgacacgtataccgcaaggacaacaccaaaccagacg

SEQ ID NO: 79993 - DNA, 677 bp, Oryza sativa
  unsure (1)..(677): unsure at all n locations
aattcctgcagccatgtatactctgttcgtttcaaccacagcttgagaaaagaagagtctaataaataaatttctatctatctattctgttgatgtgcccactcaaaagttctacaacaccatgaaaaaaaatactagaccaaaagggtggaacagggtgtacctaccacatacctttccgaccatgatgtgccaaagtattggagtcaaaagggacgaagcagtggggaataggaaacagtaactggcagcaatnncacaaggattgatgatggagtaactgggtcaactgcagtggctggaagcatagaaaatatgattttcatgtctaaggcacaaaaagaaattacacaataacaaaagttgaagcataatcaagagattagatatgtatacagtgttcatttcaactacaactttaagagatatatttatctgccaaaagaagggcaaaacatgcagttatagcctattgaataagaacagtagttcatatatttttacgaagaacttctaaaaacaacagcttgcaagtctcttgaaaagttgaaagtagataaaccaaggttgtctttgttctttagagcgaaaggcacacataatactctacacacttgcatcctattagagaaaacaatcaatagcacaaaaatttaaattttcccaaatttatggac

SEQ ID NO: 79994 - DNA, 5799 bp, Oryza sativa
aaaaataattcattattgcgtcataatttaattaaaatctatataagtgttttaatctgatttaatctttaaaaattcataactaattcatcttaactcagtttaatgtggttcaagttgcaaaagttgtataaaataaagatctacatattaaaattttccataaattgaattaaatttatttaattctttttaaatgggctttaaatagatttaatcttgtaaaattcataataaattcatttgaagtcagaatgaggccgttcaagtctcataattcatctaaaattatgatctacatgtttgtttactttttatgtattgtttatttggtttttattagtctttttctttgttttgcgtgttagcttgtcgtttccgttgttgtgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattactttaatccttgataccttgggttattataatttgactagttgagctttatatattggttcagctagatattagatgtgattgcttagccatgcttagaaacattagcacactattgggataacttatgattcattattatttaatgatggtttaatgatagttcacgatggttaatcgtgattggttaattaattacttgccaactaaaacttgataatggtgggttgtgagcacatggttttgagagtcgtgctcatgacaattaaggaccggttcgctagctactattgtgaaacattaaccgtgccaaccacaagccagcgtgggcaacggctttaccttttgtatagcatgattcattgcggagcaccagactgagaagtggcggagataagcccacgggggtcgctggggagtccatgccttgttttataagggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtcccacacctctcaccataattatagatgttataactggtaataatttgcttagctcctggtttggagttagatctgtacagccgggtatggtttgttcaggatggttgggcctgtacagcatgggtgtgctgttcagtgttgattaaaatttctgattaattactctactgttttactactcttaactctttgctaaatgctgctttcgcaaatgagcctatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcatggtgaggactaagtgcctcttaagtaagtatttatccttttagttaatttgatgaatctgtatattaaattgtcagtttgtgtacctcggctgattcctggacgaggattttatgcacaaataaattcggaaattactagtgaatttccgggcgtgacaggggtggacgaggacggcgacgacttggcgatcccgacggtggccttccagagcgacgacgacgaccggagcggcggcggcgcacggctgaactcgcggcggcgacggcgatgcaagggctaacgcggaggcggcgctacaggcggcggcgagctgaggcgagggtggcggcggatagaagaggtcccgggggtccttttataggggctaggcggcggcgatggaggtccacggcggtcggcgacgagaaggaaaggttagggttagaggagagagacgaatacgaatcaaactcgaatccgacgatttccaaacaaaattagacgaagtttctataagagaaaagatagaggagatcaaggggatcatttcccctctaccaatttgaccggatcgggaaagacgcggccgaatttggaaggggctgcggcggcgcgaggaggaagacggccctgacaggtgggccccacctgtcagcgggagagagagaggagagcggcggctgcgcactgacttgggctggggagagagagagagagggttttgggccgactttcggcccaaagccaaaacagggacttttaaaacctttttcaatttaaattattcatgaaatgcaattccatttattaaaaatacttccttggctcaaataaagcccagaaaaatctaggaactatagagtcaaatgaagtatttaataaaattttatctagtacacttttatattggaatttagtatttaaaattagatcttttcttctaggcttttaaaatcatttctaataattccaattaaacatcaatttatatatttggggatttttagggtgtgacataaattttatgtataaatcaatagtattcatatttgtaagacatcttacgatttcaataaagttgatttcaggtaaagattacggtcaaagtgttccttcccgacgatcccttaccacgacgacacctagcgttgaaaccaatcctcatgtccctttacgctgtcttgacaaggcctctgaggaacctaagggaacttcggctacggacgccctgagcggataaggccttgtcggatcatgtagaaacaaacgaccatgtaagatctggtcatgtaagagttctcgccgtgcgtattaaccaagccgtgtaatcggaaattgagttttccaacttcacggctgggggctagggtcagtgctttttcaaccaaggcaggtcaagggtccaagagctttatcctccgagaacgtttctccgacgacaaggctgggggctagggagagtgtatgactcaagtgactgatcaaagtcgcaaaatgagaaaacactcatacacaacatatccagagtaagagaacttagctagatagatttcttttctatttcacaagtacctcttacaatttgtaaatattccaaaatatattacatgtttccttgagatattttctacaggacacaaagactaccaggacggccaacgccaatccatggactgaaagaccttctcggcaagcggcgccatcgactgcgccagttggtcaatctctgcgggagtcctccgagaacgcgagaacccttcatggaggaactcgagctgcagctgcgggcggtgatctcggatacaggccagcacatgccctccggcatagtggctcgaccgacgacactcctgcttcagggcctcgtcgatgcgcttgccgatcccttcgagctatgtgcaggccccattcaaccatgagatgtacccggccaccgactcctcgggattcccgcgaggaactcggagctccctacagactccagccattgccatgcagcagctcctgagttacgaattgaaccatacctcgcgacctcggagggcttccacagcctggtctttcttcactcccgtcaaggtcttctcgagttcggccacctcaaacttcgtcttccagtattggattcgacgatttcggtcggccaacgcactctcgaggtctgcccagcatggaaaggactgagtcaagttgttcttgtctcccgagaacacagcaaacttagtcaatccgaacaaaagagtgaaggaagtaaagccaaaaatgcaaacctaaggacgtcatcgccgtgttcgtctccacggacagtctttgcgacatcctcctgctgcacgtacgtctcaagtgcaagtgccgggacgaccaccggcatctcaggctgcccgtgctgctggacatcctcgatgtcgacatctctacaacgacaacaaagtgctcggaatcacatgctaagaaaacaaaggaaacaactgcatacataaaagcagttcgaacccgcagaagtttttacagcatgtttgttaaggggtacaaggcaaacagaatcctactcttcaaaaagggggagaacatactcccccaagtcactgacttcctccatcacgcccttgcgcgtgtcatcggcagccccccgatccagagcccttttgaggtcaaggtcgggataggccagcttcacgcatgcgaggacgtggcacgccccagtgtagatcccgttggacgtctcctcgccgatcctggttgcatgcttgaaggggatctcctccatcgccgtagccagctccacaagcgaggacgtcagcgagaactcgtcggggttcgccgggatggtgatcgtgacgccgcactccccagcaagctggtgtaggctggtgtaagatacccgcaaccagccgcggatctctgacaagttgttcttgagctccgacatccggtgctcgagtccttgtcgctgcctttcgttgccagccaccagctccctcatcttcaggaggtcctcacgggcctccaccaggtctcgtgctggcttgtcggcgcgttggttagccgacgacgctgccgccctggcctcctcgatctcggcctggagctccccccaggtgagggcattagcaggcgggccccgagtgggcacaaggccgccggcggggccgcttggcgtcccctcccgatccctagtcacgaccacgacatcagtcgaggctactacaggggacgcgctggaggccgccccggacccatcctgcgccgccttcgcccgcgccgccctgcaaagaatttccactctttcataaaatcaggcgatcaaggtttcatgaatgaaaagacttcggaaacatctacttacttcttgtcgatcgtcaccagcctctgtcttcgctgaggcgggggagacgcgtccgaggcctaagcaagataacatcgtgtgaggtcaaaacattccgactacgcgctaaagaaaaccagagaggcctaccgacggattaggcgccttccgacgggtcccgagtacaaaggagaattttcctccccttcttcggaacgttgctgccgcttgtggtagcagcagcagcaacgtcgaacgccttattcgcgacgccctcttcgcgacgccctctttcaatgacgctgctgcctgatgatccgcaagcggcccgatgacatctgtcaaagggatagcctgcgtaacatgaagtcacaatgcgatcctggaagaaaaagataaaggagtcattgagtacactcacgttgatcgcggcttcgtgttcggccggacccttctcgcaaagagggacggggatgtcgctcgccatcgcagggccactgatcatcacctggccgacgcggcgtgccacggtgtcgctatccaaacctgtagatcgagaacaggaactcgataagtcaggggaaacaggcacatccggaacaaaatctggattacaagaaaaataccccgaggagaaacccgggtcgcgtcctccggcccagagtagtcaaaggccgggtgggcagcgactttgtaccccgacaacccccgtactcggaggtcatcgatgatgtcgatgaaagattggagggagggagtcaggtcgggtttggcggtccactcaaggatcttgtctggttg

SEQ ID NO: 79995 - DNA, 1252 bp, Oryza sativa
aagtcgaggaggggctacactacacagtatctgtactctgggaaggtttcctttttcttttcttgaatgcacaattactattttttttctcatataaattactattccatccgtaccataatataagagattttgaccatttgcctttcaataaaaaaaaatccttaaactaaaaggtttctcatcttttctctttcttttttttttcttttacctttaaatagtgctcttattaaccagttggcatcattgtatcgtatgtgatctagtgtctctgtctattcctctctttttttttattgagacgacggccatattgctcagtgcgtacaaactatcgacaaaaccatccacttttacattagactagagcttggcgcgtcgcctgcccgtaatgatgttgaaaaaacacatgataattagggttactgaaaaaaaagaagaaagcagatggttatagataaccaaactacagtactaattacaggccaacaaatcatgcacacttcataaaagcgattattcaaccgatgctacagccaagaaaaattttcatatctgtaagatctatgtttacatattttgatcaaccatagcgattcaaatactaatcaactggtagacaatccctgttacatgaaccgcaattaccgcatacctcacggtgtttccttggatcagcatttgcaccttgagaaaagcatgtcaaaatcaaattccctggcaagcacccaatgcggaaacctaaccaggcgggggaacaaaaaccaaggtctcgatcaattacttgagcagtcatctatggtcaccatgatggaaccagtatggttatgtccatgaacaacaccggtgttctaaaaacttacagttccataccatatccatgacctaccattgaaagaatattataaagctgatctgacagatataatcacatcgatctcaaatcaacaattcccaccttagggtcagcatttccctgaacttgtacataatcacagcgtaggaaagatgaggaataaaaaacctcaaacctaatcgcatatctttcggaatacaaaaatatctattccattatactcttgcatatctttttgcagggcaagtaatggcataacaaaaaaaaaaaacacggtggtagcacgaacattgccatggctaaggaaccgcaatagccctctctgcaactgatatcttcattaatctgaaagtagtaaagcatagtagtggactattggcatcatggttcttg

SEQ ID NO: 79996 - DNA, 655 bp, Oryza sativa
cgtcatcggggtcgtccgccgtgagccggtcgtggaccgttcgatctcaaccgtccgttttggattggatcgatctcggccgtccgttcgcgtgaaccgccgcccgtgcgcccggtccaccaaaaccctagccgctgacgcaataaaccctcttttccttttcaaaaataattcattattgcgtcataattcaattttaaccgatttaagtgttttaatccgattaaatctttaaaaattcataactatttcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgccggagaagagtttgaagagttccaaggccagcaaggcaagtcacacagatcccaaacaaccctttgagcatgttgatcctatttaaagctattgtttcttttcaactattgcatttattttcgaatgtcattgggtggaattaacctattgattgttatagcccttttgttcttgattactttattccttgataccttgggttataataatttgactagttgagctttatttatattgg

SEQ ID NO: 79997 - DNA, 766 bp, Oryza sativa
agaaaaaggaggcttattttacagcttgcagcagattcagactgtgatcagtatgtaatagacgttgcgcaatgacctgcaggctaggaaatcaatcgccgattcactatagctgtccatgaaataaatacctgcatgtgaaaatcaatatgaacaatttttttggagacggtgtacgtatatatctagcaacttctatgatgcgtcagggagaggagagagatattgaggcttgcattcaagtgtttttatggaggacactttctgcccggatctaacggcaaagacatcataattcagcaaaatttcgcccatacaaatgcataaatttgacaatctgtcccatttccagaatccagacgtgaacctgaaagagccacaatgcgatagtgtgccaagctaaagcaatcctagtgtatattgtaggcatcactcacttatggcatgacatttaataggtagtattatactacaatattgttattagctggagaaatttcaacagttgatttataaattttactacaattagattttttactagtaataatcgagatgataatacaaataagggaaaattagaaccataccattataattttgcaaaatttgaaatatgtcatcatgacccacatgtcattgactcatgtgggtcctacatgtcattgatataccgatgatatatctcaaactttgcaaaattataatggcatggttccaattttaccaaataaataaatatgattcattggattggaaaagatga

SEQ ID NO: 79998 - DNA, 548 bp, Oryza sativa
  unsure (1)..(548): unsure at all n locations
tggcggagccatcgggggtgccggagggggccaacacccccctatcccaccccccctcctttacntataacaccagctataaaatgtcagttaatccattagcaaatctataaaaaacgtcagccaagcaagaaacatgatctataaaattaattaatgagagagattagagaagcatcaaatgcctcatgttcatcacttcagttttgcacccgtatgcgacagcgatgcacgcacgtctccgtcctcccatcctgtcttgccgttgagcacgcaccgatggctgtggcctgaggtctgatctctcttacaatatagcaatacctaaatacatgacctttagtttatttcctatccctaatccatagattgtagtcagactgagtactcagtttgtgatttctcatcttttcaaaataaaatagaagatgcttatttgtgagattcttggtagtttacgttgaaacgatttagcaataactaaggactagtttcaaactgccagtgatattattaaagagctaaaatttaagttttttttaaaagga

SEQ ID NO: 79999 - DNA, 2214 bp, Oryza sativa
tatatttatatatatatatatatatatatatatatatatatataaaagaagagttgtacctctccaattctacatgccaaatcaccgatcaatatatatatatatatataaaagaagagttgtacctctccaattctacatgccaaatcaccgatcaatccctaccgtccatccgcatcgctatgatccctccgcatcgctataatccgtaccgtccatccgcatcgctctgatccctaccgtccaccgcgatttcaccctacccacagcaactctatcctatcgagagctgagtcttcgccgttcgatcccccttcctgccactccctgacccgccaccgccgccgcgtcctactcctccccacccacaaccgctgcatcacctcctcccaccaccttcgcgtcctcctcctccccatcgccgccacgtcctcctcccacccaccaccggcatgtccgccgcgtcctcctcccatccaccaccgctgccactgacggagccaaggtcgtccctagccgccgccgctgattcgccacgcatcaactccaccatcgacacccctgtgctcagtcctcaaccgtggtctccgctcgatgcacaagcagctgacttccgcgcccaatgccggacggccgtgctgcccaatctcgcacggatgcggcctcactggctctcgatgccccctgagcactaccgtcgtcgaggacgccactatgggccgctccactgccaaggccaagcggatctggtcacttcaccaccaaggctgccaaccccgagcccttccaccgtgagtccgcagcctgcttgattattgttgccgttgcctgggtccctcaccgccagggctgcaggcttcagcacactccaccgtgtggtcgctgttgcgtgcctctccgcgtcccatttggcggacagccttgagccttgttgatcaccagagacgttctccaaccctaggtatttaccctagcgatctcttgggttagtgccaattttgattgcaaatctactgcaaatgaatgtgccatgatgttgctcgcagttgtcatcgccaacagctggccatggtggaaactactgacacagtcctggcgcgcctaatgcatcttgctctgaacaagaaggaattcaccaaagagggcaaggagctggcaagcagcaataggcatgattgaaccaaacttaaatatgcataaatcaaggtgattctcatcttccaaatctttcccttaatttttcccctagggattagagattccaaatcgatattaacctgcatacagtaagaattatgagcaatttacagaagaggggaggatatcaggtagttataatttagaacagtttatatgtgcatttctgaatatatattctttgcttgctttttttccaatctgcgtccctctgtaacgggtgatgatctttgtgtttttcttatggacacatgattggtattttctgttgttggtgcagatgggtgagcaaacatggatggcgatgatatcctgacattcaaatgtgaatcaaccaacaaaggtcaccactatattgcattacatatgagtattatataagtgctctcttgccatccttagttcaactaaacattttcattttagcgttgttcaactttgacatttctataattttttaattcgtatgagatgatgccatattttatatgaaatgcacgactagctggcaatgctacaaagtaattgtctttgtaacttgtaagaattcgtatgctgtccaaagaaattagctgcagtgatgtgccccagttgttctcaaacccacaaccttaagggaataatttcatattttcataaaaagaatcattctgaaattttctcaagttttatttttactgcttgcagacagtgagttgacaccatccataggtgaaccaaacggtagcatgcaaggagtccctgttggcaatggtcaaatgcatctaacgccaaatggtgaatatatacaccaacgttatgaggtgcaaccggtaaaaatttcccatcgtttgagaaacattttttcctttttggttagcacttcccattcttcaatgtaagctgcaactgtggatgatggtgaaatattcccttcacatgcatgcaggatgctacaattaaatgcaagtcaatatttttttcacaaatatcacatgggtccttccaggataaacatgctctacttatttagtcagg

SEQ ID NO: 80000 - DNA, 1084 bp, Oryza sativa
ctcctgtaagctccggcttcgtaggctgtggtggatgtgttggcggtgagattcgatgccttaggtcctgcccagggggtcccttttatatcgtgggtcagttgatctccaagtaggactcgaagatatcgaaccccacacggtatggcaaaaacccagtcttgtccgagtagaactccttccatccgtggattctgtatctattacatgatagatttccttaacgcatacagaaactatccgtatacgcgctggtataccatatcagtatacaacgtatatccaaggacgtagggtataccttatccgtaaccctggcagtagcccttgacttctgcttatatgaactcatgcaaccgatcacgacttctgttgtcggaatcgttgtcgttctcatctggtcgatctcggtgtgagaactgtagagacaaagagttatcgacaacatcgtacgaagttcaacggtcatgagtgaatttaaattgaagtcaacccagaattttccgacggcaatctctctcctttccttggaatacgcaccgtcggtagtgggcttatttaaaggagttttggggatccattttgaagtccgtttgccacataactctccagtcttcaagcacccttcgtcttctccgctcccgcagagaaaaccctagcttgcctctttcactttgctttgttccccggcgatcctccagcgacgatggatctcgacaagtccacctccaccacagcgtccctgaagaagttgcaggacgacgacaccctccctgctcgcgggaccatgcagagggagataggaggtactgaactcgaacccatcttgggcagtatggttgcggtcgaagattacatttcttgtggttttcttcctccgccttccgaatttcttcttctcgtcttgaacttctatggtctttccttgcttcagctgaaccccaattcaatcgcattccttagcattttctcctatctttgtgaggcctacattggggtagagcctttccttgatcttttctatttttattatgagttgcgctggatggaacccaaaaaggtatccggatgtatcggattccga

SEQ ID NO: 80001 - DNA, 58679 bp, Oryza sativa
agtagtggtgcccctcgacccgacccgggactctctgacgtgacctgcacgcatgcgcatggagggggatgaaaatgtgcgatggaaatttcggatcgacataacactgttaccctttttgttatataaattttattttttttctaatttctttttcagcaattaatgttgacattgaataatttaaatgataaatatggttaattacggtcgatcgagcgtcgtttccgaagagatgttaccgattccgaccattttcaccccttaattccttgtagatctcccctcatctactattttttaaattaaattcaatacaaatgatcgtgaaaagttctttaaaaaaaatgacaatgtagatttcagtaacatttaccactccaacaacacttatcttcgactccaaactttaatttcctccattttcgttagcacgttttttaaaccgttaaatgttttttacgaacttttctatgtagaagttgttttaaaaattaaataaattattttttaagtttataataattaatgcttaattaattattgagcatgtgctcaatcaaccttctcgtttcgcgtgcgctggaaatctccgcgatgtaagaaaacggacgccggcctaggttcagactcgctcagtatatcaaacagacaaatccacgcacgtatatattgcagcaatgctattcataactcataagttggattttatctttttctattatttgtggatgttattttgcgaagttgtatatttatgttttatatatgaattttcaactttttttaagattttctcatgataatttgaataatgtttgaacaaagagattaaatttgtctccaacatgcgcacctatgcaactccatcaactggtgcaagctggctagcatacgagattagatcttaatcaccatcctgctcgtgcattaagtagtaacaactacactaagcactagtactaactgcactgtacctgtgcaccatgcaacctggctaaaaaaatgtcgttttgacatgagcaaaaaactaaaaatcaaagaagacaacaaaaatccaagcctgctactagccaacaagaaaacaagaaaacggtcgggtaatcatgtcgcggtggaccgtggacgaacaccagctgctagcttcaccttcacacggtggcttccggcgagtggccgccgccgccgagccggggcggggaggccggcggcgtgtagaacggcgtctcgggctccggctcctcctcgccctcgctgccggcgccggactcctcgtcgatggtgtagagcgcgcgcgaggcggcggcggtggctggcccgaaccaccgatccctccacgtgttcacctcctcctcgtcgggccccgccgcctgctccccttcctccccctgcgtggcggcggcggcggagtcggccggctccacgcgggtgaggcggcggcgggagcagaacaggaggcggagcagcgctcgccggagcgcgctgccgccgccgcggcgccgggccggcgccggcttcttcgggctctggaccgtgagctcggcgtcggaggcgacgacgacggctggttgctgcctgtttgctgccgctgatcggcggcggcagcgccagagcaggaggagcgacgccgcgaggatgccggcggcgagggcggcgagcgccgccgcgacgacgacgagctcgacgacagcctggcgtctcattgtcagcggctaactaatcactctcgctaaatcactctgctcgaagctcgatcgatcgagacgatgaagtgaaatgtgtttttggatatatggccaacgagatgactccctgtgagcaaagagaatttatgtctcttcttttttgattttttgatgtctttaacgttggcttctttaactttaagtcgaatatttcccggcgatggttagtgggagagaaaggaggaggggtacttttgggatttcgactttgcgttatcagagtggggcccagttgccagcgactcatatccagaatccggctgaaaaagatcagaggatatgtgttgtgtttgtttagcttgattgatgtggtgttttgccaactcatcgcctgcatggcatgaaattgaagggcacgacgaactggtcgctaaataacgtgcatttcggtgtccatatgaaaaacatctctattcatggcagttgattgctgctgctgcagactcggtcagtacgtacagtatgcagtagccaggaggtcagggaactagtagtatttcctaaaaaaatataaagctaatgctaaacagtactacatcatttttaaattggatgacaccgttaactttttttttaacgtttgatcattcgtcttaattaaagatttagtataaatgtgtataaatataagtcaaggttatattttatttgatgataaaaacaagtcacaataaaataaataatatttatatttttttctaaatgaaacaaatggttaaatattatgaaaaaattaacagcgttatacatcttgaaatagagggagtattttttcccccaaaataacttcgtttttagtcttatacgtgcaaaacaagaaagattaaagtgttgttaaaaaaacaggagtagtattaacggtaaatagattagggctgattaggcatattgaaggaatcaagctgattgatttgtgaactgaggttagacaggaagatagaaatgaaattaatctgtgtatcgatcattgcagaaggaacgacaccacactgcacacaacactttagctctttagtttgtgatcttttactactacgactacgacctctttaggctttagcgaaaattaatttacagcgcaagcaaagtaaaagcaagtgcctttaactcggatctcgtggacgcagtcgtcggtgccgacgcattcacctacacggcaaattctattcaggtgcagcattgcagcctacggcttctctgaaagaaacaatgcagagacttcacttgcagggtgtagcacagtggtagcacagtgttcccctgccacaatttttcttgcactaatttgcgctacatacaacgtagtactacattcattattgtaaagcaaacattgtactgtagtagatacaaatgatattacataatagtgatatgaggcaaaaaaacgtcatactcatctggagtacaatctttaatttacagtccacctaaaatgtactccctccgtgttatttgtatgacgttgattcgtttaaaattaaacaaaccaactttatatatttaggaaaggaggtagtactagtgaatagagaataaactatattaaacatatttttatacgggtagcgagattgtccacttgtagggctgtcggaggcgatggcctatgggtccttgccgcagcccatgagagcgtgagtgagcagcatggcgccgcggcgggtcgcctccgccagccggccgaccaccgggaagctcaccgtgtccctgttcttgagaggcttcttgtcccaccagtcttggtgcttcacaaccttgccgtcctcgacgtcgagcgtgatgagcgacgccaggtcgatggccctgcccaggaacttgtagtgctgcttgttgtcgatcagtatctgaaacagatcgattgattgttaattcctctgttagtgatcagcatgatagtcaaacactgtcgatgaagtttgggttgattagttacctcgacttttccgggcgcggtttcgttttctgtaattgtgtactccacgattttggattcaccgaataactgatgaatcatacaggcatagtatattacagagaattcagtttgaaataagttttggttgtgtggaggtggaacatgacagatatgatgttaccttggggagtgtgtagaaggccgatttgatctgcttaaccctggaatgaaagaaagaatgaaagagaagaagggatattttttttttcgggaatacgtaagaagcgcatctttgtattaagaggagtaaaagtctgtacaggttaaagggaaaacacagcaggagacgggattataggaagtcacccaagaacattaaaccctaatctcgcgatacaatgttgcgacctgagcgctctaaaggcgtggccggtatggcagtattggcgagccgccacagcgctgcctcttccgccattgcccttgccacttctgtccagcttctgtgcttctggttgaacaccctgttatttcgctccttccagatagtccatgttgcgagagtagcaatggtattgaaacctcgccgttgagagctcggtaaggtttccctcttgtcacataactaggagtggaatgaggtttcattgatgggcaagcattccgagtagggctgtcaaaaaagctcgagactcgcgagcagctcaagcttggctcgtcctaggctcgattcgagctcgactcgagctccaaacgagccgaactcgagcttgagtaaaagctcgcgagctttaccgaaccgaggttgagcttctaccgagcctaaccgagcttggctgtgtacagtctatattgcatgttcaccttattaatataataaactaatagataaatatatatatttgtatctatttacacaataaattagcatgtgttagcacaatatatttattttaatcattttctactcttttattagtgtgattaactagaaaataattagacttatcaagagattattattaaaatatatattatactacttatggccgagctcggcaccgagctcgagctcgagctcgagctcgaacgagctcgaaccgagcttgcctaaaagctcgaaggtgcaataggctcggctcgagcttgtgtcgagctcgagcttaggcagacgagctcgctcgagctaggctcgttgacagccctaattccgagcaaccgattgccgagagcagtagccaccagagctgtcttgattctgggcatgcgaccaaaatgtggttgatgctttcctcgtactgatcgcataggacacacatgctgggatggggcaagcccctgatgcttaacctgtccgccgtccagcagcggttgagtgcgaccagccagctgaagtaacggcagcgtggcggcgccagcgatttccagatcggcgtggattggaacgggattcgaccgaggaacaatgcttggtaggcggagcgggaggagtacatgcttgaactttcccatttccaaataaattggtcctggcgatccgagagctctatctcccgcaacaacgaccagagattgagatactctacgatggcctgcaatccgagggctcctcatatatcgcggatccaagctctgttgagtagcccctctgctaccgtccttcgtcgtcgggttcgcttgggtactcgatcatagagtgccggtgctagtgagcagatgcaggaaccatctagccaccggtcttcccagaagagcgtagtcgtgccatcaccaatctgtcaagtcatggatgcagccacgaaacactgttctttcggagaacaggggatggaaaggccttgccaaagaagaagagatatgatggatcgatggtgaggaaacaaacgtagacgtacccatgagctcgcataagcgggtcctcgaatgtggcatgcgccgcgtaaatctcgaagtcccgagccgtcgcgcacgatccgtatctgcaacatatgcgtgcaacttttttttttttctgtcttgtttcgtcaccgaatcaacaacacagagctaagcagagaacaggtgaacgtacatgttgaggagatgcggcatgatgtgccgggagacgggcgaggctgccttctcctcttccatggctcctcctgcagtcgtcgtggtggagaagaaggagaaccagagcccgtcgacggcggcggcagcagtcgcgcggcggagattgagcatgcaggccaggatcggatcgagcggcggtggcattcattcaaatggcgagaagagaagcgtactagtctagtctagtcgcctaccctgccgtggttgactagtccagttggcatgcgcggcggaggagggcgctacgtcggcgggacaatccggtggcgaggacgacgacaccacgacgcttttcttcttcttttttcctttttttcttcttttttttttcgtctatggaacacttacggcccagaggatttttggtagggaagtacatcaaaggtccctcaacttgtcatggagatacaaaaggaaaaggtacaccgaagagaatgcttgatggagattcttcgccgcgccgagcagacgaccaagaccaagactttcatatgacagaaacagcaccctagcttttcctgttacatctcaaattgtatttattttgttcgcctagcacctaagggagagaagaatggaaggaggaagtagaaagaaagtcagtttcatcagtacataatcacaggtgttgcttgatatattgtaggaccaggtgtgccattgtatcctgtctacagagcagtattctgaattcctgattgttcattaatgccatcatggtagattaattggttatatcatctgaaagatccaaatgagcatagtgcagttaagtatagcaccaagttcactggttgttaacaagactagtactgctacaaagcaaatactccaatggaggtaacaagagatattcaattatcaggtgcaaactcatatatcatctctaatcattaaaagaaaaccgacatgttccgtataagtttctgacattttgcatgcaaaaagctatagtaattttactttgaactctgaagatacaacgccatgaagctaaacccaagcaaatcaaactgtctgagccgatcgaattacatcagaatccacacgctttggtctcatcacagattgcacatgcgctctcagcatgtgtgcctctcagccgggctccgtgagcgcgatgtcggccttcttcagtgctagcgcgtgcgatgttggctgtgccgatgtcggccttcttcagcgccagcgcgttcatgccgttgccggtcatcccgcacaggtggccctcccgttgaatgatcctcacgatctcgtacttgtgctccgggaacatgccggcgtccaccggaaacctgaaattacacaaaggatggaacataagttgcctagctactcaataatgatggattcgatataccacatatttttattaaagttctctacctcaattaggtttttgtcaacagtgagatggttgagagtgagagttccaattttgtcacagcagagaacatccattcctgccatttcttctatggctgtcatccttttagtgatagcaccttgccaaaaattaattaattttagtaatgatatgtgatatactgtctgttaattgaagaaacatgacaacaatatcttggacacacctgttgagacaggtgatgagaacctattgcaagtgtgactgacagaacagtaggcattgcgatcggtatccctcctctcagaagaacaagaacattgttgattccatctccgtatgaccggtgctggattgggaacatgattataacctcaacaatcacaccaatggcgattgagcagatacagaacttgcctctggaggtaagaacctgaaaattcactagttagaaacagctgacagcacatccacttgcgaggttcttataatcttattacagtctgaagattgatgaatcaccttctgaaaatgcccaacaacctcagtggagtccactagatgagctgccttgccaaagaaagagtgtatccactagattcagaggtgacagaacctaaactagacattcatgcaaagcatgtattggatctcttagacggccgtctatatgctactgtgcctcaacagggtgtggtctcaccttaacattggggatgcatttgcgttggaaatccatcgtatagaactaattaatagcaaaatgcatcaaattattaggctactagctttataccaatctgtgcatcatagttttttttttcattgtattgttctcaatactcatatcaaataatttatcgtgattatattattgattgttttttgtgtagttcctgacctctgattctgtagatttgctacacctcatgtatctatatgcaaatgacattattgcttagacagaaacaacagcttgagtctccaccaagtgcagcgtaaacaccagtatggtaggagtaatttcttatgtaacagtaacatgaggagaggaaaccaaaagccatgctgtgcagagacaaccaatacagttaatcgttaaaaagataaatgattccacattactattttttttaacacaaaacattagccaaaattagtggcgtggaataaccttcttccacgaatcgctaacctagttcttactcaggatcaagataagtttcattggaatttaacccaaaatggagagttttcagtgaagtcgcattatcttgccttggtacattcagatttgcccaacataaacaaagtaatttggaaattaaaaataccgcttaaagtgaagatcttcctatggtatttacgtcgtggggtagttttgacaagggataacctagctaagcgcaattggcaaggaagtaagaattgttgcttttgtcacaaagatgagacaatattacatttgttttatgagtgcagatttgcccgttttgtgtggtgcattatacaagtggctacagggcttttcccgccacgtggtgtatccaatatgtttggtaattggctacggggaattaggaaagacttgaagtcacttatcctgttaggggcagccactatttgttggtcattatggctttgcaggaatgatatggtgtttgacaaaagaaaaatctcttctcctttacaggttatttttttaactatccacttccttcgtacctgggctatccttcagaagcctggttcacgggatttggttgcagcggcgtgttagcgcttggagcaggtggtcagggaatgttttacccagggacatgggtggcggtctagcctgaagattggtgctccctgatttttactgctttccttctcttgttacaaactcttttgtgggtttgtgtgttttggctgtgtgcatcctagttatgcagaggccgggagttttcttagtatggttctatcaacttgatgtaatcgtctgagattaataaaagcttcctttatcaaaaaaaaacattattaagttgaacaacagtgaggtaaacaagcaacatgcttccttattcagctccaatgtcccagaagcaacaatgacagtttggatctgtatcaggcaatatttgtgcaagtttctgccttctgcatgttttatttgtggataaaagtaggactaaagaagtagaaatgacaatacccagaagcgaggtagatgatcgtccacaagaatagccatcaaggagagccaaaaccaccaccaccaggagtgagaatctgaagaatctcaccagcattaaccataacagtgttcttccctccaaggtaaactctacgaccatctttcttgacgagatagtttgcaccacgggccccatttcttcctcccttcagtcccctgggagcatgcacccttctctctgaaagaatgctcacaacaacaggctggcaaaattcaatctctctcacaaggccatcaccacctctgtggaaaccagaacctccactgttctccctgatgctaaatctatgtaaaagaacagggtatcgctgctcaaagatctctgggtcagtcatccttgtgtttgtcatgtgacactgaacaccacttgtaccatcccaactcgccccagctcctgaaccgcctccaatggtctcatagtaaccgaaggtgtcgtctccaaatgtcaaattgttcatgcaaccctgggagcaggcgcatgcttggaaagccattaggactacgtccgtcactctctgagaggtcaatacattaccaccaaccactgcagctttgtcacttggagaaaggaaagagcctttaggaattaggatcttcacaggagctaggcagccttgatttagaggtatatcaacgtcgaccaagcaccgtaagcagtatatcacagcagccgctgttactgcttcaggagcattccagttaccatacacctcaggactggtgccttcaaagtcaaaggttgcttcgcctttacttgaatcaagggtgagcttcaaatggagcacagaaccatcatccatgtaatcttcatcttcgatgacacaagacccattctccttttcaactctcgatgcaactaccttaagcatttctctaacagcttcttcagcattgttttggacatgattcatataagattgaacagtgatcaaaccatactgatttatcagttctttgataagtgttattccccgctggtttgctgccacctgagcatggaggtcagaaagattatcttggatcttacgtgttcctggaatcttatggtttgtaagttcatcataggacggtgactgtagcaagtgaattattccttcctcttggaaaacacctctctcaacaagtttaaatgctttgatggcagcaccttcctcccagatgctttttgagaaaggaggcatgcttcctggggtgataccaccgatctctgcatggtgacctctactagcaacaaagaagataactttaccttcattgaaaacaggtgtgacaactgttatgtctggaagatggctacccccagaacatggatgattcgttacaagaacatcaccctcatggagattatcaccccaatatttgagttgccaacgcacggtgctagacatggctcccaaatgcacagggacatgaggggcatttgcgacaaggccaccatccggaccaaagagagcacaagaaaagtccagtctttcctttatattggtagaaatagaagttctttgaagtgttcgacccatctgttcagcaatacccatgaatcgatgattgaagatagaaagttggaccacatcagcaactgtctctgatacttctacactgcttggagcagcacttatctcaatttttatgttaccatacttggtgatgatagctttacagtctttttctactatcactgtactgttcccattcattataactgcaggacccttcaatacatgcccatagcccaaattctgaagcttgtaaagtggtgtttcctgccatccgtatgaaaaataaattcgacatgaactttctggcacaggtttggttgatactggtgtcagttcatgaggctgcaagatatttgtagcaccaactccctgaaccctcacatcacatatgagtatttttctgtttaataatttgaagccatactcttgctgaaacagtttcacaaactcatcagcataatcacttccagattccctctctggttgtttaaccatgattgctgtatcggttccctcgtacctcaagttcaagtatgaatgtgtcctgatgctgtcctctccaaaaccctgctctattaacttttctttcacctgcttaactaaaagatctactcttcgagatgcctctgcagcagaatcaacattataaatagcagagtatggctcttgcaaatcttcaataacatcagcaaggcccattccatatgcactcaatatgccacagtagcgatgaataagtaactcagacatgccaagggatcttgccatagcacatgcatgttgaggaccagcaccaccaaagcatgcgagagcatggttcttagtgtcatgccccttcatttcggtcaactgccttataggtcggcacatcgcctcatttgcaacattaacaaaaccgagggcaatctcctcaaccgtcatgtcctttgctgatggatcctgactctttcggtgagagtttatctcaacagcaagaatctcaaatgcctttttagtagcgtcataatcaaggggtaaatcttcgttaggaccaaatatggatgggaagtactcaggaataacagttcccagaatcaaattggcatcagttattgccagctcaccaccttttctatagcatacaggaccaggatgtgctccaacagaatctggcccaaccttgaaagctccaaactgaaacttaagcttcgatccaccaccagcagccaccgtgtttatgtcaagctggggagcttgtattattgccccagcaatttgggtctccagaacttgttcatagcttccatcgtagcggctaacatctgtggatgtaccacccatgtcaaatccaatcagcggttttgatgtctcaagttgaaacaaggtctgagagtagccaaccacaccacctgcaggacctgacaacactgctttgtgcccggagaatctcctctctggtgccagaccaccatctgactgcataaacagcacattcacctgctcacctcccccttcaaacctggacatgaatcctgataggtactctttgatgactggtgtgagataagcatccacactggctgtcaagccacgaggcacagcacggaccatcggcgtcaatgatgaagacaacgatacatgcttgaatcccatctcaagagataatttctcaatgagaagctcatgctgaggataagtatatgagtgcattaaaaccactgccaaacatcttattcctttgtcaagcaaacctttcaacaaaggcttcaatgcttctacatcaaccggcttcgccaccctgaccaattcccctgagatccctttaacagataaaccatcatccctctcaccatcaccaccaccaacaagttcaaccctctcatcaacctcaaccacctcctcatacaaattcgacggctttgacaccttgagatcgaatatgttcggccgagcctggttaccaatctgaagcaaatccctgaatccccgggtgacacacagcgcgatcctttcacccttcctctcaagaagcgcattcgtggccaccgtggtgcccatccgaatccaatcaatcttgcccgtgggaatcttggacgaccgcgggatcctctccccggagaactcctggaggatcctcctgatcccttcgatgggggcgtcgtcgtagttcgacgggtcgacggagagaagtttcatcacgtagccttccctcctcccgggcacctctgcgtagatgtcggtgaatgtgccgcccctgtcaatgcagaatctgaatttctccgtgctacccatcctaacttcgaggtactctcagaatctgcgtcctctgcaaaacaccaaaacagcagcgtagatgcaggcaattcagattaatctggtaatgggtgatggattactgtaataagtagaaggagttgtagcactgagctgtgctgtgaattaatcaaacaaagggggataagagcgccaggggcggatccaacttgggacatggggggttcagttgaactcccaaattttgggggaaacaaacaataaactgttacttgtattttctcgtgaaatagcttcttccagaactagaaaagaagctaggggttaacgaacgcaagcaaattccagacagacgtagccccggtggggtgggagagagagagagagatgaatcagaagctcaccaggatcccctcccctgctctgctcgccaccgtgctccaaccctgccaccgtcaccgtgctgcgtcgccccagttgccgtgcgccgtgctgccgccgtcaccgtgcgctgccgcctaaaccgtcgcaccgagagaaggagggaggaagcagcctctggctctgccgccgctgcctcgctcgtctcccctttttctcctcgcgataaggcccgagtcgacgagtgggcggcgcgacggttcggctggatccaaggtaatgcgatggcatttcctgtaatttcgatgaaaggggacgggtagcgctgtaattattttcagagtaggacgtggagccacgttttcgccactccacctcgctaagtcgctagtactctgtttctaaatgtttgacaccgttgactttttagtttgtgtttggtcattcgtcttattaaaaaaaattaactaattatttattcttttcatataatttgattcattgttaaatatactttcatgtacacatataattttatatatttcacaattttttttaataagacgaacggtcaaacatgtgttaaaaagtcaacggtgtcaaacattttgaaacgaagggagtataaatttctggagcgattcacttggctcccgctccaattgaccatttggccgtgggaatcttggacgaccgcatgatcctctccccggacaactcctcgaggatcttcctgatcccttcgatgggggtgtcgtcgtagttcaacgggtcaacggagagaagcttcatcacgtagcgctagcgccttcccctacctcaagaaccccctcccgatgctggacatcgctgacggatcgtttggctccggcgccgcggcgatgtgctaggactgcggtaaccaagcaaagaaagactgtggccaccaacattgccgcacgtgttgcaaaagccgcggcttcggttgctccatccacgtcaagagcacctaggtgcccaccgctcgccgccgtgagcaccaacagctcactggctcatccccgtcttcccccgcaaccgcctctaccacagccaccgcttccgcctctgcctccaagaagccttgccttctcacctcccaaacgacgacgtcgcacaccttcacctccgatgccaccacgcccgcagctttgacaccacctccagccatcaagtaaaacgccattgataccagcgcatgttcatcaatacatacgcgcaattcggcatgtttgtctcctacgaatctacaaacagctcaaattattaagcttgtgccattttttgcagatgtgttgtttaggagagcttgccaatgcaggtgtgcacaccggtggtgtttaggtgagaggagaggaaaatatgaaagaaaaagaggccgacggagaggtggccaggccgccgctgctccctatcgccgtccccaccatcgctccccaccgccgctcggggcaaggtgaaaaaagaggccgggggagagaaagagagataagggagagagagaggggggaaggaggaggaagaagggaaggaaagggagaatgacatgtggggcccacattgtcgatgggtcccacttgtgtgtgtttgtgagtgacatgtcagtcctacaaaattacaaaattttgccttttgttttactctagttccacataagcaacgcgtcgacgacacgtgggacgaagaccggatcgacagtaccacgtaggtgccacgtcagctaaaaccgcttgcaaacccacctaaggagtcaaattgtatctgttttaatagttcggggagttttcttatccagctttctggttaaagggcacaaattagattcggccgatatttaaggaagtcaaatgagctttttccttgtttaataataaatccctctgtcagccgcccaacaaataccagcgtaatcaaatcatatgatgtggcaattaatattagcagcacggtttttaaatttcccctcgtgatcgcgcacaagatgtagacaagatgctccgtattcatgacatgcaaaatagatgattatagtactttgaaatcgcaaaataaacatgcggacaacctttgttataccacccgtctcacggccaccggcagatcggattattaactactccttgattagctacagtactttggaaaaaaaaacgttgactgatcaaaatttatacggcgacacataaaagtatatcctaaatttatttattttgacgcacattattattgccacaacaaagccatcgcacagaataatactaacatattagcatagtacacgtattccaaatactagtttccactgtgtgcacgacacggtatgtccggacgtgcacgtatctccattgctaacgtattattaccactataaatacaaaccggtcaagtttgaagagtcagtccaccatcggttctgtacatagtaaaataaaataaactagcaatacatacaggaagcataaaagatttaattcaaatccaaatccaaactcaacccaaagcttggcaagggttatacacggcgttgatcatgtggctcacacgcggaggagtaaagacacgagactttctgatccgactagaggccacgtgccacaagcatcacacagaacaagaggcacgcacacgagaaaaacaaaaaccaaaaataaatagggagagagaggaaggggagagttttatagcgtggtgggagtggggagaccagaccaggaaaggagacggagacccgattcgttcccacctcctcgccgcccaccgctctccatctcctcttcttcctcctcctcctcctctcgtcgtcctcgtcgccgtctcgtcttctatttatttaggagtatttttttttcatctatctatctgtatctatctataccccccgcctccccgatttttcttcttcttcctcctcttacctcgcgtcgccgccgcgggcgtcagcgctcgcgtcccccgtgtctcgtttcgtccatcacaactcgctctccgtgcggcggcggcggcggcgatccccgatcgggcgactccggcgattgcgaggtaactagcgtctctcctcctcctcctcccttctcgaggttcgctcgatttgggcgcgtgtcgaattcgggaggctggtttgctctgattgggcttgtacagattgcttgcttgcttggtttacgtgcgcagccgcagcgtgcttgttttgctaaaagggcggcttggagaaatttttagctgacatcgaccgagcttgttgcgccgccgccattatcgtgcgacgacttaactgaatccgtttgcagttttctgctatgcggcgtcagttagttcagtttcctccgtgcggggggtggggcagggtgcggtacatgggtgggggcgatgaactgtgtggcacatcgaatttactgcagtaatctgacaagggaattgcaattgtaaggatataagggaactgcttctgctgtgattctcaagtgctgcaaccctaggtggcttccgcagtgcccagcccaggtggtccaatgacttgtacagtaggatagttgctactcgtgtgcacattgcacagtaggtggggtgtgtgaagggccacaaaacacctcttgttattgcttcttttgttgcatatatgctactgcaatcagctatgattttgttcagtctgtgatttgttaatagacagttgcccctgtccgaatgggtcctctgaatgtcaaaaatttctgccactgtttcatcgagcttttttatttgtgggatgggatttatatctaggtgatattaactgccacattgaattggttgctagctgttagggagtatttttcatctgtcagtcagtggaactcaggtctgcagtaagtttgttcatgattgagagcatatagcttatatctcacccaactgctaacttcaggcagataggaacaattacactttattttgttgcatgctatccccctctgtggatctaaagctttgctgcccatttttagatccatcttgcttgtcatgttttctctacttcattttttaacaacagtttgcaatgcattccgttttgggcaattatatgatatacatttttctgcttattaatcttaacaggttgaaattaatacattgatgctgtatcatcacagaggcggtctttcttaatcttcaatattttcttagagctaaacggttatattttggtgtcttcttagcaacaatgccatctcttcagttattgcaactgacagagcacggacgcaaccttttgtcttcgagaaggtgtgctgttttaacattgtctttctaaattttagtaagtcgatcatttagttcttatctcatgttccttgttctttacaaacatcaacaggagaactcttgcagttgtttctggtgcgttacttgcgggtggaactttagcatatgctcactcagctcggcgccaaaaacgtcaggaagaatattctcatagtgatgcaagtacacagaccacgggtaatcagagcatttgtcaaaatggtgttgatggtaaattggtaaaaacaaggaaaaagaaaaatgggttgaaatccttacaatttctggctgctattttgcttaaaaagattggtccaaatggaataaatcatcttctcggcttgatgataacagctgtaagttcgatggttctctttagtgtgggtgtttttgtttgacattctgataatattgttctgaatttaataacttgtatggccatctatgctctacaccttgaatgtgtattctacttcatggactaagcatattgtgcttgttatctacatttccaagtatttatctgcattttatgctagagtttaatatgttactgagctttgctgacttggttgctgattagttatgatatgttgtatcagttagttaaactctcgatcattgagctatagcataccatgataggaagtaccatttccagccttgtctgactacatgtaaaaactctatagagcttgggttttcatatttcttttatataaataaaatcttgcttctgcaggtgttacgtactgccgttggccacagattagcaaaagttcagggctatctattcagggttgcatttcttcggcgtgttccaacctttacacgcctgattatcgaaaatcttcttttatgcttccttcagtccacaatatatcagacctccaagtacttgacagggtccttaggtttgcactttaagaagattttgacagatcttgtccatgctgattactttgaggtatgttgctttatgaagttgaaatcttcattctttttgcaccttaaatttcacatgattacacttactgtttatttttttctttctccacgtatataatctactccctctgtttcatattgtaagtcgtttgactttttcactaatcaaacttctttaagtttgaccaagttaatagaaaaatatagtagtattatcaacacaaaacaaacatattatcaaaatatattaaatgctagctttaatgaaactaatgtagtattttagatgttgctattttttttctataaacttggtcaaacttaacaaagtttgactaggagaaaagtcaaacgacttataatatgaaacggaggaagtaagatacttgatactctccaattacgcagtgaacagctatagttaattcgataggctttgttgatagaataattgatgaacagtgagacaaaatgcttgctacaaacagagcaactgaaaaggttaccttattcctgattatagaaaagcaatagcacaccttaaacaaaaaggaggctatttacttaagtcagttaaaccccatagagttaagtcactcctgttgctgaaatgtacaggaaaatagaattactgtttcatcttttcggagttttcagtctatctgcacgaataccaaattttcccttcttctgtagtgaagtttttgtatattacttgggtttgcagctacttctgtagaatcgttgagtcaaatagatatgaaagttattataggtcacattggaggttctagttatttgactttgactttttgtactcaatagctttccatgatctcatgctgtagagttcatcatgtaaaatgtagatcgattagttagctcatctaatttccttggaaaggtatccaatagtttggtcaattgcttgacgattaatgtgttgaactgcatatttaacattacatgccattgattctttttctcccaccttttgtgtgcagaacatggtttactacaaactctcgcatgtagatcaccggatctcaaatccagaacaaaggattgctagtgatattcctaagttctgctcggaactaagtggactcgtacaggatgatctgactgcagttgcagatgggttaatatacatctggcgcctctgctcttatgcaagtccaaaatatgttctctggattctggtaattaactcccccaccccaccccaatggatgcatgcatgcatgcaccctacaacacacacagagtaaagggttgttacgctttgtgaaatataatatgacaacctctcctgctctttcacgtcaaaaaaggaaatgaaacatcttatgacaatggttgaaaagtagtactcctagtttgagaaaactgtgctaccttaatgtttgtttaatatatattatgactactagcttgctcattattatatagattgtcaacactggtaaattgctttcaggcatatgtacttggtgctggtggtgcaattagaaagttttctcctgcttttgggaaattaaaatccatggagcaacagctagaaggggaatatcggcaggtccattcacgtttgagaacccatgctgagagtgtggcgttttatggtggtgagaacagagaagcatcgcacatcatgcagaggtttcaggctcttgtgaagcatttgaatgttgttcttcatgaaaactggtggtttggcatgattcaggattttcttcttaagtatcttggtgccaccgttggagttatcttgattgttgaacctttctttgctggaaaccttaaacctgaatcatccactttaggacgggcagagatgttgagcaatcttcggtatcatactagcgtcataatatcattatttcagtctcttggaaccctttctatcagttcaagacgcttgaatcttctcaggtaaatgcactgtccttgtgtgaaatgcttgccctgtcatgttatttttttttgggggggggggggggtgcactgtcacatgtttaatggacattgataaagtagttgatgatacttgatggttcttatgatgtcatatgacatgtttaacctttatgtaacctcaggttcatattttgtttatttagtggaactataggttctatctatcatcatcactctagttctttgctactaagaaattagttattcactcttaaacttcgtttctggagtacaaacataaaattttgacttgtggtttctaaggaatatattggtgattcatgttttttgtgtgtatcagtactgttgcgaatatgcaatttaagattatctgttgatatatttgagtccatcatattccaagaatatcttgtgcattacaagtatctatgacttcataattccatttgataaatatctttttgctgattaactttctattctcattaacagtggctatgcagatcgtattcgcgagttactggatgtttcacgtgagctatctggggttcgtgatctatctatgaataaaaaatcttctgtagacaattatatcagcgaagcaaattatatagaattttcgggtgttaaggtaatcatgatggggactactagttcttctgtctgtttggtatgaagaattctaataaatgatttgttacaggtggtgacaccctcagggaacgtcttggttgatgatttaactcttcgggtagagtcgggttctaatcttttgataactggtaataatctataccaaaatatgtgtcctcttagtttggatttgcgattgagctattgcaaattcatcatgcttattgtaatgaaaacctgatatttgcacatcactttttaacacgcccaatacaagttcttttatgattgccatctgatgtaaacattagttgacactgggtaactactgtgctgatgggcaaattgtattatgccgagggaaagggcttaggagaagcgactggaatggacttttggaatgagaacatttattgtttatcttgctcccctcgttggcaataactgtcctttatgtagtgataacacttaacaactgtctaaacttttgatctaaagataatattagataccatgcactccatatatccatggatgtaggttgctgtcggatccctgtgatcaaccttaaatttgactcttaaatgtacgcataattatatatattctttctagacattttgtttgtatatgtgtgacactacttgtatgttttggtgctttttcatgaaagttacagccatggaaactaattttataatgcatgtttgctcattttcaggtcctaatggtagtggaaaaagctcccttttccgggttcttgggggactgtggccacttatgtcaggccacattgtgaaacctggtgttggctctaatcttaacaaagaaattttttatgttccccagcgaccatatacagccgttggaacacttcgggaccagcttatctatccacttacagcagaccaggaaactgaaccacttagctatggtggcatggtggatcttctaaagaatgtaatactcataattatccacttgatagattggcatctttagctgcctcattgcacttgtttgtgactattttgtcccaagtacctagaaagtgttactggaaaaccttagtttttttcttcccttttggtaggtggatctggaatatttgctagaacgctaccctcttgataaggaagttaactggggtgatgaattgtctcttggagagcaacaaagattgggaatggcccggctgttctaccataggccaaagtttgccatcctggatgaatgcactagtgctgtgacaactgatatggaagagcgtttctgcaaaagggttcaagcaatgggcacatcatgcataacaatctctcatcgtccagcattagttgcatttcatgacatcgttttgtctttggatggagaaggagggtggacagttcaggaaaataggttatcctcatgatgatttttatctccttatttatttatatataatatgaaatgcagttctaaaaagttcgttatttctcttgtagaaatggctcctttatctctgctgaaccagagtttgatgcattgaactcatcagaaactgatcgtaaatctgatgcacttgctgttcaaagggcttttattgccaacacaaaggtagttattattccatattgcctgttctgttgttattgattttttatgtaccattcttttaacagattttatttgctagggtaatgctttaatgggccccaaggatcattcttattctacacagctcatagccacttctcccaatatggaaatagaacacacagaacggtcaaatctagttccacaattacagtgctcaccaagacctttgccactccgagctgctgcaatgtcaaaaatactggtgagaaacatacatttttttacgcttatcagtaattcagtatctagtatccactattcagagatctcttcgactcaaatttgctgatcgtccacatgaaataattttctgggatatttgtttggcaggtccctaaattatttgataagcaaggtgggcagttgcttgcagtggcattgcttgttttctctcggacttggatttcagatcgtatagcttcactgaacggttggcttttatcttcatgtactggagatagatctgatggtataccttttacttaatatgttttcacaatcttgataggaacgagcgttaagtatgtcctggagcaggacaaagctgccttccttcggttaattgggattagtgtgctgcaaagtgctgcaaattcaattgtgtcaccatcactaaggtaatattggttccctgcaattgaaatgttcctaccaggatgctttgggggcagtgccaggcaaatactccctccgtcccccaaaaaggcaaaccctgggtttccgtgtccaactttgactgtccgtcttatatgaaaattttttataattcgtattttcattgttgttagatgataaaacatgattaatattttatgcgtgacttgtctttttatttttttcatatttttttcaaataagacgaacggtcaaacgttgggcacgaaaaccagggtttgtctttttttgggacggagggagtagataatacactttttttttaaagtaaagttcctgagcctttttaacatatacttgtcggtgggcttaagttttccttatagttctgatatctgtttatgtttgccagaagaatgtatgttctactttcctagtcaggatatttaactattgtgcattggtaactgattttgtgtattcaaattcacggcttgataaatatttctatgcagaaaccttacttcaaagattgcccttggctggcgaattcgcatgaccaaccatctacttcaatattatttgaaacgaaatgctttttacaaggtaaactctactgatagatttgattgtaaacattgttttcttgcactttctaacatttttttctcttttacttttttttccatgaaagctaagcagtttgagtttttctttttcaggtatttaacatgtcaggcatcgatattgatgcagaccaaagaatcacacatgatgtggagaagttgaccaatgatcttgctggcctagttaccggaatggtgaaaccacttgttgacattctttggtgagtttgtcatggtctaaaatattacccaggtgttctttgattaatcaggttttcttagcaagtccactattactctccaggtttacatggagaatgaagattttgtcagggcgaaggggagttgctattttgtacgcatacatgttgctaggtcttggttttctaagagctgtttcccctgactttggtgatcttgcaaatcaagaacaagaacttgaaggaacattcaggttagtgacatatgatttgcggtcattggcaaagttgactttattactaaggaacttccaagtattgaccttgttaatttcacaggttcatgcactcaagattgcggacacatgctgagtcaatagctttctttggtggtggatcaagggaaaaagctgtgagtttttcatgtctcataaatgctgcttaaaatttctagtttccacactataattcttgtgggcaatatgttttttgtgtatacaaatttcttgttgcttttgaacatctggtacagatctgttagtaaatttacatgccctaatattatgattattttatcgtaaatcagatggttgaagctaaattcacaacgatgcttaaccactcaaggactcttctgagaaaaagatggctatatggtatttttgatgatttcgtgacgaagcagctacctcacaatgtgacatgggggcttagtttgttatatgctttggaacacaagggggaccgagctttgacttcaactcaaggttgataaatttttcaaatccaaatgatattatttttgcatagaatttcccaacaagttctcaatttcggattgcaggagagttggcacatgcacttcgattcttggcatctgtggtgtcacaaagctttatagcttttggtgatattcttgagttacataaaaaattccttgaactgtccggtggtattaatagggtgtttgaactcgaagagcttctacagacatctcaaagcagtaagttctcagtacactgtaaattttactcgatttttttttttttggatgagagacagtagggagaaaccagactataaggggttggatctgtacaaaagaggctttctccactgtaaatattaagtacccactgttaaaactaactatcccagccactgagagatctcaaaattaagaagttaccaactctcagaaattctaaatcaataacgagaagttttccccatcataagttatggccttatggggcacccatcaaatcctcaatggttattctcagtaaccaagccagtgaggtatcagctcaataatctactaccagtctgttgcactctctgcaaacatatgcttgagtttgaagttatgccgttcaaatatactatgatgctaatttttaatgggtaattaacttctgacatctgcaaactaaagaacagttactgtctatattacagattcttaaatctgtaaactttgtcgaagggtgcaaagatgtaaatcttctgatacatcatgtctataaataaagaaaattctaaattgactgtctttctgctgtttccctggacactgaaaaccatttaggagtagtttttagttggagcccacattcttcagtacaatatcttgtctgatattgtccctgaattaaaaaacatcatgtctggtatacacctgttaactatctttaactttataagaagcaacatgtgctgattttaggaaccttctccttgttcaaagctacaaatcagcacatgttacttcttataaagttacatcttaaacagatttgccattgttgatgaaattgtcaaacttgatgttttgccatttgttatcttaatgctacgaattgtagcttcatatgttactgttgtttttctagatgctgccatgccctctaatcctattattgcggcatcggaagaaattatttccttccatgatgtggatatcgtaacgccatctcaaaagctattggctacccagttatcttgtgatgtatctcaaggaaaaagccttcttgtgactggtacatcatctggcagcttttcgtcctagcttttatttactttcatgtttacattatatgttctaatatctatcatgctgttttcttaaggcccaaatggcagtggcaagagctccatttttagggtgctccgaggtttgtggcccatcgcttcagggaggcttaccatgccgtctgatggcatctttcatgttccgcaacgtccgtatacttgtctaggaaccttgagggatcagatcatatatcccctctctcatgaggaggcagagttgaaggttctttcattatacaaatcaggttagtgccagctaactttgaaaaggaaaaaatatctgcctattttaactaatgaatttttaagcactcctttattttgattatggcttttaacaaacttctatgttgaccatttcctgttctgttatgagcaatgtatttgttggtaatgtaacatcacacccttatccttgatgatgtaggtgacaaggcaataacttctgggtcactggatgatcacctgaagacaattctagagaatgttcgattggtctatcttctagaaagagaagggtgggatgctactcctaactgggaagatattctatccttgggagaacagcagaggctaggcatggtcagtgattttgcttcagcttatatttgttgtctaactaatttccatttgttttttatggatatatacctttactaagtgggtaataaatgctttctttcgttttttatggatatatacctttactaagtgggtaataaatgctttctttccaggctcgtttgttcttccactgtccaaaatttggtatcctagacgagtgcaccaagtatgtagcgtatagttttttaatgttctcatttccattttttaccaataaatgcacagctcttataaagcatactcattgcagtgccacaagtgtcgatgttgaggagcatttgtacaagatagcaactagtatgggcataactgtcatcacctcgtcacaagtaagtatcatctagatacccacttatcctaactcttcaaatggtgaataaaaaaaaaacatggttttcatttctatccattttgtttctagttgatggtattttgcatcttaagcttacatctttgtcagaagtgaaatttgggttgatgatgcctttctctcatttattcatttgcagaggcctgctctgatacccttccattcgttggagctgaaactcatcgatggtgaaggaaagtgggaactatgtacaatcaaccaataattgatgtggccaacttgaatttttgacgagttttcatcaagtgcctattcaccagtggctgcctttacaagccatgaagaaaataccaattcacattaggagacttgcatactttcacgcagcatatgcgcttatacgagattcttttttccttggttagaggtttgagatatagcaaaacaacatacaggagttgtagagtggaaaggtagatattgacttgtagcccctaagaagatagatagcgtagtacataatttgtccttccagcctaattgattggcttgtagcaattgtaacacggagcacgaagtgtgcccttgcaaatgttagctcttttatatagaaaaaatatcttttattttgttatttcggtgttatgtttttttgttccatgtcagttcagctatatactagtttgaagtttgaactttaacttgtccgattccagcatctggtacatatctagggcctgtttgggggagttttagattttagattataagaagcagctgtttggtagccaacttctgagaatctggaaaagctctgaaacccagcttctggctttttagttcatttttttcagaatctgtaattacagattctctgaagctgtggactgtttagggcagcttctagcagaagcagtttttgagaaaagctgtagctgggataagctcccccaaacagggcctgagccatacacgaaatggaacaggaatataaatttgaaaattgctatccatccttcgcccgatctttctgataatcgtcggttgattttgtgagaattggacgcaacgtagtgattcgtatgcgctccggcaagcttatcttcttcagtaatgtagtgattctgattcacgatttcgcatgtactcctgcaggctgcgtttgatttatcttattggccaaggctctgtttagatctcaccttataattttttactctgtcatatcgaacgtttgaacatctacgtgaagtattaaatataggataaaaaaactaattgcacagattgcgtcacaggacgaatcttttaagcctaattgctccatgatttgataatgtggtactacagtaaacatttgttaatgatagataaattaggcttaataaattcatctcgcggtttacagacggattatgtaattagtttttttattagtgtccgaacaccctatgcgacaccctattactatataatatttgatgtgacatgccaaaactttatatccttggataaacaccccccaactattccatcgtttttatgagtactatttctctaaatactaaatggtttgtgagctctgtttctcaaactaacgttttgtacaaaagatatttataaggaggtttattaaaaaaaccacataaatttattttttttaagtttatagcaatcaatataagtcctccctccgtcccataaaaaatccaatcctggagagaccatctgttactactatctccgtcccagaatataagaagttttagagttagatacggtattaaaatatgtaaaattaaatgaggaaagattgtgatttgttaagaaatagaggtcgataagaaaagtgaatggtttagggttgtgattggttgagaagggaatgttggcgaagaagttttgtattttgggacaaattttaagtgctaaaaaaaatcgttatattttgaaacggagtgagtagcaccgaaaataagctgtttttgtcacccgtgagagcatctcgagaaaaaaaaacatgactgtctcaaattcgattttgagcgtttttcgttagaacttggtttttgtagccgacgattaatactacaagagatcgtgtaaagtccgaatcacagcgtattaatttgcttcacttttcacatggaaacgaacgaacgaaacagagtttgctaaggcttttgctgagagaggagcacgagcaatccctgtgggccgacgaggatctcgctggcgaagctgacgaggccgaaccacaccaccggcgtgacgtcgacgccgccgagcggcgggatcaccttcctcgtcacggcgaggagcggctccgtcggcgcgtacgccaccacgtaggggaactccctcacggggagcctcgggtaccacgacatcacgatccgggcgatgaacaggaacccgaacgccgacagcgccggcccggccaccccgatcgccgccttcgccgtcgctgggtccagctcccctaccaccgccaccgccctgcacacccactccgccacctcctgccactgacgctccggtgcagcagcagcagcagcagcgtggcattggccggtcatggccgccgccgtcgtcgccgcggccacggcgagctggccgtgtgaccctcgctgctgcttcacatcgttgcttcttctccttcttcctccttgtgctatctcgatgtcctgtagtttggagaaatcaatccatgtcgatgaagatgaacaaattaaacagtgcatcggcggtgatcgatccagcaaccaagaagatgattaccttggcggcgctggcgacgatgcacctcctggcggagaagagcatggacactgtcctggacatggaggcttccatggtcatggccacgaggaggagaggccttccttgctttgccttactttggataaggcgaattgaagagccaaggtgggggagggaagaagacgacactgcccgccacgttgctctttctactgggcctccaattgagacggcctaagcccactggcgatgcgaccaaaaaaaaaaacaaaaaccctacggcccaacacaagcaatcgtctcccaacatcaccgcggcggcggcggcggcggctttccacctccccgccggcttcgcgctcccaacctcgccgtcgttcgtcatgttccggctgcgctcctccgctcgcctgctgagagaggtgagccagccaccggcggcctgctacttctagttctagggtttagcgggtgcttctcgcttacgatttcagtatggcttgtggttcgcgttgcagctacgggaggcgtcgcggtcgtcggggcgccgccgggaatggctctccggcggcgcagtagcctccgccgcgcggacgacctcgctcctgcaccctctgcccgggctcgacgtcccgcagtgcctccccgaccagctcggcgtccagcccacccgcgtcaccacgctccccaacggcgtccgcgtcgcctccgaggacctcccggtattggatactctatgttcctctgctgtgctgcggcggcggcggcggcggcggcgacgaggctgacgctgtgtgagggtttctggcgcagggcccgtcggcgtgcgtaggggtgttcgtggattccggctcggtttacgagacggcggagacggccggcgtgtcacacctgctcgagaggctgtccttcaaggacacggcgcaccgcagccacctgcagattgtgcaggatgtggaggccaccggaggaaacatcggggcgtctgcatcaagggagcagacggtgtacagctacgagactctcaaggcctacttgccgcaggccatcgaggtgctcatcgactgtgtccgcaatccattgttcctccaagacgaagtcgagcgacaggtgctggactcatggatagactagcctctaagatacagcttattactagctatttgcagcgcactgattatggttgtttggtttatcaggtggcctttgccagagaagaagttcaggagctacagaagaaccctgagagatttcttcaggaatcacttaatctagttggatacacaggtgctcttgcaaatccactagtagcccctgaggagagtctcacacgaatcaatggcagtattattcaaaagttctatcacgtaattctcttgcttctgtatcacatttgacttataaattactcataaatgcgactcaattcatgctgttcgtagtttccaaacgatgctaaaatgcaagtgtagctctatctctatagctcagtgcctcagttaacaaatttatgaaaaaaaaatctattactgaacaggagaacttcactgctgatcgcttggttgtagcagcatcaggtgttgatcatcaataccttttagatgttgcagagcctttattgtctgattggcacaagggctccccagtggaaaggccagagtctaagtatatcggtggggattttagacatagagcagactcagaggtaatatacttcccatcaacactactttgcctattcttttggggtttccttttgctctaaaattgaaaccctgctcattcctctccctgcagatgacccatgttgctttggctttcgaagtgcccgggggctggcttgaagagagagatgccacaattatgactgtagtacaggtatacttaatgagtgggtatttactaaaaacaatctggcctatgttgacatctgcatcccaactgcactttctaacatatatccatgaatatgccaaaatattttgtagactttaatgggcggtggtggttcattctcttctggtggtcctggaaaagggatgcattcacggctttgtaagtaattatctctcgacaaccatttgactttagtaggattgcaaattgctacaatatggaataatgaatatagattagattgtgcttttaatagccgttgttgtgtaattgctgcttttattttgccgttttagttatttcagttcctaaagttttttttttaaaaaaaaggctataagttgaactgttatttctttgcagatctgaatcattctcttgacaaccatttgatagtaggattgcaaactgctacaatatggaataatgaatatatatttgattgtgtttttaatagccatttttgtgttagtgctgcttgtttagtaccctagtttttttggccgttttagttatttcagttttttaagtttttttttgaaaggctataagttgaactgttatttctttgcagatctgcgtgtcttaactaaataccacacggtcgaatcattttcggtatttagcaatgcatttgatagaagtggcctctttggtatttacttgaccacggtaagctcatctttatacattattctgtgcctcgaattaaatagtgaattatatgaaacatgttgcagcttctaccttgagttgttacttcgtcattttatcaaattgtgtgagtaggacttcaaaagggactagagctggcaaagtctgctttttcaaaattttgaagtgccattgcttcagttcgtttttgagtactagaagtttgaaatactttttttttgtttttttattggtccagccttcagattttgttgcaaaggctgttgatattgcgacaaaagaactgattgctattgcaacacctggacaaggtatatatcatctcctgcttgccaaaactgcttcagcatccactgaagctacctgatctgaaacttgatgcgatttgtatgtatacagtgacagacattgaattggcacgagcgaaaaactcaacaatttctgccgtgctgatgaatcttgaatccagggtaattttggaacccccatccccaatacacacacgcgcacacacacacaaaaatctttctgacccttttcacaggtaagtaacctgctttagtgtacttattttaatttgcaccaggtaattgttgcagaagatatagggaggcagatattgacttatggttgcaggtaaggcaatatctttcacacttcattttttagaagtcttccgcacagaaatcattgattcttttctattctgtcaccacaggaagcctgttgaccattttcttcaatgtatggacgaaatgactctagatgatataacagcttttgccaagaagatgttgtcttcaccacccacaatggctagttggggagatggtatatatgctttatgaatttgcgaaaaatatgaatgacacaaaataagaattaatgtgagttcattgactctccttctgcagttgataaagttcctccatatgaatttgtttgcaagaggttttgaagttctccgacacaatgatcagtggtggacatgaagatgggattttgtttacaatgttgtataatccaattctcgctatatttgggccttatcttagaaattgccctcgttatacacatcacctgatgagattagatttttgctatcatcttcaaacagcatatatcttgtgaaagtccaggtcaaacggaggtgaaagttttgcaatatctctcgaagcaagtttagcgattcctcgtcttgttatgcaaacatgcatatgcacttgtcttattgagtgctctgtaaacaattttcacggcgatgatatataggggttacggtgcggaaattgacaggataatggcatggccttgtttcgacaggacattatgttctcggactgactggtttgacttcagttgctaccgtatattttgtgtttcttttaatgtatggcaaagcaaatcttcagaaaaaaactagtacgaaatgttgcgtctttgcttaactacagagttggataataatggatgaaaagcaacaacactgttgagttcagggaaattgagctccccatcatctgaacttttacaaaacttccaacctgaacttgtacaaaattttcaacacttgctgcaccgacaggtcagtttgcacgtttgaagtgacaaaacaagcagatggtgcatacaaaagctcggcttgcaagtaaagccaaaataaggagttccaacattccattaagcattaatcgccagtcatcagactcgcagctcattacaactaatcccatcctgacagtgcacctgatcctacctccggcacagatgatagctgctcaagagctgacgagccaaagacggtgcctttggctttcttcttcttcttggtgtgatcgattaccaggccaccaaattttccatctcgggcaatttcctgatttttgcccttcaactcaagctctggattgttgccttcaccggagaacaccaagtctgcaaatggcatttctgtgtcatcaattccgtcggcgttcttctcttccttcttggcagattttgtcctcttggctcccttactaacctttttatcagtatgatcaacagaagagttgtcatccttcctctttgatttcttgttcttgacatgttctacagccgctttttccttcttcatttccttgccatcaagcagttcagatttggctggggcagcaatggtgacatccgggcgagtactttgtcctgcaggttcttcagggctcttaatttgttgctttgagtgtttccccttgcctttcttttttgtataaatgtcagtaggaccatcatcaggcgtatcagcatcattgattggtagattctcttctctagaattcttactcttggagctggcctccatgggctttgagttaaatatgcgtaggttgggaactaatttcttaacctgagaaaacatccagagttactccagaattgcatacatacagaaaggcagaaaataaacggtattaccttcttggctagaccgtctttctcagcaataggatttccctgcaagtttaggttcctcaagtagtgcaattcagaaaggacctaacccaaaaaaaaagaaaaagaatagaaaaaagatagactgagacagtgtaaagatattatgaatgtagaagggtgggagaaaattaatcagatgcaaacctccaaatctgatctcctctcaattaagttgtttcctaaatcaaggttcaaaattttgacattttttgccaggtctgatggaattgtctgtgaatcagacagagttcagcaagatgttacagagtgaccaagtggaatgtaacatgctttcgagcagaaaaaaaaaacaatgtgcaaaagagacccagacatatgctatccataagtccatatacatacagtgatcttgttgtgagcaagtctaagttccttcagttccacacacgcagtgagagaagaaccaattttttctatctggcagtgagataaggatagctgaggaaggtaatgacaaaacattagtcatgtaaaacaggaaaaagtgcatattaaagctgataggtcttttttttttgcaaaactaaataatacaaacctttttcatggcctttgccttcatcaaagcatcaccaatagtgaaaataggattcttggaaagaactgcagcagaaaaacattcagaagtaaattaggtggagggaacatcattattctttgcctgttccaaactggactgtaaaacaactcttttgttgggtgatgggtttgtactacaatatgaaaactgaatatggatgatttataagaaaactggtattttacatgcagaaagaaattgcaatgggcaaggatcttaatgttaaggttcccaaacttactatacttacaaaaactattaacatccttttggtttatcaaaattatcggcacaaatcaagaccatatcatttaatcattccaaggggaaaaaatgaattctacaggatgaagccactcagttcattctataattaattgagatctcactatgcataccaagtgtgttcaactgatgaagctggtcaagtttgcagatggaagaaatgttgttatctgcatgagaaattacagagatccagtcatcaagctaccagcagaaacaaaatacaactgacaaaacatagcatttgtgcatagcattaccatttagaatcaatgctcccaggcttgtcaaagatttgacctcatccattgttttaagtttattcttgccagcattcaatacctgtacaacaggagaggagcaactgccaatcattgcaagtgaagtaatcaggctaagatccttttgcggggcagagaagtaactcacctgcagctttgagaggccttcaacaccttttaggctcacaagcttgttttcaataaccgaaagccacttcaaattggcacagtttgatagacccttcagcattcaaaaccacaatgtgagtggaaaaaaaaaagatactctgatgaacacagccacagcaatgatttaatggaacgattagccatcaattctctacttcaatgaactcaaagaataatccagaccgaatgggacatcaaattagtccattatatgactttctaaaaggttattacgggattcatccttttaactattcaatgtttcagatggatttacccagtgcctatgcttgtagagaacacagtaacaccgacatcgcatatatccatacaggtgaaattcaccaagaatctacaccgatgctaaatttgttgtataaacatgtgcatttctcactagaatactgtgttttaacccgtagtacattgactagttacctcgagagtgaggaggcagttgtagccgaggtcgaggcgctccagattcacgaagctgctcaggcacgacacctacacaaaaaccaacacagcacagcaccgcacaacacaaggatgagaaaacatggcaggaaaaaaaacaccaatcgacgaggcagaggctacacagcaccgacgtcggagagggcgcggtgggagaggttgagcgacgtggcgagcgtcccggcggatcccgcctcgcgcttcgcctgctccaccgtgagccgcgccatctcctcctcctccggccgccgccgttgaggagggcgaagcgaagcaagcgctcgttgcggcggcaggcgagctgagctctcaagtctcaaagacttcaagagagaaaaataccctaacctaacaagggcgatatgcagctgacatgtggggcccactgtcagcctccacggagtatttctctctcttctcgttagagaggggggtaaagcgcaagagactcgcaacgcaggtcagagcggaaggggagaagaaggaggtgctcctctcgagtttggagaaaatttcccccgcagaggcctccgcttgctcgcggagatggcgatgaccgtcgaaggtgagggtcgctctgagtttccctcccccatctaagatttgctcaattgctagtctggttctgttcccgatttcggcgtcgtttgggctctccgattcgagtgtcggggtggcgggggattgggcggctagggttccggttcgagtttggtgttacgattggctggtgcgtgctttacggattagggcgtcgggttcccaattcatcgcgcatggtttgttgtaatgcttgtgaagttaaactttcccagatttagtcttggcattcggtgaacacgattatctgtttatatgtcattcatagaatcagagtgaattatccctgcaaaaaaaaaaagaatcaaagtgattagatcctccaagttagcaccttgtattgggtcttatgttttgccagtagatattgtagtccggcttacctacaattgtgcatgaaacactatcctgtatttcaactcatctgcatcctcccgagtttccaacagaacaaggagcataagccaaaaatatgcctgcaaaaatgtgaacttaaccatctagctcaataacaagtgtccctcagaatcgcttaactgatacccatgagcatttactatgtgcatttggttttgagttctagctctaggatataaattttaccatgtgcatttaaattattttggttgtttgctaccaacctgaaactacactgcttctgagatgtatttggatatcactttcttcaatttattgctaaaagcatacagtgatactgaagcatcaaactacatggttttgattcaaaatttgtaaccaaattctacttatgattcatggaactggacaatttgaagttaacatggagctctgcacatgcttgatgtatgtttagtccatcaaaaaacaacatcccagatcaacttatgttcttctttcgacctttatttgtgcaacctcatgttcataaaaaatatcatcgaacttgttcaaaagcacttcgaaaaccatgtcgtctttagattagcctttatgtagcacaacaccaaagatgagcatgaccatcctctgaagaaaaaaaaatcatgctgaactattaagcctttgaagtgtttttagctaaactgggaggaagaatatgcattaaattatggttatgaaattcagaccagcttgttgattttatagaatagtatttcatttgcatagagttacctttctgaaaatacagttcattttcactatcagctatttgttagactctagtgctccttattaggtcatgccatcatctttgttctcctgcaattggtttgaaagtttcactaacttaatgcttcttgtctttgcttttatacctttctgctggatgatgatgatgatgtcacttatcattgatgtgtgtcttgacagtgtaagtatattattcagattcttttctgaccattcttttacatttaagataagtgttaacaatataattgcttctactacaggctcgctggacttgcatttatgttctcaacaagtattcttttgcaaatactggtacataattctcacttgtttaaatctccacctagcctcttttatttgctaaaattcaggcttctgggtgctttgtttcatgacagttgctatttatttactcactaactatttcattactttgagaagtgagaacctaacagtttgatttggcattttgtttgtacaattcattcatgcacattactctgtatgtctgtcatgctaattatgttgtgaaattcataaaacttagagcaatctggagcatcaattgctgtccagaattactgtagaagagtatgcgtgctagaaataatacttcacagtcagtgaacaaagcgtgtagcattttgaagacaccatagcccacatgacggacatgctcttgttgtttgatcaggctgttggttctatagctaattatttttccttattttgatggtgcaggcttgtgctctgtacaataattggtggcctatgttagcaggtaattgttagttagttatcctcaatcagtgttgtctaatcctcgtcgaccttcaactgacatttgccatacttctgcagctcttatgtatgtccttgtaccgatgccatgcctattcttcggtggtggatctacccagttcttgactagcagagatggtggagggtatggtttgatttgttgttttcgttccagaaactttaccatacatactgtactacttggatgtaaactaacatatgtaaagaatagtttggaataaggaaattccttctgatttgtagttgtgacaaactaatgatagagtgtttatcatttcaggtggttcaatgctgcaaaattcctgactggtgcatctgccatgggaagcattgcaatcccagcaattctgaggcacgctggcctaattgagactggagccatgttcatcgagttcacgtccttcttcatccttgtatgcacagtgatgtgcttccatagagctacgctggatgaagattggtaaaaggctcgaggcacatggacacaagaaggtaaatctgtttcatggtttgcttctcagcacgtacaagagaaattccttagtggacactaacatggacatgtgtacaaagaagcaaatatttgagttggcgtgactgtctgtataaatgctcaaagatttgctgatctagcgacaatgccaatgttctatgtgcacttttcatgtgaatactcctcacatgatctatgggcaacctgtcagccatccgtgtgaaatgcgatcaaacgagcaggcaggcgccctgtttaattcccttgattggttctttgcattttgaagcatttggccaccgtgcggcagctcgtctcctgctgcatctctccaccgtttcgcttctctcatccctatcccgcgccaccgctcagaatgtcttgggctttaatttttctgtgttatactgttctcgatcaatgcgattaattttagacatgtgcttgttctaaaaaccaattcatcaaatcaatactggacagtttttactacttgggtttgaagatgaagattttctttttggaggggttcgattcagaattgttgcagaattcctaacctcttctccctcttttcaaaccatctttttattataagaaaaaatactttaaaaattatattaatttatttttcaaatcatgcgttaattcatcgctccgttttttatgtgtatggatgaagttaccaacttcttcaaacggtgcgttcctatatgatatttgtgctgtaaaacaagcagagatatttcacatagcaatcgagcattcagaattttatttaccggccaaaaacaggtaacctctgtcctcttctcagctccggcttgtttttctttttagcgtttttaaaatgtctttatgatttataaataacaatccgcctaatcacaacgaagacagtttggccgagtggtctaaggcgccagatttaggctctggtccgaaagggcgtgggttcaaatcccacagctgtcataatttttcttccttctgattgattttgatttttaatcctctggttttttgcgttcccagatatataggttccgtgctcatggattttcgttctggtgaaatttgcaaggattttcaaatcgtttaaaatgttatcatctcagcgatgaggtaataccgcaatacatcgagcacaacaacccggagagaaatgcagaacgtcagtgtgtgtagctatccagtgaagtatgagattttcagtagttcggtcagaaatatattctagtggacacggttttttcccctcccttttcctttttgttcttttttttttgggggggggggggtggggagtggatagagttcagacagcaaaacaaataaaaaacaaaagaaaatcacaagaggattttgttgacagactgctgctgaaaatcagagtccatggtcaaaaaaaaatagtttttctgcaggaagacccctgaagaagtgaagagagaagatttagagaagaaaaatgtacgagagaggagaaagacagaaacattgggagggtaggcaaatcaggaggcgaggaagtagaagaaaccttttgcaaagtccatgggacaagcaagaagtcttatgaaaatatgctaaatgatgcttagctggctcaaatagattcttcaaggtatattatggttgcagacagttccatttttttttcatttagaaccttattttgcataaatttacattaccaagtcaaacaaactaagtcatgctgaaccttccttaagctggtatgctccatgatattgcaacaaagcaaggtctaaatggaaactgaccatcctgttgaagtaaactaagtactgaatgcttagaaaactcctgtttggaccaatccaagcaagtttcattacttttgtactgctgggtcaccacgccaacaagttaacaaagtctttcacacatctcacatcgccatttggccatttcctctccaatggtcatggccccaataccccagccatggcatcagtggccctttctcatcctcttcttccttgtacttttctcctgtgaatctaatcttccctgcaggaatggtgtagaggccacacagagagtcttcctctatccacagtctccaaaggtctcctctattgtcagcaagggatacagaactggatatcacttccagcctccaaagaactggatcaatggtatgtctgcatgttttccatcagtttttacccttttgactttggctgaatccaaccagaaactgtattatccaatttggtgttccttttgtttcttgattcaagaagaaacagctgccctaattagttagtatcttttctagctgcagaagttaagccgtgtggatgagcttaatttcttgtgtctatatgaatttcatggtatagagaggaggggggaaaggtaggtaggcaactcactgcttgtgtgagctctactgctgattgttgcacacgtttatggtgctgcagattgattttcagtaaaatcgtaatatggttatttctatgtttagattttcgctggaaaatatttaccgctgaaatgttgtatttgtggccgtcttttgacgctaggcatcatatttgtattaacagaacgaacagtacaacaaatgtggagttttctcagataaagctactccacatttgttgtactgttctgttaatactagctccagttagaaaatgttgacctagataattctaagatttgttctaaaaggcctaactacataacttttttttctgaatatttagcagatcttttcttaaacataggctagtaactagtaatcaagcatgtactgattcttgaatttttcctcctgtttgctatgtcttctatattggacaattcttctaaagctgacattctctcttctttttcaaatgttccatgaaatgacaatcctggcaaatttgtggcaattcaaaagatccaaacggtacgcatcttcttcacataatatgcatccaaacaaattgtagaataaactgagacattgcgtgcctaaattatctcaaaatttacagggccaatgtactacaatggcatctaccatgagttctaccagtataacccgaacggatcagtctggggtaacatagtttggggccactcggtctcgacagatctcatcaactggatccgtcttgaacctgcaatagaaggaaatactccgagcgacataaacggttgttggactggttcagcaacaatcctcactggtgatcaaccggttatcatatataccggtgccgacacggagaagcgtcaggttcaaaacattgtgctaccaaagaaccggtctgatccttacctgagggaatggaccaagccaaaaaacaaccctttgatcgaaccggtcggtccgggtttgaactcaaaccaattcagagatccgacaaccggttggataggaccggatgggctatggagaatagcagttggggctgagctgaatggctacagtgcagcacttttgtacaagagcaaagactttatgcagtggactagagtagatcacccattgtattcttctaatgcatccaacatgtgggagtgcccggatttctttgcagtattgcctggcaagaacaatggactggacctctctgcagctatcccaaatggcgccaagcatgtcctcaaaatgagcttggattcctgtgacaagtacatgattggggtttatgatctgaaacatgacatgtttgtgccggatactgtcttggatgacagacgattgtggttgaggattgattatggcaattactatgcttcgaagtcattcttcgattcgaaaaagggaagaaggataatatggggctggactaatgagacagatagtacgtcagatgatgttgcaaaaggttgggctggcatccatgtaagaaaatcagcctctaatctcctccttgagtaaattgcatcgtcggtacacaaacttgtcaggtgggtgcaacctagtgcacaaacttgtaaaatgctcgttttggtgcatgaacttgtttggtgcgtgaggaggaaggtgaaaaggacactacaatactacatggctaatcttatcgatttaggggccgattaagatactatgtaaacatatatctaaaaaggttgctattaaacatacacctattcaatcaaaaataaaaaataaaaaatagaataggatataatgatagtagaaaatgatgaaaaagccgagcactgatttaagggttagaaacatataaaattcatcaattccatgatgaaggataaagtagagaccaaatttataaatattgcatgtcttatgcatactcactagatgtatgcacgtcacatactaatcaacatcagcattataaaattaacattgtcaagttattttggtcctcgttcgcacgaactagacaagttcgtgtactgaaacgagtattttacaagtttttgtactaaattgcatccatctaacaagtttacgtaccaccaatgcaatttactcctcctttaattttatactatggaagcaatgttttagccttagcatgtcagtgtaacatactgatcctcattcgtcatttcataaaggcaatccccaggacaatttggttagatggtgatggcaagcgattgctgcaatggccaatcgaagaggtcgaatcgcttcgaagaaacgaagtcagccatcaaggcttagaactcaagaagggtgatctgtttgagatcaagggaactgatactttacaggctagttccaatttacctcaacaaaagtattatgttttttttttgcagacactgtagctaatatggcacaccattttcttgaagcaggcagatgtggagatagattttgagctgacatccatagatgctgctgatccttttgacccttcctggcttttggacaccgagaagcattgccgagaagcagatgcatcagttcatggcggcttggggccatttggacttgttgttcttgcctctgataacatggacgagcacactactgtgcacttcagggtttacaaatcagagcagaagtacatggttctcctgtgctctgatctgagaaggttaatgctttttcttcatccagattctgttgatgcttaagaactccctatttgcattgcactgataaaagtgaaatgatatttgtagaaatctaacctttgacagtaaacactaaaaaaaagaacgaagatatctgaaaagtctgaacttgctcttttgtctgacagttaattgtccaacattgtgttcatcatttttacttgtgcagatcatcgttgagaccaggactgtacacaccagcatatggaggcttctttgaatatgaccttgaaaaggagaagaagatctccttgagaactctggtgagtgaatgaatcagtgactctgcatctgcacgatcaacacaacacatctaggaagtgaaatgaacaaacagtccgaaacctgactcgccggcgtgcgtgcagatcgaccggtcggcggtggagagcttcggcggcggcggcagggcgtgcatcatggccagagtgtacccggcggcggtcgtcgacggcgccacccacatgtacgccttcaacaatggcagtagcacggtgaaggtgtcgcagctcaaggcatggagcatgacgagagcacaggtcaatgtcaggaagggatgaactgattgattaatcaaaatggaaacaagagagcaacatattacatgctaattgtccagtaagtagttaattgactacccattcatcagaactcctttggtaggaataagaaggaaatccagaatcaaaatttttagctgctcacagacttgttgatgacatctacttgctttgtagcaatatgtttttacttgtagaaaggagatggaaatcaaatcattgttaagaaatggttcgcaattggtaacgagatactactcttcgtgttttacagtcgaactgtaaaattcgttgtccgtcagttaattatcctgctccaactctcatccaaaatcattccgtttccacattgaatttattacttacccaaatgatgttttttactgagagaattcatttcagcatgaagcctatggatcatggtttcatgcttgatgaactgatgaaaaaaagtactgacttatcggtgatgttattgttggtggaggggttcggggaaaaaaaatctccgaacccaaaagaggcatttgggccgtagtcgtaggacagattcgatggcctttcagctgctcctcagcctacagtgtattcttcttggcaaaagaactctgcccaatcagcgaattaatttggcaagcgaaggcaccggcaagaatacgtttcttcatgtggctggctgtaaaaggacgctgtctgacagctgataatcttgaaaaaaggggatggcctcacgctgattgctgtactttgtgccaacaagaacctgaaaactgcttacatctgtttatcaactgcgactataccatcacagtgtggagactgatgcggcaatggatcagcgcttacttccccatccctgggagcgaaaacacatgcctgacagagtggtggttgcaggccagaacatgttttcggaagtgctacaggacaaacttcgacagcgcttgtatgctgatttgctggcagatttggaaggaaagaaatgcgcgtgttttcgaccaaagatcgagaagccctaaccagttagcagaggctatcaaagaagagatcttagtgtggaaagaagcaggctatttcgagatttgcagatcttagttttttagttttttagtgttgacgttccagttctttagtttgccgggctgtggttcctgccacagtctaattcgacagcctcctgtcgttgcaagcgaaaactacttgtactttgattttattcctcccaatcttaatgaaatttggtcgccggttccttcggccgacccggcagattcgatggcctaagtgggctggcccaattgctgttgcatatacggcccaaacgactctttggggttcggagatttatttcccgacccctatgtttcctgttttttgaatcagcgtgtgttgtttttctgagctgaatgttgttgtcgagagctgttcttggacggattgcgaaagaggatgtactacatctgaatgaaatggaaggtttgctaagtttttgaattgatggactatgtagtttgatacgacgttgctttgacgatatcatcgcatcattgttcacaactggttcacaatcggtaacaagatactcgacttgtttgatctgcagattcgctgtccgtaagttaattatcctgttccaactttagcttctcccagacctattgatgacatctactagccttgtagcaacatgtgtacttgtcagagttaagaccgttctctcccccgagtcggttctccccaggggcggctcgggaggcgacccggccgcccctcttccccctaccccaccccccgaagccgcgcggccgcaaggacggcggcggcggggcgctcctcgtctcctcgcgctcggacggcctggggagccacccggggatgggctggcgacggggtaggcggcggtggcggcggggacgggcgacggtggctgctgaggtgagtgcgcccggtggtgtttgtgggtggcgacggcggtggtggaggccgcggatccggcggcggccggcggtggcgtgagcacgcaggcaccccgcggcggccactggcgtcctccggcgcccctctaggcgtcggccggcgttggtggtgagggggacggccggatctggctcccttgcccagatccggcgtgtcctcgagtggggacggggtggtttggcgtccggccgtcgtgcaggtgatgtgcatattgcaggtaccctcggtgtgtaggtgacatttggtagctcccgtcgtggatgctatagttgatgggtgctccaaggcgaaagtcttgctccgctctcggtgctagcaacggcgacgcccttgggcgccgttcactttcttgaaggcgtttgctactggagccctcgttcaactccacttcaagagttttctctgggtgaaaacctagattcgttaggatcggacgatgacgtcgttctgtcggcgtgaccttcctgaaggcttcgttttaggagtttatctcttgttggacaactgtacttaggttcagtttgtcaatgtcggggttttgccggttttcctttaattaaccgtgctgttgtaaggtttttgggtccggtttcccttataaactggatcaactctcttcttctatagtgaattgcaggagctccctgtctgtcccatcgaaaaaaaaacatgtgtacttgtatagacaggagacgaaaatcaaatcactgcgataaagaactggttcgcaattatggtagtacgtgcgataggggaagaggctcctctgacataccgccctctgatgtgggtggctgacatgtgggtccaccagctgtgaggctcatatgtcatcctctcaaagttagagggcaatacgttagaggatcacgtttcgtgcgataggacttaggagcggatcggagaagaaatctccgaaccagagacatttgggccgggggtggatggtgattgacccagttcgtactaaacggctggcggcgcaaatgcctcttcggggtttgagctcccatcggatggcaaaaaaaaaactaaattttaaattttcaaatttgattttgagatatttttaaggtagtttttttttcagcattggcttttaagtcaaaaaacatatatataaaagttttacctataaatccatttttattccctaataaatagttttggcttattatgaaaaaaaccaaacgatggggctctcagactcttctacaccgaaccccacaaatcacacgtacgcccgtgcgagactcaacgacgagtgcaggtggaagcccaggttttcgtgcgatgattgtttactccatgaatttgcttaatattctactgagtaaaattgaatcaatgtgtttctttttacagaaacacaaacgcagacgtccatattgcgcatatactcactcttataaatacacaccctacctctataatcacctttaaaaagttgggttggcgtatcttaaaattgatgaagtcatcacgaacacattgttgttgagggtaggtagtctatcactaaaaaaataattagccgtaaatgcgagtattcatatcaaatctaagttttgaattcggatgagctggttcaccgtaagatgaaagatgtttttcatattcttggaatgcgatgcagtttatatagcccaacgtaaaaggctgactaaattttgcattggttaagtacatagttccatatgacgttgtttttaccctaacatcacaacattgttcaccagtttgctagtagttaaataaaggtaaatgaattgaggaaaacaatgtaaataagatgaggtaaaaaaaatcgtaaatatcacatcttgttcaccagtttgctagttgaataaaggtaaatcagttgaacaaaaaaatataaatcagttgagttgagcaaaataatgtaaatcagttgaggaaaaaaataaacataaatcattttggagaggatgggctcgaaccggagaaaaaaaacgattttgctatatctcactcgaaagattttttcttatctctcactcgattttcttactcaaatttacagtgcattttctggtaagttacagtgtaatttatgaaacttacactgtaacttttgtaagttacactgtaatttttgaatcttcgcatgtaaattttaaattttgtattggatttggtctttttattgaggatatggtaatttagtgtccattatggtatttcttaattgctttttgctttttattatatctatcggattttaatctaaagattaaaaatctgtgtgatacgattataaaaatctttcgaaagatgtataggtactcccaaaaaaaaaataaaaattcaactgagggcccatccgggttcgaaccggagaaaaaaaaataaaaattcatccgagggcccatccgggttcgaaccggagacctattgatctgcagtcaattgctctaccactgagctatggacccttgatgtttccaaaccaaacagtttattacttgatttccatatttagcaattagccgattcttaatgataaaaaataattaaaatctaaatgaaaaatcacatatttcctatagcagaataatgcgtgacacattttatgagaaatatttttatttatcttatacaatattatagtatatttttttagcaattagcaaacacatgcatttagctagccatctaaaatgcacatactccctccgggttaataatatttgttgttttggacaagagtatagtctccaaaaaataactttgaccattattttctgttataatatgtataaaagtattaacaaatatatgattttattaaaatactttttaagactattctatacatgtaatcaccatatttgaaagataatgattttaaaaatgattcataatcaaagattctaaagtttgatctcatccttatctaaaatgacaagtattatcagcccggagggagtagtacttttagtcaaaatattcattttacctatcgtgaggacatggtcaactccaatctataattatgtgtgtagggtttattgcgtgtacaaattaactgggggaccgaaatttcagaaagaaaatatttgaagtttgacaaaaaaaattgatagaatttgaacagatgttactaaattcacaagtattgaaattttcggaaaaatatagtttcgtaccgggggttcaaaattcccgaaattttaaaaatttcaagccgaaattgtaaaccctggatgtgtatggattggaccaaaccatatatatatatataccccgatcgagtacaaccaaattagtgttgaattcgtattatattaacatgaattatctgtaaacacgtacgtttggtacgactccaattccgagattcttatctcgtgggagctaaagctatatcaagcacttccaagatcttggataacataggtaaagctaccacaccgcttccaaaagttacactacaagcatggagcggcatattcccgccgctttctcagctcctctccaccatagtagctataccaaatacacccttaatcgatttagtaatctttctagcgatagaacatactagcacacagaagggagtggattttaaactgacatcctctcgttatttacatatcatgcaaataactacaagaaaaaaaataagataaattaatatgtgatatatcactccaccaacatgtaagttaaaatttaaatttacaagttgcaacataaaacaaattaaactatagatagtttacgtatacaatcaaatttgcctttttttaacttgtagaaattaaatttgatgttgcttatttatgaagtaatatatcacaaattaatctaccttaatgattctttctttaagttttttccataattattcgagtgacacttaaacaataagaggagtctccttaagagtttagaatatttcagatgaccaggtgcacacacaaaatagctagcctcctgggtatacacgtatgtttaacacgaattgttcgacaatcttggacaaataatttagtatagttcggcaagcaaacatcaaacaagacaactatgcatagatatactactctcgtgctttgactcaatatatacagcagcattagttaacggttacaaaggcacacgtcgacacacaacacgtaagagtaagagacgaactactaatccaataattccatgcttaattagtacagacaaaaccaacgcgtcaaaatgaaagccatctgaattaactggagtatcttccaactactaatactaattaatctaaccactaaagtctctttcattgcatgagataatccatggcttttcccacaaattcattcattcattaattccatcactcactttgcatgatggctgctagtggccgtcgacgacgacgacgacggcgccgccatctccacgtagttggtgatcttctcctcctcctccggcgacggcggtcgagtggcggcagagtcgtcgtcgccggccatgttgtggatgcggaagagctcgcccatctgctcgagcgtgcgtccacgagtctccgggaggtaggtgaagaagaagagccaagcaagcgaggcgacgccggcgtagaggaagaagctgccgccgatggtgatggccttggagagggagaggaaggtcatggagatgacgccgctggtgacgcggttgaggccgacgccgagagcgcagccgagggcgcggaggtggagcgggaagatctcggagctgtacacccaggtgatggggccgaggccgatggagaagaaggcgacgaaggcgaggatggaggcgatggacacggcgatggcccagccgccgccggtggcgtcctcaccgatgacggtgaggcctaagccgagggtgacgagggtggcgatcatgccgccggcgctggccagcagcagcggccgccggccgaagcggtcgagcgtgaacgttgccaccaggatgaagagcgtcttggtgacgcccacggcgcacgtcgtgccgagcagcttgttcttgtcggtgatcccggcgctctggaacacgcgcgggctgtagagcacgacggcgtcgatgcccgacgactgctggaagaagtggatgccgagcgccgacaggagcacgcgccggacggccggcgtcggcgacaggatcagctccttccacacgcgcctctcgccgccggccctcttcggcacggccacgacgtcaccgtcgaggtcggccgggatggccaccgcctccttgatttccgcgaggcgggtggcggcctcctccgccgtgtccgaggtctcgccgaggacgaccttggcgtcggcgaggcggcccttcatgacgagccaccgcggcgactccggcatggcgagcaccatgagcgcgagggcgacggacggcgccgcgccgacgccgagcatgaggcgccagccgagctgcaggcggaggcgcgagaaggcgtagttggagacgtagccgaggaggatgccgaagttgatgaacacctccgggaaggaggtgaggaagccgcgcgacgacgccggcgagacctcggcggtgtagacgggcgcgatcatgaaggcgtagccgacgccgatgccggcgacgaagcggccggccatgagcatggggtagttgacggagaggcccatcatgatggcgccgacgaagaagatgaccgcggcgaggatgatggtgaggcggcggccgatccagtcggaggtccggccggcggcgaaggagccgacgagggagtagaggttgaggatgccgagcaggatctccacctcgacgtccgtgatcttcatgtcctccttgatgaacagcgacgccccgcatatgtaattaatgagactgcatatgcaacatgaggctctctggagactggagagagcgtgtatatataggcagtactggtggctgtgtgtgtgatcgacggtcagagtaatcaattgatgacagtatgacatttggagcgtgtatatataagccatactggtgtgtgatcgacggtcaaaataatcagttgatgacagtatgacatttgcccattgcaacttgtttacttgtaaaggttggaacttggaaggcctccgtgccgagcccagctggctcgtcatccaccctatttggaaggcctccgtatcaactttgatcctgctaccatcaccatcgacaggtacacccaaaatatttcaaaaattcatatttttaaaaaaaatatttcaaaaaatcatattttctttggatccctcgtgggtttggatcccatgccactcgacttcattttatcagtttctcatggattctcctttccttgatttcccttttaccatcaaattaaaatctccattccttgatttttcctgtgcacttttgtttattttatgccatctagttacgaattaagaagcgggaaagctggacacatgtgcacatattgcctcataacaattcacatactgccatactgcgatacaaggcagtgcttctagcaattcagaaagtgagaaatcaacacaaaacataaccagtcgagttccaaattgtcttcagctaatatattgatgattcaaacagatgctaacgatgcaagttagaagagaggtaaatccataagtcataacaactccaactccaacactcaactatcaaatatagctgattctggcccagttctcttagacaaaggcgtttggacattgctaagagcgacgtagcaaagaggcaatcctcgacacaagactatatagataactcatttcgggtttttgagcacaatgatgaccgagtccccacgtaggaacatcttgctgatgaacctgtccttgttcactggaagagccttcttcttgcctttaccagtctttggtacctgcagcaagagtaacacatgttattactgaaaacagcactacactcaactggaacaaaagttcaaaacttcagataacgccttgcatgtacctcggtccacatctccctgacattctcaagaaccatgttgcaatggctatcaaatgccctcacacgacctagtaacttcttgttgttctggcaattgataagcacctagaaagaagagcatacacaatcaaaacaatgcatatctttagaagcatcaagtgtagtcaggagaaccacttatggtcggctaattctataggtaactcctaaagatacacttattaatataaccgcactgctagccgcaacaaagatctgaggtcggacccatacaatatacatcaagcagatattttcagagtttttgcctagtgtacacaaaatacagtagcagctatgaagaagtcagcacaaatttgcaactatggcttgttttcccacatcatacaaatgaccaaaattgacaaatggttacacatagcacagcatgataaagttgaggtatctaaagaaaaagacataacaccaagtgaataaattcaacatcctagtaactgaaagcaagatagcatatcaaggtatctaaaccaaaagatatcgcagggaatgaatgaattcaacatgcagtaactcaatatccatgacaaaatggcatatttcaaggtgtaaagggcaaagataggtgcgtgaattcaatccagcaactcatcttgctattgcaccaactcaacactccagtaagtaaacagactcagaaaatcaagtaaataatgaaatactaatcccacaacccacaacgattctggtcgccaaaagttcaaattaggactccatacgatacacaaacaagagcagtagagcatgttaaggtaatagcatggcgagcgcgaacctaagatatggacatacctagacaaaccatagcacaatccaagactactgtttgaactgataaaagtgaacaaaaagtaggtaattaagaactacataactaactaaaacagaaaacaaccttactgaagaagtgaagatagactaccacgttgcaatcaactatgtttcagaaaatgaagtggcagcccagatgcaacatttacactaacactacatgaaaagatgttgactatgaccaattattcagatacatgagaaaggctccattaatttaacatgacttacagagcatccttattggctaagagagttgagagaactacagttcattcacccgttaggagaagggtacttccttatttcagaaatccagatgttcatagacagttcaattgcaaacgaatcagcttctaaggaatatcaccaaacattcaaggcaaatcggttgccaaaacttttctaaggaaccccaacccatgagccagtttacaatctgtggctacattgtccattgctctgttgtaagaaattaaacttcttttgttctttgcattagatgcgataaagcttatcttatagtcattgagttcgcagatattagagttagtagaattgtctgatgtatccagttggaggatggagaaagctttaaagaaaaggataattacaatactgtggtgcccccacacttttaccactgtagataaaagtgtaccagctgtgaattattatttaacaaattcttgttttgccaaaaaatagcccaccatcagagatcgcacagagtaatagttagaactacctttaattcgtccctaggagtctgaaggccacctcaactccatcttatacttgcaaagagcaattcctgtaaaggggttatatagcaagggtgatcactttcgtactcagcaagtcaatagtagcaaaacatagatgcataaatgatacctttatatcctacatcatggtcattcatatttcatcatcaaatctaagtttattttgtaaaagggtttccaaaagggacttataaaaactaaaatacactcataacattgacaaagtttgtagcaactcctcgtacaaaagcatgaatcacgatttaatttagcactgtgcaggcttgtaccgctttacccacagctactctgatttttagggcctttgcattccattcgattgctagacttatcagagtacaagactttttccctcatttccatttactacactccacgacaccatatacgccgggtcgtctaatggggtttatatcatctcccatctatcactatgcattcgatggggttttatatcatctcccatcattgctacgcatttgatggggtttatatcatctcccatcctaactactcatagatggggtctatatcatctcccatctgaatactatgctcttgacggggtttatatcatctcccatcctcctacaactacatacccatgtggagtataataaacttaataaggtactaggcccagcccatcttgagacagatccatggttgatcggtatacatggttctctggtacaagtgaggatcaataatctttatatgtatatcaatatctccatcataatcagtctagcaaataatatcatctatattatatttattttatatgaataatggtttgatgcaatactaagagtaaaaaattttataaaataggtttttaattagagggagcgtatcctatgcacacaggccctcacgtgtacacaccgtgtacaccaactaaaaattatcaaaaaaattctaggaaaattcatacatatactttcaatagtattacatctacgtgcaaagtcgcatcttcaaattcattctacatagagaataacaaaaaagataaaattctgacaaaattgcaacctcaaaactgtcagattttttgtttttttgttacagttaaaatataatgaatttgacgttaagattttaaccctaggtgtaatacaattgaaagcatgtgtatgattttttctagattttttggtgacattttttagttggtgtgcacgtgtgtacacgtgagggcctgtgtgcataggatatgttgccttaattagaatagaaggatcatcatctatcaatatgatcaaagagagacttgcctgagtttctatagttttttaattttttgaggttaataactgcctagcatttgccgagcctgagtatctgtagttgaaatcgaaattatctagtgccgattgacccattttccattctagctttatgaaacttaatcatgatgtcattgttttccaactaattgaaccatgtgccatgaattaatattaatgatttctatttaggatttaattaagtgcgcgtcgtttcaaatatgcacataataaccctgtattaagctgatacccgatgggtgagagggggatctgactattcttatgttcttatgtaacaggagctctaaggtagtttatcccctcaattcagtattcaatttgtcagaacaagcaactcttagtttatcccctcaattcacagaacaagtaaagatgtaccttctaccatcctcgaacagagctaaaagagcatctgaattaatacttttccaccatccctcggacagagtaactgagttaacttaggctgagtttgagtaggaggagattaagaagattgggaagatacgcaaaacgagatgagctattagagcatgattaattaagtattaattattttaaattttaaaaatggattaatatgattttttaaagtaactttcgtatagaaactttttgtaaaaaatacaccgtttagtagttcaggaaacgcgagcgccggaaacgagacaagctcactcacaatcttctcctgccgaacgctcccttagactacttttttcttttctttttctcttctcttctcaacgtctcagttctcacgcctaggcaggaagatgcaggtgtgcggccgacggcggagcgggcgcggctgccggcgcagcgggcgctgcgacgcgcggggaagaagctggagagggggagaggaggc

SEQ ID NO: 80002 - DNA, 762 bp, Oryza sativa
ttgcgaagtggacacccagtcacccacccatgtccccgtgttagaaacttctggtaactaaacacactcaaatcgaagaattacaagtttcttgaggatgacatgtagaactatgaacaaaacaatattattgttttatttgtaaatggtgaaaaatgtaaagataatagtaacaaataattttttttgttgcagatgattgcgacggcgatcgtggtggggatcacgctgcacgcggggaaccatctggcgtgcgatttcccgaggctgatcgcgtcggggccggaggagtaccggctggtggcggacgcgttcgggccggagaagccgacctacgtggggctcctctcgggcgtggagggcatcacgggggtcgccatggtggtgctcatgaccgtctccttcacgctggccacccacccgttccgcaagggcgagaagggtggcagcggcggtggcgcagccgccaccgtcctccccacggtagcgcggctcccctcgccgttcaaccgcctcgcggggttcaacgccttctggtactcccaccacctcctcggcatcgtctacgctcttcttatcgcccatgggtacttcctcttcctcgtccgtcgctggtatttgaaaacggtatgtgccatcacaaacatccttaaaaatatccaattattttatattttttccttttttttgcttgaatccgttacggattttttgggttttttttttaaaacggtgagggtgacggttttctgtttggtccgg

SEQ ID NO: 80003 - DNA, 546 bp, Oryza sativa
agaagcccttgtcgctacgcttgcgtatccaacaagatgatcggagtgcggtcttgttctaggtcttgttccccagtcgactgcctgtggcatgttaatcgggcccttatattctttgtcttccgctgttgttctctgatagttgttggcctacctggccctaatgtaagtatttaactcttttagcctgaattaatttgtgatatgttgtgatccaactatgtatgtgtgtaccaactactgatccagggattggtacggataaacacagaagattccgatttccaaaatcgggggtctacactcaacttgaggagtgcaatgccgaactagatcttgaaaaacaaaagctagccgatcttccaaatgccattgaagaacagaagtccagattgagatcggctatcaagaatgtggctgacatgactaaatctctcaagatcatccctggaaccgatgcccaagacatccaagccatcgaagaagtagatcaaatcaggcaacgagctttgtcggctatccagcgctatctttctcaatgacatt

SEQ ID NO: 80004 - DNA, 665 bp, Oryza sativa
tttaaaattgttttgctagtatagtcaagagccagcttggcctatttgacaaacatgtatgttctgctgtagattaacagaatgcctagtactatttgcacaatacagaaggttcatttgtcagaaagtacacactggtctccagaacgcacatggtagtcggtccacatgtttatcagtataattttatatattatattcgatgtaaacacattttattgtgcaattctcgaagcaccaaagaatctgacagctgccaagtgccaaaacgagtggttcaatttgttattttaatgcagcttatctttctcttatctcttttggaatgatatcatgtgggaaaattttcttttcaaacaattttgtgtaataaaaggcgaagttcaggttaggaacaacgcagagctttaacattgaggaatcttgttgcatttttttcagacatggatgtacatttctgttccattgatgctgtatgtcggtgaaaggatgctacgagccttgcggtcaaatgcttatgctgtcaaaatcttgaaggtaatttggtaactgtaaatggcataaactttttgtagtttctaatactaattgattgacttttctgcacctctaaaaagttttatgctatttcattagtgctgattgatctactttactgcctagta

SEQ ID NO: 80005 - DNA, 743 bp, Oryza sativa
attaccacctctaggatgatgccacgacataaatcttactccctctgtttttatctataagcatttgtacgtcatttaggagaattaaggttcacgaaaaaattatagatttatagcgtgtcattaagtgtgagttgatcgaaaatgggagaattaatgcttggtgtaagataaggaacaatttgaatactcatatagtatttgggacaagagggagagagagtagaccggaagggatagagattcgaatggaacacggactcccaatggaacacgcagtaacctatctcaaaagaggcaaaataatctcattacagccgtacgtgtacaggtgagttgtacgagtcgccagtaccagcttgcgaactgatggattaattcatgggaaacaaaagggccgcggggcgatgcatgcacgacgtacaaaacgcatcgctagcatggtacaaactccacttgttgctatggcgctatggcttgcatgcagtaatattctgttgccacttggagaatagattcgagcacacacggccttatccggtatgtcgttgaaactcgaaagcaacgtaacctggcccgtgattactggctctcgtgtcgtccaggtcaaatgacggtggtcgatcgggcgtccatagtctatgcagctatgctgactacctacttataattagctggtacgtatctactccctccgtcccataatataagagattttgatttttggttatactggttgacca

SEQ ID NO: 80006 - DNA, 4410 bp, Oryza sativa
  unsure (1)..(4410): unsure at all n locations
aaattcccgcagcaatgcgcggggttttacctagtataaacaaaacttataactggttaagtctctctcacggtaaaacatgtctattcgaaatcaaatcctaaacttgatagctaaacttgataggagagcgtttgtatttatggttaattaaatttccagtagagtatatgtgtgcacgtttatagaatgattgtctatgcgttatgtaagcgtcttatgcgcggttgtacggtgggttgtacatattgttttttttctaaaaaaaactaagacaggattagagaggtactaatcgtgccaccgacctccttattccttcttagttaagtaggtatctactctctccgtctcataaaaaagaatttagaaccggatatgacatattatagtataataaatatggacatatgtatgtctagattcatagtattaggatgtgtcacatccaatactagcttgtttttttatgggatggagggagtataatctatcaagatcgacatattcacatggctcgctaatttcatctcttttggcgattaattctgttggccccattgggtcactcgtagcatctatatttctatatgcctatatatatatatatatatatatatatatatatatatatatatatatatattgtgtgtgttacatgtcgagttctcaagtgtacacatttccagactccagtactgtagtagttgccatatactatctccgtcctaaaatatagctatttctagcacagtacttancctaaaatgaagctatttttctacctaccttctcctctcaaccaatcacaaccattctttttcatctaccttctcttttcaaccaatcacacacctttttcaattattctcacctattttcttaatacccatgccaacctcaaaaatacttacattttagaacggaggaagtactacgtaggagcagtagctatagctcgtcggtcatgtgcttgcacgttgcagcagccacctttccaagcgatgccaatgtccttatctgaagatctagcataacacgccggccacgtatgtgtcctccgtttctagtttatgatgaataagaaacggtttaattttgtgtgatgatgctttgttaacggctgtttggttcatcaagtaatgtaaagtttgggacatgctttagctaaatagtacttatcattctcccttttaatttacatctgggtgcatgcatgctcagctccccaggtcattagttatttgagggtggtttattaagaattgtttcagggatcagagcataactcagtggtcatcagtccatgctttgggggtttctgtccttgtcacgtcgggccaaaaataaaataaactcaagactcaaatcatacaggaattaaaatgaagaattttttaatctacgacctttagatggattcatgtacatagtacacctctagcatacgtacttcttccgttccaaaatataaaaattttgggtgaatgagagaaaattgtaaatgtcttagaaattgaacataagaccttagagataattaaaaccacacacttcttaccactgcactatcaagtgcattttagaaaatcacaagtaagtatatggcaattttacgcagatgcaccggcttaattctgacttggtgatccatcatgttctaacctggcatccgatcaaacacaatcatgcaagcatgttcctgtgcaggccatacataaattaaagtccgtacttacctgaaaaattaattaatttccagcgcacacagcctgcctcaggccctcagttagctattccactgcagaaaaggagtgtgaattaagcacaactccagagtccagacttggcgattgcgccaagctcatcactaaaatccggaattgatatgatatattcctgcttcgcttgcaaggcaacgtacgtacaaaatatatttatactttttttttctgaatcttctttaatttgaagtctagctatctaagctaagctagctaaagcttagcccggatggatcaaacacaatgcattcttgagcgacacgccgcgctagtctcgtccaatcaaaacattatcaaatcccattttaaaaaccgggagaaaattaatggaatctctccggctgatgcatatgcagctagcttgccatgttacccctccatggccgcgttgcgagtacgaactgattatataatcgcatgcccactctcgcatgccgtcctctcgatccattcatcattcgctcgctctcgctctcgctgatctctccatcttcttctccagctcagttcagtgacaagatcgatcctaaatgggcgacgatggcggcggcgtgaaggtggcggcggcggcggcgacgacggcgacggggatgaagcagatcacgcggctgagggagctgctgcagaaatggcaggcgatggcgctgggggcgaataagggtgatgttgccaccgccggagacgaggaagacgaggaggtggtggaggtggctccggcggcggcggcggcggcggcgataccgccgttcgtgatgaggcggctgcagaggacggtgacggtggactccgacgacgagagctgccagagcccggagccgccggcggacgtgccgagggggtactgcccggtgtacgtggggccggagcagcggcggttcgtgatcccgacgaggtacctcggccacccggtgttccggctgctgctggagaaggcggaggaggagttcggcttctgccaccagggcgcgctcgccatcccctgcgagaccgaggccttcaagtacatcctccagtgcgtcgagcgccacgacaacggcctcgccgccggcgacgtcgtcgacggcgtcgtcgacgtcaacgaccgtgcgccgccgcgcgactagtagcagtttcttcgattgctttattaattaattacttaattaattaattagctcgcgatcgagacggagctagccgtcagaaatgattaatcgtaatccatgggggttgtaaacttgtaatggaactgcattttgttgtacgctgttgtaacacagtattcctagatgaaaaattaaaatgacatgtaatatttgattgttacgatctagccaatgcaatatctgtcgagctcttcgcgtgttactccatcggtctcaaaatataaaattgagtacgttgtactagattagatatatccaattacaaatttggataaaccatgtccaaattcataataagtatgtatgtttaatttgatacgtattttctttgtttcaaaatataaaggattttggatagatgtcaggatggagggagaactagattgctatatttattttgagacggagatattaccaatgaattacaatgggccgtgttttgtgagttaagctgaatctgaaaataaactaatctcttccgtacttttgaatcattcatgtgacgcgcgcgatgatctgtgcgtcaagtttgtccagttggacgtacggcatgcatggagcgctccccgctgttgccagcgttttcaattttatttttgttttcaattttaatacttgtgtgattttatccgaaaactaatcagaaagacagaacgatacaggcaaaaatcgctcgcataattgagtgttattactttgtctattacttaattaactagtacgtacgtaccatcaatcattttatcacacaaaacataaagttaattttagcttagctctgccgatctcatgctatgtcgaagccagcagcatcatcgagccaagatgtcaaagactatttatttatcactagccaataatcctaaaaaaataggcacgatattaaagactatttatttatcattaggaaggaagcccgcgcatatgcgcgggcaattcacttattgtttataaaaaaaatactaaaagatatctcaccatattcactataagaatcattacctagaataaaaaaaaaatatttattccgtaaaatagaccataaactttaatatactatatgataatgtctattatattcaaacaaaaatcactttattatcaccatccttcacaaacatacgagttaatatgtgttttgtttttttcttttattatgcatctaatcacttatgcattttcatgggtaatatacgaaagaataatttatattatcaaaattgtttatgctagttattaacattattaagatgatattggcataattataaagagttataatgtggttccacgtgctattttcgatcgtacgcatgtatgtacgtacgtatgtacgcacgcacatatgtatgtttttcatggtgaatatatagtagtctctcggatctatataatttctcttggcttttttttacaaatattttcctcttgtaggagataatgtttgtatgtgtattcacaggatgggctgcaggaattca

SEQ ID NO: 80007 - DNA, 827 bp, Oryza sativa
tagtgcagtgcatgcacacgtcgtccagagaggcgcgtcccgtgacagcgcccttccccccgcgcgcgccgcgcgcacagcgcgtcgtacgcgcatcatctctccctcccgtacgttacgtggcgaaacacctcgaaacacatgcactcctcgaacccatcgaacgcgcgaggcacagcacgtcgcgcgcgcacgctactctcttccctctcttccccgcggccgtgatcgccttggtcccccacgcgtggcgtacgtacgtacgtcggcggcgcgcaggtcgatcggcatggccaccaccccaccgatcgagtcgcgcactcgtgtactccgtactacgcatggtcgcctatcatttccgtctcaaaagtttcacatgcgtgtgcaataatccgtgaacaaaaagatgcactgaatgggggtgaaaatggccacggaaattcctgatcgatcgagcactgtttctatataaggagtatcgtttccgaccatactatttttgactatttttaaatgttgttttttcacaattctttctacatcgtattaatgtggtcaattactgaccgatcgaagatcgttttcgaagaaatgctaccgattcgatcgtttccgaccggttttcaccccctttctgaatctgatgggaggcactatcgatggagcgagcaaacacgcacgtgtactgtagttacatgcactcagatcgagctctctttggatggggaaataaggagcaggggtaggtccggttggtggtgtgtccatcgcaccagtagcgcccgatgtgatcactccgcgaagagaggagtcgtagagatcggata

SEQ ID NO: 80008 - DNA, 4692 bp, Oryza sativa
  unsure (1)..(4692): unsure at all n locations
ataaggcacaactacttcttaaagttgtttcataatataagagcaggtacaatagcagactattagccagctgcaaatatattttaatgagataaaacatgagagagaagagcagcgggctacagatctgtagccagctgcagcacggactctaagacgcaatgtgtgtatgccatatgggaccatatattaatagtatagtaagcaactattgtatgaattggcttttagattggctatatatggattggagccagtagtgggctatactattaaacttgctctaaggcatgcatgtcattagctagcacctcttttttactaaaatattattatttaaatcctacaccataagatctctaattttattgggtgcatgctttctatttattaaggtaacccaatctatgagatgataataattatttcttggtctttgggttaagagtggttgtgccttatattttagaatggagggagtaggtcttagacttttggaacaagggagtattatattagggattacatcgagatgctgatcaaagccaagagtgttttgatttttgaagcgtaaaaatgttatttactctgttcttcttctctttttttcttctttttttgcatcaatgaagggcaaatgtatagctcgaagtgatactcaggacgataacactgacccgagcaatagcgatagccatggcctgaacgacctgcctgccaaggttcgccgctaatctcttcatcccaagcaaaagcttactaaatcgattctagaagtaatcctgtcacgacctttttttttttttttttttttttttttgcatagcagctgcccttgcaggatttgggacgtcatcttgccgaacgatgcgcgcagctgttggatgaggctatgagagaaatcaaaattttaactcaggaaacgcaagaagtcatgcaggcattggcctcgaaacacagtgaggaattcaccctcgttatttcagatgtaatggaagccatccaggcagagcacgctcaagtgaatgctcgattacatcgtggaatcaaagatgcggatgctgccgatgtgcaggcagcagcaaagcgaaaagctgcatgactacacggtaagctcacacattaacagtatgtttactagcagtaccatttttcgttgggcctatcagtgaccatttggttccattagtaaaggttataatatattttcaaagtgaaaaacacttacaattcctgtccacccgcatgtcgaagaaggtgccaagactactcgtaaacgaagcaagttgtcacgcgtggcttctgcagccaatagatcccaagcccccgttgatttgagaggtatttcgtttcacatggtgctgcacttttccgtaaaatttgatgatttcacactattcgctaccactttgatggtactaacacttgtgataatgacttatgggaccgactgagtctatggcaataagccaagatgtcaaataagcgaagcccaatttgtaaactgtaaaagaaaatcaaatctcttgcatttttccactgcatatatactcatgacacaaacatttgaatcacattcacaggtgacttgttagggccaagcaactcggaaaatgaagcaagcgagcatatagaccaacaaagctatcaagctgttgaccatgcaaatccgatattgggcatggcccctactgcgcatcaccgtccattgaactcatcagcccaagtgacggcagcagtccaccatgagctggatcaaggttagcttgccaaaaaaagagtaaaaacactgaatacttgaatacttgtgcagtaatgggactatttttttccccacaatgcaggattccaaatgcaagacaaatgtggccttgaatggttggtatcagcagcagctgtgggagaagccaccatgagtacgcatacatgcctcatatccttcaacccaccccacgcatactttagagaatgaaatgcatctgtcgtgttttatgttgcaggagccagtgccacattggatcaaagcaacgatgacaacctcgcggttgtcacgtgccaacgacaaccagaacattgcgagacacagatgacgaaagaggtggcatgtccaaggccagcttgcatgtcaccgttttcaatgcccatacttcacgaatggccaaatgctaaattagctcggaggttgtaccgttggctggagttgaagtcacgtgatgaagatataaccgggtctgtgaaaaacaatctttaaaaatgtgtgaattttcattacaaataaactttgtgttgcttattaattgtttatcctatatgaagggtttggttcaagcacgacaagcctacaccaattgagataagtgccatgaagctcaaaatgcaggtcacccacggtggcaatctatgtatggacctttgttcggcatttatcagactctaccaacagttagatgccaagatgaatacaaacccatctggacagcgttggcgccacttcttcccaccccaatttgcggtacaccaacatccccaacatttgtaaaaacataaatcgtggttaaacaatgatcaaagcttgatgtcttttccccttgattttggttttataaagctttgatgattgagccaaacttcagttccatgaaagaagtcagtgacatgtttgatcaacgtgttaatggctacaaaatacagaactgtcaactggtacagattttcaagacaaaacaagcctttttgtttttattatcaattctccttggatcatcacatatattggctagtgaaacattttatgtggaaactacagctcattgccccagttgaactagctggcggtacatggtcatgctacatttgggacatggagaagaggcaaatgcacattttggaccctgtcttgcagcagcgggagacttacaatgtgagtgctaagcagtaagcaccatcgaacagccacaatgatccacgcaggcctgttaacatgtataaacaaattctatggcggctgggatattaacccaaacgaatggatgttttcgtactacacagggattagcccaaggagccaaaggtgagtggcttctgccaatgccacagaaaaaagagagagattcatcccattacaaatttaaatcattttgctgctgcagtaggaactctggtttttacacattatactactcgcgtgagttccatgatggcaagctgcagagaagtctagattcggtgagcacacggcgttgatacatttccttatgtttttttctccaatttgtgtaacctgaaaataatgattcctcaattctccatcggcagggtagtattactgccttgcgcaaggatcttttgtaccagctcctgactatggaagggaactacgccgagctgccaagtcacattgcgagatacttggaatagttgtaccaagtgtcatgctggtcatttaaccttttgctagtatgtttatggtgcaagtatctaacgagaatttcccaagaaatctcctttatctaaaaaaaaactaggcgtctagataagccagtgttttctgttgataatagtgttgcactgaataaatgtatagcagctaagttgttttagtggttagtaccatttagcagaaacctttttgtatggctcccagcatgttactctttggaggagtatcactgaaagaatgggttttctgagtacctctttaattcagtagttttttttttttgcaaggaattcagtagttaaatttgacagtagaatcatctgcttctctctctctctctctctctttcatttgcagagtatcgactcatccctcacaagtgaaaaaagggaacagtaatgaaagcaagcataagagcaacatttgtgcaagacctgctgatatactactctatcaggagattaataaatcaggatgagcctaagaaatgaatagattcatgggtaaaccctaggatgagcctggtgcatagttgcaaaggtaagtgccctaccaaagaagctgaatgtaatatccatggcagataggcatgcttctggggcaccaagatgtcgtttgctccagtaaggtgcagcagagttgataaggccatggggctttttatgttactgtaactggtacgtatcttcagttacatgacagttgacattttaagttagggacaattgcttctttgaccctattctgaactataactactaatttgaccctacttttttaggtttgctcatttgatcctacttttcaaaattggagttgccgtttggccctggtttcatcacaccgttagggtttcatttaaaaaatagaaaaaaaatgtttttttatgccacaatggaccaaaatacccttgtacacatcaatattctcttatcctctccctctcatctctctcaccggagcttgtctccctctcctctttctcgccggaaatgggagggatggcggcggcggctcgacaaggcggaggacggcggcggcggcggcatgggagggatggcggtggctcgatgaagaggagggtcgggcggcnnnngnncngcnaggcngaggaacggcggntcgncgacgaggaggggcgacggncgaggcnnctaggcgacgganccggcggangggggggcccgcggggaggtagggagcgccgtcagcggcgacgcacggaggaagggagcaccggcgcacggagctgc

SEQ ID NO: 80009 - DNA, 528 bp, Oryza sativa
aattaaaagtttggttgaaattggaacgatgtgactgaaaagttagaagtttgtatatataggaaaattttgatgtgatgaaaaagttaaaagtttaaagaaaaattttggaactaaactcggccgtagtagctaggaagcatcggtaaaggacagcctacgtgtgtcacatggttggagatgaggacggtgacggccaccgccgcgcacacgaagagccagtcgccggagtagccaccggcaggagctagcagcagctgtgtacaacacgtactccggcgaggtaggtgagagttcagtgtacttccacacaccgaattgaccgacgacgaaagcgatgacttaggtcgacctaagcagctaagccaagggtttgttagccagtgatggatgcagcaacgcaccacactactactggttcagtgcaccgtgtagaacacggctgcattgcagatgttgatgcctgatctcttttttttttctcggtctctcggtctcagtctcgccttttagggctggtttggtttg

SEQ ID NO: 80010 - DNA, 1298 bp, Oryza sativa
cctccggccgatctagggttagggttttgggaggaagagggagagggaggaaggggaggtgagaggaagcacggccactgcaaggccaccgccgccacccgccctctccgtccctcagtccctccagccggatctgagagggaggggaaccgccgccgccctcgctcgtcctctatctggctagatctgggagggaggggaactgccgccaccaccctcccccctcccctcttcggccggatctaggagggaggggaactgccgccgccggccccgctgtcaccgtggccgtccccgcgcctcgccgtcgccggatcccgccacccctgccgccgaacacccacagccgctgagggagagagggagaggagagctgagggctactgagggaaatgagaggtgagggagaattgaggagataagacttaggaaaaaaattagcgatgtggcgcctatttatatgccacatcaatttttgcaggcggaccatataaaagctccgcctgcaaaaataaagagtatttttgcaggcgcaccgcttaagttgtccgcctgcgaaaatagatttttgcaggcagacaaccatctcaccccacggttgttattttcgcaagtggtcatttagctttcagaggcctgcccacctggaaaaaaaagctatcatcgggaaaaaaaatggttttttagcagtgtgaagggaatgtcggttttcggtaacagcttatttaatttggtggggagtggttgatacatgtcttggctttaggagagtggtaatcatcgatttgtagtatgagatgtccaacactttaactttgatatctaaagtaaccaatgttttacattcgacgatttaattgaaggcaacaatatttggttattttgcgtaaaaaaacaatatttggtcataatatggcgcaacaaaaataatctaaacttatactccctctgtccaagtttgatcgtcatatttcaaaaaattatattttcaattttgatcgtcacatttgcagtcagcagccgttccatctcgtccgatgcgctggccgttcctattcgcgtgcgaaattaatcaggttgcgcgcggacgcctcgggagcagtctaaaaaagcttgttgcatgcatgcaaaattaatggcaatcacagctggctacatatcattggttccgtcgtgcatgcatgggccattatgattagaaagatgtaagtgcaataatgagtagattagaaagatgataagtgcgttttctgtccttggtctgtgtgtcaagccaaaatatgacgatcaaacttgaa

SEQ ID NO: 80011 - DNA, 740 bp, Oryza sativa
atgtaaatttccaggatgttcatgtagttagctcccaaccaaagtggaatttggtttttgttcgtatacttcaacaatgtgaatttttttcctgcagtaaccttggtttttgttcctgcagtaattgaatttccaggatgtgaattttcaggatgttaatgtagttagctcccaaccaaagtggaatttgctttttgttctatacttcaacaatgtcacatgtcttagtttaatttggttttggctaatttagtcttgaaaacaaaatgcactgtagtaggaatcacttgagaaattcatttatttcataaatacacatgatgaaattatttttttaaagttctgttattggttgccctgtcgatctattgagttcacaaggatcttcgcttggtgagtataaattttgaattctatcctcttcgtctgtttctcttctcttgctcgatttgctttgctgttggtgcctctttgtgactgtactgtatctgctacttttttttgttaatcttgtcatggatctcggaaaggttacctgatttcgcatagattttgtggcttaagaagtaacaatcattgttaaagtaagtgagatttgaaataattatttcctaataagtgagatattagataatatgctggtaaattatttcatatattattactcctaataagtgataatgttaaatttttctcactcttcgcattagctacgtacaagcattataacaaacatctca

SEQ ID NO: 80012 - DNA, 683 bp, Oryza sativa
ttaactttttcatcgtatcacacaagggtcggcctgtaccactccaccataaataaagtaactggagtagtggagtagtactgtagactacccttttccagtcttcttcacttgttctttgggctacaatatggagtattactccagctccagtactggttccccttcccatcctcccactcccaccgatgaagggtcggaccgtcgggatcgccatcgccaccgtcttccccgccgcttcctcaccacccaaccttttctgctcgcggccaacgcggcccgccggcgtcgacgagccttaggaaggtggcaatatcccttttctcatcgctccgccgcttcctgcattttttgtactcctactgagtttcttttatttccgcctagatgaactatatgtgttgctttcaagcaaaatatggttcattacggcatgcatcattcacaaaaaaaaaagccctccttctaagagcaagtttaatagtatagcccactactagcttcaattcatctatagccaatctaatagctaattcatacaatagttgcttactatactattaatatatggtcttacatgtcatacacatattgcgtcttagattccgcgctacagttggctacagatttgtagcccgctgctcttctctctcatctttcatctcattaaaatatgtttacag

SEQ ID NO: 80013 - DNA, 1510 bp, Oryza sativa
gaaacatttgtaacaagtttgtggagcaagtaccacatttaaggcacgtttcaaccggaatgattggataaatacaagcaagagaaacacgcttatatatttttttaagatataaaaattttaggtgtttacttcgatagaagatatacaaaatgcacttatcatctcaaaataataaaaagggttaaaaaacaacaaaatccagatgaaaaaacattatttagaaagcaattgtttgtttaaatctccatccataaatagtggaaattttatgaccatcttctttagattttgacatccaagttgtatgtttccttatcatcctcatacttgtgtagctggactcggaattaaatctatattatctatatagttgatgcccactaacttctaaagctcaatatgcaagtgtaccatattatcacctactagcaattattatataaaatattttaaatcacatgtaagcgtgtattttaaatataatgcaaacatgacatattatttacaattttgttgtatttttagaatacaatatgcaaaaaatgtcaagtcattattttcatattatctaaacatatacatctatcatttttataatgtataacatgcattcgttcacatatatgtaccgcagcaaagcggggagtatcaactagttcaataaataagcaagagcaatatcatgtcatggtttattttcatattatctaaacatatacatctatcatttttataatgtataacatgcattcattcacatatatataccgcagcaaagcggggagtatcaactagttcaataaataagcaagagcaatatcctgtcatggtttagaggaaccatttcttgaggcagtaacaccatcggacacattctaatcttttagagaatggtattttgtacccggcctctacatccaactggatgtatacggctattaaaatagggaacttagccccgtaaacaacccaatctaaaattcgcttatatggagatttgaactcaagaccttgtgatacaactcaggtcactgcaccactaggagcattctaattggatgattaaatagattatggacagataaactcatgtaaatgaattaaatatcataaatgctctgaaaaaaaatcatctaattaaagttgatataaaaagcttctgaagagattgtacttaagagaagcatggcgtaaataatcgatatctccattaacagtttagaacatgctcaccagtcaccataggagaggaccgggacaacaagaggaaacaggaaacggactgattaggaggcaacgacgtgtaatgaaaactgttttattggatttaaatgagaataatgttgccagtgaaggtaataatgattcagagaaaaaaagatcaattaacctttgctaaatagtgattcgactatgtaaagtatagtgactgatatagcagctgtcgttatatatacacactcctgaatagcagcgagaggcaagaatggtcattccacatcatgca

SEQ ID NO: 80014 - DNA, 13338 bp, Oryza sativa
aaactgatcgataacgaccgtcaacaaaaccccccaagcttgaacctttgctcgtcccgggtgaaggacggaaggaaacaatgacttggttgttgatcaggagttgctactatgctgcatatctcaaagatacatgtgcaaggtatatgtactctctctcagattaaataatctttggcacggtggcttacccttacccctgattcccacgagacactgcttctccttggcttgggcggttggaagacagaacagcaattagagcaccaatcacccgatctttgttcaactcttattccggaagttttcaaatgattttggaaaagaaagccaagttcctcaaatgattcactcaatctctctaagtgtatcaatttgaattcctcaccaaatgttgccttgttgattcctactctaaggtttatatgtggagctcggtagggatcaaacatggcatacttacattcacatctgttactaagtcaaaaacttagactaaagcagataactaaacattctcaagatcaagatcgtgcataatgtgtgtggtatatagtggaaatggtgtatgaggaaaaataaaagaaaaatgcttctcctttgtgcttactttcttctcccaaaaatccttcttttattgattagaagagggcatgataacatttttttttcaatcatgctcatgtttgatggagcataaccttttattattattattattattattattattattattttcataaccatgcctttccctcctctttttttcttatcttcaaaggatttttcttttttttaggagaagaaagcacatgaaagtatggagaatttattttggtggtaatatggaatggaatattgcttagctcccagtgtaggagtttagcatgtgcatatatgtgcatgtatgatcttgatcatagagcatgagaagtatctacacaagtcacaagagtttgacaaagttcaatggaatggcaagtaaacaaaatgtatatggtttaatcatgataggacatttttggctctggtaggaatttatatcaaatgaggaactttcaattttatcattttgaaaaacaaaacatccggaattcaagccaaactagtatcaggatcatagcaactcatatttactatctcatatctcgcaacagcttagacttagattagcaagtgcagcccatttacctcaggttcccggataattgttggctacttttattcaatcttcgagagagtacttaccaagaatccatatataagagatataaaacagagcaactattcatcatttcaacaaagagaactagcttgtcttaccttgcatgactcaaacctatcttatctttttggtattttctattttgcaaatttttatgttgttttcaagttttataggatgcaattggaaagcaaatatgcaattggaaagggaaatatgcaatgtgatacaagttatctcagtggggggagcgaggtctccccccaagcttggctttcgctcagggtccttgataaggattgaacccctgaaagcgaaagtacgcctgaaggtcatcatgctgttgctgcatcatgttgttgatgttggtgaactgagcatcagcagattgttgccattcttgcgtttgagctatgtgttccgtgaggtcatactggatctcccccatctgcacatcaagggtgtccattctcctagtaatttcacccaagtcccaatgagaggaactcgagcgccattcacttggagatggagacacaccacttcatctgggaggttgattgtccccccagtggatgtcatgagacgcatgccaccggtcctcactggcgtttgcctaggttgagactccgatgctatggcgtggagcttgggtccatctgggtgcatccccggttcgtgcccaacctgcctcatacatctgcacgggtgtcgaggatgatgaacttccttgttcgttccttgtcatgttgcgcgtctccctgtatgttccacctgcacaagattcttctatggtctgcaggggaatggttagttcatggcagttgtacaaatgataccccacatttggtaatgggatttcatttgtacaaccggggaaaaagtatatcaaagatccatctgctccatgtttcaaaatatgcccttgcactagataggcctcataaatatgcggacgagcggctgagataaaagcaatctggttgctaacgacccctagcccttttgctatccgagtaatcagagaagtgcactcaataggagcagagaactttatactttctaaccattgtcttatcatacatttcataggagaaattttgatctttctaaccatggcaaacatgataattaattcatctcccctaatgggtctcagatcacttctaggaaacaaagtcatagcaatccatttgtgcatgagcccaagtgtaggattatggatatcattcgttctaggtttcttgcaaattggagcaccagaaatatcttcccaaaacctatttttctcgaacccagaaattcctttctggagatcgattttacaggaatcgtgaaaaccaagaagtgtactcaagcctttccatgtgagtgtgaactccttacggaagaagcgaaaagaaataccatcttctatttctttcaaagtgcatagaaattgcaaagtaagcaaacgagaaccaggctcatctaccacaacaaatctctgccaaccaacagctttccaaatagaacgaaattcaacatccaaacctatctttttcagcagctccagagagtattcttgagtgtgagcatattcccggtcgctcagcatgtagtaggcttgtctctcccgatcactgacaaggtcgaggtcggtgtcgttcaggagtcatcgcggagcttcggcgtcttccatcgagacatcagctaatgaatgagtgctagattcgccatgatgacttgatgaagagccaaaccccttgaacagacaagacagttgcctcctcatactgcacaatagagcaagaacggactaactcggcgggggttaggaatgacaagaatttcacccgccagttagtttcaccaaagcaacttgtatatatgcaactaaataattcaatttgagggaaactatcaaagcttgaatgaacttgagagcaaactttggagagggaatgaaaatgtgttgaaatggggtggaattccctctctcggccggctggctcttatagggtacccataacggacagaaatgacatgtgggacccactagctgttaccctgccaaaagcggcaggtagcagttgcctggccggttcggccaaaccagtgggttcggccgaacccctggtgggcccaaccgaccccactttcggccgttggaatccaacggtcagtgtggtcgtggcatagtgaattttcgttgaaaattttattttggtttgctctgaaaaattcatttgaagaatttcctgaaaattcaaaagtcctaaatgcaattttgaaattcaaatatgtgatgatgcaaaaattcaaattgttgaaagcaaatatgcggatacataccaatttacctgtttgcgaaggtcgcgtcattttgattcagttcacggattttccacccgtctccggaggtgatggagcgggtgtctttggcttttccttccgcaccttctttgatttcggtgcggaagacggcttcttctaagctggctgctctgactttttggcgagtgcaggtgattttacctgcgtcctccaataacggttcctgggcatcgttgtttcctcctccaggaaattctgcataaacttcacgaggctgtccgtcttgggtggctccacttcgaccacttgaatattctgtgggttcggcccgtactttatcctgaccatggagcattgttccgtccatggttggaactcaaacttcacttccttcccgttgatgtggaaacggatactccccattcccacgtcaatgttggctcctgtggtgctaaggaatgggggccccaggatgagtggcgtctccttcccgtgtccatgtctagcaccacaaaatcaactgggatgaagaaatcccgtatcttgactggcacatcctctgctatccttgccgggtaacagactgatgaatcagccagttgaaggcgcatcggttttggtgccaataccgtgaagttgagcttgtcgaagacgtcttttggcacgacgctaacactggctccaaggtcgcacaaggcctggtccaattgttgtgccctgatcgagcaggtgatcgtaggacaccccggatctttctccttctccgggagcttgtggagtatcacgttgctgcattgttccatcagcttgaccacctctgttgttgggagcggtctcttgttgttgagtatctctttaagataacgggcgtatgttggcacttgcatagcgtccaacaacggcacgttgatgtggatcttctggattacttcaacaaaacgagtgaattgctcgtccactgacggtttcctaccccgttaaggaaacagcagcaaccgtgtgtcgcagtactcctgcggcatggtcttttctggctgaacctccttgtcaaccgagtcactagatggcgctccttttgatatctcattagttcctgcagggtcaggatatggcagatcacgagtggacttacctctcctcgtcgtgatcgccttgacattttcaatggaggggtcgggttgccccggaatcctcccggattcatttgcagggactaaagattccaactgagctaactgggtttctatcatcttattaaagctcatctggttttgaaatgcggaagcaaagccatctagcttgacatttatgttctctaagatcttatcattagcagcaagctttttgcttagcacatcaatggttttagcttgcgcaaaaacaagatccttcaaggagggttggttagagaagttaccgttattattacctcatgataatatgggcttagttggttccacccctgacctccttgtggacgatacccgttgttgttgcccatgtacatcgcctcctcacgggtttccgggcagtcgttcccagaatgacccgtgctgccgcagacttcacacgtgacgtgtgagtccaaggccttgacggtgccttgtggccgtttctcatggtcgtccaagcgtttcatgaggaggtccagcttggcagcaagtaactccgtctccttgacggtgtgcatgcctcgctgacaggtctggagtcgttcctcgctccaacccatattggagaccatcttctctatgagttcaacggctccttgaaccgttttagagaagaaggctcctccagctgccgcgtccaagtgatcgcgggacattggggtgagcccattgtaaaaattctgcaggattagccagtcgtccatcccatgatgaggacaggcggccatgtgctcctgcagtcgttcccatgcttctggaacagactcgtcccttgtctgctggaaactggaaattcgtccatgaagggcgttggttttgcccatcgggaagaacttcgagaggaatgccgtagagcatttatccctggtgttgatagcagcacggttggcatagaaccactgctttgctctcccgaggagggacaacggaaacagccgcagcctgacggcgtcaggactaacgcccttgatggtgtacgtggtacatatctcctggaattgttgcagatgagcgttggcatcctcattaggcttgccacagaacgggctagcctgcgccatcgtgatgaggctggacttcaagtcgaaatccacatctcctatgttgacttgcggcccgacggccacattggcagcagagggagcagcgaactcgcaaagagtcttgctggccattgtcttgaaagttggtggcgctggtacggctggtttctctgtcggaagagttttttgcggagaaacgactcgcggcctgacgctccggaagaaagcttctagattttctttgaagttttccggcaggttgaaaccagtcatgcactaccctgttttcacaacaaaaagtgaaaacaaccaaggttagcctgcaaaggaaaatgactatacagaggtaaatataaagcattagtttaagtaatctctatcatgaatcttccccggcaatggtgccagaaatgcttgttggtatttcttaacgacattacgagaaatataattcccagcaatagcgcagaaatacttctggtatattatggttatagagttcatccgcaagcgcacagatataccattgtagcatttcacccaagagtattccaagggtatcgtatttattttatcccgtgggaagatcatgtagagagaactcaactaataatttatatattacttgccataatcatatctaagcaggggttaagataatccaagggtagagtgacacacaagcatttaactactcatcctcataataaataatctaagctaggtggaaagaaaagagaaaggaaatctattcctatacttctaatatacatagtacacatacattctagttaactgatatactagctaataccctctatccgatccctcctggtacttcgagaagccacccctgactgccgagttccttacgacagcccgtcatgaccatacaaccggggctaaatacggaggaataccctccccgaggaattaacttaggattatataccggggtggaggaatacccgtactgagctgtcaccatcagcggcccacctctcatccacaatatataatcccaaataatgatatctcataatctagacaccacgtcgaaactaccagatattactctaatatcatcgtcatgacatagagtaattgaataagaaaagactatacccgcaccaaagcatctcccagataagatagcaatatattcagtataacatgaacataatgtaaagtaggtactcatatactcggaaagtatttcaataccataaatgtatttagaagagtattcttataaaagtacaaagcttacaaaagaggaaagggaaactactagagccatacccgaactcttccgaagacttccggactcctgattcctattctaattctattccaccagctagatactactaaactaaacttgagaggaatgagagagctcttgcttgaggtgtgtgttgaagtgaagagagtgaactccttaaataggcaggtaatgacggttatggtggttggaaaggtcggtaatactccatcgttccctcaaatccctgcatccatcggcttcacgggaagttcggctgaaccaccaggttcggctgaacctagtgtggcccaaccagcccacattttggctagtggccccctctgctgcttcacttcgtagacttgtgaaatttggcccgattcatcgtgtcaagtctgcattcttggcccattcatacacaagtctgtttctcgacatcgttcgattgatctatcgtctaagttgatgtcgattttccttcactttattgtcattctctgcaaaaggttagtagacctaatacttgtggaatattattattctaacatatttatgcattgcaatcatcactagttctcccttgttttagtaatattgacggttgaaactgatcgataacgaccgtcaacaccaagaagcaggacaaattcgagtggaaccaagaagccgagaacgcatttatcgcgctcaagggctacttgtcaaattcccctgtactcgttgctccacacatcaatgaagaattattcctgtatatcgctaccacgccttattctatgagtacagttaacgtcgtagagagggaaaaagtgcaacatcccgtgtactacgtaagcgaggccacagatccaaaaactactctacgctgtagttatgacatcgagaaagctacgccactacttccaggctcacaaggacaccatcgtttcctccttccctttgggtgaagtcgtctggaataaagacgtggtcggccgaattgccaaatgggtagtcgagctaagccaattcgatgtccactttgtgcctagaatagccattaaatcacaggtcctcgctgacttcgtagccgactggaccatcccagaggataggccagccgcccaaacggacaataaaacctggaccatggcattcgatggagcactggacagccaaggagcaggcgtcggattcatcttgacatcctccacagggaaccaattcaagcatgcaatccatctaaacatccgggcaacaaacaacatggccgagtacgaagtactactcgtagggataagagcagcagccgcacttggcgtcaagcgactaatcgtgaagggagactccgaattggttgcgaaccaagtacacaaagactacaaatgctccagccccgagttagccaaatatctcgacgaagtcagaaaattggaacacaagttcgatgggatcgaagttcaacatgtctatcgaaaagacaacgtcgaaccagacgatgcgcttccaggtgagaaccgcttcagcccggaacgtttttggatgtcctgacaaaaccatccgtcaaggacatgaacgacgaaagcaccacagccaataccagcatcccgcaaggggctgcagaggtcacaaacgtcgttgcgaacatagagacaacggacgactggcgcactccgctaatcaaattattggagtcagatgagctgccggacgacgacacagaggccgagaaactatcctgtcaggccaagatatattgtatgatcggcaatgatttatacaagaaggccccgaacggaatcctcctcaagtgtgtatcatccgacgacagaaaaactcttctcctccacatccacaaaggcatttgcggatcacacgccggcgcgcgtactctagtcggaaaagctttcagacaaggtttgttctgactaactgccctccaagacgtatgtgaaatagtgcaacgatgtaaagcttgtcaattttttaagcaaacacaccaagttgctagcacaagcgctccagactatccctttaacatggccgttctcatgctgggggcttgatatacttgggccatttccacgaggacaagggggctacaaattcttgttcatggcgatcgacaaattcactaagaggattgaagcagagtcgacaagagaaattaaagccgacaacgccatataattcattaagggaatattctgcagatacgggttgcctcaccgcatcctcacagacaacgggtcccaattcaccagcggtgatttccaagattactgcatcgaacttggagtcaagatctgcttcgccttagtgtcccatcctcagagcaacggacaagtcgagtgggccaacagaatagtactacaagggatcaaaactcgcgttcatgataggcttatggcctatgacaaaacgtgggttgaagaactcccatcagttctatgggtcgtacgaaccatgccaactacatgcaacaaggaaacacctttcttactggtatacggatctgaagccatgctcctaacggagttatgacatcagagtacatgcgtacagaagcatactgacgagaaactagacgaaaggcgaagcgacaatgtgaatcttctcgaggaacatcgtgaacgagttgccattcgggcagccgcatactagcaggccctacgcccgtgtcatgagaagcgcatcagagctcgcacacttaccatcggcgattacgtcctccgatgagttcaaaaccaggcagggcgtaacaaactctcgcctaagtgggaaggaccatacacggtggtacgaatactgtgaccaggcgcgttcaaaattgaagatggcgacgaccttgcaaatggcgcctggtcgcgagttatctaactcctggaacattcatcaattatgtaaattctatgtataaagtcaatgtatcccaaatgtgtacaaatcaattatccaaaggtattttgatctcctcatgaaatacatcagtgttttccccagagatctcttaccacgataacacccactcttggatcgaacctattgatcatttacgccgtttcgacaagcctccgagaaacctacgggaattttggttggggacgcccagagcagataaggtctcgtcggatttgaagagccgaacaaccatgtaagacctggtcatgtaagagtgctcaaaaggtgtattaactaagctgtgtaatcggaaattggtttttccaacttcacggctgggggctaggcaaatcgcaatttcagataggcaagttacgggtgatttgaagagcggaatgaccatgtaagacctggtcatgtaagagtgctcaaaaggtgtattagctaagccgtgtaatcggaaattggtttttccaacttcacggctgggggctaggcaaatcgcaatttcagataggcaagttacgggtgattgcgccttcccctccgagagcagacctcaccgaggacaaggccgggggctagggagagtaccttgctcaataacgggccaaagacagcccgtaaaaagagtagtactcgttcacaacataacctgtttaagcatttcactatataggtttctacttcgattacaaatccttaataaagataacagtatgttataaattctttctaggtgtttcttttacagggactaaaagcctaccacgacggccattgccagttcatggaagcaaaaacctcctcagctaaaggagcaagggatcgcgccagtcggtcgacctcgtccgccgataaccgcgaacggcgaaaacccccgcgcaggaacccgagatccatctacgagcggcgatcttggatgcaagcgaggacgtggcttccatcgtaatggctggcgtgacgacattcctccttgaggttgatgtcgatccgctgtcctatgccctcaagctgagcacatgcccccctcatcaaggacaagtagcccgccgtactctcctcgggctccgcgcgatcaacctttagctgacgacaaacgtcggccatggcactgcagcagctcttaagatacgacttcagccaaacctcgcagcctcggagagcctctacggcctgctcctgcttcactaccacgagcgaccgctcgagttccgcgacctcgaacttcgtcttccagtatgcaatacgcctatcttgttcagcaatgatcccatcgagatcttaaaaaggggagaggatgtaagagatgccaccatttaaacaacatgacaagtttgaaagggtaacttctctatgccatcgcacccgagttctcgctagggagcccgaccacacccaggttaggcggaccagagctcatacccacctccccatccttaacaatggcaggggtaggcatatcgctcgaggaaggtaggtcgatgcttgcgacatcacgacatccgccttgctagacatcctcggaatctacacaactacgaaagacaaagaaacacgacaaatcgacaaatggcgcgaagtaaaagaagtcgctccgcccacaggacaacaaaagcgtttgtacaaaaaccacaatacaagacggagagagtttactcctcataaagggggaggatgctctccccgagaaccgacacgctggacgtcacgttctcccgcgtggcatcagcagcccccttcgccaagatctccttgaggtcgacgccagggagagctagcttcacgcacgtgaggacatgacatgcccccgtgtggattccattggagatatcctccgcaacatgggcggcgtgctacaacgggattgcctccatctcgcctgccagctccaacaataccgatgtcagcgatgtctcgtcggggtgcgtcgggatagaagactccacgccgcacgacaacgctagttggtgcaggcttgttaagctcttgcggagggagtcgcggagggaaaagaggatgtcttgtgtatcgttcatcttcttctctaggccctggcgttgcatctcattgccggccatgatttccttcatcttctgaaggtcttcatgggcaacctcgagtcgcgcctctggctgagccaccctcccgtccgctaccgtcgcgcgggccaccacgcggtccatctgggcctccaccgcccgagaaatgctctcaagaaggcggtggcattcgaccaccatattagaccaattggccacttcgggcggcggtaggccccacggactcggcgacaacaggggcgacctccacgcgagggatggtagcggtgggagatccactcatcaccgcttcactcccgctttgcgcggagaccgccgatgcgttcctactagggctagcggatatcatcagcaaatattagagatgtgacaacggagtgggtcaaaagtttcacttacttgccggtgggcaactttaacacccttctcttcggaggaggagcgaggctgcctaagtcctgcgtaagacggcgaattatgacttcattccagtatctcaagaaagaagggtgacaacggtgcgctttacctcaaagctggcagacttctgccgagaactggcgatagcgcttgacctcgcccagggctttcgcttggtcccgctgcctcctgcaatgacgggaacggaggaaatgttggcgaccttgtccttaagcaaggcggaggcatgatggtcaacaaggggaccgacaacatctgtcaatggcaaggcctacagaatttggagtcactttggctctccaaaagaagaaaaacataaggtgcaccagtccttgcttacattgatggcggccaccttctcggatgccgacttgtcgcagagcggggccggtggttcgacggccgttgaggcagcactgatcaagacttccttgaaccgctgcgtcacgatgtcacccggaagatctgaaataaatgaagatacaagaggatgagttaggcctcagccccaaagtcatcaacgaaagcaggaagaagattacaacataaaaacaagtaccccgcgaggagattcaagttatgtcctcagtcccgggtagtcgaacgaggatgtcattggaggtttagaggtccagtccccggaacgctctggttggacctcgggcatggcaagaaccgggtcgagttctttaagttcgaggtagaaccatcttgacctccactggctacgggatgagtggcattggagaggaatgtatttcgccttcatgccaccacgaaggcggaatccacaacatcccgtgatgaaccttgagttcctctcgacactcaaggttgttgttggcccgatctttcggtgagttgtgataactaccatttgggagaaacgttgacgatccgactacaaccgtacgagacattgtgttgc

SEQ ID NO: 80015 - DNA, 26318 bp, Oryza sativa
ccccccccccagatctaagcaggctaaatgataaaagaagattcatcatcaatggggaattgcttagcaacaatttctccctgtgttcttcctacaggtgtgtctcagggaagataatctttctcttatgagtgttatcacccaacatcggctgcaagacaactggggcttggccagcttcccatcagtctccctttactgaaagtcgtagagccaagatgtgaagtatcatcagccgatgtcatgaagaaaccgctagaatgcaaattccaagtctcagccgatattggcgattttacactttatcagtttaagcatgtcacctttgacagttggtggtcggattggtcaaaacacctcttctctgctccatcattctattatcttaccaagattgataaccgcatcaaggtaggccgcaatctacttccgactagattatgcccccgtgatctaacttgttttgctccctttttccttttttgcagatatcaaaaccactggcaccgaaacgcagcctgagtgatcggccaattttctatgcccaggttctcaagcattccagagggattaccaagatattgccctccccgatcatttcttctgctccttcaattgaaacactcatgaagactcttactggggtcccggctgccgatctcccaaattttggcaaacgcaaggatccttcttcgagaattgccgggttatcacccaagagggctaaggccgatgattctgctgggacaagtgcctaagcgttagctgacaatatcctgccctctctctcgtcatccccaccaaccagaattcgtcacgccattcgcaaggttgatattcagctttgccaaaaatgtttgtcttcttcatggcctctttgtaacccgtccttttccctattgtaggtgaaagcgtcatcgttgatagacccatcggccccatcggcacaagaaccgtccccatcggctcaagctgctccgtctgtccaagccgttaccgaagaaattacatccacctcttctaaggctaaggtacttcccccacttctaagcttgatcgtcggctaatatttatccatgcctaacccatctcttcctacaggatctgtccaacatgttctcctttgacgttaaagaatttttaaatgagggtgagggaaatagccccgagggagctcagataaccgatgaagttagggccctattggtggaaatcgccgatcggctcaatgcctctttggacacccttgtaacaaactgtgggccgatctgacaacgcttccaggagatccaggatcgaattccagatgatttatccaacaagatagcctcggccgccttcctggagcaatatgagaagcaatgtcatcgggccacaaagaggatagccgatcctcacgaagcccaggctttggatgccacgatcgacacttgccagaagcaaataattgaagacaaagcaatcttagatcaactcgctattgccctatcgccgatggagcacgaacttgccactttgcaggtgaaagaggcagcactggtcgaagagctgcagcaatgccgagccgatatattgtctgtagaaggaaagatcaagaacttgccacatgccaccgaggagcaaaggtctaaactgaaagcctccctcaaacacttggctaatctagtcaagtcctccaaagagatcccagggaccacagagcaagatcaggaggatttagacgagatagaccaaattcgcctgcgtgtgattaacgcaattgttgacggttgttgaatacaaaatttaagcatagtggtagggtttatttctaacaatttccacgagtgttggtgtatattcgtatgcagttgacaactgacaaactacctcagttgagaagaaatatacctggaggaggagaaacaaacacgtatccgaacatatggagttttggacccagaaacccaattaaacacctccaaataggccttccatccataccaacagaatgaggggcccaaaatgagtgtccaggacgaaaatcggagccgacggagtcgtcccgggttcagccgaactcttacggaggccgctggcccaggcccaggttgcgttcggtggataacgacttcccaatgacggttgtacctacagaaaccgtcatggacacgtgtgaagaggagaaaagagatgccctttggattccatggaggatctccacattcccatgaaagcttacactataaatacccctctcctctctcattctcacacacttgaagcatgagctgaattacaagaggctctattgtactttattgcatactagattagggatagagtagagtagaagaagtcggaggagttccggagttgtcggtaatccacttcttatttctttctgctctattaattactctaattataatataaatatattttgagtaatttagttttgcttggtgagaattatctcttggttagttcctaattagcgtgtaggatcattgttcactatagttcattataatatagtgattgctttagtgagttataaacacgaaagtagttattaactgcgtagatgctgtgtctaggtagttgatttccagtgtttgctacgcatctcacagtaggtgtgaggtgggtgtagaggtggtaacaaccctcaatatcattaaagtcctccctgtccgggtgcgcagtagagcgatatctgggagcagcgagctggctagtgccctaagtatcgcgttaggattgaagttaagctttctgtagacattgtttctcaccggtgattcctctatatcctttgcctatccgtaacttcgtgtccttggatgaacctgatttagagttgacacacacgttccctgtggaaaatcgatacctaagaatactcccaggtgaagtgctgcatcggtattttcgtgcgcttgcggattctatctgtgaggttaagaaataccaacagcaatccaaaatttcttgggtctgtaaatatcatggtcttagggcagtttagcctcggtgatagggaacttcagtttcggtgatggtaccctgactgtggagccaacgatgcccgctttgacaatattttgctaataatacttttggttggccctatcttgtccgtaatggttgtcctagaaagttttgcaaatccgtacttcaaattctctcaaggatctcaatcctatccgtgtacatatgctcctttaattttgtagtgttgaaaaagattgacaaaattatattggtctaagggcgatatatataacatatatcggccatctgaagacgatgtaaacaaatcggctatcttgtatcggcttaaatcaaccgatccatagtactgaaatcttctaagggcgatcatacacgtatctgccatctagaggcgatgctttgcacatcggctattatgtatcggcacaaaccagtcgatcatgcattgacccaaatacttaggaaatacttcttcaaatattttccgttgagtgctcttccataaacttctccatcgagcccttgtaacatgtaagctcccttataaactgacttgtagattcagaaaggtccttcccaatttggtgaccatttgtcgaatttattatcacgggtccctatcggcaaaatcaacttccaaactaactcaccatctgtaaaagacttgggcacaactttcttgtaataatgacgggcaactctttctttatccttcatcactttttccaatgtgcgtagcctggattgaaccaattcttccgattcgtctaccatgaggttacggtattcatcggctgttaactcatcttgcaaagcaatccttcttgagccgatgttgatctcccttggtaggaccgcttcatgcctgtaaaccaacttgtaaggaggaactgttgtatcgacccatggcaagccatccgataggaccacaatgcttctgctaacctggtatgacattgcttagggtaatccaaaatcttccttttgatcaatttaattaggcttttgttagatgcctcagcttgcccattagcctgcgcatagtatgatgaggaattcaatacttgattcccatgttctctgcaaactgaacaaattcatccaatacgaagatagatccttgatcggtcgtaatggtctgcggcacaccgaatctatacatcatatgttccttaacaaattcgattgcgtccccagaatcaacatttttcaatggaactacctcaacccatttagtgaaatagtcggtggcaactaacataaacttatgccctttgcttgatagtgggttgatctggccaatcatatcgattccccaacctctgaacggccatggcttgattataggattcatagctgatgtcggtgctctttgaatagctccaaacttctgacagtcttgacagcccttgtaatatctgaagcaatcttccaacattgtcggccaaaaatacccagcacgtcgcaataaccacttcatcttatgggccgattgatgggtgccacatatgccctcgtgtacttctcccatcatgaccttggtttgatgtgcactcaaacacttgagcagtaccccatcaatcatcccataatatagctcatcttccaataaaacatatctcaatgctttatatcacaattttctcgaagccgattgagagggattctttaagtactgaaatatgtcatgcctccagtcatcggctgcaattgtagtgacttctatcccgacatcccttgccatcggcttgtaccccgatgccccctgagctaaatcattagcctcagcattttgcgctcgagaaacatgtctcattgtcacaagccaaaaacaatccatcaattcccggcacctctcattctagatcactaacgtatcattcttgcactcatattcccctaccagctggctaatgaccaacagagaatcgcctataatctcaacgtcatcggcttcaacttctttcaatagctgcaaccccttgaggaccgcttcgtatttggcttgattgttatttgcataaggcttgatggtataggcaaactcaaaacttgcccccctaggtgacacgatcactaagccgatgccacatccgtgagtgcagacggacccatcgaagaatagcgtccagggtactatgaataccaggccgattgagccgttttggtgttcgacaataagatcggctatggcctgccccttgactgccttaggtgattgatatcggaggtcaaattccgtaaggcgaaaatccatttcccgatccttccttttaacactagagccgatagcatgtacttgacaacatcggctttgcacagcacaatgcattcattggacaataagtaatgccttaacttcgtgtaagaaaaatataggcataagcgcaatctctccactggagaatacatcgtctccgcgtccaaaagttttctacttaaatagaaaattgccctttctttgccatcaaactcctggactaagaccaaaccgattgccttctcatcggctgataagtataatttgaaaggcatccccttttgtggaggaatcagaaccggtgggttgctcaaacatcccttgatgttatccaaggctttttgctgctctgcccccagacaaactcctgatcggctttcaacctgagcaaaggcgtaaaagattctatctttcctgataaattagaaatgaatcggctgatgaaatttatcttaccgaccagagattgcagttgtgtcttattctttgggggttggatctccttgatcgcgttattgctactgtgagttacctctatccccctttcatgaacaaggaaacccaaaaactgcccagccgatacatcgaaggcacatttcgtacgattcatcttcaaaccatatctccttgttctttcgaaaacatttcttaaatcggctttatggtctttgaccactttggatttaactattacatcatcaatatagacctccaccaataagctgattagatcgtgaaatatatagttcatcactttttgatatgtagccccagcactcttcgacccaaaggtcatcacaacccactcatataagccgattgcaccaggacatctaaaagcagtcttatgaaggtcttcctcacccataaatatttgattataactagcattgccatccataaaactaccatcgaacacttatcaaagctgaataaaacaaacccttttctagccaaatcaacaattgggtgaatgagactttgtaaaaatagaacaagaggcttttaaattcatcggaacgttattgacatagattaaaatataaaaaaattgggccccctaattttttgggacccaaatcggtcgctcacttagcacaccctcatcgacagccctggttctatggcacatactctaagagctgaagatcgtggacataactgtagatgcacacctaaaacgatgagctctagcagggcttacgcgacggcggatgctgtggtataggtgtgggagatactgttttaggaagcccatgacgccaagcgatgtcggcaaagctcaacctcctcatcgtgccaaatcagaaagctgagaagcactccgttccagctccaccggggttatgacaggcagcgaatcgtgtcgacgacctcgacaccatccctatatgccttcccccttatctccatgtggcgtgtccctactaccagccaccacctcaccgtcgtgctccaacatgtggactccagtactcgagtcgatgacctcgacacgacctccctcctcatcttcgtggagcacatctctactcttgacctcctccttaccatcggagcatccgatgtgcagaggttccagtagtcatgccgacgggtggaaaatcatgctagtgacctcaacaccatccccgtattcttccctcctcatctcggtgtaccatgtccatgctgctagccttttcaccattgtactcctcctccatggctcgcatcccaaagctctagtctcgccgtgtcgtcagagctgcagtctgacgtggaggtacaggctatgacacaaccctcatcgacctctcctccgcccatgaccaccttcaactctaacgacattgtgacagtccgagcatgggagctcggcttcatcctccagtgaaggcttgccttcatggggatgagggaggggatgccgtgtggggcacatgtcaatgaggtggagagaacaagtatagtaggggcattttgggcaatacgaaaatataatggcctgcatgtgggtccaatcacatccaatttctataaaataccacatctaattgtaatgcatggtttctaaaaggtgaatagtaatggtgggtctctaaattgtagaatttgcaatggcattaatccaattaacccaaattcatttctaacgtttttatacgtgaagtttttatgtataaggttgtttctatgtataaattttatttggaaaaagtttctatatagaatgttttccatgtacaaaatttatatgtaaaaagtcatttatttataaagtttctatgtggctcgtgctagagatatatttgtaatattatctccttggtcggtttccctatttctcttgtaattatgtttctttaagtcggttgtaaagataaggatgcatcttgtctatatgtactcatgtccggcatcaatataatttatcacgttgactctcgtatacttttagctcaaaatcacatgtaggtttcgctcacacctaactcctcagcctcacacacggaatctacaccatgtcggctcatatattaggcctaccgatcaaatggcgagtctgaaattctaaccgtctatgttatgacggtgcccaactcaaccgatttctgcgtgtttcccaaaatgtttttggatgaagagatgtgtacatacattcaaaatatgagcagaaatcaatatagaagtattttggaatgtggagtagtttaaataaaaaaattggcatgccaaattatttgacattccttccaatgcaatacttatcaaagcttaattagtctccaaacaataacctagcaaaaattttgctactatcgaatcttgccactaccaaaaacaccccggaatcatgccattaccgaaaacatatatggcggcagaaatggctgggaaagtttttggcgggaatccaaagtgtatttcgcgccgaaatggcaactgtataaaatgcgtactcctccacggtgcgacttctactaagagagaacgagatggaaccgtgtgtgagaagcgagagcggcggcgtcaagaagccgatgacctcgccgccgatcgacgccgtcggcgtggacctcctccggaagatactccttcgcctccccaacatggcgtcactcgtcaatgccgccctctcctgcaagcgctggcggcgcgcggcctccgaccccgccattctccagcgcttcctcccgctccgccgtcctccgctcgtcggtttcatcctcaccgaccgcggcgacaagcccgtcccccgccactgccccaacatctacttcgtccgcaccaccgcccgtaagcccaatctggcatccgccgccgccgattgcgatatcttcttcgaagacctccccgatatcgattcggacgaggacgacgacgacggccgcggtttctactccgacgagtggcgcctccgcggctgcgacggcggccgccttctcctctcccgcggccgctacgggctcgacctcgccgtctacgatcccatctcgcggactgccatcttcttccgcccgccccaagccttccgctgctcgttccacatggtcaggtacgccattgtcgtcgacgacgccgacgcctcgttccgggtcatcggcatctgtgacgacacatccgccgccatgttctcctcccgcaccaacaaatggaccctgttcgacttcgacgcggaggcggatttgtgttaccgcttcaccgaccgcgacggcatgtccgccggccggttcgtgtactggcggtcgaacaccaagaacaacaagaacgtggagaggatcttgctgctcgatgtgggcaccatgaattggacagtcatcgtggcgccgtttcaggtaggggagtcgtactgcgtcgctgacatggcggagcacggtgggctctgcctcgtgtccagccaggagcaaaaccttcagctctgggtccgcagcagcggcagcggcaccatcaatggtggatggctgcttaagaaggagatctcattgttgcatcagtttgggtacttgaagaagctgcggagtgaggagtggatgaagagggtgcgtgtgctggcagcaaaggctggctatgtctacatggagttctggtccatcaggaaatctaattcctatcttctcgtcctcaatctcagcaccatgaagctggagatgtttcgcaacggttcggatgaacctttcaggggtcctgcatttccattcttgttgcgtttggcacctctgacgacacctagctgggatgatgcaaatgatcttcaggttccatctggatgatggaatcagtttactagctaatattatattaagtttgtttgccagattgcaattcctctgttttagtaggtaatactctgtttaatttgtttgatagattgcaattcttctattttctgttagagtaagtataagcctaatcactagattctggacattattttttaaacaaaagcactagattctggacgatttcctttttagcaggagcactagattgtggactgatgtataggtggtagtcgatttacaaagttatttgatctttgttctgaaccaaatacctctgtgtttggttgctgtgaggatggacaatggtacatcccttttagggcacttttgggattcgtggagctgcaaatgctagaacggaatgagttaatggctttgctggcaaatgttctgcttgcagacggggaggatagaattcgatgggtgtttgaaaattttggtgtgattttctgtcagatgtctataaagtttcatgtttcatggcgcatagatgggttataaaccaaaggatgagaagactttggatatgtagacttccaatgaaaatcaaagttttttatggcagttattcaatgatgaaccccctacttctcaacaactcttgagaggagaattatgcagacaataacaaactgttgattatatctttttttttcttttctttttgcaacttttgtatgtatttgctgcactgagtctatttggtggttaagaaataagatgtcaattgaacataagttcccttcaaatactagtttggcgctttacaaattcattttcttgtaacagtccaggagcattctgtttgagtggtggacagagataaagtggtagctggcttttgttctgcagttgaaagactggatgctgtcgtcaggaatttagttagcgaatgttcagtgatcttttggtttcattctgtgttggatagggtagtgttggctcaatgttgtctaagcttttggctatggtttgagacctcttcgctgcgctgttaagctgctaagcaaccttttatgttaccttaaaactcttattcagctttcaatagaagctggggtaatatcactttatccaaaaaaaaaaaagagaagggcttaacattcttagctgtgaccatttctctttgatgattgggcaacactactttggcagctcgcttcatcttctctccgggaatatctatagttatcagtcactacagcaattgattgacgttatttattttgaaaggaaacagttttttttttttgctagctcctgcagagaacattattgtccccttttttttcatctctgttagagcaggtacaataaactgactcagcaggctacaaaactgtgccacatcatcctattcctacgtggagggaagagaagtgaagagagagagaagagaacgaccgactaatttgtagcccggcgatagcgatttttttactccgcatcgctcgcctgcagccgcactcagcgattaaaaaaacacaatgcgggtcccacacaaccacaggggatcacgctttccatccgtatcgccctccccgtccgcatcgccctcctctccagatccccttcctctctctcgatcgccgccgcctcctcgattctcagcgcgcgacgcaatctatccccccggctcccgcgcttctcccctccctcccgcgcggttcccgcgcttctcctctccctctcccgctcgcgaaattgcctacctatatgacagagaaatccagttgctccaaaattccccatcgccatattccgccgcttccgatctccctcttccgccggccaccgaatcgacagccacctcgaccacagacccgctcctcttccaccttgtataatctctcccgcccccgcaagaaattcctgcctaaaaccctagttccccaccaccaacaccatgtctcgtcggaggaagagggaggtagcgccgcctcctcaggccgtcgtgagctctactgctccattcgctgttcctacgtcgcaggcagcgccatatccatatgggggtctcgggttcccgccgccaccgacagcttggcttgcttctccacagccacaagccatgcctggctcttctgctttccatcctcctgcggccggcaagactgatgtgcatcctgatcttgaagaatggtatgtctgtcaattggctttgttagttctgaatttgccatgctgattactccttttagtgctaaataaaaaaaaagagcatgtactgatttacttatttaagtgatgtttctttgaaaaacaaagttacaaagcatgcactgaattctatttaggctaataagatttgatatccatttgtgactgaaatctgaaacaatttgattgtggttattgcactgaaattttacagatattgtttgcatttaaaaattgttgacataagtgaccacaagctataagtttcggtgggatcataataaaaacctgaaacaatttgattcgattttcttgcacctaaacacatgcaacccatcattccaaatttaagcacacaatgttcagaattatatttctaatcagcatggccagtggcgaattcacctcccgtgcagctgcccgggcttcacagcgacgatccttcgctaaaatagattaattcccgggcagtgtgtatgctagttagaggtaataacggcaagcatgtaggctgcaaccgacacttgggttaggcctcggctgcctatggcatgcatgcctcacaagtactagcctcaatgcgtcacacggacatgtacagaagcattgaacaacttgctaagttttaattctaataccagttccttgaatgaatagactaacttattgttgctagagtttcaggcataatgtaatatttagatgatatatatgagataagtcttaaaataacagagttacatataagataagtcttaaaatatcacaatgttaatttttatggctttatacaaaaaaaatgaacatatttaaatattgtagcagtttatttgttagctagccttgcccaggcagtttattcagttgaactggtccccaacaaaataaattggctgtctttttaataaaaacccaatagattagtgggcttctgctataccttgtttgcaccaatgtagtataggctcgtctgttagccctttgtactggatgagtgcatgtttattttagtagtgtatagaactccatttacaaactgaatggccattttcttgttaaaatattatattattcggacacaacttgaacaagatttgcatgttcatgtgttctatacggggggttgaatctcgtccgcccggcggtttcgttaattttatcaataccccatcaaaccatgtccatcatgtggccgaagggagtccatcacagcccatcaatgttgtgaatggacatgtcgctaggactgataagcgcttgtcatggatgaaggatgaagacttgagattggtaagtggcttatgtcagctatttatttgttaatggcatgcatgtcacttgcattactggcaataataaatttctttttcctgaaattgtagatcagtgcttggctgaacaactcaaatgatcctatagaatcgaatttcaagaagaatgataaatattggggcgatgtagctgcagcttacaacagcactacaccaaaaaaccgagctagactagttaagcaagttaaggatcgttttggtaaaattaggaagaaggtcgggaatttttgttgctcttggaaggaggttaattcattatatgctagtggggagtctaatgaagatctgatgaacaaggcacagaaaatatatgagaatgacttcaaggatggtccattcttgtttatgcactgttggaatgaactaaaaaaacaaccaaagtggcatgcatatttggagcagcttgacaagtcaaacaaaaggaaggcagattacaatgatgttatcccccttgatgatgaagaagatataccacgaccaataggagccaaggcatctaaggcgcaacgtagttgcaaagaaaagagcaaggtccaagtttgtacaactgagcttgaggatgacatccgtaagtttatggatgcgcatgcagcaaccaaggaagggcaaaatgaagtgttagagacccaaatacgggtttctattgacaaccatgcagccaaaaagcttagtcgccagacagctatgattgaaacctatcgagacttaatgaacaaagacacaaggaagatgcctgacgatatgagatctgagcttgttcacatgctgaaatgcatgagagaagagatattcaacaaaaatcagtgaggtatgaatctctgttctaaaatgtagttagatgaaattaatttgaagccttcaaaaaaaaacatgtaatcagcccaaaaatcaatgcaagttagtacaaacacacatgcaggtagttccctctttcatgcttattaattgcagtttgtccaaaaaaaaagaactttctccaagttcccatactgattgcttattcattgcagctagtcaaaaagttatgtagtcagtccaaaattttgcacttggtccaaattatgatgcagtcaactcaaatattcattgctagtagtctcttatggtgaaattagcatgcaaaagttgtttgcatttaaagtggacctttgtccaaattcccatgttgactacttattaattgcagctactcaaaaaatcatgtaatcagtccaaaattttgcacttggtccaaattataatgcagtcaactcaaatattcattgctagcattctcttatgctgaaattagcatgcaaactactacaacctgtcaatctctatctatatattgactctcccattctggaattcccaaaccattccatccttttctagaaccaccatgtcagattcatcctcaaactcaaactcatcctcctactcaaatgacctagacccatccaaatttcttgacaagtacatttctgatcaaaatgtcctagactcctttgctactcgcatcgtagagaagatcaagaccaagtttgcagctgggctactcaagcgctaaagtggaactaggaagaccattgcaagggatcatgaagaaggtcaccgacgtctagtggctgattactttgcaaatcagccactctaccctgagagaatgtttcgcacaagatttcgtatgcgaaagcatctctttttacgtatcgtgcaagccttaggtcaatggtctccatactttactcaaagagaagattgttctggtcgcactggcctttctccacttcagaagtgcacagcagcgatccgtatgttagcatatggcactcctgctgatgctttagatgaatacttgctaattggcaaaagcacttccttagagtgcttggacacttttgcacgaggggtagttgaggtctttggtgggcaatacttgcgacggcccacaagtgaggatatagatcatatactacaagttaatgaatctcgtggctttccgggtatgttaggaagtattgattgcatgcactggaggtgggagagttgtccgagagcttggaggggacaattcacccgtggtgactataaagtcctaacaattatccttgaagcggttgcgtcatatgacctttggatttggcatgctttctttggtgtcgctggttctaacaacgatataaatgtgctgaatcagtcccctttattccttgaacaagtgagaggggaggctcctcgggttcatttttctgtaaatgggaatgagtacaacaatgggtactaccttgctgatggtatatacccagaatgggccagcttcatgaagacgatatcacttccacaaatagagaagcataaattgtttgctgaacgtcaagaaggtgcaaggaaagatgtggagcaggcttttggggtattgcaagcccgtttcaacattgtacgccgtccagcaaagaagtggaagcgaaagagtgttgggaaaatcatgctagcttgtgtgattctccataatatgattgttgaagacgagagagaggatgcaatatgtgacattgacctcaatagaattcctaggacatcaatagttctgcctcctgaagtaacttgtgatgataacccatgtttttctgatgtgctacgtaggagatctgctattcgtgctcgttcagtccatacccagctgaaaaatgatttaattgagcatatttggaatcggtttggaaataggcagtcaacataaacatggtagggtaataagcatgtggtttttgccttctttttttgtcatatatagatcatcaattaatccttgtgtaatatatttcaggaagatgttctcttgtccaattcatggtgctgaacttcttacaggtaacttgtatgaactaaatttactcctaggccagactacttacaaccatagtttagtgattctctcttcttatttgggatgcagtagcatggcattctcttaatgctcttacatgttgaactcatactgaattaacttgtttatgcatttggatatactggatctctcactcaattaattatctcagcaactatttctttgaaagaactcacactgaattaacttgtttagatttatatctccttcatcacatttttcgtatcctgtactaaggaaaaagcatgcagtagttactccttttagtgaggtttcattgaaaagatgattcactgtgcaatttttagtttctcatttattcatcacacgatgtacatgtcatatgatacatctgtcttttttttttcagcaaatgatggtagttcaggcaatggtcatatgatgcaatggttcaatgaagagtctctctttgattagatgaagaaatcgttatctatctgttagataacatatttatgtattttgcttaatgtcacattgtttgtgacttttggatttgtaaaccattaagtatgttttgttttatcctctattaccttgtcggttatttagacatgcactaccctatccttttgtttagacctgggatgatccattaatctacttgctatggtattttatttatctgttgttggtgccttgtatttttttatactacggagactcttcatcttataacacaaatttggttgatgtgcactgtattgtgttaactatgtggtgttttatgattacttctgtagcatacaaatgttcatgccacaacaaattggctacaatgatccacttcactcttgatcatacacattgacatgtgctagttataattaattatttgatctatgagatgtagccaaccaacagacaacctactgtatgagcagttggctgcagcgttggctataaaatggagtgtagccggcaatgggctatactattagccttgctcttagggcaccgttacatgccatgcgtgtaagatcactaccgaaagaatttctattgaatatacttggttaacttgttttccatgctctctcaaatagttcagtatatttttttcaaagaagcaggtaggagctctgccattttattttatattagaagagactaaaaaaagttttttttttactggagcagcaaacacaaaaaaagaattaaaaaaagacaactttggtaagaagcttttggagctacatttgagccggcgcttctccccttgatttgcacaatagtagtagctatgttgaccacatcttccactgtctcgttataaacgttgttgaaaactctatcattctatcgttttgctccagccaaacgcaccatgacgtgcatatgatgatgccatcaaacatcctttgatgttcctttagagcaagtttaatagtatagccaacaactactagctccaaatcttctatagcgcctgaaaattcactagtaattttcaaactaatttatgcaataaaatcatcatccagaaatcagccgaggtacacaaactaataatttaatatacaaatccatcataataataacactacatacttacaaaagaaaagaaaaaacaacagcggaattacggtctagcgaagctccggcttcacttccataggcagctcaactggggtataaaccaaacgtcttctccttctatttccttttcttcaactgaggtttgattgattattgcaagatgagtacatggaatactccgcaagccatacagcaaatatgtaagtgtacaaggataccaaaggatggcataatatatggctcatttgcaaaagaagcatttagcaaacatttgagaattgtaaaacagtagagtaattaattatcaattttaatcaacactgaacatcatacccatgctgcacaggcccaaccaaacctgaacaaccatacccagctgtacagatctatctccaaaccaggaatgtaccgttccaaaccaggagctaatcaaattattaccagttatagcatcatttattatggtgagaagtgtgagactaatcacgaaagacattgttagatccgcccataaccgcgggcacggctattcgaatagctttactctggccagagatgtaccactgtacccacaagacacaacccaccgtcatgtcaccgtgtccgcgcagacacgtcaccatggcgagtgattatgacaagacccctcgcataactcaactcaaagctgtacaccattcctggatcaataatcacccccttataaaacaaggcatggactcccagcaacccccgtgggtttatctccaccacttctcagtctgccacaccacaatgagccttgctatacaaagtgtccagccgttgcccattctggcttgtggttagcatgattaatgtttcataaccgaatctcgcgaaccggtccttaattgtcatgagcacgaccatcaaaaccatgtgctcactgttgacggtccttatcgatcagtttcgaccgtcaatattaccaaaatagaggagaactagttatgcttgcaatgcatatatatgttagaataataatattccactagtattatgtttactaaccttttgcagagaatgatcattaaatggaggagaatcgacatcaattcagacaataaatcaattggacgatgtcgagaatcagatttatgcatgaatgggccaagaactcaaaattgacacgatgaattgggccaaaattcacaagtttgcataaaggagcaatggaggagaccgccagccaaagatgggccaggatggcctagcccatggttcggccgaacccatcctgacgccttggatgcagggttcggcgtggacgtccaggattgcttcccaatgacggttggagggcactttggacaattctccttccacaaccatcataactacctctatataagaacttcactctcttcagttcaatacacacctcaagcaagagctctctcatattctctcaagttagtttagttgtcttaaactattggaataggaatagagtagaaatcaggagtccggaagtcttcgtaagagttcgggtatggctctagtagctcttctcttctcttttgtaagatttgtaattagaatattcttctatatacatttatggtattgaaatactttccgagtatgttaatacctactttacattatgttcatgttatactgaatatactgctagcttatctaggagatgctttggtgcgggtataatgtttgcatatgcaattactctatgtcatgacgatgatattagagtagtatctggtagtttaggcgtagtgtctagattacgggatatcattatctggggttatatgctgcggatgagaggtgggctgctgatggtgatagctcagtacgggtattcctccgcgcgtgtacatagtcctaagttaattctctggggagggtatttctccgtatttagccccggttgtatggtcatgacgggttgtcgtaaggaagtcggcagtcaggggtggcttctcgaagtactaggagggcatcggatagagggtatttgctagtatatcagagaactagaatgtatgtataccgtgtatactagaagaagtataggaatagattatcttccttttttctttccatttagcttagataatttattatgagaatgagtagcttaatgcttgtgtgtcactctacccttggattatcttaacctctgcttaggatatgattatcacaagtaatatataaattattagtcaagttctctctacatgatcttcccatgggataaaataaatacgatacccttgaagtactctcgggtgaaatgctacaatggtatatccgtgtgcttgcggatgaactctttaaccacaatataacaagagtatttctgcgccattgccgggaattatatttctggtaatgtcgttaagaaataccaacactcacaacccaccagtgtcaagttttagttgacaaattaattaattaaccaatcacgattgaccatcgtgagctacaattaaatatccatcattaggtaatagtgaagcattaatcagcctaatagtgtgctaatgtttctaagcatggctaagcaattagatctaatacatgcaaatgggccataacaaaggaacaggttcacaccacccggtgacattcgaaaataaatgcacagttgaaataaacaaagaaattaaatataggatcaacatgcttaaaggaattgtgtttgggatctgtgtgacttgccttgcaatattcggtcttcaattaatcttcttgaatacttccgacgcactcgcgaacctccgaaacgacgaaaacgacaagctaacacacaaaatgaggaaaaagactaataaaaaccaaataaacagtacatataaagtaaacaaagatgtcgataataaatttagatgaattatgagacttgaatggcctcattgtgacttcatatgaattagttacgaatttcacaagatttaatctaattaaagcctagtataaatattttaattgaattacgacgcaataaaaaattacttttgaaaaggaaaagagatttattgcgtcatcaaggacagtccaccataaaccgggttcacagaagcggtccacgaaaccaacggccgagatctaattgacctaaaattgaccgaatcggacggcagagatcgatccggtctaccacggtctacggctgacgtggcactgcgatcgacaatgatatcatcaccggcggcggcccggcacctcatgctcgccagcgaacaatggcgcggcggcgcaaacggagggcgccaaggcgtagagctcggctcaacgaactcatcggtggctcagacgacgacggatggcgatgatcgacgacggcgacgaggttgaagcggcggagagcttcgagtcggtggtgacggtggtcctccagcggtctacgacggaaacggagggcgggacggggacggtggtgaccttgcgaacccgatggtagccttcccgagcgacgacgacgaccggagcgccggcggcgcacagccggacttccttcggcttcggcggcgcacgggctctagtggctaaggtgctacgggcgacggcgagctaaggagaaggtggtggcggatagaggaggtcctgggggtacttttataggggctaaggggcggtggctaggcccacggcgaccggcggtgagaaggaaagagctagggttttggaaagagaagctaaccaaatcggcatcgaatccgatgatttccaaacgaattagctcaggattacaaaagagaaaaggaagaggagatcgaggggattatttcccctcaattgattcagccggagaaggaacgaggtggccggattttaggaaggaggcggcggcttgcggcacagccagggcgcggttggaggttgaacacgaccctgacaggtgggccccacctgtcagcgggagacagaggggagggagggactgggccgagcgcgagcaggccgagggaaagggagagagagagaattgggccgactttcggcccaaacctgagaagaagattttaaaacctttttctatttaaattattcatgaaatgaaattccatttattaaaaatacttcctttgatcaaataaatcccagaaaaatctaggaactatataaacaatagaagtatataacaaaattttatctagcccacttttatattgagatttagcaaattaaaattagatcttctcttttaggcttttaagattatttctaataattccttttaaacaacaatttataatctaaggatttttaaacaagaaaggcacttaacaaacttataattagatcattaattgataaatttatagattaactaattactgaaacattctttgtattattaaaattaggaattgagctctgaaaaatcgagaaaattccaaagtataattaatcatggagaatttaatacaaattaaatccaaccatgctttatgtttaggaaattttatttcccacatttaacttcacttgtaaattaatgaacatttaatataaattctattaataatttattaaataatttataaatcctaaaacggaaattcaagctgtgacattgtcagttttgcttgttggtgcatttggaagcaacataatggactctcaaatgagattcgtctgcatgtctgcagaatgaatggttctctcacctctttcattcttagctggttacagagcttgtagtttatcaggttttgttttgttttttgtttttctgtacatgactcttcttttttttaatatatataactactaggcaaagccctggtagtaatatctccatccttttcttttctcgtcaagccacattaccttacttttacatttggattatcaatctatatactatttaaattatcataaaacttattaacttatataagcttatattgtttagctattttcatattatttttatttactgctatcatactaaagttaaagttaagtagcaatgcgcgagatttcacttagtatttaagtatgactgaagtacacttgtcttgctgccaggccttcaaccaaacaatggtcactagtcaggctgtgcaaaattcttttatgtttcaagtattccttttcgtagcatattgcggaggttgctaagcaaacaaccaatatcgcataatgttgcctaatatttaagtgcttaatagaaaatataaaactggagaacagagatggcgtgaggagaggggcacatggatggataagtacgatcgatgggtggttggattgacagagggtgccagtcatatgttatagttatcagttttcaataaaccggcacctatagtttgtttattgtatgtacgggttttttttaacaaaaataccggtaccaatattatagttgttggtttttatatagaaccgacatataggtaaccggtacctatattataggtgtcggtttttatttatatctttttctactagcaatatgtctgtgcgttgcaacgcgtgaaaatgatattaatattaacaataaataaatactaataattaaaatttaagtatcacaacatattgaaaaggaatatttttttgctaaatttcttgttggttccacttaggcaaaaaaaaaatcaaagtgcaaaattattcctaaatcgtaattccagtgggccgggggaataaaaaataattaaatattctaactaaacttcctgttggttgtatttagttagaaataaattaaaatgcgtcaacaaaatttactgcaattttatagcttaaaatgatggctcaaattgactaaaattatttataaattaaataaaacagtaagtgattttagagtgaaaataaatgaaaaatgaatttttggccgagaggctagtgtcggcccaaatggcatgccgacccaatgtggggccgatctgagccatccgatctgatggacagcttggatcggtcctgtgccgattaaatcgctggccggaggggggaggggtccaaaaaccctaaccctaatccactttctcccctactccccctatccaatctccagtgatgctagtggtgatggcggtccatcgtggtggagcacgcacacggctccgacttcatcggctggtacgtgttgacgatccttaaatcataatatctgaccgtcaatatctgcatatagtggaataaaatacggtattcaactgagtggtagggtttattactaattatttccactagtgttggtatctatttggatgcaggtgacaaactaccaaagttgaaaggaaatatacataaagaaggaggagaatcaaacttatatccaaacttatggagttttggacccaaaaacccaattaaacacctccaaatgggcccaactaccatgccaatggactgagggcctgaaaatcagtgtccacgaggaaaaacaggaacaacggagccggccagggttcggccaaaccctgagagaggccgctggcccaggcccaagttcagttcggtagcaaaccgctccacaatgacggttatggccattttcaccggtggaaaccgtcatcagctggatacttggcaagaagagaaggaagatgctctttggaagctatggaggatctccacaatcgcaaagcacctccacctataaatagacctcctctcccccacttcacccacacacaactttgagctgaattacaagaggctttattgtatcttttatacattagaaataggtagaggatgaggggaagctctggatgagtgcccagaagtttggcgctctcgccgacttctacctcgacaagtgtagctttctaggaggaattctggaggagtaccggggttgtcggtacactctgctccgtattcggagaaacttcttctattaagtaagcattcgggatcctttcttatgttatttaattactttgtctaagtgagatagatttccatctttgcgggttcattgtttagtattcgtactaagtgctctattactaggactttggataaagaaggaagttcatgcgcacgtattcgagtagtaattaaggcatggtgtctaggttagagattatctttgtttgttgtgtgttgacggttgttagtgatcagtttcgaccatcaatattaccaaaatagaggaaaactagttatgcttgcaattcatatacatgttagaataataatattccactagtatttggttcactaatcatttgcagagaacaagtataaagtgaaggggaattgacatcaaatcagacaataaatcaatcggacgatatcgagaatgggccaagaactcaggattgacacaatgaattgggccaaaattcacaagtctgtacaaaggagcaacagaggaggccacctgctgagtttgggctaggtgggcccaacccatggttcggccgaacctcccgtggcgccgatggatgcagggttttgatggacggctgggattgatccccaatgatggctggagggtattaccgaccattccaactgtcacaaccgtcattaccttcctataaaaggagctcctcttctcacttcactcacacacctcaagcaaagatttctcatattctctccaatttagtttagtgttctcaagctagtggaataggaatagagtagaaatcggagtccaaaagccttcggaagagttcgggtatggctctagtaccttttctcttctcttttgtaagctttgtactattattagaatactcttctttatacatttatggtattgaaatactttccgaatgtacgaatgccagctttacattatgttaatgttatactgaatataccgctagcttatatgggagatgctttggtgcgggtataatgtttgcttatgcaattactctatgtcatgacgatgatattatagtagtatctggtagtttaggcgtggtgtctagattatgggatatcattatgtggggttatatgctgcggatgagaggtgggccgctgatggtgacagctcagtacggatattcttccgcgcgtgtatataatcctaagttaatttcctggggagggtattcctccgtatttagccccagttgtatggtcatgacgggctgtcgtaaggaactcggcagtcaggggtggcttctcgatgtactaggagggtatcagatagagggtattagctagtatatcagataactaggatgtttgtatactatgtatactagaagtataggaatagattctatttctcttttctttccacttagcttagatatttcatatgagaatgagtagctccctgcttgtgtgtcactctacccttggattatattaacccctgcttagactatgattatcacaagtaacatataaattattagtcaggttctctctagcctgatcttcccacgggatataaatacaatacccttggaatactctcgggtgaaatgctgcaatggtatatccgtgcgcttgcagatgaactctgtaaccataatataccaggagtaatgtcgttaagaaataccaacaagcatttccggcaccgttgccgggggagattcataatagagattaccagaactaatactttatatttacctctgtataatcactgccttttgcaggctaaccttggttgttttcacttttgttgtggaaacagttgtcacaccccgaagttctcctcccaagcctaaaatttaatttataaaaacgaccccaagaaaatgaaggtgcaatcaagagaaaaccctaagaaagtaatgcaaataataatcggagttgacatgtggaatttttcttgagttctacatgttggaattcattaacaggatttttagtggaattttcagagctctagaaataattttaaccatttaaaa

SEQ ID NO: 80016 - DNA, 4499 bp, Oryza sativa
  unsure (1)..(4499): unsure at all n locations
tgtgacatttccaatcactatttgatcaattacacaacaaattgcttcaataacgaacaaattgatgtgaccaatgtggtgaatgggttgtcaattgattttttacatggatttctcatgctactcgggttcaggacaagaaaaccacctgtaacataacagagttaccattgctttttcaggggcccgcacaagccgacctgagggattcaatagctcaagtgaagtccgacattgttgttaaggtactcttatcttgtactgtattttcagttttgattcataggatacttttttgcaatactttggtatgcaagtcgccctgttaactgaaagctctgaaccatggtttgaagtctcgattgaactcctaatattcgttctcctttatatatggctacaacctattatccattattattttgaaaaataactcgagttatacaatttgtcgatttggacatcataattcataagccattatattttgtgctcctcacttatgcaattttgcattgttctgttagtccaacattctattatgccctttcctttcacattggtctccggaaaggctagtcatttgatgaagcatgtgctgctggttttactgaagagagtggaaccttgggagatatttgggagactgtttcgggcagtgacctcgtgttgctgttgatatcaaacactgcataggttaacttaggctctagctgcatgattttagttgccacttgatgttgttacctttaccaatgcttgtttaaattgtgctgaatttcatggtcctgtttattaaattgaatctccaatgccacatgccatctgctgtcacacaatcactccttttatcccttgtagatgcagcaaagcccacactcaaaagagagatagttggtgatggatcaggagctctgagcttggcggtggagcgtgatgctttgctccaggaggactccatcgtttttgcgctcatcaagcagcagcctacactcccgctgccgaagctaccggtggccggtcccttgcggaaatggtaattctatcatttaccggtttcttcttctgttgaattgtagatagatccatttgatttgatcctgatcaagttctatttttgaactgttgtagttctttcacatgacaacttgtggttaatcaaagctctggacatctacagaagaacaaggaatatggtctgtatntcatcatgtacctttattttgtttttattattacctagagttacatgcattttttttccttctgtacgaaggcattgggagaactaaatgatctctagaacataagacaaaaagcctatctgatttctataatctttgtcagtttaaaactcagtaggaacttccaattcccagttctaacagaggcaattatctttaccttatcctgtaactgtttacttttcaccgctgatacttttctatctattgtcaacttgaaagactaggctgatccataatatttcctatattattaattagtaaccttgagctgttctcatagataatggaggagaatgggttattgttgtgaacatctttgtggctgtttgaaattatcatgtatcttttccttctttctcgctaaccttatctcttctcctcctctccacacatgaaccagccacggcagtgaaaccaacgggcgaacgcgttgaccaccgaagtcgccaccatgcgatttccaccaagatcaccataagccggtcttcgcccaataacgttgccataaaaccccaggtaagttcctattgcttgccttgatccctcaccatatcttttgctttcgatcattgatccctgtccacactcttctgggcttgggatttgatgctgtatgtatgtgatgatttgaatgaggggatacgactaggaaagtaccgtgtgagggatttatatgatattagtgtcgtttgacttgattagattcaatctggctttttttaggcaaattttgctacaggacatcacaattgtgtggttttagcttaggggcaccatgaaagtgaagttttgggggaagacatcccataaccacaaaatttcccataataatttatctacagtatcaactcctttctcagtaaccacaaaagaagcttaccaaaaatatacaatgcaggcaacaccaggaatacatttgatgatgtgtgctccttagcacagaatgctcagctatcatctcacatgaaacatatcacagatattgcccagactatacatccttcaaccaggctttacattgtcgctatgaactccacattcatgaaacaagacagagttgtcagttccactccaagctattactctcttctagctgcattggttatttttccatgtccttacagctatataaaacaactcacatataatgtcttttatagtactttggtaaggaatttacaggtagatatataaagccgctgatgcaaaacaagaaagccatcggtatttgtcagtgatatgggcccgggggtacccacactaaagggaaaaaagtcatttcccccagccacgtggtcacgcggcccgaaacccctggcgggggaggtcggatgcgtgggcagtagatagccaagaggtggccgtgtccgccgagggggttcggggtaaccagttgcacccgttgggcccggggggtgcgttaccccgaggccctcgctcggccgccacgtggcgaccgagcgggcggaggtaagggcgctgccaggcgcatttatgggcggcgtcccaaccaacccccgtcgcttttaatgcgacggggcaggtcgtgcgctgcccagtgatcgacgtgcgtcaatcactttgaccaggtcgtgactggctgccagcggataggacaggcgtcagcgcacccacgacctgcctattcaggcggcgtgggggcaggtatgccctgtcccatcaatggtaggggatcgacgattcgaccggtgcatcccgcgtgcatgagcctccaaagtctccaagaatttataagggaatgatgggggatgtcccccgtgttaggcgaaggatggtgttgggccctacatgaggttgcgcggccgccttactttttgcctaaggcatgagtggaggccccaccaggttcgcgcgggcccctccttgaaaaagggacgggtagaggtggtgcatgtggtatccccttgaactataaaaggagaaccttgccgcccgagcaaggggacgactttcggaagcttgacccttaggaaagagttagccaaccctctccctagggtttgagaactcttgtaacctgataagcataaatcctcacaggagtagggtattacgcttctaaacggcttgaacctggataatcctgagtctccctcttgatcatcatccaccacgctagcgcgatccatagaggagacacgctcttgatcatcgcgtcctactcccccggtcgaactcacaaaggggatctcacgtccctccgctagagagaattactcctctacagtattcaggtccagacactatagggtgtttcaaccaacatgctcctatatatgtcaacagatggtcgttgcaacctaaagaaatgatggaaggactttgcagcaaacattggcatacacctacacacaatttgcagtcccccgagaacagtacttgtgagctgttatattctataaaggcccttcaaaaatacgtgaaaggagaggggtgtttttgaaaaaacgccgcgcactacccccaagccccgaaccctagccgctgcctccgctcacaccatctctctctcgtcttccctctccctctcgcaccgctgccggcgctggcgcctccgcctcctccgtgcgtcgtcgccgagcgcagccgtatccggctccaccaccgccgtcgccatacacctccgcgccgtcgcggcgaaggtcgcctcgcgccgaccgccgcctcgcgccgaccgccggcgtccggatccggcctccatgtggtcgggggacgcagatctgaccgcccccgtgcgccgggcaacgtctccgcctccgctactgccgtcgccatcgccgagcgccgccacttccgccttctccgtcgccgagcgccgccgcttccgccttcgtctcgctccaccgctgcagcgccgtcgtccgctgctgtcgcaatcgctcagcggtgctgctgcggccttcgccaccatcaccgactaccacttcttcctcgtcctctagctgtcctggtaaatcgaagctcctcccggatctacaaggctctggagcggaggtagctgcaggcgaagcagggtgtcgcagcgacgcgactgttaagctgcgtggcagtgtgctcatgcagctgttgtcctaacgagcgcgcgtggtggcacaaaagcaacaacggcagccgaagtagtgcagttcctcggtggcggcgctatagcaatccggagcagcagaggtgtgcgttctacgtttcctctcttttcattgttgttgttggctggggttgacgttggcatcgatt

SEQ ID NO: 80017 - DNA, 4286 bp, Oryza sativa
agagggggacagcaacggctcgccatacatcccaccagtacccattgttagctcgctgtgtggcagtggtggtggcagaacaggaggcggcgccataaccggcacaggaacctcctcctccagctgctgccgcttcggcggtggcttacggtccttcaaccgccggtggcagaaccacatctgcagctgcctgtccgtcagccctaacttcacagacaactccgctctcatcgtctcatttggatacggatcctctgcagcaacacagacaaaaccaagtaagcacagaaatcacagggctgtttcgatcgaaaaatcgacaaatcaaacacgaaatagccctaaaaatttccagaatccccagtcccccataggccatcatccacgaacctgtgtatgtcctctcgagaacctccaactgatagggcgtcttcatcacgcgcttcaccttcccgctggatccagaggcgcctgctccaccaccaacggcggcgggaacgggagcggaagcggaagccggagccggagccggagccgacgccggggcagggctctcctcctccaccccagccggcgcagctcccgctccctcgtcccctccatcgccggacgaatccatccccccacccgatcaatcaaatcgagaatcccaaaccctagattcgccgattccgcccgccgccaacacgatcgattcaacacacaaactccaaaatccagcaaacctaaatcccctcgatatatagcccacgggccaacgacgacccgaaccgaatccggcgacgacctcgatccgcagcagcagcagcaacaacaacaacaaaacgaggggaggagcaagatgatgaggagaaggagggtgcgtgcgagaggggaaagagaccgcggggaagaagaggaatcgaaagaaaagaggaggaggatgaggaggagcaacacgggaggccactccaaacctgttctttcaccgctcgatccggactggtcaggatttggatcgctcgttccatcgtggtgttactactactactctcctaataaaaacccccctttattattcgctgctcctggctggctgcctgactcttctgccgcctctgcttacttccgctgtgtatgttggtgttggtggtgctatcctttttttttctcttcgcgatggggagaggagaggagaggagtccgggagtgtgcgaaggaaagcgaggaaaggtgcggaataatgatgggatgtggctgcgtgggcgctcggattcgctggggttcgctcgatcttgcggcgttggcgagcgaatgagatttgatcatgtatgtgcgcggcgtgtgtgcgcgcgtgttcataggtggcgtagaactgggcgtggatcttctgtggcaacggcggcgtgcgggtgggaggagtttgggagtgtggggccctggttggtggtggggtacttggtgtgcctggcgtgccagttgggttgggtcggattgggaatccagtgaagtatccgcggcctgtggtgtgggtggggggatgtgggccgtgggatttggggcccgtgtggcagtgggattcggggtcaggttgatgagtttggatccgtcgatgtttgtgttctgtaccttcgatgtgatggttaaactgttcttgtgattggacgtgttttgaattgaagactaccactaaaaattttagatccaacgtaaaaaaaacttttacaccccgtcacatcgaacgtttgaacccctgcattaagtattaaatataggctaaaaaataactaattgcacatattgcgattaatttgcaagataaatattttgagcctaattacgccatgatttgacaatgtggtgccacggtaaatatttactaatgatggattaattagacttaataaattcgtctcatggtttactgatggattctgtaattagtttttttattagtgcccgaacaccccttgcgacatcctatataaaatccgatgtgaaacgtcaaaattttacccctggatctaaacacccccctaagagcaaggtcaatagtatagccagctgatggctccactcgtatccatgtcattttatagttgatgttaaagctaatttgtacaacatagtggctattgtgttgactgcatctcatccatcaaaaatttattttatacgcatatattgatatacatgatcgaaagtgaactcaatccctgtggtcgttgttgtgcaatactcaggagtgctatatacataaaaggaaaatacaagtcacagacagcaaatagacgagaagaacaaaagaattaggaagagattagatgacaataactcaaattagaaagctattcgctgctccatcaacgatgagatccgtttgttctgctcgtagatgcatctgccccttcttgacgcgatggccagcagcagcgccagcccgcagttgtcgtcggcgcccgccgctgccgccacgttcacgatctgctgcgccgcgagcgctgcgttcgtcgatgccagcggccgagtcgccaagaagaacgcccttgtcatcgccgccaccacgggcgccgacgacatcaacagacccttcttggtcaggcttttgagcgagattgggctaggcgtccgggtggaagataatcgcaagcggcggccggcgaagacacgccgggaagattgggcggggaatcgacgcggaagacaactgcgaggcgatggctggcaaagatcgatctgcgacactcccgtgaggagagaaacaagatgggctgcggagggggagggaatagcgctgcatgtcacacgggatcggatggctcgccgtgggacccacaaagcgcatgcgaacccgtgctatcgcccagctatagattagtcgctcgctttgttctctcctctctcttccacgtaggaatttgatgagctggatatttttggagcctgctcagtcagcttattgtacctgctctaactctctttctacgaaagcagattgttggatacacgcacatccgtataagtgtatactctacctctaaaaatatttttaaagaataaaccggtatactatatatcttaaacgtgctgggttcgccgccatgccacgttttcaacttttacagaaaacccctcgtcgttttggtatatcggattaggttcagctgatcagagccgttctttcccacgcgtgtatgaaatccagtactccctccgttttttaatatatgacgccgttaactttttctcacatgtttgatcattcgtcttattcaaaaaatttacgtaattataatttattttgttatgagttgttttatcactcatagtactttaagtgtgatttatatcttatacatttgcataaattttttgaataagacgaatggtcaaacagatgagaaaaagtcaacggcgtcatctgttaaaaaacggaggtagcgaaataagtgccttgttatttaccaatgaaaaaatagtagtggtggactgattgagacggggatagtacatgtttcctcggtggaagtcaatacaagaagtcacaatcaaagtcaacagcagtagtatagtacacgatgtcatcataatgcatatgggccatgagaaccgcggtccgaaccccgtcctgctctccccgggccaattctctcgacaatatcatcaataggcccaaccaaaagtatcatcgtccacggcgtgcaaccccgctgcacagcctccgatcgagcgcgacgcgacgagaaaacaccacacacttcccactccacagtccacacacccgctgccctcgcttcacgccttcacggtgccggcgcgagaggacgacgggttggagttggagatcgcgtcactccccggtttgacctgtgacttgtgagcttggtattcctcacaagtttgtcatcatccaagcttgcacgcatttctagtacgaggtaatgctagctaatttcccgcccgtttgcacccacaagttcatcatatcgtcatgccgtactcaaacaaagcgtagattaagttaaacttgtaagcatcgactccttgcgagcccattggggccgtgatcagctttacagtgtgttcgttcgtgtcacaatttaattacatgcaattaatggtccaaagaactaagacgaggatatgcacatataggcgtacgtgcaggcagaattctactaaatattagcgcggcgagagtgggaacccgatgccatggcgtgtggtcgggaagctcacgaacagcatgctcccgacgacgccgatggcgatcggcagcgccgtgagcacctgcctcgtgccctcgg

SEQ ID NO: 80018 - DNA, 3315 bp, Oryza sativa
caaacttacatgagtcaggctctgatatgttcgccgtcattctgaagcagctataccagcctagctatcacagagacacagacgcaatgcaatcaaaagtagcataacatgaacaggatagcttgggcaagataagaataagcttttgggtgccaagacaaaaacctcctgatgcagtggtccaaatacatgcatgctcctttaacctctgccagtactccatggcctttctttctggcaaaacagattcctacacattgcatgttgtaacagtgtagaatgcatgctccacctgaggtcttggagaacaaacattgcaaagctataagacagcacaaggctttaatcatgtgattatcctttttcggccatcaatcattaacatgctcgattcggatgtctgtaagctttagcctagtattgccctaccttcatgcagctgcatcaaagtatcctaagcagtacgtgtaaattaattatgacccacagatcatacaatgtacttatcctatatacttatacaatttatccccacaaactttaattttctcctttcacaacgtgccacatcaccttaaattaattcggccattagatctacaatcgatgtctgatatatcaatggaaaactattgtgatccctctatgtatatcatttgatgcagattttgttttatttgttttagttcgttcttcaagaacgacaacaagctaatacatgaagacattaattggaaaaagagaacctgttcattcttcctgatatgtacttctctgtagtggcatatgagtacctaatgatttgatatttacatctagataggatacagctaacaaacttctatgttgtgaaattaaacgatatcgatatccattacccagtgtttttttcttgatggtatttattttgccgtggtacaaaagaataaaacaatttagtatttgcctctttatgcttcatgcatgcatttagggagttgaatagaacaattgtacatgcaaatttgagagtcgatcatatccaactgctctatcaaatttgttctaaaacctccgcagcaacgcgtgaggtactatcatctagttcatcttaattagtactccatctatttttctttttaattgtgttggttagctcgaaattgaactaatcaacgttacacattttaggaaacgaagtggtataacatagccttgacatcatgtagacgaaccatatatgcaagaattgaagcgaacgagtgcgatttcatccacgttaagtacccttctcactaaaagttgaacaatcatgcgttgacagatgaacatcaacgcacaaaacatccaatcaatgccaatataatttccaatcaaaagtacttactcgccaatctatggagaaaacttgagcttcacccagaagccacttaaacagttggtttagatcaattgtactcctcgattagtaatagattagctcgtataaacgccattgttagcagcttaattaacatatagctagctaggtagtctaccaactgctaataaacagaagaacttccatatcaagtaaaatagtaggagtgaattgaacgatcgactgcaattaagcctgtattgtacgtagatgagacagtcagtcgacacttggcaagaaattattctctttgtactatcagcaatctaatgcaaagttttacatacatctgcgtcaaatgctacatctcaacggcaacgtatagtactccagatatgacctagtgcgatatcttaattaatttgtagtactttgtaggtccatctagtacgcagagaaaagttgatttttcttatataaaaaaaaaacttctgctgatttagacatgtcatcattcaccgagagagcttatagcacactagtactccctcctccttcccattttaaagcagttgagggtttcgtgttcaacatttgcacgttcattttatttaaaaattttataatattttttaaaaataagtcgcgtataaagtattgttcatattttaccgtctaataacaacaaaaataataatcataaaaaaatatccaataagatgggcgatcaaatgttgaacacggaaacacacaactgtatttaaagtgggacggagggagtacatagtagcaaagaaattagaaataatatatattgattttttggctccttcgacgctgccatacaattggggtaccaaatcattttctgatagaggcgtgctagctttctcccgattgatcctaattaacaagctagatgtttttattgcctctgcaaattaattgaccactctcttaatcatgtattctgatcgttggtttcagaaatcgccacgattagaggatcttaataagccctactgatcaagaccatctgtagcagtagtagactcgtagtgtagtagcagttcacctcacctaaaagctacagtatgggcagctctgtctgtggctgcaaactgaagaatgcaacagattgatcgagttggtgcaatccacttcctgccacacacacgcgcgccaacaccaccacctaccaaacttctataagctctcttgcatgattaatccttttctgacatgatgcacacctaagctcgaaaaggctatcggctatgtgaccaaaactggaacacataactgttggtttaacttaagcttcaagccggatcaattgacaatttagttttttttttgaaaaacttgttttaagaatgtgctgtgcaaaaaacatatttctaaaataaaccgtgatcttaacaccaaatctaataatgcagaggtccaatatcattttaacatgaaatatgattgggcattgaaaccccaaccgtagactagttggaggcacgacatagcagcatgtggaggacaaggattttatacacctaggtgtgacggcacctatcatttgcatacgacttaaatagttataaaaaaattagtaaaatcgattgtgatgatataagtctatacacaaacatacaggactaaatttaatctacaattagagaaacaaaaataataaaatcagacattgaatagtactcatacaacgcagataaaatttgttatttttgtttcttcatatatcgatcgaatttagacttgcatttttgtatagtgtcttaattatcatgcctatcttattaaattatataaactttttatataattgtttaaattgcatgcatatacctaagtgccatagcacctaggtgtagaaaatactttctcagcatgtggatgctaacctctcaacctaagcgccaatgggcctagtgctaaggtataggacttgattagaagctccg

SEQ ID NO: 80019 - DNA, 3019 bp, Oryza sativa
tttttaggttgattttttttatcggagtactaccatgacaaaccaactggatttgatgtaagcataacaagaaaacaaaaaacgttttgaccctacttaggcccacacctcagcctccgtgccatgcatactctgtcgaaagcaaccaatacgaagtgaggctttcactgcgtttcactaattaatcgcattgatttgtccctagtagtggggggaggttttcatttcaggtggaacgaaatgcatcaatcgatcgagtggatcgggtccagtagtccagcactccagctgagctgcattccccaaatcctcctgctggactgccggcaggcagctgagaggctgaggtggtgtctagaaatgagggactaaactttagtcactctcacaaaaatataattccctagggtaaggacttactctctccgttttgaaatgtttgacaccgttaactttttagcgtatgtttgaccgttcgtcttattcaaaaacttttgtgaaatatgtaaaattatatgcctacataaaaatatatttaacaataaattaaatgataggaaaagaattaataattacttaatttttttgaataagacgaatgggtcaaatatgtgctaaaaagtcaacggtgtcaaacattttaaaacggagagagtatgtttttgtgagagggagtaaagtttagcccctcccacccaaaaccccctgagacgagcgagaggaaagcccgtgcagcggcagccatgatgactgcctcttctctccattttcccttttccaacgcccactgcatctgcttgaccagccacggtgcctgccgaatgggacgccccagataagccggattgttcgtttgggccacgacacgcacgcggggcctgcttcggccgtgctgtttacggtcaaactcatgactgaccacccacgggccacggatcgatattaccatcatctatctcttcgtgactttgccacttcagaccttgttttgggagcttcttgaagtagtagcaattcttcccaaaatcttcggctctctccaaacaatcagattatcactctgattatgaaaatctgtatcaatataatctagaagatgaataaggtgctgtttgaatctactgaagatgaagataaagattaaatatttcacgtaaaacgaggtggtaataatgtgtgattaattgagttttaattattacaaacttgaaaaatggattaatctgatattttagagcaactttcatatataaaattttcacataaaacacaccgtttagtagtttgaaaagcgtgccataaatatctaaaatttcatccaaatgttgttagagaaatgaacgcagcctaacaagacagaaactgaaagacctatatttgttctaattcatattctagcaaatgcttctcaaaattttaaggcttgtttggaaagcttctagcaactgcaatttctttcataatcaaaagttctactaaaagtacatctttttatccagtttataagaaactgttattgaaaatctaaaaaataaaatagcaactagaagttgtatttcttagattcttcgtattctcataagttagatagtaaccttaaaatgtagagtaccctgttccaccatacgtcgttaatataattagaaacatagtacaaacgtaaatgcttataatatgcgtacactcatatttgtgaacgcacaaacgtccattcaactagtcaacaatgaggggtatgttagaagaagaagaagaagaagaagaagaagaagaagaagaagaagaagaagaagaagaaggaaagaaagaaagggtggaggaactggagtgaaatgctgttgtttgtgggcctaaatatgtatgggccaactggcctggatcgaagaagcagggaacgaacaaagtggaatccgaacaaagttgacaaggcctgaagccctgaattcagcggtgcaacgcttgcccagcgtggacatgcactcatctagtcatcaggctggtgatcaaactgacaattattctcgacctgccttattaggttgctggtggtactgaactgaactactgaagtactctcacgcagtcacatccccatgttcatcggtgtgcttttgctgttctgcccttctccatgtgcagtgcaagatgtgattatgttaggtcgccaactagatggaggaccatccaacatcgatccatctatgttgcagacatagttttaatgtttaattaataccaaacacagcttgattggaatgagaaacacatgaaatttcaagagtcaggagatcgagtgaaaatactacgcataggtaattgatctgggacaccaaagaaatactaaaatcagtctaaaagtttcctcttttttttcgaggtaaaaggcctactaaaagtttgtctagaatctctcttttttcataacgaagtggttggtagaagtcacatcagctaatgggattagttagaacactaactttaactcggtgtttgttgaaaccaacgtcaacacctaatcatatactcctacttgtggcccctaagagcaggtacagtagcatgctataagccagttataaacatattttaagaagataaatgatgagagagaagagcagcgggctacatatttgtagccagctgtagcacagactccaagacacagtgtgtgtatgacaggtgggactagatattaatagtgtagtatgtaactattgtatgaatgagctattagattgactatagatgaattggagctagtagttggctatactattaaacttgctctaatggaagtcgattgatcatcattaacacacacggagaataagaatttctagcattgcccacattcatatatatgttaatgattcattaacatctatataaatataagcaatgctataaagtcttaaaatctgaaacggaggtattacttattactcctacttgtggcccctaatgaaagtcgattgatcatcattaacacacacggcagttgcatgctccaacaactggg

SEQ ID NO: 80020 - DNA, 1043 bp, Oryza sativa
aagtaaattaagatctgtgatgtgaatgttttgggatgttactttgatttgggatttggggatatgcatctcactcgatttgggagaaaatatagggattaaactctggctaaagaaacaataaaaaaaaaagagaaaatgagacctattgacagtgccattgccctctctttagtcctagttggtgttactaaccgggagtaaagatatcttctctttagtcctggttggtgttatttcaaccgggactaaagatgccatctttagtcccggttggaaaaccggaactagagggggttaccaaccggtagtataaacggtttctccacaagtggtaacatcaaattcgtttcataaaatccaccgtgaaatgtcttgatggtaaaattcattattgtaaatgttagtttatttcctataagatcggtcgtagttagaggagtttgatttataaacaaaacttaaatataatttattactacagtaatactagtgcaacaatacgtttgatcagatcatcagatggagtacttatttcatctctgtactataacttcttcatgtctccatatgcatggcatacacttcctttttctccatgggcgacgggcacgaaccacaccaaccaactctctctctctctctctctctctctctatatatatatatatatatatatatatatatatatatatatatatatatatatatatcaagtgtggtatcacaagtgtggtatcagagccagtcatcatagagaaatcaaattcagaagctaatattggaaagataattactaccaaagataatctgaatataaggtgtagattaaatcacattgaagaccatagttggcactctaacaatagtcaattaaatttaattgttgatctgatatataatttttatataaattgggataaaaagcaggaagatttagagcgaaggattgaagatttgtttaaagaacgaaagcaatctgaagaacaatatttgcttgtcagtaataaattaaattcagtgctaaaagagctagaggaata

SEQ ID NO: 80021 - DNA, 15851 bp, Oryza sativa
ggaagaggagaaaaggaggagtaaaacgtaaagaaaagtggagagtagagacgagttgggtttgttccaagcggggacggaataaatacggagagaaaggaaaagggaaaaagaaaagaaaaagaaaaaggaaaaataggcgggggggtgaaaggctcaaggcgggtggcgggtcagaatccggggcgggtttggcgtgtggtggtggggctcgtgatccgcgcgcagggtcaaatggccgccggccgtgttcgctgcatcccccgtacgcgaggactgtggacgaggaaggacgaggacgcggcgcggccgcttccaccaagtcgccggcgttttccacgatcatggattggaaggtatggatttttttttatttaaaggaaaagaagtcatcagccaaaacgcgggtcagtttgaaatatttgaacgaactgttagtactataatttttctatttattatatagataaataaacttaacaaatgatttgtaataaatggtccaaacaatacagtagagaaaagtatctttttaaaaaaaatgtgtttttttcgaagcgttaaataactaatccatttcaacgaatctagagataatactgccttcgtattttaaataggtgacattgttgacttgaataacgtttgatcatttatcttaaaagttgtacttaaaagttttccaatgataaaacatgttccagcaaaataaattatatgtacatattttttttaataaaacgagctggcaaatgtcacgaaaagtatattaaattttaaaaacaatgagtgtaacaggaccgacgtataggtttgagtggttttctttcttataacgcttaaaagccaaaaaaaaaagtcaatttaaaagcctaaaccaaccagattaagatctcgttcttttctctaacaagagttggatgaatatgaagataaagattttcgtgtcatgtttttcaaactgctaaacggtgtgtctcttacgaaaactttttatatgaaattgctctaaaatatcatattaatctatttttcaactttgtaataattaaaacttaattaataatacgttaataccacctcgttttgcgtaaaaaacttaatcttcgtcttcttaatcttcaggggaaaagaacaccacctaagccaaaacaagatgcagcttagttaccctctgacactatcttccgttttgattcgatgttagtcgtcagtgttgttatctctatctttaacgttgtattataagtagtttttttaattaagccgtaattttacaatttacagtagctataataactggttatagtttatttttgtcagggttatagataccacatacctaatagtagttgactaaatctcgacaggacccaccacataccatgtcctatacgaaaacaacctgcggatataggaagagttccacataaggaaagacaaccagagttctacatggaaacgacaagtactactcggattatatccatattggttttcctagttctacttggacaatgggacacctatgagtataaatacaaggccccctaggaggagaggagacgaccacctcaatcaacacacccaccacagtctacggaacaacagaagatcaacatacaagccaacatacaccaagacaagatgccggatatcgaattcagggataagtacggctagtcccctacggtgtctccggatactgtcaagagagacaaaagcgctgtctctgatctcgccgggtacggattcgaggaggaagactacctgttgtcgactacgagtcagatcttcagaccgccatgttgacaaaagttagataggctaccccaaatattgtactggtgtgattatggtgaataagagcaataccggcttcggccaacaggatgtagggttattacataacaattcagaggcccgaacctgtataaaaattaatgtctccatctcttttacctcaatctcgtatatatcctagtactaacgattccaatactatgcaaataccggaatcgcgatatcaaacgtcgacaatttgaagcatgaatgaaaatgaattttattataaaaatagacactttattgtttgctgattgatttgtaagccgtatccaacattttaaattattatatgtattttttatcatattttattttttggttgtgtattttttattaacccttaagagtagaaacatacaagtaatgttctaaaaatcttttggctcgtttatttcttttaggaggttttaaccggagacccgaagtcaaccaatatgccaaaaaacatcagccgaaaattctaaaaagtttaattaagatctgtagcacccagaaggaaatagaaacaaatgctgtggaacactctagacaagttttgacttgttcctaacattagttacagtactagtacttgcatttttacaattggaaaggctagttggcgaagccaagtcagtagacaaacgtgctttgatctctgcatcgacttgtatacttacgtcattagtactcctattaaacaagtaaaacgtactactcctacttatacatgcgttttaaaaatgaacgccaggcaaatcgcatcggcaagttggaattaatgaaaaccccaatttggcgagtcaaatacgcattacagcttatcaaaagttccaagttgcgtacaatcatagactaagatatcgtaagtacgtgcttaattattccaggattttttttcttcttccgcattctcccctaactaacctagaaacttcgatttcctactactgctggtaagcagtgcagcatccacacatcacaaaaaccacaataataaaaaaaacgatttgaattctcattctaccaccaatccggtggttaataattctggtgtgattgcgaaccgaacgaatcgaacgggaggccacggtggcgtttgtggatagacacgagggaaaaagattccgaccccattgtttatcctactataggacagaggcggaactagggtattgagcgggtgaaacctggtcaagaaaatattatagctataacttattttttaaaattacacagtacaacatatacattcacaacacacgcgcactcatctttataaacgcacgcaggcaaacccatctattttcaccatgtatgcatcactcttaatataaatttagacactcgtatcatcttaaacttgatataaagtagagtaaattaaacaagtggcacctcactttatttcgttctagctccgctagagaaaaaggcaaaacggtatatttacaaatgaaaaataaacacttgtggatataacttttacatacgtgttctcaatgatctaatagtggagactaaaaaataaactatgatgaaaaatttctaaaatcaactttaaaattaaagttaaaaacttaaattttaactgataagtataagtataaatgaaaagatgatgcggttcagtttcatggggacgataccgacgtcacgatgaattggattcttggagctaagagaaaaatgaaaatgatatggccggatcgaagcttaggtttggtgaattgctgacgggtcacgcgccgtccctgccacacgaaatctgtggccgtgcttaattaaatcgggacaaaaaaaatagtactaacaaattaagtggctggtaatgtcccccttgatcgatccctttctgtcaccattggccgcacccgtccaaaacgccggaaaatgacacggaattgaaatgacaggattcgaatccagctcgatcaattcgttttcagaaactctcagaagcaactgattcgtaatatcattcattcattcccttgtgcatttgcattcagttcgtaggaattgagtaatgctttgtgtgtgcgtttgtgattgcgtcggtcggtttcagttcaggtgcccttcgttgaaggtagctcgagtttttttcgtagaagtggccgagggaaatggtcgaggagttgtgcaattagcacgtaatcctcgtacacacggcgtgtgtttaattaggcgtgtggataattagcggtagcttttgtccattcatgtcttggaatagacagcaagagctatgaaatgcacacgtgaagcatacgaagagttagttcgtcccgcatggaccagatggtgtatttatgtacactgcgtgctacgagccaatgacgtgtagcctaggaagtatatgtttcacgcgtacgatctcatcatgccccatctgcaataagtcaattccgtgcttaatcaagcgctactttgttgacaataattgttgacattgtcgatgagacgagagatcacttgatatgcatttccctgcaagttaagtaatgcaaagaaaatgctgacgtcgtcaactctgtttcaagtctcacgttttctttagaaatgcacaaatttaacgagattttgagtttcaacagtggttcacttcagtctcggtgtgaatcaagaacaagaaaatcgggtgaactgagctactattttttttcctcagttttgattcctcatttggaggagcaattttgcaccggctttggaagttacggtcgagggatgcaattcgatcgagggtaagacatagggagaaaatatagacttgctacttcctcgttgcatccgtggcatttgggctaggcccagggaagtagacgggccaggctaggttgggcctggctgcttcggcggcgcatcaaactcgccgctcaccagcatcgcgtcggtggcacgtggcggtcgcagtcgcagtcgcagtggggatcagcggcgccgccgtgcgaagaagccggcggagatgccgatctgcccgccgtcgtcggaatcctcgccggcgccggggttgggggggcgcgcgttgatcttccacgggttggccctcggcgcggcggcggcggctgcggcggccgcggcctacttgtacaggcggccgggcgggttccgcggccgcgcggtgggcatcataccggcgcgcttcgcctcctcccgcttcgaggggaagccgctcgcccccatcctcggcaagcccatgatacaggtaggtcccgactcccgtcctaccgcctacgccacccgcttgatttgcgcttttgcttcgcgtgttgagactggatctgagagtgcgagtggaaagcttgtgctgaggaattcaagcgaggaaatggaatcggtgatgaaaacccgcgagatgagttccattcgtgttttctcgttgcgatttgctgctgctgctgctgtgcctgtggcgtcctcttcatcaggatgcaatttcactacagtagtaggcagtagcagcagcagcagtgacttgctgagctttcagttggattccattattgggaattgctcgtttcgttacgtgcgacatggtcgtacgcgtcaagaccttcgatattcttctacatgttagatgttgttataccatgtcgcagtttcttggttgtttcgagctgtggaatgagggttctcattttgcgtttcgtccagaattcacattgtaacatctctttacttcataactacggcaaattaggtggggatgcctaatttaccctaaggactttaaggagtcctttaaagtgaatgcaattttgttgtattattaatattactttgagcaccgaggttagtgccacagaccagagctgtctgatgagggattatgctacttcaagttatcttctatgtgattgacatatagaatgcactattgcctattggataacgttgatatgatatcttgcaagttggtttgttgaataatctgtgtagttcctcatgttgggaattttttttgtcctaagcagatctagttagtcctgaaacttttaccttacacttttacagagaacatgggaaagagttatgttagcctcctctttggaccatgttggtaagtccaagctcataaatcttatatttaatcttttcctgtttctgctcaaaacattatgtttagtatcatcgtatattttgacttgtggcctatctctcttttgtgacaccatttgtacaagtaattgttgtttataacttttctttcatgatattagtcgtaggtgtttttgaatctgcattgcacatgctaatcgttttgatactgccagtccactcagccattctcaccattttctctgtgtcatagtcgtggcaacggacgatgaaagaatagctgaatgttgtagaggattcggagctgatgtaataatgacatcagaatcatgcagaaatggtacagcttatgttgttttgtcattatttgccctttccatgattacttgattaacccctacatgtttttcgttggcatatgcttcatttaggatctgagcgttgctgtgaggctcttcaaaagctaaacaagcattatgatattgttgtcaatattcaaggagacgagcctcttattgaaccagagataatagatggtgtagttatggcactacaggttgttacttatgtaaactatatcttgctagtttttgcagttcccatcaaataaacaaatttttattagatatttttttgaactagggcttttattttatcataagcaagcttagacttgaatacattgaaagttttaaattcttcattggagaatacagagtgcacttgatgttgcactcctttttatcttttaccttttgcatctccttttaattcacgtaatttacttgctctagtgatgtccttcaatttggcttgcagcgagctcctgatgcagtctttagcacagctgtcactgcactgaaacctgaagatgcatctgatacaaatcgagtgaagtgtgttttagataaccagggttatgcaatatacttctcaagagggctgattccatttaataagtgagatactacctccgttttttaatagatgatgctattaaatcgatcaaattgtcacttgcaattttgaacatttcagatcagggaaagtcaatcctcagtttccatatcttcttcatctgggcattgcggtatttatcaactcatacttcattctcagctttgtgttattttcttttggatactcctgtagcctgtagtgcctactcttcatagtgtgcctttttttcatgaagggctttgattccaagtttttgaagatctatccagagcttccaccaactccattacagctagaagaggatctcgagcaacttaaagttcttgaaaatggatacaggatgaaggtaagccagatagaaattgtatttgttattgctatgctgttttgctatgactcctggaaaaattaggtcatctgcgtgttattgttggaaattcctgttttagaacaagtaacatttatcaatcataccacaacccacatcttatgttcgttataatgccaagatggtgaacttgtatgggtcaaagacaaatttgtgatggtaggcatcagtgcatgctattcattgttcagtatcgtaagcctttatatggtgtatacaaatgtcgcgtttgctagcttatgccttatactgctgaattgaattttcattatcctcgttgataacaggtaatcaaagttgatcatgatgcccatggtgtggatgcgcctgaagatgttgagaaaatagaagcattgatgcgtgcaaggaacatccagtagcatgaaaatgatcgattttgtacgttgtgtggttacatgtttgattcgactgttcgtgttctagtatagcctttctgaagagcacatgaggttaatttgagtttgtaaattagaagctgtttgaaagttgaattactgttttgagtgtgcatagcgttgcacttctttcttacaacgttgaaggaacatagcgcatctccatttactgaaatggcagtgcacctacttgtatttactgtaattaccaggccatacagttcgtttcgagtttgttcttgttaattaagctgttaatgttagcgcttctccatcgttattgttatatttctcatcgattatttggctaagcttcaaagcttgcctttgtatcttcagttatcaattaacgtagggctaactcagttcacaaaaaaggacactaacaaacaccaaccgtttgcacttcagtttaaaagcactaacaagtaacgacatcacccaggaagtaaaataatgatcacaaagcacataggaaaccacaagggattacataaagattctccatgcattattcctgcagcatatgcatggattctccaaacattgccgatttattattcgttcattcactcatgcagtctgagtccgaccaaaccaaactaagtcgacgtcaccgtgagttacatcctctatcataatagcactattattataggaactgacgacgtgtcggtaacaataatgaaagttatattatgatagagaatcctcacccgaaaacgattatatcatcagattagtggtggtgctgcgggtcaggtccgccggggacttcccacttgccgccgccgccgacgatctccgccgtcacactcaccctgttccacgccccgccgccgcgagccgccggcgccggcgggtgaagccggcggccgtcgcgggccgccattgccggcgtcgccgcgaagacgacgatcatggcgagcacaatgaggcaccatacctggacaacacgaggcctcatcgtcgtcgatcttcttattctcgatcgtcgttagcttcagctactggggttcgatcagtgtttgatcgcttgctgatggcgttcacgtactccctgatcggctagcttatatagagagcgcgagtgaggcagctgatcacgcctcatcacaagttcacagtacgtacatgcaaaaacataacaggttcagatgtgggtgtatgaccacgtatatccacgtactatgtttcaaattttgctgtccagaaatatatactccatctattttttaatagataatactattaacttttaaacacatgtttgattatttatcttattcaaaattttcatgcagatgtataagatataaatcgtatttaaattattttaagtaataaaataactcacaacaaaataaattataattacgtaacctttttataataggacgaatcgtcaaacacgtgacaaaaagtcaatagcacgatttattaaaatacagaggtgtatatagttatatatgtgtattcttttttttttgaaacgaaccgcacaagatagtgcgagtttcatgtatttataaagcaggagaaaaatacaatctatagtcatggaagagcacataccagaaaaagaaaatacaaccacaccgcgatatacgtgtattcttagttagtgcagagaaaattatatttactttattaaaaagagagaaaatcagagtgtatatgagccaggactagagcccagggccgtacctaaattgttagggaccgctgctaacacaaaatgaggttccagcaacgacaaatgggtcctgatgcaatttattcgatttctttacttaaacagaaaataaactcattctagccaaatcagtagaacgagatacattgttttgaagtaaaacatggaaattttaaggctccaaatttttaggggttgtgctatcgcgcaccttcgttacatgtcaaatcgacccgggccttaatcttaaaaggtttttcatctctatctaaaatctatcttggcatacagccccagccacttagtcaactatattactcttaaccaatatatatcctgaattgcacggtggatttttgccgcttaggcactagctatcctcctagcttaattgatcgaccaccgtatctgcaattcgagcctcttgtcgactcctgaatcgtcaattacagggggtgattttacacagacgtcgagcgttttgctacgtacttttttactgccgatatatatgatctgtgtctgcaagagcgacaggcaacaacgtcacgtcgtcacggagcaaatggataaaaacagagctagacaacggcacgatcattctgctgaaatgggcttttagacctaagcttagcaatgggctatcagcacgcagacagccgtttaattgggttgggctcgatcggattggttcgatcgatcacacctctgcgtatatggataagcacgtacgttaattacttgtggatgctgagggcaaaaggcttttctggtcacatccaaggatcatcaactgatcaacatcaatacaagaattacatgtgttatatatcaaagaggtgaaaaagaatcacaactttttatctccctaacagttcactggatatcaagagagctagtgtgtatatattgtagtagcactagacactactagtagttcatcgaacaacttagtcagcatgcattgccgagagtgggaagaaataccatatccaatagctaggataatctgcatattgggataattaactaatccaaacttactttctctagccatcatacccatcacctttttcttcttcttctttttttttttttgccgacaaacagctagctactagcaaacattgctgccatttagaccaattaactaactcacttctttaaatgttattttgcttctgtcaacactagtcacatggccggccggttcaatgcactagatcatgctacttcattggataattatcgtagactattaatttgttccacgactctaatcttctgatgtattaatttacttcccttattctaagttaactactattaaatttgtttgtcaaaatatttaattgatatctataatcgtgtaaacaacctactataacaattcagtcaataatctatttgaaactagatataaattgagtttgattcagcaattcgggtgagcaacttcctcattatctatagtcacgtttcttaaacagttaaataggaggtttcataaaaactttatatataaaagtttcttaaaaatataaaataatagatttttaagtttataatagttaattagtcacctgctaatactctttttccataccgagcaaaatctcaccgagttgtttaaacggacggactattagaattagactgattttgttttccataccgagcaaaatctcaccgagttgttcaaacggacggaccattagagttagtccgatttcgttgtttgttgttggaaactcatacctcacgcactaaaacagaatgactcattagcacatgattaattaagtattatttttttaaaaatagattaatatggtttttttaaagcaactttactatatatttttttaaaaaaacacactatttaatagtttgaaaagtgtacacgtagaaaacgagagagttaagttagacctaacattcagatatgacatgctatgcacttgctttcccggtagcagttggacagttgataaacaaatgtgcataaactgattaagcgcaaaccacttggctaatggccaacgcgatctgatgcgcttatcaaacataaattttaataatgctttatttgcatacggtttctggtcgtggcgccgcacatgatcgaagataaagtggaaattaataactaatgatggcagacaatttttggtgtgtcacgtacgcacatattttctgtacacatcttggttgccgacgacgacggtcaaaagtgttttgttttggtgtatacgtccatcgttttcagttctagcagggcccggcgaaaatttttcctttcaacggttcataacttcatatttgctgatcagttgtgccattataccaccaatatatactcctgttattgattggtacaaatattatccatgtaatatttgttttccccaaaagaatccatgtaactttttttaacaaataaattatattatatctgttgtaaatataagcatttctacgcgatttccaaatgcatcttaacatccttatacttccggatgcattttaaaacacacacataattacatatatttcaaaactgagtgagtatacaactgttagtattttctataaacaacttttacttatttttgcagttggttattactagccactagatatgcctggtactgtaatagctataggtacggaacaataggtttacatgtatgtttctcgaccatctaaaaattttgtgagtttggtaaaaactatctaatatgatttttaaatactattttatatccattttttttagttttgtaatgcttaatttcatctgtgcccttaaataattctaacagattttcagctatttaaccattttacacaaagatcattgtatttgaaaagatgcacttgatagtgtaatggcaagttgtatgtggtttcaatcccgagttctgatgttcaatccacacacccacaacttcttcatacaaagtgtttggaggcacgtgtctcccaccaaatcttgttttttttttcgaaacgatagaggagactgatccagtcccttaagttttgcttgatgattagttttgctttagactggttcagccttaagactgcttttaaaacctgtcatgtggcataatatatattatagaaaccatattattactgctcaaccatagagaccaacatatagctgataaaggtaaatcagatatttcacatagattttgtatgggaagataatatggcatatccccacgatgatttggatatataggcccatggataatattagaccagatgataaattttaatgatttgttaatattagaccaaatgatataccaaattgtttgtagagagaaattttgtagaccgtattggccgctatttctcccactcgtataatgggtatgttcagttcagctagatggtggttgtacagctgcagcgcttttagtacaaatttgcttggtaggtcctcttggtgtggctacaacgttgccactcctagctcttccgaacacagccaatattaggctgaatatattaagaatattgtctgagttcttctcgtattatttttgaaaaataaaaaatggcaagatcagctatgccttattgacgtgtaaagttcgaaagaaaagatcagatctaccttttatttaagcggggtgcagaagtggcattgatcttttcagtttcgtgatttatcttgggttagaccctaggctgttgtacgaatttgtgggaatggtgactggacgctgaagtgataaataaatataaaatgcattttcttcggttttcaagtgagttgtttgccctcttttggctagtgggattagcgtcacttaaataattataagtatcctaactggaacttttctgaataaaatctagttagtacgatctctgatagacaaaattatagttacaaaatgacattttgtttaccaaaaattaaagcgtcttagctcggtgcttagtcatggaatgatgaccaccttaggcattaatttgttagagagaaggcattcatacaggagaacaatccggtgcatgtctactcgtcttgaaattaaggccaaacaaaaaaaattaagatagtagtgaaataatctctatcagtaaaatccaggtatgaaattataccttttttcatattaataaattttacactgtgggggccttcccatacagagattttggcaaaaaagaaaaagaagtcttccgttccattatatttgtcatcactgatggttacagttgcaactttgatcactaataatttttttaatggttaggttgtgatgaacaaaaatttaatactcatatctagtatgtaatatacttcaataatatgacatctatttaagtaatatagtataacatttgactattcgtcttattcaaatgtaaatattcaaaaaataaaagtcagcttaaagtttatttaatgataaaacaagtcataaaaaataaaaaaatactaatatatttttttaaataaaacaaatggtcaaatatgatatcacaagttaatgatatcatccactaaaaacagagcgagcaataccttataataacagtaaaaagagaaagaagattttagaacacaaatacacattcgcttagatgctatttagatttgtgctatattgaaaagaggaatatgaacgtctacataatattcgtgctatttagtacatgtccatgtccatgtgtatatgagcgattgtgtctatatcatgtttcgcaaaataaaagaggaatataatatttggccttattaaatttgtgccatatgtattaatctaaaagcaaatccgacaacaaggggtttaggtacacatggacttgtgttataaattgacttttctgtaaaagttacacaaatatatatgaaaaagaaaacagaactctcttttcatctcaacaaaaatgaaaaaaaaaaatcgaaccccattgttagccttcaagcgaaaatttgaattttcaaacttaattttgattttagagttgatgtatgagaaagtttttatcgtagtttattttccagcatatgatttcgtatataacaagttttatttatatttttttactaaataagttgttttgcttataataaatataagccaaatgatgaggtgggaatacagtcttattcagacaagcaaatgaacacacactctcaatcttcaggatctttgcaaatacgcgcgcgatggtgggcatatatatatatatatatatatatatatatatatatatatatatatatatatatatatatatatatatataactgtgcatacatgtacagtatacactacaagtaaaacatgcatgaaggaaaaaaaaacagctataggaattggtacagacatatttgttgatgtatcgtcagtagacactgcaggcaacacacagtcacacagatgatcgtcgatcatatccctgctcagtgatgctgagggtctggaccgccggggctccgcctcttagactcaccaatggcggcgccgccgtcgtccagcgtcgtctcctctcgcattatcttcctgaaacgccccctcgccgccaccgtaggctccctcccttcccattgccgtccggcctctgccgtcaccgcggagtacgagagaatcagcaggattatgcacatcagcgtcgtcacaccagcaaccagcacgctaaccttcgccttcgccatgcctaggaaaaaccaagagctcaatgcaactaaactgctccaacaatatcgatcgaacgtgccaatgaaatgctgtagatgcagtagtgtgcaatgctacgaagatggcaggtttatatatagagagaaagagagaggcgtgagaccagtggttggctgctgataactaagctaatgctctcaggtcaaatcagttgtaatctgttcctttaattttctctgttgttacatgcatcgaaccatcatccatccaatccaatccaccggcggcggccggcgataagatggccggcaactcgcccacacaaaagccggttggtcgctaggcaatctcagctctgttcggtttgtttataaagctgtacacgttgggcggcgcacggtgatgactgagatgagcagccaggttcagaaatggggttacacgtacgtacgttagatggggcatgggatgcatgggcgcgcactgccggccgcctcccctgctacgctcgtgctccggcggaaagcttttgctttgcgtcgtcacgcggaggtggaggtgggttcggtgagtgtcggctgggttggacgacgagtcgcggggctagcaggagctcttgatttacgttgggctgggcgactgaaaggccgggtaattaggccccgcgagaaaagggctggttttgaatgggctgagaaagaatgttaggcatcgcttagcccattgcgtagggatggtccaatactggtgtgacagcccgttgccgagaaaaatgtataaaaacactctggtatcgattttgctatatatttgtcgacaaa

SEQ ID NO: 80022 - DNA, 104482 bp, Oryza sativa
ccccctataggcaatacctcctcccacttctccccttcctcctccccttcttctcttcctactacagtacaccacaaaaaatttaaaaaaaaaacaaaagttagaaaaatttatgtatagaaatactatatataaaaaatttgaattcaaattcaaatttgaatcgggtatgtaaacttttgacttataaactttgggtctataaactttaggtgtataaactttagatgtatagaaatactatatatacaaaaaatttgaattcaaattcaaatttgaatcgggtatgtaaacttttgacttctaaactttaggtctataaactttaggtgtataaactttagatgtatagaaatactatatataaaaaatatcaaattcaaatttgaatcggatatataaacttttgacttataaacattgggtctctaaactttagatgtgtaaacttgtggtgtataaactttaggtgcataaatttactaaaatagggaagtaatgcggtgccaaaaaaaagaaaccaggtggagggagggagggggagggggtgcgaattgatcgctacccccatcgctaggcgagcaatctctgattagcatttctggctcagatctagatccattgggagattgaactcggtgtaggcatcataggcaaagagaacatcagtagcattgttgttgtaaaatatgtcgaaccatgtcttgaaaccttcaacggatggcttgacaccatggtaaactgaagctgcttccctataagacttgcacgaccgggattctgattgatcttcattagagtcatatttggggaaggccgattcaagcagggaaggtctgttggccacggtgttggtgtgaattgtcaaccacagctgaatgaaccaccaagggcccccataactgaccggtttatttagaagtataccggctgaggaaacatgtaacatctgataagttgcccctaggaggtatcggccaagaggaattttttcctttctcaccagggcttcagcgaagtgaaggaagttcgcagtcggtgcacaagtagacccatagaaaacaaacctctcaagccatagggaaagaaaggcagcatgttcctcatccgaaactagaccagtcttccgatggtcgacgatgaagcctgaccaacaattgttcttcttctttgtgttcagttgataagagcatttaatgtccaagtcaaaaggattagtggacgaaaggatgtccaggcctgttagcatcttcacatcaagcaaagtgggagtcataggtccctgcctcaagataaaagcattcaatgtatcagaccaaaagcagccgacagcggaaagtaggggctcatccttttttatgtctgctatagataaagccaggcattgcgctattcctactttctcccaattagatcgcttagcagccaccatcctcttgtaccatgacttgtaccctttcaacttggacggccaagacctaaaggtcgatttccattgagctaagtctggtttggtctgcttgaaggggatcctctccgtttcagcgttgataaactcggtgggatccggatcacccatcggcccaaggaaaaagtatgtggaattccagaaggtgggaatcaaaagatgatccctggaatgctggcagaaggaaagaaggaatcggatcaccgaagatccaaagaagattgagggaattgctcaaagtaacatggagcttgcctcggggatctccgccacgtatgccatcgccataggtccgaacaaagttggcggggtggaggaattcgccgattgaggaacgatcaccaagagattagggattgctacagtgggggcttcacggggaataatgaccgaaagcggtaaaaaagggaagcagggcggcgtaagtaggatcccaagacggtgatcactatttaaaagggcgcggtaacggccgaaacggaaaagaaaccctagatgcgaatggaaacagaatcgagcaaatccgcaacatcgcaaatatcacagacttgggaggcatgtgttaacgaccaaaattggtaaatcataattggatccgaagtcagaaccaaagcggatttggaggaactccataatcacggaaacagaacccgcatcggctacgagttgcatcagctaccgtctgcattggctgataccaaaccagatagggagaagccgatacagccgatcccggcaaggcaatcatgagaccattatcgagatcggttcaagtgctacacaagtattggcaagtgtggattgagtctggagaaggtaattgtatctattaattaggatattttgatagtttccttatagatattttcggtaagagtccgcctaagggacttgttcgtatttttgagttgtaatagagatagagttgtgtccagcaaggacatatcatgttttttgtgtataaatatgacccgagaccatgtaaacaaacaacatcaagttcaatacactctcggtgcatcgccgccctttttacttttctttgttttcgacgagttcttgctttcgagttgggctgcatcgatttcaatctctgacaaagaggtaaagcttgttatagcggcttgagttctaggggctagtgcttacatctttataacactctagtcccgcctatgtaaaccgccgagttatcatatatgctatataatctagttcgatctagctatataatctcatcggctagcctctatcatcgaaaacagccgataaggttaaatagctgcgacgaactagattatatagtatatctaccatctcgaaaaggctttcataaacttgtttagatcttatgtttctctatgtacttgatgttgcatcggttatgtttgatctgttaagtaacattcagaaccataatatctagcttgtcttatggttatcgatagagatagcatcggggtttcagccgatcttacctgatttagttatctcgttcctcatatgcttacttgatatgctaaatctgccatttacattaagatctcatttgggccaaatatattaagcctgctatcagtctgttaggttaccctgacactggattgatctctgtttagcgtatttgatctatatcgaaaacttagtataaagtggtatcagagtactagctggtacacgttgggtttgcatgtcggctatgctgtgagtatatataatccctgccttaaagcgttcttggattcaagtagtttatactgtctcggtgcgctgaccgatctatcctaatcacttggtttaagagtatttcaaagcatagattatatattactgatatctatagccgacagagcacattcaattatcccttcgccatacactacttggccgatctgatctatattgcatcggcccggtataaacgatacgtcatcgacaaaccagccgatcggctatcgtttatagatttaactttggttctttgtttcttgttggttgcaggatcaaaccaactgacacgtcctagactcgaaagcgatctctttagatctgcactagagtaaagcaaatctctcaggccagcacgtgttttccacgtcgacaagggggtgggtagggaaaagggcaggaagacccctacgttgtcacccagcagccgcccgcctccatttgcgcgccccgccctgcagctggggatgctgctgccgtctgccaccaacgcggcgccagctcgacccggacgacgaggtgggggaacgggtgggagcggagagggagagaaggaagccccgccaccgctctcctccatctctgccgagccgcgccgtcagctggggtcactggctcgccgccgcccgcctccaacgtcgcgctgcccagccccgcataggacaacgaggccaggggaacaggagagagggggagagagatggaggagagctccgctgccgccgtccctgcggctgccaagggtgcgccgctcgtgcggtggcgtggcggagaagaagttagcggcggtggtagggattggcagctaaatagacaggccggctactctagtatcacagtctcacataagccctgtgggtgatttgttgaaccaggtttaacttcaccagcatggatatagcgtgaattttcagcttgttgtttcgaggtgaagtgcactacgatcttgaaatgcctgatcaaatatgtctatgcagctaattcatctacctgtgatgtttaactttcatttgctcagaatgtctcgtaatacaatgccaacaaatgtaggtctttcaggaaaagaaatgaaacaatgtctcgtaacaatgccacaacaaatgtgggtttcagaaaaactaaacagattgtctccaatatgcacccagttggaaagaaataaagaatagcaaagcattcagacaatttgcgtcaacaagagacccttttctgatctttcaaaggcctgttttcgtcatgggctatagaatactgtcttaagtaatccccagtagccatggttcactcccatagtacatagtatttctgctacattctatagattcagagtatcgtgcaagactccacacttcattaccatatgcttcaactggtggaagcaaaattccatgcacattggatactctttcttcaagcttaattgtttgtaacaattgtgtatcccctattttcacgcagcaacacacagggcatcaactagatgtacgtggaccactgaggccaaacgacagcgcacgaccactgaggccaaacgacagcgcaccgcactatcaaatatcaatggcctaataaaccacgtttcatctatcatccatcatccatccacacattcaaataggccatggtgactaatttcaaagtttagtgtttgagttttgaaatttcctcccacaaccttctgggcttcttgccattttgtatctgaaaggtgtgccatttatttagcattttccttctaaatattcacattatatttatttatagagtattttttttaaaaaacaaatcacatgtattatgacttgtggtacataaccacatattgaaacattgttttttaaagtagtgaagagttaaacttacaagcttaatcaataaaccaataattatatatttcatatagactattttaaaattgtaattttaagtagatgtgtgcacggcttatatatgagtggggttttgtgaaactttagatctataatacctaaggttatttgtcacaagtcataatacctaaagttatatgcactttaatcaaaaagcatagagtttattgaaacgtgaagatctgaagaccatccttgattcaggtttaatagagtgaccatccttgatgtttggagatggtgctgtactgttgcacgttgtctctaaaggtttatgaacatgaaacatgaccaaataaccccgtacaacacttaactgctatgaattttccataaaagacaaatgttccattggtgtttaatttaaggatctcattgttcatgtgtatcacctttgatcctagaggacccagtagcaagttgcaacatattttaaatttttaatcaagggatttacagccaacctgcgcactccattatatatctgtaggagatacataaatcctaaatataatcagacgaaaatgtaattgtatatcaaagcaatcaacaaaaggaacaagcaaactatctaaacaggtttactatcatacattgtgtaccacctcataactagaaattaagctctgaagccatacacaaaaacgtagctcaagaagtaaatagtgattttcacctacattatcacaactgaaatgaaaaatataagcacagatatgtcagtaaaggtggaggatacctaactgctggtttgctcccgaagatcatgagataatgacaagcagttacactttcaccttcttgctgttagctttgtcaaccttctcattttcgaccttcatcttcttgatggaatcaaaaagggatgatggctgttctttgcttgatgaggatttcgcgaaggggttaactggccgctgaggctgtacaccattgcagctatcgacgctcttgtttttaaggccaacctgaccactgcctccctttgggttctgatcaactgtagttgcatgtgatgctccatcattatctttcttcgtttttacacccatttcactgttttttggaattttaactaacggagtttgtgcaggtgaaacctttgtactgatttctttcaaattgtctgcttgttctacctctgccttgtttgattcagttggattgcttcgttgggcggcaggattcagtttaggcaatgtaggtaacttcaagctgtttccattttgcacaaccttagctggtgggactgcttgagtgctcaacgctggtgatggtgagtagtttgtattactattggagaaaacaccagatgtattggcaatttttgcattgtttagcatcatctcctacaagaagccattgcataaccttcagttgaacatatgataaattcttaaatattgaatgtgccatttttagagtgctaaaagtacgcaggttcagtataagggttgtgaatttcacctcgagtatggcactgaacctttcttgcaatatgggaagttttaagcgtgtaacaagcatcaatgctcccttcattgacttctccagtgttagtaattttgcaagctcggtagctcgtacaagcttatcaccttttgaaatcaagaaataaaacaagaaataatttaatgcaaagcactatttatgggtaaaaagcatagttcaagtcttgtaccattgcagcagctggagatgagcctcaagatgcaccggtcaagtgcagcctccatgttgaatgcttcatcatctaatgcaatcgtgtccagacccaaagcagccatttcttctattttcttttgaatctgagataaacagcaacgattaaaaacaatatcacagatactgcccttcaaaactgaaagaaacacagtgcacctgtgagagatgcagtttcctcatcatgaattcagtttccaaactattggcaccaaggtcagatgatgcaagaggaaatgacagctcaagtattgtcaaaacaggtttgggcatcacctgataagatcagtcaaagacgtcaaacgacaaacaaatttcaatatttgagaattgcatatagaagtactatttttgttggaacatcaacactcaaaagttgtacacatgagaagttgcatttaggcatacctgtggataggactccggggacttgcatagaatgcagaatatattattagcatctaagcccaccacccagtggctttcatcttcggattttcttgccttgattgaactgcagttggatataattattaagtgtgctttggtagtagtaaaatgcataacctgtcaggcagatactatacctaaatattggaatccagcttccaccgaattgaccagaaaagaccctcagtattccctagaaataacaatattcagtttaaaactcccatgatataactaaagatatgttgaattgttgacagtgttcattggtcataccttggaatcaaaggaactaagttcaccattctcactgaaaccaaaccaagataatttagaggcaggagttaaaacaagtcggctggacaatgattgagcacattcagatatcttcagtactttaacatccagcacctgaaagggttaatcatgaacaaatccatgtttcaattcagaatcttgtagtaccatttcaaccatcagttcatatgtactgtgaattggttcacacgattggaatcatggtacactaggaggtgctgacaatctgataagtgatagctagctacaacatatatcatcactacacaaagctccaaaagtcaaacgaacatatactgaatacctggtctcctgatgaaagacaatctgaagcatgagacacaatcgctagctgatctccatggcctgccgcagtaaccactgggccaccgactgagaggatatgcatctgaaaatcaagagatgtgtttgacaaaacttaaagagtttttaattgggccacggaccgaggatatgcatctgaaaatcaagacatgctaggtaaaagtacaatataaaatgagtaaattaaattgaatttttcccacttcaagtaacaaacagggaatgatgtaaatcagattcatgaatgcttatgtaacccccagctcgcatgtatcaagaaaaaccatccaagattagtaatatgtagtttggctttgctatgtaagtcacgaccaatgtcatgaacagcatttttaatgatctaaaaatgtaaatgtgttccgtagaccacttcttggtgagaaatggtgataaaagttactagtatctacatggaaagtgcattccctgaattattttcttgagtgcaaaaagtcaaagttataattcgtgccccacaagttataattcatgagtggttacatagtacaacaatttctgtgcttctgatggttagggcgggacaatttcggctgtacattggatgtagaaataaaaaatggtttcagcatttaaatgttggtagtatagaatgtttccttgaccaataaatttaattggaaacatgtcgagagtcgcatgaatctaattttcttctataacattaattgtttttaaaatactataaattcttttgttaatacttcacagctattttggccttatgaaagctctagtagatagcactgaaaaaaactaaagcaacctggttttttgggtattacggaactaataaggaggcagttttctttcaggaaaaaaatgaacttcacaaactgattaccaggcacaacctggttttttgggtatttcggaactaataaggagtcagctttctttcaggaaaaaaatgaacttcacaaactgactaacaagtatattcatcaggaaaaaaggacttaaatacaaagcttgaggaagttacaaaacctgcaaccctccctctgtgaaaatgcgcagaaaatttaaagttgtaactgcagcgacccatccaacaccaacagccacagccttcacttcttctccctcaaacctcattgaccactaagtaattttcaaattagtccagtaagcaccaaagtggtaaacttcaaccctatctcagaagctggcaaacaacaatttcatttagttaacttacctcactgttgcctgcccaactactgaaagggcggtacataagagtgctcatattcttgtcacccttgcatggatttgcaaagacacttcctgattcattcagtgcagccattgtgaaaccaaaataatcagtcatcgaaggaactctaggacctcttccggtgtcatggaagtctacctgaaaaacaaagtaacttcggatggtttattcacatccaagctgcaaacaagtagaggatacaatggcttataagatagagggtgagaagattttacctctacatgtgaatgcccctcattttcgatagtagtgatacttccaagcatattgtaggcaaggaaatttcgcttgccaggttgaggtggtgtggacccaggctgaaatgcagtttgcattcttgctgtaaccagtcttactgaagttgctgaatcacctattgccttatcagcaacctccttgttatctctatgtgtatctttcattctcttgcgtgactccatctgaagtatcagatcctcatcttcactatctccatttgagtgatcatgataggttgacttcctcctcaatctcttgtggttgaatggacctaattcaccaagactttcatcatcatcatcatcatccagtccaccagaggtactcggcctctcctcatcatcctcgtcatcaaacaaaggaaccttagtagagttcaggtcaggtgcaccctctgtgggcgatttcaaagtcgacgggatgaccgattcccaaatgccaaatctgccagttacgtcgatcactgctacagcattactttcaggtttccaagccaagctacatatcctttcatcgaacttctgcctctcaacatcctgctttgacttcacatcccagatcagaacctgcttatccaatccagcagtgactaggtacctcccatttggagaccagcagagactacacactggttgctcatgctcccctttcagagtgaacacctcctcaccggtgtccctatcatacatgaccacattattcctcaatcccggaacagcaaggaactgcccatcagggctccagcacagggcattgttgattgagtggtctgaaccaaatgtcggcgcaatccgcttcagactacgggcttcagtccccgtgcagagatcccagaagatgactgtgccgaaggtgtcaattgatgccaaataatcgtttctgggatcgaaagacaacccggttaccgatcccttgtggcccttgagcactttggagatggtgttgtcgatggtggcaatcaacttgatgccgtcgtcgtctccggccgccgccagcagagtccccttcttgttgaaggccagtgaccggatcggcagggtgaaccgggcgatattgctctggaacaccccctctggaaggaaatccgaagcaaaatttcacaaatatagccgtggaaatgacggagattaggagaaattgcatccggggcagtcagatctaagaacctgggaaagaacagaacttgacggagtgatcgatggagccggacgccagcgacgcgccggagcccggcgcgacggcgagcgccgtgacgccatccttgtgaagccggatcgtggaaagcgccgccgcagccgcggagcccgagctccggccaccggcggcggcgaccgcagcggcgtcatggatgaggatggccacgtcggcggcggatgcggtgacgacatgctgcccgccttggccccacgcaacggagcagaagactggcgagccggccttgtgcgcctctcggagcttcaccgcgcgccctttcatggtgacaccgacgacgacgacgagagattcttcacccacgaggctgaagctatggtggcggcgggtgttcaggaatttgttaggggtttccagagattgacgatacgcggggtggggttttggttgcagacattttggtgggttttggcgcgtccccccgcgcgggaaaggacgtttggcgggaagcttttggtggagtaccgcgggaaaaatacaccgaatttcacggccgcagtggcggaggtaaggtagggatattttcaaaaataaactcaaaaggaatatatgtttaactatcgcatttcttagctgaaatatcattgctaaccatcacaataaaaaaaattgtgctttttagtcaaagtccagcacgttatatacttttggatttttttttccttgtcccagcattgctcttgcgcgggcggctggcggcaaaacaccgccaccttcctcactctttcttgctgcatcgccaccgtcggaaaccgagcggccaaccaagaaggcggtggcaggcaaaacaagttaatgacgcttcttctcggcacgggaggtggagtggcatgcaccggtgggtagagtactcggcgcggccaatttggccacgccggatgcgcatctagccctcctgcagcaagattgggagcgggcaactccggcggtgccgaatccctcaacagcaatggcgctcgcggtgacggcggcccggtggaggagcggggcggcacagggcgacatgacgaagcacggtcatggtcgatggcggaggacgaggacaatgcaagtgacggtcggacgacgaggccggcgcgtttggcagcggtggaggcaaggaggtcgtcaccgaagaggctgacgtggcgtggaggaggctccgttgccgaaaggctggagcgggcgttggcgatgacagggaggctattgcagtgaatccggcggcggctgaggccaaccgagaaggcgtgcagagagcacaacacggaggctcgtagctggcgagcgcggcgcagaggctaccgctgtgggaggatggaggcaacggcaatgcgaccaagctggtcgttggacacgaatagtctagtcgaggcggcgatgacggtagcgccatgaggtgggtgttgaaggctacaacgatctcttttctaagcgttagtcgaggcggcgatgacggtagcaccatgaggtgggtgttgaaggctacaacgatctcttttctaagcgttagtcttgttgtggtggcggcttgccgcggcaagatggccatgttggacgggccagtgcggaaagaagggattcattcctctctctcaccctttccctctccaacccacccacgtggatggatctagagcatgtcacgccttgaaatttagctcaaattttcagactattttatatataaatccttgtcgaggaaccaagccaggatacacaaaacaacaaattaatttatagatccaaacgtaaatacttatataagagacaaaaatttacactccacagacaaaaaatcaactggggtataagccttgggcctctaacttcgtattcagctcggaaagcacaaacttctgaaaagggggaataatacaaaggctgagtacaaccaccgtactcggaaaccacaccaacgatacagacatgtaagagaatacaagggaggtttatggctatttgcaaaaaggcagttgtaaacatttgaagttaaaaaaagcaaaattgttgattgattaaggcaatattaaatctccgctgaacaattctacaccacgttgaacagacccaaccaaaccacctgaactacaccaatttattaaatcaaattaatagagtggggctaatcacggtgaaactagttaatcgcccatcatcacgggcatgactattcgaatagttttactttagctagagatgcacaactgtacccacaagacacaatctaccggcatatcaccgtgcccgaccagacacgtcaccatgttgagtgattgtgacaagacccttcgcataactcccactgaccaattgcatcatactgtaagtttcgcccctatctttaaaaccaaggtaggcaaccccttttgtgcctaggtgaatccggaagccataaaggccgtcgcagggcccatccaaactccatcacgctcactcttgcctcagtacgtcagaaagggaaaagttacactacaagtccagcagttgcccattcttgcttgtggtaagcactgtaagtcttctagggtttcacgcgaaccgatccttaattaccatggatacaactagcaaaaccatacacctaggtttcccgcgaaccggtcgttaattgctatggatacgactagcaaaaccatacacacacagctcaccattaagccatattttagttgtataatttcgagcaataaaacatggctaggtgtctcgaactcacaactcatcaagatactaaaggtagataatgtggtaattaagcatggctaagcatatataattctacctaggtcaacataagtgacaagctagtcaaattatcatccaatttgacaaaggatggatattaagtaaacatggcacaagcgagcagatcggtagtccctaatcccatgtaattagaaaaacatgcaatttaattatttgcaaacggtaaaacattgtataaagtaggctcaaaatgctcaactgggatgtgggacttacttcttcaaaatatcttccgaactcttatcctcgcgatcgctatcttccgaaatggtgctacctaacggcatagcacttctcatagccactcccatccagccacacatcattacctctatcgtagtaattttttattcaaccactacaccaccgatctacccatcactctgtctatcaatagtgatttttttactctcacccctcacccttatccatggcacccaccaatatatttacggcgaaaatgctagggatcgggaacccgatcagcgccagaaaaatcaggcgcccgccacttccggacctccatgccgtccccaccactcgccccaccacatgcgtcgttgtaacaaattacccacatattatggaaatgctctattaaaggaatccgtttcaatttttgttccaccaacattgtttcagcaagtgtactcgtaatttttcactattgtcgaggagagatcctctctagcgggtggtcgtgagacccccccctttgtgagttcggccgggggagatggtgcgatgatcaagagcctacttccacttggtgcttaactactaaatcgctcttgtggctgtgtcagagaccatggattatacaggtttgggccgctatcaagtgtaataccctactcctctgtgtgggattatggtgaattttgacaggaggttttgagctctaagggaaacctagctgttcttcctctgagctcaagttgtctgagagtcgtcctctttctcggtgggcgaggtcctccttttatagttcaaggggataccacatgcaccgtttgcacctacccctccacaggtggggggcccacatggccctgatcagatcgctatcctttgtttcaaccggaagcaacacggtcgcccaacttcaggtggggcccagcgccgtcccccgcctgacatgggggacatccccgtcattccccattaattgtatggggacttcggcggctcaccacgcgcggggggcgcccctggcagtgtgccgatgcgacggggcgtacctgcccccattccgcttgacacagggcggaacgtgggggcactgccacctgtcctatcacctgtgaccggtcatagaccagtcaagctcgattgacatcaatcgagcagcgccgcacgtcctcccacgccgcattaaatatggcacgggatggttggggcgccgcgcattgaaggcgtggagcagcgtttctcgtcccgcccgctctccccgccacgtagtggccgggcgagggcctccgggtagcacgccccgaagccccgagggctgtgacgtggcaccccgaggccccccggccacctcagcgctacccgaggggcgaggggagacgaggccacgtggccacgcgacttagatgagaatgatacttccctctattgtgtgtactcccaagcccatttcaccgacagtagcctccggcactgtatccgagtgcgacccccttggggtggtctggtgtggtgcctcataacttccgtctcatgataatgggttgcacgggggggtttgaggagtcattgttggcgagctcgatccaagcgtccaccgtgatgattattcgaccgccgataaacgcgccacacgcgaggcgcgcaaggcaggaaaagtgaggggtcctgttagactgtgcccggtgccattactggccgtctcgtcaaccgcctgaccaccaggcgcgtgggaacgcgggattatcggtgggcccgcctggccgcaaccgtaatcatcatgcgtcccgcaccggccacgccgttgacaggcgtgctaagcgcggggcgtgcgattagcgggacgaatgggacgagtgggtgcaaaaaacgaggaggcaaccgaaatggcgagaaacgaggagtcgggcactggtgaggcgaggataaaaagggaggaatgcggagagttcgtctccttcctctcgccattttcatactcatgcacacacttgccaacccctagtgctcttctctttctccaccgtactccgtgcacccatcctcttgctcgcatccgcccagctgccatggcccaggacgccagcaacgccgttttccccacggacggcgccatcttttttttatttttctctttttttccttttttttaaaaaaatactgcaactggggttctcctgttgtgagattccctcccgaggggcctcgacagccgaatcccccgggggtctaagtccgagtggccggggcggctgggagccggccgaaccggggccgtgaatccttcacagccccccagcgggggccgtggcccgtacgccgggtccggctccgaatctaccacggccgagaccgccccctcgagggaggagagggtgccatccaccgtcggtggtggcggcaccgagatccccctcggcggcgttcccgagggcaccgccgaaggggaacacggcccagaggcggaggccgaggtagaacgcggcctagaagccgaggtggggcgcggcccgggggccgaggcgagtcacagcctagaggccgaggtggggcgcaagcccgagcccgaggccgaggctgaatcggcccgggggcccgaggcgaagggcgatgacagcaatcgtacccctctgcacctggggcgcccttgggtccaaccacgtgaaagggggcccgagtgcagcccccactctcgcggggggtccagccgtactccatcgtcccggggacggaccacgcccttctcttccccgactcccgcaagcatggagccgctcctacgggtgctcgtcgccgccgactccactgtccgggaggagctcaactcccaagtccaagccctggcggacgagcgagcggccctagaggcagagtggacgtaggtcgcggcggaccgcgcgcgggtggatgaggggcgctgcaccgtggacgacctggtggagacagggcgcaaaatgcaccaggcccagctgacggagatccaggcacgcgaggagacgctggactccatcatgcgggagacggaggaggagcggcaggcggcgctcatcgcctcgagcgtcctagacgaggcgctaggcaacatccgcctgcagtatgaggcccatgcggacgacctggtgcagagggttgaggacgccagcggggtccttgatgcggccgcggcctaggagcggtgggcatcggaggtcgacgcctcgctgtgaggccgagcgtaaagccttagacgagcgcacccgctccgcacaggagttcgaggccatgattcgccggcggatcgaggtcctcgactacaacaaacgcaagcaggaggggcgcgattgggcacaagcgcagcgggcctaggatctggaggagtgggccctagtgctcgaggagcgggcacgcgcgttggaccagcgcgagaccactttggccgcccacgaggcgacggcagccgaggccgaatccgcccttcgcctccgtgaagaggtcgccgccgagcgcacccgaaccaccacggccgccgaggccgtagtggcccatcgcgcggaggaactgtggcttcgagaggaggcgtggcaggagcgggacgccgcgctcacgaacgcagggccgaggtcaaccgccacgaggtggcggcacgccggctaggcgaccagctcaccaagcgtgaggaggccgtcgccgggcacaaggcccaccacctagaaggcgcccgggccaaacacgcggcgatggcggcacgggcgtccgagctggaggctagggagaaggaactggcgtcgcgcgggcagcctggcgattaggccagccagcttgccacggcccaagacaccctcgccgatctggggcgcttggtgcaggaccaggctggagagatcgcggccctccatcttgccaacgacatcgggcccggccagctccacgacgccatcgaacggctggaacgtgcggggcgccgggtgggcatctccatgcgccgggacaagaagctcccctccacgaggccggtgctcgcatgatggttggacgagatggtggtggacctggagaagctggagaaggaggtcgtcgaggccgtgaagtcgtcatcggcttccttggcgcgggctgcggtggagcttatcctcgcgagccaccaggcccgtgaccccgacatccttccctggcgcgcactcgaagatttccccccggggattgaggcgacggcccgggagcacgttcgagacctctcgctctctcgggtcgtccgccatagcctctcgctctcccgcggtggcctcggggccttacttgggattggtggctttgggcgttgggccgctagggaacgaggggctgtcgctggttaagtgggcccctggttccctcccatgtccgggcttgtgacttggcatccgcgggtcatgttcatcgcgttccactacgagggcggcgctcaccacatggggggtcgcaaccaagtagagtagcagcggctcctctggaactggggccaccagggtcgaaggggaggtgaggtaggccttcaactggttgagggcttgctaagcctcctccgtccacacaaatggccctgagtgcttgaggagcttgaataggggtagcgccctctctcctagcctcgatataaatctacttagggcggccatacgtcccgtgacacactgcacatccctaagcttactgagggcgcatcctctttatcgcgcgtatcttctcgggattagcttctatgcctcatgacgagactagaaaaccgagaagcttgcccgccggcacatcgaacacacacttttcggggttcagtttcatgcgcgtggacctaaggctatcgaaagtctcagctaagtccgtcaacaatgtttcttggtggtggcgcgtctttaccaccaagtcatcgacataagcctcaacattacaccctatttgattactcaaagtaatgcgagtcatgcgttgaaaagtagggcctgcatcctttaaaccaaaaggcataattgtataacaaaaggtgtctacaggagtaatgaaagcaattttttcctcatcttcccctagccatgcaaatatgatggcatcctgaataagcatctaggaaacacaaaaggtcgtaccccgcagcggagttaactatctgatctatgcgtggtaaagggaagggatccttagggcatgccttattgaggtccgtgtagtcaatgcacatccggagcttgccgttggcctttggaacgaccaccgggtttgctagccactctgggtggatgacctctcggatgaagccggtctccaggagccgcgtcacctcctcacagatgaagccttgccgctccggggcctggcgccgtaccttctaccggatgggtcgggtttccggccgcacggcgaggcggtgctcgatcacctccctgaggaccctgggcatttccgacggcttccaagcgaagacgtcggagttcgcccgcaggaaggagacgagcacgctttcctatttggcgtccaagttgccgccaatcttggcggtcttggacagatcatcgccaaggggctccttgacgggcaccttatcgcccgaggtgatgcgcttcttggaggcgtgggatgcggaggccttcgggaatccgccggcctccactggctcggtggccgccgccaagctgtcagcacactgctccgcacaagccaaggcgatcttgacatcgccagagatggtgattgggccattggggcccggcatcttcatctgaaggtaggcgtagtgggtggcggccatgaacttcacaaccgcgggccttcccaggaccacattatagggcaaattcagattcgccacatcaaagtcaatccgctcaatgcggaagttgttggagtcgccgaaggtgactgggagctcgatgtggcccaaaggccacgtgtgccctggtgtcaccgcaatgattggcagcgacggctgaagcctcatccccgaggccttgagggcatggaaggccaccggggagatgatgctgaggctagcccccccgtcgaccgagacgcgcttcatcttgacgttgtggatggtcggggagaccatgaggaccagcttccctccacgggtgagcaccgtcgggtggtcgctctggtcgaaagtgagcttcacctccgacccgcctcgtgggttgggatggcggccagaagctcacgcctcatggccttgaaacttcgacgggaggcatgagcacaagcccccccccggtcgagtgtggcgacagtcccctgaggtacctggaactccaagttctcgctgttgtcatcgtcatcggcgggggcctttttcttggcctcctctcgctggtcgccagcggaggtcgcggggccttgccctcccggcgactctgctgcctctcctcattggtcttcctgtaccgctcggccaagttcttgaccgtgcggcagtcagcaaggctgtgccgataagtgttgtgcaccgagcaccacttatccgctgaccggctttcgccggggggagtggtgatgcttggcttgtcgctagtgaccttctccttgcatggggtccgagaaggaccgtctgcggcaaggacatggccctcgtcgttggagcgggccggcttcctctttctcctcttatcccaccgcttggagtgggaagagggctcgggggtagccactgccgccgcaccatagccagaggagttccaagcccacgcctcttccttccgagccaccttgtccgccagctcgaagagctaggcggtggtcttgggctccttggaggtgatcttctcgagcatgcgattgtgccgcacgtcgctgcggaatgcataaacggccgtatgggccggtatgcaggggatggtgttgtggacctagcagaaacgctgtatgtacgagcgaagggactcgtcgtcctttcgctgcacagcgtgcaggtccgcctccactcctgggcagggatatgtgccctggaagttcgtgatgaaccgctagcacagtcctcccaggagtggatagagtcagggggctgggtcatgagccagccgcgcacctgacccttaggggccatgggaaaataattcgccatgactcggtcatcacctcccgccaccacgatgattgtggtgtagatctggaggaactcaaaggggttgatgctgccgtcatacttctcggtgaggttgggacggaacttcgggggccaccggacattccggagactcgccacgacggccttgcacccggccccaccgggaatggacgtggggggcgagccacctcgcgcggaggggcgcgacactccagatgaggaggcgccttcccctatgcgggcagcatggcactcgtccctgcggcgctcgattttgattcgagcgtcctactccccgtagaggtcatcatgatgcctccggctttccgagggccacgacgacgttgggctgtcgaccgcttcgatgtcaaggccgatcgacgggccctccttcttgcggacaaggagagggtagtgggggtacgcgaggtaccagtagtcacgggcccgccatcggtggccagctgtcgctgagcggcggtgaccaggttggccacgtcatccaaccatcgctgaataggagtctccggctctaggttgacagggggggtgccgcagaagagcccccaccgcctgaagtgcgccctggggcgaaccttcgtcgccgtaggttaggcggcgccgcaccctggcgcggtgtggcctccccccaccaggtggcggggagagggccgagcccccagaccgattggggtcctcctgccgtcgggggctatggcgcggaggagttggagaattctggtgatggtgtcgaggatcgctactcccacttgcatcctcactcccggaagaatgggtgtgcgtaccaccacctcatgttccaccacctcaaccatggtcactgaggatggagagaaacttagggcggaagaaaacgacttccttctcaagcgcgcggatttcctcctacctagcgcgccagctgtcgaggagagatcccctctagcgggtggtcgtgagacccccccctttgtgagttcggtcgggggagatggcgcgatgatcaagaccctacttccgcttggcgcttaactactaaaacgctctcgtggctgtgtgggagaccaaggattatacaggtttgggccgctatcgagcgtaataccctactcctgtgtgtgggattatggtgaattttgacaagaggtttttagctctaagggaaacctagctgttctttctccgagctcaagttgtctgagagtcgtcccctttcttggtgggcgaggtactccttttatagttcaaggggataccacatgcaccgtttgcacctactcctccacaggagggggcccacatggccctaatcagatcgctatcctttgcttcaaccggaagcaacacggttgcccggcttcaggaggggcccagcgccgtcccccgcctgacacgggggacatccccgtcattccccattaattgtatggggacttcggcggctcaccacgcccggggggtgcccctggcagtgtgccgatgggatggggcatacctgccctcactccgcctgacatagggcggaacgtgggggcactgccacccgtcccatcgcttgtgaccgatcacagaccgagcggcgccgcacgtcctcccacaccacattaaatgcggcgcgggacggttgtggcaccgcgcattgaaggcatggagcagcgtttctcgccccgcccgctctccccgccatgtggtggccgggcgaaggcctcagggtagcacgccccgaaggcctgaggggtgtgacgtggcaccccgaggtcgcccttgccacctcagcgctacccgaggggcggggggagatgaggccgcgtggccacgcgacttagatgagaaggatacttccctttgctgtgcgtacccccgggcccatttcaccgacaactatgtatagatcaaatgttgcagtgaattgaaatatcctttcgctatttgctgaaacattgtttttatatatagtgaaacatcacctgattttttggaaaccttttgtttcatacgttgtagcaaaatgttccatgaggtgatttggttgtgtttcagctttttaaatgattgaaacaatttcgatctacttgatgtaacaatgcccgatttttgcaaataataataataataatatcgagcgtccgatttgtaggtgcctcgtatttacagtagtgatatttttattatctaataagttcttgcgatttatatatccgttttgagagcgactagagtacgggatcccgtcacaaggacgagatattttaatgaaccccctacccctttcttttctccagttacgagaaatcccatgcgtgagaaaacgagtaaagcaggaggacacctacccaccctcgtgcacgcatggtgatgatgctagcaggaagcaacggtgctagcaccagcggctagacgccaagagggcgcacggacgtagctacagcaggacggcaacaacaacaaggaagagatagtggaatcgaggaaagaaaagaaaggaataagagaacaagaggtgttggcgatagaccctcgccagccgactaagcagtggcacatgttccttttcggtgtcttgatactaggtacgtccgtacgtggggtatcatacatgatatccataggtaccaaatctgatctcttggtactatgatacctggtacttattaggtaggtatcatacttgatacctatggtaccagacatgatacctgtggtatcagaccagatacttgatacctgtgataccatggctcacaactgataccttatgatacctatggtaccagacctgatacctatggtatcagaccaaatacttgatacttgtgataccatggctcacaactgataccttatgagacctatggtaccagacctgctacctgtggtatcagaccggatgcttgatacctgtgataccatggctcacaactgataccttatgggagtcttcttcgatggtcttctttcttgtttgtttcccttgctgccttagtacctggacttgatgggcgtcaccttgctgcgagcttgggacaaaagaggacacaagagcgttgccgctcactgccctcgtccccaatgtgcgctcagaccggatctagcgataggatgacctaggcctctagatccagcattggcagctttgctcagccaccaccatgactgcccacaaatcagcttgttgcgctgacgccacacctccacaagaacaatactcttggcgaacgagagaaaggggagtgcgacagtggtgttggttggaggcgagggagaggagggaagtatcatcagcatcagctccgatggaggccttatcggctacgccgctatcaattcagtctgtaccacctgagctcgtcctcatctctagcagatggcgtcaggagatgagtggttgagggaggagtggcaacatgagataagactttattaattaactgacatccttatcctttacctcgaacggtatccagtgtgctagtttttctgatccgtttttacccaagacccactctattttttattctcccactgccttcctcctttttcccaacccctctccctcgttttccacgcacacgcttttcaaactgctaaacggcgcattttttgtaaaaagtttctatacgaaagttgtttaaaaaaatcaaattaatccatttttaaaaagaaaaatagctaatacttaattaatcacgcgctaatggaccgttccgttttccgtgcggaaggatccggtttggatccaggaatagcgaacacacccttaagtttatcccgtagctcgaacggtatccagtgtgctagtttttctgatccgtttttactcaaggagagcagctacacaacgggatcccgttgctacgggatactttaaatgactcctcccctttcctttcatctgtataggtgagattccatgtgtgctccccctgatacgtaccagaggcacgatacctatccggttccaactcggtatcacgcgcgcgatacctcgtcgccggtgtcgctcctctgcagccggaccagtatagcacaggctggtacctaatacctgatacctggtacacctagtacctgatacctagtatctggtacctggtacctgatacctgatacctgataccagtgtatggtacctgtggtacctggtacctgtaaaattatgggattcaagaggataggacaggggaattgatactatccatataagccggagaaaaaatcagcaaggaaatcatcaagaaaaaaaagaaaaacacacatgagtaagggatgcaaagcggctgtgaagcactgccgacatggggggcacctaatacctgatacctggtacacctagtacctgatacctagtatctggtacctggtacctgatacctgatacctgatacctgatacctgataccagtgtatggtacctgtggtacctggtacctgtaaaattatgggattcaagaggataggacaggggaattgatactatccatataagccgaagaaaaaatcagcaaggaaatcatcaagaaaaaaagagaaaaacacacatgagtaagggatgcaaagcggctgtgaagcactgccgacatggggggcggagaaatcagtcggagtagaatggagtgtgaggggtacctgcaggtatcgaaggaagggatgcaaagtagcggcgcagcgctggtggcgtgaggaggcggatggacggagggaagcagtggtgggtgaaacactgctgcgtgagggtagagggacgaaggagctcgcggtcctcgtcggcaggggtgcgacgacgcaagagctcgcatgctgcttcgccgccgctccgcacgttcctgagccggcgggagcaactccgcgcggcgccgtcttccccatcgccggtggaggagggagagcaagacgccagcgaagcaccgccacgcgtaagcgacgacgaggacggcggaagccggcggagattcaccgccgtgagcggcaacgacgccgatgaagtcgatagaacgccactgtttttccgagagtcacgggtgggtgggggaaaatgaaacaggcactggacgcttctgttcagaaaaacggtttatacactaattaatcacggttaatcgctatcggtaatcgcaagttaagttctcccgttgcaactgaaagccgtggagtagattttctgttacccaagacccactctattttttattagcccaccgccttccctttttttccggatctgaggtcttggctcttggcggcggtaagctcgggtaagctggggtcgacggcggcgaacttcacctacacgctccgcgcagatttaacatgccatcatcctctgtaccatcgcgatgcccctgacgagaaggcagcgatcgaggaggtgcgccccacgctagatcgggagaaagaggtgagcccgtcgtggcccatagagcacctccgtcgcaccacccgtgcagatcggaggatgggacatcgtcccttgctctatgaggtggtggaactggacctgctgataggcctcccctatggactgagctttagcgccgttgatcaccatcttcaccggtcggaggaggccgaagatgtagccgtcagatcaggcacgacactgccgatcttcctcgtgtgttccgtggttgtgttgtagaagagtagcagcctgctacggctggtggcggtgttgttaatggccggcacgtctcagcgtggtaagtttgcattttgctttagtctgcatcttgtttatgtagcagaaacaagagctccgaggcaaagcaagagtgtgctgtagaagcttggcacaatgcagatgccttccctgtgcgttaacgctgccgccggcgccgggtttcctactctggcaccgtaaagccgtcctccctcttcctgctccgccggtggacgccatgactgttttgttgtcgtcatttttagccagctgcccggaaggcactaggacaggagacaggaggagttcctttgatatttgattgaacattggggcttcgatcctttgcagtatgcttggtgagattgaatttttagtttatcacttaattgcaggctgccaaaaacagattaactaagacttaactttgttgttggtactattctcccttacctgagtatgaactttagacccggtttagatcacaccctaaaatttttcaccctgtcacatcgaacgtttgaatacatatatgaagtattaaatataattttagaaaaaaaactaattacacagatggggactaatttgcgagacgaatcttttaagcctaattgctctatgatttgacaatgtggtgctactattagtgtctgaacaccccatgcaacaccctacacaatatccgatgtgacgccaaaactttactcccctagatctaaactctcccttagtttgttatggatgcttgtttcaggatgtcggcaggcacttctgttcagtgtccaaaatgcatatatacgattatcattaaggcagcgaaagtgtactgcgtcataattggaattctactactgcaagcatatagcattatggatttatgaagctgtgtccccgatacttctgagatgtcctgctaactgagcccgccccgagcttcacacgagactagagaatcggcaagtggcgatgccgtcggcgtttatggggtcgtgctacaacaaacaacaattattcatagtgacgaggtctagtgaaggtgtcaaatgctcatttgccgatgtcctagtgctcatatagtctgtaatctttctcgcggagtcagatgattttatttgtgtgcaatttttttttcatggatagattttgatgtttgagatgtaactacgtatggtgatggtagaatatctttttactgcgatttttagttggcatataggaataaattacttccttcgttttatatatatgttaatagatatatatgtatctagatttattaacatctatattaatgtggacaatactaaaaaatcttataaccttttctgacaaagctatcgagacattagagagagaataaaccaatgagtaaagaaattactagtggtgaaaaaaaggccacgggggattagagagagaaccggtgaagcaggaagtaatttttcggttttgttaaaatactgtcaccatatttttggcttgtttacagtagatctctagatgatttgatcttctctaagattcatgctgtggcaaattacaggatataaaccaaacaatgatgcaagatgttagcagctataaaaatatggtgacaactttttaggtaaaaatacgtcaaatgaaatttacacagtagttacacactacttatatatgtaattagtatgtaattttgggacttacatcgtaaatacactaaaattatatatgtaatttagtgacttacaatgtataaatacatgccgactattttttattgaaaaatataacgccataaatatagctactccctaatctttttactctactataagtcttttttttcccaatcttattggtgagtaatatttttacttcaatctattctggcttttattgtgcacatatctgagtcggtcgagagcaaacaggggattgaatcttagaaggacaaaatagtcttattgtgttgctttttttttacgttagttctataaatattttttcctcttaactgcaccaaatcaaacggcaatggcgtatggcatacgccatatacatgcactaatttcagtggcaaatttgcaattgatggttttataatggctattataaattagagggtgaaagtagtgatatatttataattcttccaattttaactgaacaaatgttccacatacatgcggatttatttgacgagtaacttttctactcatgctatacgagggcaggtgggttggtggcctcgtggtgggggactagggtttttgtcactgtgtcgcgccaagaagttttatcgcgcgcagcgtgttgtgtaacgggacccctgaccctcgacaaaaacggaatttctcccacatgcgctccgtgtcacacacgcgctaccgcgcttcgcgtggggcatcttgcgtggcctgagccttagcccaggacagcatggactcccccacacatcaggacatctgtcgtctttccacctctggacaaccgccacggcattatcgattgaaaaaaagagaagcacgaagaggggaggaggaaaaacagcaacttggaggagaggaagccggaagaacatatccaaaaatcatagaattatcacatgtaactacatatcaagttcataaactgtgttttgagattcatccaaaaaacacataacttgttttaataatggaatataatcccggcctttactcaaatttctacagccaattattacaccaattcaacaaaaactcacacatgaataaacaaaagcacacacaaactaataaaaactcccacggcataacaagatcacaaaaattattgaattctatttatgaatctccatccaaagttagtgaacaactgtataaccattgactccagattacgacatgcagctttcactgacttgatttcttcgtcacactttagtagttgaggctaagaccagagccaatatattgccctgaaaagaacctgcgtatacgacatcgatggtgatttgttaaaaaccatatcatttctatacaaccatatagcccaacatatagcggatgctccagcaaggataagtttggtatattctttatcaccccccacaagccaattctcaaaatatgagatatactatgaggagtatataaaccagtagtaaactatagagctctccaaagaaattttgcatagtgacactccacaaataaatgttgaatagtctcatttctcatgcaaaaacaacatttcaaactaccatgctaatttctcctagctaaattgttctttgttagaacaaccttgagaggcatcttaagtttccagataatattattcctctcaatgtagccattattaattaaagctaagtatatagaccgaaccgagaatacaccattttgatgaaaattgcatataaaaatatcattctcctcagtcaaataaatatgcacaattgaagcacataaattatgccaattgtttaaattatgtcctactaaagctctcctaaaagaaacatttagtagaacacaagacataacatttgcaattgaagaattcctcctacgaactatagcatataacgacgggtacccatccttaagagaatagttccctgcctatttattctcccaaaatctcacttgtacaccattattcacaattcaggaacccatatttagaaacttgctctgaactttcataagacccgaccaaaaatgggaatccccttgtttcttctcaacttgacttaaggattgattataaagatatttcattttcatagatcctaccacacgccctactcatttataagcctaaacaaccatttactcaaaagacattgattttgaattttaagattatgaactccaagagtacctttgatctttgggttaagcctatacttattcttgtgctcatctccttgccaaaagaaacgtgatctataattaattttttgaagaactcattttggaatctcaaaaaaaaatcataaacatggctaaactagaaagcacagaattaatcaacaccaattttcccccaattgacatatgcttacctttccaactactaagtttcttttcaattcttccctcgattgttttcctatccttgttactaagtattctaaaatgcataggaataccaagatatctcacggaaaaattcccaagcttacaacaaaaaatattagaataaagctcttgacattccattgactaaccaaaacaaaatgattcacttttataaaaattaattttaaggccagatatttttttcaaaagtcaataataacaattttagatttttggcttgtagtagatcatgttctaaaaaaaaaagaaaataagagtgccatctgcatattgcaaaatagaaagaccatcatccaccaagtgtggaatgatcccgctaatttgaccatcatccttgaccctcttaattataattaatatagtaagcatatcaacgactatatttaaaagaattggagataatggattcccttgcctaagacccttataactttgaaaattagaaccaacttgactgtttacttttataccaacatgtcccccctggataaaagaggcaatccactgacaccattttagcgagaaacccttcgtccttaaggtttgttgaacacaagaccattttaccttatcataagctttctcacagtcaatcttaagaattaccccactcttgtttttgcgatgaatttcatgtataatttcatataaaataacaactctttccataatatttcttccaggaataaaagcagtttgagtaggactaatgactttttgggcaaccccaattattatgtttatagcaactttagtaaaaattttaaaactaacataagtaaacaaataggctataaaatatagtaccaaagttaacagaatataaacgtaaagttcccctatgaaaatatttaaataactccaacaaatcaaatttaatgacattccagaaaaacctgataaaacttagctggaaatccatcaggactcggagccttattatgttccatttggaaaactatgtctctaattttcttctcactaaattcctgagttaaagcctcattttccatttgagaaatttgaggaatatcatttgttctactctcatctaattgtaagatagagtcctctagtggccaaacaaacctttgtaataagtggtaatatgcaattttaaattcgcatcaccatttatagtttggtcaccatcttgtaatacaaagattcttgttttcctttgtttgccatttgcaaccaaatgaaagtatttagtactagaatcaccttctaaaatatctttagtcttagctcgccgataccacttaatttcttcttctctcaacaaacatgctagtctatttctccaaacatatctaatatcaatctcccccggagttaataaatctgtttcaccctttttatcaagcaaatcaagattatttaataactattttttctcttttttataaacaccacttgtatgtttatcccatcccctcgaatgttttcttaatctatgaagtttagcctgtcaacgcttaggagtattaccttcatctgtggaggaccatatttccttaaccatgtctacaaaaccatcccatagtagccaatctaattcaaacttgaaaatgtgttgtccattacatggtgaagaggagtttgtaattaaaagtaaaggagtatgataagaaatatctctattaagagcaacaaccgaggatagcgggaagttatgttcccactccgtcgacattaatactctatctaatttctcataagtagggtttgctaaattatttgcgtaagtaaaatttcttccagacaaaacaagttgtctaagactcaaccatccatagttgctttaaagagaaaagggcacatatcatcacagttatcattatttttttcatcatgactgcgcaaaatattaaaatcaccaccaatgagaattggtaaagcttcatatctgcacatattcactaattcaagaagaaattgttctttaaattcattttgcgtcagaccataaaccaacaccaaagcccatttaaacttatccaatttattacataaatgaaatttaatataaaaatcaccctcatcaattaaaccaatatcaaaagttcataaattaattcctaataacatccctccagatctatccctaggaatgccacaaaaaatctttactagcacaaagatttttaagatcagaagaagtaaaatccctcctaacaaactctgataacgcaataaaattaagttgatgttccttagtaaaatcagaaataaacttatgttttttttgggtctttaaacccatcacaattccaaaagactcctttcattataacttatttttataaacttataacttatttttataaactttgtttcgcctcactcttttgccttttttttttgtccatggaaggtatcttagaatctgaagtagtttgaaaacgaatccattacctcatccataatttcactacataactgatgtagtaaaaagatatcctctaattgatcctctacgaaatcattatcaaagattaaactcgagtcattattatcatttaaactaacatgatccctaagtctttcatgttctacacttcttatatcattaatagcgtcatctaagctaacatccttatttgcagcaaaaataccaagattttgtaaagaggcagaaatatcatcattagaaaaatgtaaaaaggaaacattattatgcaagttacctttagccttttgattttctagatttctgtcagcctttatcttctctgccctttctagagcgtgttgaatgatgtcactacctctcctcttactcttcttagatggagacaatatcacttctggaacagcagcaagcttttcaactaaattgtcctgggattgaactccctccactagagaagtatcctccatcaaagtatcaaattcttcatcagacatagtcaatccacgtaaaagcataacctgagtagatggaaaggaagaagcacccttctcacggtcagaacgctacgacgcacgggatggacaccatgtcgcttgttcgcgggatggatggctttcccagcattgcgcgatggcacaaatcgataggcctctcgatgtagatttatgttctttttagaaaacctgcatgtttcaggagactggaatcctatacctatacaaatcatccccactactagaactctctgcttcctggtgcttccacgtcaccttttttgtccccaccgttggatccgcatcgagcccttccttccgcgtcgcttctctcctctcctctcccacatctcgctgcttcgccggctccacgctccccttctctcctctcccgcatcactctgctttggcggccccacgcgcatcaactcccctcctgcatctcgcgccgccgcccccgcaccgcatccacactgtgccccgcttcgcgtcctcctcctggcgccactctgcgcgccggttccacttcgcctcccccttctagcgccggccacttcaccttccccgccccatcgacgcacctgtccatccaaccctgcgaggctgcgaccccccatctggccgtctgtcctatgcctcgccacaccaacaggaagcaaggccgccgctcccgtgctgcttccactcaccgctaactgcctcactgccctgccctcctgtcttttactgatccattttcttgcaaccattcccattcctcttctccgtccagatagagttcagatgcaaataaattcccctcctcttcctcaccacgaactagcatctcatcaatggagattgtttcgtcctccatcgctaccgctggtcaagatgaaggcggatccacgctgttgcatctctgatgaatggctcgtgtggccgtgttatagcagccttgctgacgccctttcgtagggcctctttcttatacctacttttctttacttgctgctttgggttctttcacttccgctctagaaagtaggccttaattgctattggtgactggtgaatggtgatactggtgagggaaccggatcctctaacgtaatctattctacgtcagagggacgttcgataacagatcgtcgttgcttgcgcatccgatggcaacaactgtttcaatcccatctcttgtctcaggccccgcaagcgcgatgtccctgcctgctctccggcccattcgttaataggggcagcggtgccgcgccagccgccggggagcttaggccaccgcgcgctgaagccggcggggaggtcggactggaacgcggtgctaccgctgtccgccggcgaggtcgacggcgatggctccgcccagcggctgctgttgtcggaactgtcgtcggagagctatacggggaacaaatagaacagaaaagttactcatcttctcttcacttcatgccatgagatttctttcattggttaacatctgcactcgttgatctcttcttcaaggaaaaaaactatcttctttggtattttcttattgcaattgtagacttgctatgtcgcattcaactgtgaatctgttggcaaagttttggtttcttttcttctggttagctctgatttttattcttcaggttacttgtagtttctgagaaaagttaatgacagcacgaatgccttagcaagattttcaaccagctgcctcttccatgagaaaaggcaacctgatgatggaagttcgatcggctacagatcgattccaatccaacctcgccggcgacggttccgagaacagcagtcgttgggcgatgggaccaacagcaaacaccgaggcgggcgtagccgtcgccctcgacctcgccggcggacggcggtagcaccgcgtcctagtccgacctccccaccggcagcagtgtgcggcggcctgagctctccggcggccggcgcggcactgctgtccctatcaatgaatgggccagagaacgagaaaattgtgattttgctatcgcaaaagaatggtttcgttggaatactatcccttcaaagtgattcattaaaatgctatcctaaactaagaggtgttcactgaaatgttattttggatctttttgttagtactaatgtttttactctcttttagattttctccggaccaaaatgccctcgcctctatgtcctcctttcgccaggataatggcaggttgacacatgctttgctagagcaaaatatattgctatatatttgtgaaacctatgcacggctcacgctccgctgcatgatatgtatatactaattgatcattaacactaatacaaaagctctagtgcactggtttgaaagtcaaacagcacctctctagttaattttgacacatgctttgctagagcaatatattttgctttcacatttgtacaataaaaatggtgtgtagtccagtttagccacaagcgcgcataaagatcaagatttttctcactccaagttataaagatataatggtgaagctagcttaacccataaattttgggcatgaaaaaattgtaaaaacaaaatagaacaaatttggacagcatgtagacataatattgaatagcatgtggttcacaaaatacctcacataacaatggttcacaatataacagtggttcacatgtaccatggttcacaacggttcacaacataatagagacaaggacacaagggtattttggtcagaacaaaacttaaaatagagtaaaatcatttctagcaaccaaaaagatctaaaatagcatttcagtgaacacccctttgtttagaatagcattttaatgaatcactttggagggatagtattccagcgaaaccattcttttgcgataagcaaaatcacaattttctcccggagagcaggcagagacattgcgctgtggggcctgagacaaaggacgggactgaaacggttgttgtcgtcggatgcgcaaggaacggcgatccatggtcgaacgtccctttgaagtagaataaagtacgtcagaggatccggttccactggtgagtagtgactatgagtttccttcttctttcctctatcttcgactggacatgatttttgttttccaagattacaaccagggttcagagcaaaaccatgtggttactgattgataggcaaattctatgtatgtggatgaaggtatgtacattgtttaccacaaaacatttcactctgcatcttctatttactaattaattatgtaacgcttactctctcctatggtagtgtccaggagcagtagcaccatgatttcatctatgcaaatcacccaaagtaaagtacaaggcatcttattaccgctcttgcttctaagaactttatagatgaatccagttccagtactgctttggcattgagcaagagtaacatcgtatgatgtttcctgatgcattttgtccttattatttattgtcatattctaaactgtgtgttgatgtatttaggtagacaaatattctctttttccagctggcaatgtatctatgtttacctacaggtatttacctcttcttttttttttgcgtcaatttgcaggctatgctactgcttcctctaggaaacagttctgcacaattagaagaacctgatataatatatatatatatatatatatatatatatatatatatatatatatatatatatatatatatatatatatgatgcattgtcaagtttgttcccagaggtgatcttctatgctttaaatatctctcttcagttctttttatccaatgtacattacatagttttattcctatcaacactgtaaaaattaatgatctaggttatatgaaaaaaagatatcagaggtgcccaagctattctgctcccacaatggatgcataataggccacataatccattcatcttcatcgttaacaatattgtcctaaaatgtcttacttagggaatttattgtatctatttttttcctttgcctgacaagatcttacccagggccattggtttgattctacttgagttagtcaacatgataaaagaacagtttgatttagagccaatgaatgttcaactgaatagcattgcacaagtattgttttgatctaaatgcactcctaacaaattttgtggtcctcattttactattgtccaactacaaatcagtacacaacatcaatattaatctcctttagagatgttcatacaggtctacaatattatactattgaaaatcttcttcagagatgttcccacagtattacctatggtctcgaagcaccgtttctatataacatcatgaggacaaaaacatccaaaataatttttatcctaattcacttttataagttaccagttattaagaatcgtctatgatgcaaagtctaattgaggagactggtataattcagcttacggtcacaagcatgcatacccgtcaaacgccttattccttttatcaaaccaagctcaggcccattcataaaggattgaaagggaattggagaaaaattattccacgtatattgaggtgtgaaattaatcctcttacccttataatccttttcttttagggattaaccaaagaagccttaatagggtaaaaacgactcatacagatggaaagcggctgttattacatgcctaggaaaatgtatatacataaacttacaagttaaacaagaattttgcgaacatttcaactcctcacgataggcaagccgcggcaccgtacagtacacagcatattctacgtccttatgtgtagataaccaatgtgttggcagcacatatactgtccacttacaaccccatctcaattcctctatataaaattgcaagagagtaataacatattccttttttttcctttacactgtatgcatacatgtacatcaaatataaacaggcagacagatactaatagaaaggtagtcggccataatgttaaacaaggttttggcgtagcaacggttgaacctcactacctgtacacccgtccccaacctgtgatttccagaggttctttagaaaactataccgctgttgaacctttggagtggtaacggagtcagctaggtcccctgatgcctgtggcgacagctttatggaacttgatgatgagctctgcaccttctggaggcatacttgcacagcgtcgtgcactcgcacgaagcaccacccagtaccaatcatgtctatgatgcccgatctcgaaagcagcaggtgtacctgccggtttgggttcgctattgcaatctgcaaccaatcagtagtactcaatgatttaatgccatacctgtacacatttgtttctacttttcactcgttcaattaattagaagaagtgccaacctggatatggcgatccctgtattcttgatacaagtccttgagagcctgaacagcacttgaatcgatgtatgtaacagctgcatgttcagtatttgtttatcttaactagtctagtaaatctacttgatgctcatgagtttcttaattgaaagaaacatttttatgcaaacatgatatgacaaaaaaattaatgtgcctcatatcatgtaacataagaaaaagatcttacgggacatctcgaggatcacaaagtacactcttccgacatcaggtccacggtttgaatttgggagattaagctcatattcacgcaacctgataagggacacaatcaacaaaacatccatcaggacatcagggtaagaaaaaaaattgataacacaaactgttcatacagataaaaaaaatatccacctgtcttttatgtaacttatgttggcaaagtagataggtgcatcaattcgaacaacaactatcccgttgtaggtataagcctcagggtattgcaatctatttcggtacactgtggtgccaggtaagcggcccaatacggctgcacacagaccataaaatctagttaaatcaactgttatactctaatactatgcagcagctctggatatttctgttatcctatagagaacaaaaataacggcgacaaaacaatccatggcgagagaaaagatatgtcaaagcggactacaaatttcttcaagcacaacctccaaacagtacaagggattattgaactctcaatatggttgtcttgacttatttagactatcagattcctatcccacacaaaaatctacggcacaaagaatcacagcctccaatcatctactgtgacctaattacttctagttacttcctttggatgagtccctcttgcaagtcctcttaagacagagcaggaatcctcatcctatgaagctatatttatgaatcatcgtagaactcctttcatggtcctacttactaggactagaattacctttttgccctgcaataatatatcagaacctgatacctaaaagttaaaattcttgaacataacagttagaaatagcaagtctatccaaatccatgttgcagaggggtcaaatcaggtgcatgacagggaaatcaccagaggcatgcataaataatacataagctgtcattcaccatgaggattggattgcaaagtgcagtcctggtttccgtcccaagtcgacggcaatatatcctggtttaggcaaggtcgcagtagggcacaaagagcaatatgtatggacgtagagcacatgagggggtcaggaagagaggagaagcatgcatacacatgctcctgcacccatggcatggcggcttcaaaatctttggataagattatttggttatgtattgattagttactttcctgatgtgaccatggctactatgaatacgaccattgctcacatcatgaatcaacaagaagacatcaagatcaagtcctccatgtgctgcaatctgattcggccacgtgttacattgctgacttcaaacggccgccaaatctacatacgtgctccgttttgggcccgtgagtacttgatggaaagctctcgaagtcctccttccaacggatccagcctcatctcggaaatctatctcgtttggccgcaatcacaaaagcaaggtgctgcgtctcctgtattgggccaatgggcttgtaactttgtttgggaccctggcccatgtggggcccatgtggggtgcgccccaatctggtggagcacgacccttggaccctcttggtcgtcctcccacctctataagtagttaggtaccccttcagggtttctggggtttttgttagattaaagtttagccattgctacttgcttgcagcgcgcgtgtcggctagaccgtccgtctgcttgttcttcggaaccccaacttatcatttgtattaaattcctatttgcaatatcagattgcttttatcttgttcttgcttgtttcttcgatttgcttgcaggaatagggttgatctgcaccggcaagatcaacaacccatggagaggtgtatcgatcgctaaggcgcaacacaacgtctcgtacggttgtagtcggatcgtcaacgtttctcccaaatcgtagttatcacaactcaccgaaagatcgggccaacaatagccttgagtgtcgagaggaactcagggttcatcaggtggtatcagagctttcgttgctcggtgagtttttatcttcctataaccagaaaatagccatacaaaaaaaattcgtatcatttacctagccatattgtgccattgcattgttcttttcagtttttgctttgttgaattttgtgttgcattgtcacgtcgtgttgctggtcttagcgtctagttcgtttagagtttcgagttctggtcacgttttgtaccacagtcgtcgctgccaccgtgtctctgttgttgtcgggacctacgaaaacggaatcggctcgctgccacggttctatttttgtagttttcagaagtttctgtcggttagttttggagttcttgagttgcatctagagtttgccgatccttgtgtgtgtttattttggccgtgcctgtgtcgtgcacgagaggaggaaggtgaattaccatatctgattttggaagtagtcaagtttgttttggaaagatatagtagattggattggttaaaaatcagtttcctttttatcccatacaccaaattcggctgccatccactccacctcctggccgagtcccactcgcccctttggccgagtccgactccctccctctcttccaccgttccgagttgtgtcaaacaccttggcaaatttttgtttggtgtcggtttcgagatctgtttggaaaaacggaaccggcataaattcagcattccattttttgtataattttaattttgggtttagacttttacatttgagtccctataaattttatatttatgtttgagtccctgtaatcttacattaaggtccttgagtcagtttttgttaaaaaaaataagaaaaaaagtgagaaaaaaaaaggcagaaaggtgcaaaaaataaaagaaaaaaaaagccgcaccaaaaaaaatcagaaaagaaaaggaaaaaaaaaagaaaagaagaaagaagaaagaaagaaaagagaaaatattgttttgtttgagctgaacttcatacatcagagtgtgcttgagttgtttctggtgctattttgtggtaccgtttgtgtctaggctcgcgtctctagtacgttctagcctaggaccagcacggtacttgactttgaacaattattcaactttgcgttctctgatttgagcatttgctattcctttgctacatatttaagcctacccagagctccacagatttgattgcagccgtacagcaagtgtttgccgaggcatcgatatatccaacctctattggggtgcttggttgagtcggtgtacatcaccattccacttgcattggtaagatcttgtaagagcttggttaaaagcttgagtgtgtgtgagatttgagctgccagtacctagtagttgataggagcgtgtatattcttgtgtatgtttcttgtttgctgctaaccatggcaggattgcgcaaggggaaacaagatggtcatgctcaacgtcaacatctacaccttcgacgagatatgacgacttcttcacgtgatgcatatgaggtacatgactataattttgcacaagttgcatgtaagttaccagtctatgatggaaagtatgattccgctgcatacattaattgggagctagcagtagaaaaacaatttgatgagtatgatttttctaatgctcaaatgattaaggctgctagtaataagtgtaccggttctgcatctttttggtggcatactgtggggaataagcttgaaacttgggatgaatgcaaaatactgatgagaaaaagatttgtgttttcatactatagacgtgctctccttgagaaatgggaacatctaaaacaaggtgacaaaactgttagggagtacttttatgattttaaaatttgtatcacttatagtggtttacaagaatctaatgagaacacaatgactagatttttcagagggcttaatttcaatattcaggctgggcttgttaatgtgacatataatcatataggccaattgttcatgcttgcttgcattgttgagcgcaaaattttggagaatccaatggagcaacaagatatgcttgtgcctcctatcactgatgttttgcaggaagttcagaaaagtctccaaaatgagaagaacgatatgtttgagatgtcacttccatcactcgcgaatgaggagaaggctgatgcagctacattatctgaagaaagttcgcaaggtaaattaaatggtgctgagagaaatgaaggtgagtattctcaaggtgagctacacttgtccacttttcatgctatagtagagcaaccattagtggaatcaattactgagttgcctttgtcacaagttgatttacttgctgttccttgtgataaagaagagttgtgtgataatgtttcacttatatccatgccacaactagtgaatgaacatgttagttctactatttctttgtgtgctgattctaagcatgttgttcacattgctaatgaagtagaggaacgcgaattgctatcttctttaaatactttgggctattttcagtttgatgattttggtgagctcgataatttgaaggagaaattatttgctaaatctgatttgccatgtccaactaatgctatttttcatatctttggcgaatataatgatagaggaatatttttggtgcatagagtttacatttgttcagatttagaacatcttgtagttccggataaaatatgcaagctagagagacatgttactgctaatcatattgtctcgagtttgtcttgttttgattgcaagaaacaggttgttttcagtggactgcgcgaagagcaccatatggaaaaaccgaggacggttttctgtgaagaaggggaggatgatgtgaccatggctactatggatacgaccattgctcacatcatgaatcaacaagaagacatcaagatcaagtccttcatgtgctgcaatctgattcggccacgtgttacattgctgacttcaaacggccgccaaatctacatacgtgctccgttttgggcccgtgagtacttgatggaaagctctcgaagtcctccttccaacggatccagcctcatctcggaaatctatctcgtttggccgcaatcacaaaagcaaggtgctgcgtctcctgtattgggccaatgggcttgtaactttgtttgggaccctggcccatgtggggcccatgtggggtgcgccccaatctggtggagcacgacccttggaccctcttggtcgtcctcccacctctataagtagttaggtaccccttcagggtttctggggttttgtttagatgaaagtttagccattgctacttcgcttgcagcgcgcgtgtcggctagaccgtccgtctgcttgtattcgaaaccccaacttatcatttgtattaaattcctatttgcaatatcagattgcttttatcttgttcttgcttgtttcttcgatttgcttgcaggaatagggttgatctgcaccggcaagatcaacaacccatggagaggtgtatcgatcgctaaggcgcaacacaacgtctcgtacggttgtagtcggatcgtcaacgtttctcccaaatcgtagttatcacaactcaccgaaagatcgggccaacaatagccttgagtgtcgagaggaactcaaggttcatcatttcctttaggggattgtttctgtcctttatctttttagatccattgttaagaagcccttttttgagaagagaggttatcctgttgaaagcaagaacaattaacagaaggatagtccaatccctctgccttatgtaaagaggggtaccatctacccacaggtaaagggagtaactatatttatgtcgccatatttttcatcaaaaaatagtcggtatatatttacatcgtaaatttctaaattacatatgtaattttagtgtatttacaatgtaagtcctaaaattacatatgtaagtctctaaattacatatgtaagtataatgtaattataatgtaagtgcaatgtaatttctatattttgcattgaaaattacatatattgattacttatgtgaaagaacgtgccaacgagctacggttaaagcagtgcttcgagccaatcaaatgcaattgatgagaccaatgccaccgaaaaaagcggcgctccagccaatcaaaggcttagaaaaatttcgactgagaattgagaaaaaatatgtcgccatatttatagcaataccgcaggtaaatgtaggaccctgctacctctcatttctaccaatctatcctcttttccaagctttaataataataaaggggcaaagcaccaatagaggagcagggtgggatagaatggtagtttcttagtttgataaatgatgttgtggtatctattaaagtgtgagtaccctcaggtctagtatagcataattactcaccgatatgaggatttgctgactcatggattacaaaggccaatgagaatccgacctacgaaggaagatgttaccatcaaaagaattcagaacattttggtatcttatccacatgtcagtaatcagcaataaatttacacttaccccaacaagaacaccaatctcaataccaaaaattaatgttgtaatgaatgtgattgcccatagaaagaaatccttcttatcaatactccacaagaagatagcctcctcgtagtctacctaaataacgaaaatgtccatgacaaatcagattgacatagtttacatcataaagtgagaaagctacaaaacaaattattgtgacatgtcagagaagaaagctcaaggtggagggtaaaataaattaactatacttattttttaggtaaaagcactaatatgtaaattgttacaatgtttttcaataaaatgtttaggttggcacaatttcgtcagtagcttcctttgaaaaaagcactacaaaggcatcaagattgacagagcatctttttcgataaaggtattttgatatatctgagaaataagatgtccttaccaggctagtgactgcagaaataacaattgcagccaaggcacactgaaggaagaaatatgaaatcaaattagtaatgtgtgtaattaccatagctaataaaatatctgagatggagttttctgcagtgcatgtttagcacaatagtacaatgtttccaacataacattgattcatttggttacaggcttaatgcaacaaatggggctgaaaagttgatttctgcaataaagttatgttttttatttgaagtatcaagagtacaaaactgtggttatttttagctgataatagaggatctcaagtaagactgcattttacataggccagtttctttgctaattaaacctccgtcccaaaatacaacaacttttagctctcaggatttgtcccaaaatataacaacttctccaccaacattctcttcccaaccaatcacaaccctccattcacttttcccacctacctccactactcatccaatcacaactctccaccattcacttttacctactttcttaataaccgtgtccaactctaaaacttcttatattctgggatggagtacagacaaaaaaaccaaattaatgcaggggaatgtagttattgttgcagtttcttagtaagtatctacaggcataatcatcaaccaaaatggaaaagcaaatgcatttcaaaaagcaaaactgtacctacgtttggtacttaactgtaaacaacttgaatatattaaaaggtgtgttatttattaacttttatacacaagagatactataaattagttgcagtagatctgctaaaagtacaacttcaaattaacttgaactgtgaaatataccacaaatacaacaaggacctgtttgcaacaccaaatttcacattattttcattaaaatgcagcaggaatatggaaaaacaaatacgacttccagagcagtaattacaaaaaacaagttgcaaaaaagattctcagatggcaatctacatggaaccaatacttaaaagggtgctgtcaaataaacaagacatgtggagtctaacctgaggtatatccgtaaacaagggtgtcataaacaagagagcaccaccaattattatgcccattatgattccagatagaccagtttttgctccactttcatgattcacagctgacctagaaaaggaacctgaaagaatagtacaaaataatcagctttttgaagcttagctctagtgaattaagaattttaattatgtaatatacagataaataagcacagaaatgatctctcattaatatggttagtattttacctgtagcaggatatgaagagaaaaatgaaccgcatatgtttgctataccaagcccaaataactgtgacgaacaaaacataaaaggaaggtatgagtttgagcaaatgaaaatatttgggaggaacgaaacacagttcctactgtataagagtgcctgacagttctgtgtaagcaacacacaatatttgttttcagatcttcacaaactcctaagtcttataagcattatacaaagatgtgccggaataatggattgagacattttccattatggaatcaaacaataactcagccatcagaaaaaaaaaaccccatcaagttaaactttgtgtagtttgcagttaagacagacgtgagggactcagggtcggtaattttttatattttaaacctttttaatataatattttaatactgaaccatctaaaattttatttccaactctgaaccttttggccacgccaagctagctagcgttgcctattaactttgccacgccacatgtattggcgtgacagtactgccacgttggattagatatgacacgtcatcagtgttgtcatgccgctgtaattggcgttgcaagcgtgttctgccataccattttctctggcgtgacaagctttgccaccggcagagactaatcacatgcatgcttaagtacaggctgttgcttgcttgctgcagtaccggggatgtaattattgttgttacacgattgagctgctcttcgtccgaagaaaaaaatgagctgctcattgctgctacatgtaacttgcgttagcatggtgctgctacatttttccgtaatcgctaaattataaatcagaaaaaataagagtactaattaattatggtgggattgaatactggtataactactagctctgctatcctactgtgttttatacatttaggatgtgttcttatccatactttcctaacttttattctctcttttttcgcatgcacgcttcccaaactactaaacaataagccattttttaaaaaaaaaacatatataggagtttttaaaaatatcatattaattcatttttatttttatagctgatactacctccgtcccagaatatagcaacctaggagcagaatatagcaacctaggatgggatgagacccatcctaggacaacgaatctggacattctgggacggagggagtatttaattaattgtgcgctaataaaccatcatataaattttgatgctatttaaaataccaataatttgataggataaaatttggcttcgaacaaaaaaggcccttcgcacttgcatgtataacaagctagatcaattcgacttgctaattttaacgagctaaaagtttggctcagatcgtgaaataactaactaatctcatcaacaagttttaacttatttatatcagcttaaaaatattaatatttaccaatttatcacatgttaacacgatattacacactaactcacttaaatacaagtggtggaaatgtagcaacttttagctttaaaaaagagtaattgcctaggtggtcaccgggagaagacagtacgcataaaaagatatactacctccattttttatcaagctaatgagctaaaagcccatatcagcttgggagtaagtttttgcaatattgctgtacacataatagccaaaggaaagcgacaagcagaatatataaaagcagctaatatgactgtatgggccaattgaacaaaagcagtgccaaggaaatgtagcagagggcacaagcagctcacgaagtcacgcaacagcaataagcaaggaacaacatgtggtacaggtacagtgaagcagcagccaagccgttcacgaagcttaagcatgcgccactccatcggcaagcttgtcacgccagagaaaatggcatggcagaacacaattgcaacaccaattacagtggcgtggtaacactgatgacgtgttatgtataacacaatgtggcagtactgccacgccaatatacatgtggcgtggcaaagttaataggcaacgccagctagcttggtgtggccaaaaggttcacatttgaaaataaaattttagatggtttagtattaaaatattatattaaaaaggtataaaatataaaaaaattcctcagggtcacagacacactgacttttacataacatcttttggcgttctccctccttttcatattataagatgttttgacttttttttcctagtcaatctttaagttttaccaagtttctttactattataaaaattgaagatgtttacaccaaaattttggtacatcatctttgagttggttcaatgtcacctatgtccaattcgacgtgactctagaataactattatacacccccttcccagcccaacccctccccctccccctccccctcccagtccaacccacaccatcccaccgccctgacccgcgcgcatccccgactagcgtctttttttctctcctttattttttctatttctccttttcttttctcacgatcattctgtcctcttcctctccttccaatctcctctcttttctcttccttttctccttttttccttttttttctcttccaaatttctctcataaatattttccttttgaaattatcattaaggtgtgcatgcggcaagtttgttactttgcaaatgctttccatctacaggtaaaaaactttcactaattgaacaatcaaaatttcaatctttggtcgatgacgtttagcaaaatacacgtgtcaacttatggaatagccacccgatcgatttgtgagactatggaaagatgtacataaaggattcttcgtgtgatgacacatgaagcgagtgtaaccgggttcaatactacatatgatttttgactttgttttgccattgttttgtttgacttgtttcggtttgtcgtttaaattgacagagtttatcaattgtgaaaaatgtcttcacctgttaaaacacacaagcatttttgctagtatagaaaaacatagcaacattttcaacaccaaacaaacatgtcatcaaaatatattcaatattaaatttagtgaaactaatttagcgttataaatgttactaaaattttgtataaagttaatcaaactgaaagaagtttggctaataaaaaagtcaaagcgtcttataatataaaacatagggagtaacttgtttgttgttcttaaatttcaaatgctctaaaaagatttaaatataaactataagatgataaaaaaggatttggtgcacaattactaccatagttattagaaccggaccggaccggctgtccgactagaaaaaaccgaaaccagggcgccggccggtccggttcacctaaaagatcgctgtgcaatcaaatcggcaagaactcggttgaaccgggcggttttccaaagaaccggacaaaaaccggagctggttgaactgctggaacggcgtcacgtggaggaaacagaagcgcgcaggttgcagccttgcaggtgcgtcacgtggagttagaaaatagggaaaaatgatgtagtacttgtgaatcgaacccaaaacctccatgtcaccgcataaagcatcaaccaccaggctatgagccaagatgtgataatagtataatacaaatctatttgaaccgcaataaaccgccggttggaccggtccaaccaataaaccagtgaaccgagtgtattaccggttcgagcaccggtccggtcttaataactatgattactactccatttctcggtgcactaactattcatataattaatatgcaatttacatactaaccgttagtctactaataactatccttagtctgcaaattgtcactctctaagataatgtgcatgaaaaatcattgtgtaattttataacatgatcaatatgtaaagaatatttaataaatttggttatgcatgtagaagaggtctactaattatgacctcctctaagatattgtgcatggaacctattatttataccacataacatgaatatataaagagattgtttttgtgacaataaatggggagcagcttgccccaacatgaattcaatgcattagttaatgatttacaactaacctccttattggggtccaactcatagccattcttcgcagccaaagctttagcaataccaacagattcctaaaattgtatgatacaaatggtgaataacactaaagcaagtaaaaaggactaatacatactagatttattgtttaccaaaatggcgacgccagtgataagtactgcagttggcattagggacatcagatgctcaaatcctcgaggaatggagaatttgggaagaccttgcggtatttcacctacctaagcactcaagaaatagaggattacataaagtatagtttttcctgacagacaaattatggtcaaccgacagaacaaaacaacctaattctgcgttcttctaaaatggaaatcatttaaatgttgaatatatatgtttatcaaaaaaggtaactaaatacaaagaacaactaaaatatatcttatacgcacatttgaatataagaagcatcaatgcatcatataacaaaaaaaaagagtcaaatgataatgaaaaacattcttttgtgggtgttgataatgtagcaaacactaccatgaactgcagtaatatgcttaggagtttaccttcaagaataatagtatctacttttttataatgaagaataataatacctattgcgtagttattcccaagacatatcgttagtttcgttgattggtatgagttcgattaattaggaacatatccgtttggttagcaactaaagaaatggtttgttaaggatgtagagattgtattattagggggtaagctgctcacggattcacgtgaatagtacccatgctactgtagctcagaaaccctccttataaaaaggtcccatgtaacccactaccaattaagcaataaataatcataaagctaggtctagcttgataagagtctatggacaactgggacaagctcggtgctgacaagagagatcccgcctttatcccgatcttcggacaataccttatccatgaatgaatgtctataacaattcaatttacgaacaaagtaaagctctaaactagagaaccatagctaagagactattgtaccacaattaataagatttacttatacttgttcattcaataacaacgaatcaagtaattccattggaaaaagcaaccacaactttttagtgtaaataatattctaagggataagggagaaaagattggtaagtgtagtataataacccacttcatagacataaattcatagaagtagataatgttgtgatcagagtaaatttcttattataaagtacttccattgctcatattttgtaacatctaagagtaagaaatataaagaataatgtaggtgtttcttaccactgatatggaagatggatggaaaattttcacaaaaattgttccaaacacaactgctgtaaggggaccagaagctcttaggaaacgcagtcttttattcgattttccctgaaaaaagtttcgcttctcaaggtaaaaaaaaaatagaagtctccccttgattgtaatgtttccagaaaaaaaaaataacagaagaaccatactgataaagaaagaaattaaaaactcactagatttttcattatgagaagaataacaaaaaaacttgatcccattacaaatggtggccaggagaactgcaaaatggaactgctatattaagttagtgaaaaatatgtagttcaaataccaaaaagcgtattatgatctgacagaaacatttcaaattatgtatgctttttacctgaagaattggattacattggaacatgcactgtgcatagaaaaatttaaatgggaaaataaacagtctataagctgatcgtacagatacagcaaagcccacctgatctattcctccaattatactctcaataagtggtataattttgctgcttctcgtaacgctgtagcccaagaaatacttgatctgtgacagaccaattacaatagctgaagcagtagtgaagccagatatgacagaatggctaataaatcgaataagccaaccgagcctgtaaataagaacacatatcattggcaacataactatagtaaaaattaagcatatctaaatgattttggttttgccccctaaaacttagaagatagtttgaagtgtgcaaacatggaagagcatgaatatgttactagctaatgccccatccaagtacctgtccgctatgtgaccaagaggaggaaaccattcaacatattttgataggttgtgtcttctcatgacaagtttagtatctcctctttcatcggcttggtcggacagatctttcaccacaaccagaggatggttgtttttgtgaatggtggctaaagatcatttctccggttcaaagcactggaagtgtgatctgaattcgctcattactttgggagtgtggctgatttggaagcaccgaaattattgtgtttaacagagtctctccatatgtgcagttgtttcttaggcaggttttggaggatgggctttgtggtgtttagcaggacctaggggcttggcccagttggaggtagcaggtggctagaatttttttggtgtttttggtcacgtcctcttggttttggaggattttggtgttattttcctttccttttccatcaccacagcagtgggtgtcttaaatatttaaatctaatgcagtgatacacaattctcttgcgtatttgagaaaaataacggtactagctaaatgtacataggttcgttaaatgttcacatacatttttgaaaattcattcacacactacatatatacagatgaaattttaaacgttgttaaagacaaatagaattacaccgtagcgtttagtatgggcatattactagtatatacacaacaattcaatcatcttagacctttttgtattaaattatgatcttgaaggacaaataagaaaagaaaaacaacatatggaaagtccagtgtgtaatcataatgaatccagggagcaatttgcagaaaatgaaattgatgaggtaatggtggtgccagtgccttcattttaggaagtatagaatctatagatgcatacgcacaaacttttaatgttcaatccaatcattttcttgagaatataaaatacaagaaatacatactaatgtttttcggtgcactacaacagcgatgaattgggccacagaattagcatgtgtgcataacataaggacacgacagttgttcagtgcatcatgaaatagtcatgaaatcctcaaaaatatctggttgtgatatatcagcttttcctatgaacgtttgctgcttttgtattggcacacatgactgttagacaacaaatttgtttatgtgagccccaaaaaaacagagccccacaagagcagaacacctttgtacccatgaaatgatcctagtatcactctaaaagtagcaggacctatatactgttgccctctacatgaacttcatgatcactttccatgaacatatgggataacaagttatagctatagctttagtaaaaaatcttgtaaaggatatatcatcagaacatggtgaaaagcataaggatatgcggctggtggtccaaaattttaagctatagtcatagctataatgctgagacaataaagcatttgtcttgaatattcataagtgtaaaattccaaaggaatatgtgtagatgtgtccatacttcttaaattatgtcctatctactgtaaaatgacttaaaaaagaacaccagctacccagagtagaatagaattaccttagcaatcccatcaagcattctaatacaccaaccatgaatgccaataatatggctaattctgtgtacagctcactagatgaatcaacaataccaccgaggacattagaaactagaagagagacaagagccactggacccactgccaactgtctcgatgagccaaaaattgcatagacaaatagcgggacaaagcctgtgtctgttcagccatggaaatagcatactaacgattaagctcaaagacatacaaatataaaaaactacaaagacaggagttgcaaaagatataaatacttacataacccatatattgggtgaagcccagccaactttgcatatgacattgcctacaatacaatgctaattattaatattttcatttctggcattttttggttattattttcaggactttgaccattgcatatttgtatcggaagacttttaaaaagtttcgacagacttaagataaaattcagatgactggactatcaagtgtcaactgtcaaagatgttgacattctcatgcaccaaagttcatgaatagaaatgaaattgttgaacaaatgcgtcccaaaataaggctaatttatgttctccatgttggcaaattcagcctatgtgaaggatatacaccagtttgcaacttattaagcagaaacaccagaaaagatgtccagaaaattcagtatttgtcagaaggcaaaccaacctaagtcctcaaactgcaatttgcaatggtgttaacagaaggggtagccgaatgatatgtaagcaagctacatgttcgatagagctttccatctatagctgaatgcattgctgaaaataactccatatatggaaattgggattatcttattccgggccagcatgaaaagatggttggatccactaaataatagcgccgtgtgcaatagaccatttttaggagacgaattgacactcatccattctatacttcaataatccagtcatactacagttgacataattagatcttagaactagcgaccaccaagcagtaaactgtaataacttcaaaaaacaattatgtaactgttcctggcgatatgatgacaaactaactagacaagcaagagaataacctggagattaacatgttcaatcagtagccaaaaaatcaggtaattacaaggacattctacatcatgtttcgaggcaatgagttttgaaattaacaaatataaccatatctttcccgtttgataaccaggattaggaacagttgaagccgtgcatagcaatacgaaatgttgcgaatcacgagggtaaagaatgtacttggggcacgagcatgacgccgacggtgatgccagcggcgaggtcggcctgcagatcctccttcaacctgtacgtccgcatccacgacaagcagggcagagccgcctccgcccaatcccgcggccccattccccgcgccttcaccatcaccacggaccaccacgacggcgaggacccagcgaccgcctcctgtggatgccgcagtggtataacccgcaccgacctgcccccaccacccgccacgacgccgagctcgccggagctcgccgacgcgtaggacttctccattaaatcggaggccgcctccttgcaaccaaacgattcgagttcagacgaacagtaaaccccaaataaaacaaaacgtttagtctcggtctcattgctcaccgggaccggcggccaccgcagcggcggaggtgcgagcaagacgactgtgggtagtcgaggaggcgggcggccgtggacgggatgcggcgacgcgcggcagcgggatgagtgcgtcggcgagccgcgcggcggaagtacgcaggaggggaatggacggaatggtctctctttctttctgcgctagcctactagtcgaatgctgaggggtaaactgatgatccgacggtcctggatgagcaatgattcccagcctgaggctgacgcatcacgttgatgtaactggacgggaattgcggatgagtgcacgctgaccggcaagatggcgatgtacatggatggaatgctggcaccggtccattggtttgcttgtggacagaagagaagtaaaggtctcatcttatgtgatgatgcagatcgtgtaaataaattattccctcgttttccaatagaattatatgcaccggtccgttgaattttctgtaatattataccctctccattcacttttgatcaacatatactactgtttacacctaaatttgatacctatgaacgaaatacggaaaaatactaaagttttgaaagcgtcgggtttccttcacgggctggtccgaccacaggtgtatgtccggtctgagccggtctgaccgcaggcatgtggccggtcagaccggtagagtccgcgtccgaggcgaatttcattggttctcgggttttcttgctcggtaagggatgtttcgggttttcattggtttctatactgagttgaacgtggaggaggacttgtaggaggcaagaccaacccctttataagggtcaaggctggttcaaccccaatccccaacaatctgtaaaatcaaatcgttcttttacttttacttttcaactatgtccatctttgtggtttgcgccataaaccgtccgtcgtcgctgcgagaatacgattacccctttgtaggtttgttccgtaaacctttcgtttgcccacgagacgggtagttatcctcgtatcgatctaaatcggcctattttgatctctaaatcgactctgctagccggtttagctttttctacggaacccatctcgatttggcctttggcgagatcgggatgattgacgactccatatcaccgcaaggcgtttaggtgttccaaatgtgtttatcttcttgccaaaaaaaaattgccaacaactacataatgaagcatctgtttcatttgctcttcctgaaacaacaacataccttcaccgatgcgcactaaatggaatattggatgctttttttcctcggtcttgattcacttctcttatatataagctgatcaaaagtgaatggagagagtataagtgtgttggtcgtctcattaaaaaatatgtaattactctttactctgttttattatgaagtataatttaagcatgatttatatttttcatatttaaaattttttggacaagtcaaacatactattaaaaaaatagaggggccatcttcgaaaaaacatagaaagtaatggggaatgcgtagcagaccacctgattcacatctaaaaactattccataatgaaagaaaaggttagtaggatcgttggaccatctcttcaaaaaaaaaaaaaggatcgttggaccagccatctatttttttcaatagttacttgtgcgagaaaattagaaatctctctcctataataagtggagtacgggtcgcaacctatccttctcattgtgccgatagtcgattaattattttcctttcaaccattaatgcctatcatataattagcttttcgctgataaagacaatattatcctttcgcataatccttttgctatgagtagttttcagtgacaactaccctcatgttggcacgtaataaggaaactatggtgcacagtagaggaaaatattattgtcttattccgttatcaccggttcccacttctgggtcgtcatttatatatactagttgataccccgcgcttttaccgtgggatatgtagatgaatgcatattatacattatagaatgatatatgtacatgtttaaataatgtgaaaatgatgtggagataatgatttgacattgattgtatgttgaattctaaaaatacaataaaattgtaaataatatgttatatttgtttgatattaaaaatgctctaggtaataattattagtgggtaatgatgtggtacacttgcaagtgatttaaatactctatgtaataattgctagtgggtgatgatgtatcacacttacattgagatttagaagttagtggacatcaattttatagtaagatatgattccctccattttatattataatgcactttgactttccttttaagtcaagcttctataaggcttgaccaagattatagaaaaatagagtaactcttataacaccgaatttgttccgttaaacctaatagtgaatatatttcaatagtatgtttgtttggcgttaaaaatgttgctacgattttatataaacttagtcaaacataaagatgttcgacttagaaaaatgtcatagtgtctcataatataaaatggagggagtattgtgtaaactgtaaccatcgtttgtctatgcaaaagaaaactgatggtgttatttgtacattataggatagaaaaggtttgtataatgtatgtgaagtgttacgcttaccaaggtaaatatacggtacaaatcccaacttgggtgaaaactcgtgtatgaaagtgaatctagccctaagttttgcatgaacgacattaatatccgcttgctcgttaaccatctcttcttcacactaaccatcatccttggtctcacttgcagatttccattcacccatctcattcacaagcatggttcttcgactagggcactcagcagcaatgtggccacgaccttagcatttgtgacacacaatatcgcggctacgggacgaggattttgctataggtgtaacaagccgacgagactcattgcgtgtagctggagaagatgccgaagatggttgtagcttggctatagcagctagtggagaggctcgtgtggaggctctctgagaacgagcgccaacaaaagtgatagtttgttgcgtgcgatgccataggactgcattggagcagccactagaggaccaattatgccgttcttattgaatgtacctttccatatgttgggcttgatcaagaagatcttgcaaaagtgttgaataaacatctccaaaaagtcagaaatttcatcattgagaccatgcaaaaatcttgtcattttcgactcatcttctttaatgtgagcacggatcaagagcaactccatttccttgtaatactcatccactgtacgagtcccttgacacaacaattgtagcctattgttgacgatccttaagtaccaattcgaccatcgattcctacataatagcaaatagaagaatataaaatggaataccaaacttagaggtagtgtttgctactaactatttccacaagtcttagtgaatatttgtatgcaggtgaaatatggatgaaaaccacccaccatgtgacaaaatacacctccgtacaatcggacgtgtttacacggaatggagaccccacatgtcaatcaaaaccacctaaaattgagcacaaccatggtacagcatattgagggcccaccagacagcctctcccagccgaaggagtggccgggaggtgggctagaagttcggccgaaccacaaggtcgcctgagccgacttcggcccctctcaccatctgcttccacgtgtaggctcctgagagatgtgtaacacatttggcatgttgagtctgaacaatatctgctttgctcattattcggcattgtgtattttatatcgattggtgtcaatttgtgaccatgggcacattgaggtgtgtgtggctatttatgcatgtatggatccgactcatccaaaattatgtggcggtcacaaattgcactggacagtataaatttcgagcgcccacaacccgcccttacggggccagggatagtgcatccatggattgaacggggcagagcccataagttatgcggggtgagggatcaatttccacccgcaaatgaccaatggggccctggttgtagaaagcccataaaaagtctagtcattgttggtatttcttaacctcacagatagaatctgcaagctcacggaaaataccaatgtagcacttcacccgggagtattctaaggtatcgatttccacaggaaacgtgtgtgtcagctcttcactagttcatccaaggacacgaagctacagataggcaaaaggatagagaggttttaccggtaagaaactatgtctacagaaagctaaactttaatcctaatgtggtacttcgggcactggccaactcgctgctcccagatatcgctctactgtgcacccggacagggatgacttcagtgatattgagtgctgtcaccacctctacgcctacctcacacctactgtgggatgcggagcaaacaccagaaattaactacctagacaccgtgtctaagcaattaataacttgatgtgaccatggctacaatggatacaaccgttcctcacatcatggatgaacaagaagatatcatgatcaagtcctacaagtgctggaatccgattcggccacctgctacactgctggtttcgaacggccgcctaatctgtatacgacctccgttttcagcccgtgagtacttgatggaaaactcttggagtcctctttccaatgaatccagcctcatctccgaattccatctcagtcggccgcaattgaagaaacaaggtgttgtgtcacctatattgggccaatgggcttgtaacttcgtttgggaccccggcccaagtggagcccatgtggggtgcaccccaacctggtggagcacgaccctagggcacccttggtcgccctcccacccctataaatagctaggtaccccttcagggtttctcgggttttgttagattaaagtttagccattgcttcatgcttgcagcgcgtgtgtcggctagaccatccgtatgcttgttcttcagaaccccaacttatcatttgtattcaactcttatttgcaatatcagattgcttttatattgttcttgcttgtttcttcgatttgcttgcaggaatagggttgatttgcaccggcaagatcaacaacctacaaagaggtgtatcgatcgctaaggcgcaatgcaacgtcttgtacagttgtagtatgatcgtcaaagttcgtcctaaatcgtagttatcatcaactcaccgaaagatcgggccaacaacagccttgagtgtcgagtggaactcagggttcatcataactactctagtgtttataactcactaaagtagtcactatattttactgaattatagtgaacgatgatcccgtactctgattaggaactaaccaagaaataattctcaccgagcaaaactaaattactcaaatgatatttcaattataatccgagtaataaacagagcagaatgaaataggaagacgattgccgataactccgaaattccttcaacttcttctaccttactctctccctattctaatatacaataaagtacactagagcctcttttaattcagctcatgcttcaagtgtgtgtgagaatgagagaggagaggggtatttatagcttgcttgggaatgtggagatcctccatggaatccaaaggacatctcttttctcctcttggcacgtgtccatgacagtttctgcaggtacaaccatcattgggaagtcgttatccaccgaacgcaacttgggcatgggccagcggcctccgtaatggttcggcagaactcagggttcggccgaacctaggacggctccattggctccgattttcggcctagacactcattttgggcccctcattctattggtgtggatggaaggcccatttgaaggtgtttaattggatttttgggtccaaaactcgatatgttcggatacgcgtttgattctcctcctccttcatgtatattttttctcaacataggtagtttgtcacctgcatacgaatatacaccaacactcgtggaaattgttagaaataaaccctaccactatgttggatgttttgtatttatggttttatgcaggtattgacggtgagaatttggtacttaatagccgtcaacagtcattattcacaagaaatggtccaatactagtaggcccaacgaaggctgaaatacaagcaagccagcttgacttgtatgaaggtacctttccaaattccaatttccttagccgccactaccagcctatctcactacctgcagaagtggaggtaagccactcacacttacgcgaaactatcacgcacttctttatgtcgtgggccagcatcgttatgcgctaagcccctcctccgctgcctggtctatgcctacttgacggcctcagcgttgcatgcataagtaccacaacgacccaactgaacgcttctgttgttgcactcactcaccggttccctgatcgcatcatgccacgcgctgagttctcttccaatctccctctttccaaaggccaacgccgcttgttgtccttaaaagatgcgatgacacataggtgcagggccccgagggtggtgcagggacccaacaggtatggggatgggagacattttccacccgatcatcagttcggaagtgggggcaggtgaggaagtcaaggaccgagggcagagacgttccagcccaacccatccccaaccactattgaaggtcgttaagtacaaaatttaatagtcaactcctgcatagaagaagtaaaatattatatcaacttagtggtggtagtttattactaaccattttcactagctttggtaaagataggcatgcaggtcatttaaggagaaaatatacccgccatgcgaaaaaatgaacctccgaccaatcaagtgcgaatacaaggattggagggcccacctgatactaaaaaccggcctaaagtgaggccaaaccatcctcaaccgccataggggcccacctgttagagacaaagggaagttggttgccagagacggtggaggtggtttggccgaactagcctcggcgctactaaccgctagcttccacgtgtcaactccccattggtcctcaatgacgattaagaggggggtgttactgacatttccaactacccacaaccatcattagcacactatataagaagtaggctttcatatttgcaacacacaccacttgagctcaagtagagtacaactcacatgtagtttcatctttagtatgtttttatagtgagaaagtgagaggaagctccggaaggagtgccccaaaatatcggagttctctcccagaattttcagaggagtgccgagttaatcgacattcttccaacggagttttggagaagcgcttgggggttgtcggccttcttctcgattgtacctcggcggaagcttccttttataaagtaactgttcgagatacttttatactatttaattagtttccttaagtgagatatattctcatcagtgtgggttcgtcgcttagtttataattaagtgctctagtactaggactctggataaagaagaaattttttgcgcaaggctagagtagtaatcaataacttacgcgtggtgtctaacttagatgttaccttcgtttgttgtgtggtctaagaaaagtggggtaggcggcaggtggtgacagccctatttgtcatttgcatccctccacattcaggtacatcatagaagacaaggctggactcagctaattggcataccaggggagggccggtggccaaagcacttgatagagtttccaatcctatcattagttgttgtcctttgttgaatcatgttcttagatagtactacaacagcatcaatgtgtttgcagatttatgtgtgtgcgtagcaaataccaattcccacacctaccccgttgccacccctagccatagctagtggtgtacggggaagtggtgctggcatgcagttaattagaagtccgtcaacattgtctagaaaaagaaaatgagaaggattccctaaagaaaaaaaagagaatgagaagtacttttaggtaacaagcaagctacatcgatgatttaagagatatatgacactgttaggtgcttgttacatgtaataacattggagatgtaggatatatatttttaaagcctatagaaattaaaataaaaatcatattatcctaaaaattgtcatggtattttatatccgtccccaaccaccagccataagggattggtatcttctatgaagctacaacccactgaacacttaaaagttcaacatgaaagtataaatatatattactccccccgtttcaaaatgtttgacaccgttgactttttagcacatgtttgaccgttcatcttattcacatttttttgtgaaatatgtaaaactatatgtgtacatgaaagtatatttaaccatgaatcaaatgatacgaaaagaataaataattacttaaattttttaaataggatgaatggtcaaacacgtacttaaaaagtcaacggtatcaaatattttaaaacggaggaagtagttaacatataagtaagccacgtcaacccactaagcactgtcaacacgcatagtacatactaaaacttaaaacttaaatgtaactgcatacatcaactacaaattattacattataaaaatcaatatgtaagcatgctaaggcggtatttggtggcacgctaaaccaagcgatggattaacgtataatcaattaagcgtataaaacttaaaaattagactaatataattctttataagtaacttttcaatagaaaacttatgaaaaatgcattgtttagcagttttaaaagcatacgtgcgaaaaacgagaaattagaagttgaaagtggggaaaagaacccaacctaaatcatcattcatcatataattttcacacatttctatcaaattcatcatttatcatattaatttctacattattttaataaatattcagtcatatatatttgctacgagagcctgtgaaaggtcatctgattcaggtaaactttgcacttgtctagaagcggtcgttttatcagctgagcaatatgccaatagccctttatcctatgggacccaagcgagcacgaccgggcctaccaggaaccactcgagagtcgagaccactagatagggatgcaagcggggcggacaagcaggtttttttttttccgcttatttcacttctagttcattttttcttctaaattttatactaccatacgaaaaatagactaacaagcgggtttttatgcgaatagcgggactatccacttgcatccctaccactagataaggtacaagtgctctcaccggctagaaaaccgccacgttttcacctagctgattcgcctgcttcgtctccctgcgcatttgtgcctacttgtcccactcgcatccacgacctcaagaaaccaaaccaaatcaaagcacaacaccacacgccatgctctttgtgtggttcaggtttgcgcatgtccgatcgaaaaacaagtaaagaagccacgtactactattactggaaaaataagaattgaacaattaataggagttgctagctaagctttgccattgctggaaacacgtcttcgcacaggcacccagccatgctgaagttggagccggagttccccggcctgccgcagcggtgcgactcgtgccggtcggcgccgtgcgcgttctattgcctcgccgattcggcggcgctctgtgccacgtgcgacgctgacgtgcactccgtcaacccgctggcacgccgccaccgccgcgtaccaatgggcgtggtggctgcccccggcgccgggggagccttcgtcgtccgccctgcaggcggtgtcaactcctcctggccaatccgagagggcaggaggtgcgactacgacgatgacgacgccgacgccgctggggaggaagacgaagaggcgacgtcgtggcttctgttcgacccgctcaaggactcctcggatcaggggctgccgccgttcggcgacgcgctggtggccgacttcctcaacctcggcgggggcgccggggagaaggaggacgcgtcgtcgagcaaggactgcagcagcagccacgggaagagcagcgagggcagccacgagttcgccgtgcccggcgagcccgtaccggagcgccagggcttcggggcggtgagtatggacattaccgactacgacgcctccaatttcaggcgcgggtacagctttggcgcatcgctcggccacagcgtaagtcttaatgttttttcttacaatcttacacgaattttcatcaatgaattatctacactagtaacttacccgtgctaactatacgataacattaaaccaaagactatcatatgttaacacaatcaaaaatataattagataaatttaaaactcacgtaaagattgaacaatagagagttgttatattttaaagacaaccatgtgcgcaaaatagcatggtaacctttatatcttcactcaaaaccatctattttttgatgcactgagaaattcttataagtaaataaatactatttgctcatgatatgcaaaataactacaagcaactcttattgaaaatttttccatgataattcactgacatattggtcatggatccacatgtcaatgagagaatggaggtcaactttcggagtcaaataaagattttatcccacaatttttggataattaaattatcaaaattacattatcattcataaataaaatgagttgggtaaaaggaaacgagaataccgaacacccatccatccaggtgtgacttcaagagttcaagaccaagaccaacagaaaaatgcattctcaagctcaaaccaaaaagataaagagaaacatagcactactagaaaaataatttttcatagcgttaccctattatttttctggcggttatacgcgaaaaccgcccacaaaaacgtaacaaggggtggggggctacagaccgccagcgaaaatagatttttgtcggcggccgagttaaaatccaccgtccacctattagaatccgctgccgcgaaaaatccacctattccacgcgcttctccaactctctcccttctctctccgcctatctacccaccgttctccctcctttctctgcctctccatccagccgccagcgacgacgaagctcgtggcgcgcgcatcggtcgacgggcggagcactggcggcttggttgacgggcggagcaccggcgactcgcggggcggcggatccggcggaggcgactcgcggggcggcggatccggcggcgacgactcacggggcggtggatccggcggaggcgactcgcggggcggcagatccaacggcggcgactcgcgggggggcgtcgcccagcggcggcgactcgcggggcggcgcggtgcggcgagtccggcgacggtgacaaggagaaggggcgactcgtggggcggcgtcgcccgacgaatccaacggcggcgactagctttgcgaggcggcaggtctgattcgcaccggtggatggcagctcggcgacgaggtgcagtggctgggctctacggcagtgacccacctcctcgtcgaccttgggcctccctgtcgccggcgatggaggatgggcacgccggtgattttgattttttttttcaaaatctggattccaattttcttcttttttaatcaaaaaatattttcactggcgggtgttttatcttccgacagcgaaaaccgaaatttgtgctagcggttgtcttagccagccgccagtgaagacaattttcgctggcggttgtgttaagccggccgccagcaaaaatcgatcttctctaacggtttgtcgctgctagcgtagatgctacatcttaactagcctttactttgtggcggctccgatatccgccagcaaaaacctaaaatggccgccacgaaagattgttttcgtagtagggtagaatacaatctaatgatccatcgcctgctaggctataagttatctattcgcctcttcacttctctttcagcaagcatacttatatggtgaagaaatgagacggtggagttatagattcagcaggaaaaaaaggattcaagagacaaccatactcataatttccataataggaggctcttgttttagccacgacgtacatcatactctgcttcgtcttcactccactttcacgatcctcaccgggctatttgttcatccaccacagcagagcatacctttgatctttcagttttgaaaaataatgttattcatgcatataagtagtaagtggatgattatggatgcttacactggaaatttgaaggactgggtgcttgccgtggtatatctgactggatgtagatgttgccaatatgaccggaggtccacacttgattgcccatgatgatacctaagagagcacggcggactgatcaaatgatcattacctgacatgaaagaaattatctgcacttaagaggaggcacaattcacactgactgattaaagttgttaatcagaggagttgtgttccaaattagaatgattctggtactaacagacgttacaaaattttgcaactctctctgatatcatgttaggactctgtctcaggtcaaaaacaattatgctactcacagattttgtacaaaatttagccctgacttagagttaatactccaattgtgccaaattaaactctaaatcaaattatcattacctaaaaagaaagaaattatttgcataaagaggagacataattcaaacctaactgatcaaagtttccaaccagaggagagtgcttgaatttaaaacaatgccagtactaactcagtgatcatgctctaaaccagaggtctctgtttcaaatcagaacaattctgttactcacagattttgtacaaaaatttagccctaaccaggaagtcccatagcaaacaggagaggttcgctgctttccttggaagtgccatagcaaacctgttacatttatatattctgaattcctcaaaggaattttgaaagcaagctgccagcatgctcaatattaaaaaattcaggttactttaaatgcttatctttatacaattcaaacttttataaaacatagaaaactcccagtttccattgtacaattcaaaaactattaaccatttagtaataaattcacttaaccactcatataagaagcaaagtcaagggacaataacaatgtatatttcagtgttctaaatttcagacggcccaatgcatattaaaaacaactatgccatttttctatttccatttcagcacagaaatatatacttaatataggagtacatagtagaaatacatagatatacatagttagatatggcaggtaccaatcaacaatcatccgataaacatgtagaaatgcactcctaactgcattgtggatgctgctggggaagtcaaccaagcatcaactatggacctttgtaagttcttccgaacaaaagatgcttcgtctgtacgaccataaccgtcaaacacctgtaaaatacccctaaaaatttgaaaccattaaccatctgctgtgaaaactcgtactgaacaaaaaaaaatgatgaacttaacatctcacatatgaatgttacttcagaaatttactgctggtgatgttgggtcccggtttgagcaaagtaatttattcccaaatgttcagtgttataattttattgcctagtttcaagtgctctaaactcacagattgtttacatgcatcaacagaatttgagttggaaattgtcagtgttgaacaaaaaaaaaactaaccttttgattgactggaaatgaaactcttgtgagtctcaatttccctcaatttattgcttctgattaactggaaactgaactctagtgagtgttaaattcccttaattgattgtaccactcaggaagactatctgcctacgtgcagtttgattcccaaatatgttcagaaccatacaaagacctaacccatcaatcctgccaagtctttccaatttcccacaagccctgtattgcatctgcacgccatctcatctaatctcacatcctctcacaaaataacagcaaaatagtccgggcaacagctgctgctgcggctgcttttgttgtgggcactaaaaacaaattggttattttcaagtctaagccattgagggagttgttttggttggtttgctcggtatttcacatgcactattttcgcaaatttgcatttgaactgtaatggttgaaggaacgggatcgagcgatgcttaccttgtccccagcgtggtcgagaggattccggtggtggcttaacagagagcacatggcgcaggatccttggcggcgcgagggagtcggcggtggcgtcgcgacgcagtcggcaagaggggatgccggcggcgtcgatttggaggcgtgtgagggggtgccaacagcgtcaaactggaggcgggaattgatggcgacgcgatgccgggcgtcggcgtcgtcgcacgcgaaggaggggcgtcggaatctatggcgcccggcggctgctgtgatgcggttggtgttgggatacgcgtaggctacgatagcataaatcaaaattttctatcacgtaaaccaggaaccatgcaagtattagatcatagatcgttaccactcgacgcgctgcgcagcggaaggcgctaagaaatcgaaggaattctcgcgaagtagcgcgtgtcgttatagaggaagtagtcgatcgcaccggctcgaccttctcctcgccgtattcccacgccgatcagcatcacaaatcagaggcgcctctaccggtattcacacgtacagggacggaatgccacgcgtagatgtgctagcacccgcgcgcggctagggttttgctcggggaggggagtgacggctagggtttcttacgtgatgcaatacctccgccggttacacccctcacgaatatataggatccatcactcgggcctccaaggcccataggactcctattcggatccctatctgaattaagctcatattagatccccatccaatccctttattccggcccattaagcgtgcgaccctgtaggttcatgtacactcggctgtaacccgaaaactccttttcggtccacgcgtcaacagcggctcctagcagaacgtattgactcaccgggcatacataaagatcatatcggctgaacctctagtgtatacttgtatgaacccctttgcctcacgatatcgattaagctcaaagttagatatgtgctatcctctaatagctcaatcatttactcgaacctgttgatagattatataacttgtgattgactcctcaatcacctttggcatggccatgcacttccataatctacaacatcgaggggcccagagatatctctccataggaggggcaaatcccatcttgattattcatatcccactacatgtttcatagcatacccgaaaactacttttataactacccaattacggagtagcgtttagcagtccctaagtaagctactacacatgttgagaaccatgataattttaagtctaaggattcaacaccaacactaaatgagatcactgatgacacaacatatatggctcttgcagtgtctcatgttgggtctatccaacaacatgttcaccaacatgtgtccacattattaatttggtatctctataccatgatccatgagacatgatcatcaattaatacatgtgttgatcatctaaacatatttgttccacatatgatatttgatcagggatcctttagaaatagcaacacacaacataaagagtctcatgaaagaatcacatattcattaactaataatgagttatctatttcaaggaacaaagtcggataaatatgtaaacatagtatatgatacaatcatctctatgattgcctttagggcatatcactaatagttggagcggcgacgactgttagggttaggcggcggctggcgttgcgtgagagatgtcggatgtcggtggcgccgcgcgcgaatgcggggtgtccgaattgacagtgggcagatatccggcttcagcggcggagaccacgacatagattctgtgtgagattggtggctcgacatcggcagcgaccgcaggcctggactggtctgccgcaaagaccgtctttgagccgctttctcgcccccaccgccggcaccgcctgtgtcagccgccacaatgccaggccagcccagactgtcgaagaaccatcgccgccgttgttgttgtcttcaccagctctcgcccttcattgaatcaaacacatttagccacaccacacacatgacgttcgtttcggcgggtggcggagccggtcagcggcggccgcggaggagatcgtcgctggctcagtggtctttggcttcgacgattggagtaaggggtgagacagcatcacgggtgccgcggcggggagcggggcgacgcttgcggtggcaggggatggaggaggtcacggtggtgaggggagggggatcgatctgggcgggaggagaggatttggggaaggagagcacgtgagggagtggcgagcggtgtgatttttgcgcaaggggagtggggtgatatgcgtgcgggctaaggaggggataggggaaacgtgggatgatctgaggcattggattgaatgattctgggccgttagatttgatgaatgagtaatgagtaatgtaggtgtaagagtgagttggtgaattattagagggtatataggtataggtatatatatagtagggacgatctgaggtattggattgaatgatcctgggtcgttagatttgatgaatgaggatttgatgaatgagtaatgtaggtgtaagagtgagttgatgaattatatggtagatgatatactttactagttttttttatttttttagagaagggtaaaaaataaaaagaaaacatatactctactagtgactttaaagtttcatattccaacgaatctttcaacacttgattaaaattatggaattagtggtgttctggcagcagaaggtgtttgcttttcttacgatttgtttatacacaaatcctactcagtaaaggggaacccaatgctttgctaatgaaagcgtttatcaaagcggtcctgagcacaatcttagtctactttctaatcaccatagatcctccaaaatgggtcttaattgccaaaggtctatgtgctcattggagtgtactggcttaggcatcgacaatctagagcttatgggtgttgcgcttaggtcctgatggatctcggcccaacgcacatctcaatttaagccctagcaaggtctccatatgccgtactctaggcaggaacgcgagtttgctgttgtttccatgacgtgcgtgctaggcgatggcaaatcaattctcttctgggaagatggttggttgcaaggtgcgagcatccatttctaggcgcctgcgctctatgagtgtgttctggagcgcatccactggagcctctcgatcgcagacgtattaagaaacaacagatgtatcaacgatcttcgcggttctctaggagtatggccaatcttctagtaccttttgatctggttgatggtacgtgccacaacactatctgtggaccaagtcggactccttcctctataagtgagaaagctcaggttcctactccgcttgctaaccctaccacgcactattcatgggcaggatcccattccatcactcgctgatctggaatccatggcctctcctcgctatagctactttttgtgattggtcgctcactggcattgctagactgttgatcgtctggagaaaagaggcctcccacaccccgcttgcagcatctatcatgaccaatgggaagaaacgactgattgcttgtggattgagggccctaattcattacagctttgatggatcatcctttcaggcctcgggttacactagtgcttcctcgccggagtctcctcattccatgattggttgtgtgctctagccaccacaagtccaaaaggaccagtgttgtggctttgacatgattgcaccccttggggcttggtccattcgaaaggagaggaacaatctggtgcttaatcaatttaatcgaacatggcttgaagtggtcgcggcaatggcgcgggaagccaccctctggaagctttcccggccttcgtcgcaggcgttgctaccttagttctttaggtcgctaggttgtttcctctgttatcatgagaataaacttaagcttcccctgtttttccttttcccctttttatttccctacctctgttctgtcttttggtttgttatttcttttgttttgctctttgtaagttttactcctcttgatgcaaaggtgcacaattcttttgcgtattcctcaaaaaatgctttgctaatgaagaggtcaaaaaatgcacatttttagtaaggagggaacaatgaagaggaaaacgaacaactttccttgagaaatcaaaatcaacatgtacagaatcactacaacaaaaccccccttcagtgctggctaggaaccctaattggtgccagattccgagatgaccccaaataaggggcataaatgaggcaggctcatcggtgcatgatttaaaacaaaaacccttattgatgaggtgcatgatttaaaacaaaaagtctgatcggctcgattcaagccaattgagcccatgcattgagtccaaaaatttcccaattggttcttcatctatcccaaattgtatttcaatatcaccattgaaaaagtgaatcacaaattttggctcaaatgcattacgtactactcgaattggaaaggtaaaagtacaaattgccggatctgacctcgagctcatggcgaccaatggcccatggcgaggtggaggtcgagagagcgagggaggcacaatgatcggtagggacgttgagaagggaagtagacctcgagctcgtgacggtggatctagctgccctcgagatcatggtggccggatctagccgtccccgagcttgtggcggcgtatccactggcctggaggaggaggcgctacatgtggcggcggtggagatgacaaggggcgtgcggcatctgtggcagataggaggggcatcagctgcagcagagaggaggtggtggtggcggcgagagatcaatggagtgggatcaactctgagagaaaagtgcgagagagaatgaggtggactctgagagagaagagaggtggaaagattaacttcaaggaataaataaaactagggctggctcggtttgtctgctagactctcttagaggtgttgtttttttaaaatgcctcatatgtgggcatccgctcatattggcttgactaccgatttttaattttagattagaccacatgtggagttggaatgaccagaaaatacttatgtgtgctggttttagggcatcccggccctatctggaccttttttaatacctaaaagatagaaacttatttaagaatattcgaataaaaaactgctataatagtcaatggaacagtcacttctctccttggctttaattttcctgtacctagttttaatatgaggtttgaattggtcctgtcatccctatcctagatatatacctataccgacatacagtatatttcctatactcgctttagtaaaataaaagtgttgttttggacttttctaattcaatgagttacaagttcaactacttataatttgtacaaataaaaaaaaggtaacacacgtatgagaaataatttggtacgacaattttatccacataattctagggctgtctgtgatatcatgctcagcggcggagccagaatgtgctcaagagtagggttgaactagtataatagaatgtgccctagctgccctactcctatatccgccccattcatgctgaaaaattgtgtgaaatcagttgaatttttagccatgcgataaaacatgtgtcaaaatcaccacccacccacccacccccgagcgcgccccgccgagcgcgagcgcccttctcacgattgcttctccattaaaacaatactcattgttgggtcaggactgagaaaacatattttatcttttgttatttattgggcttgttttcatattgaacaaccttaacattgttgctttgggctattcaaaagaagctcaaaatctgtctgacatcaacacacaaattctttccattaagtcataacaaacccaacatgagaaggtccatttgtagccaggaaacaacaccagagcgagattgaatccattttgttatcacacaacttttgcgtgacaaagctcagctagcaagattcattagcaaaatccttacaaacaaagaaatcttgacatatcctgtatgcataaatagattaattccaaatgatattaccatctctaatcaattttagcaacaaacttaaatgtatgcatcgcaattaatttgtgacataaatatctgacattatagtgaaggatctgtgttccctctttttcctagacagcaattacgtactgattcatcatactaacatttgtctcatgttaacaaaactaattgtgtccgattttctccatgataagcatggactgttaaatctcactgacatggaaaacccattaaggctcagttttcccaactcatctctctcgttttccacgcgcacgattttcaaactaccaaatggtgtatttttttcaaaaaaattatatacaaaagttgtttaaaaaaatcatattgatctatttttgaaaaaaaaaatctaatacttaattaatcacgcgctaatggattgctccgttttccgtgccggaggggagtgttcccaaccaggaggagcgaacactccctaagactgcagagactaatagagcaaatgggaataaatgcatgaaacatggaccagaagttttgtatgataaggcgggaggaaggacagagattacaggtattcgttgagataaagtgcaaagtcaccaccacctcccattgccaaataatcagtggagcaaaatgtgaaatctatgcaaatcctatgaaagaaattgtataaatgacctgttggatgatataaagcagttgttggtctcctgaaagattaataaatataaagtacgatcagtgtaaagatcgaaatagatatccaaaaaaattgctagaagataatcaagcctagtagtcactaaataaattactctcgaaattttttatgcttcagtgcaaacaatcaagctcagtgcactagcactactaagtagatgcttgatgccttgattgtctaaatttaagctcagtgtactgattttgtaattactaagatatagatagcacacaaggttgacaaaattaggttacgatagttcatattaaaattacattgataaagaaaagtagcataaaccctttttacatagcagtagatctatggaaaacaatcatggagtactaaaatatgcaaatgtcatgataattttttagcatactcagacaaactactgtatatatgaagtcaacatctacagtgcatgcatggcaaatgcaacccatatgatacatgtactacctatactaactcagccctaaacaaaaaaaaaatatcaccaaaaatatatgggttaattgatcaacaattccaaactggtgattttctagccaggggataaatgaggtcgagtcaccaaattcttacattaccaacttgtcatttattaatagcatcttttaggataccttccatttgtcaaggtatagaaaagaaattatccactaatctaataaggcatggagaatgactcgatgcatgccgctttcatatttccaccctgaaaaatgaagcaactaaactataatttgggtatcaaaactagtaagtacaatgactcacatagggcctaactacctctatgacatacgtctgaattcattcagcaaactatgttgcagacaaacctacaaattcatcaagtcaacgatcaggttaacaatcatgtgaatattacacacactttgaacaaaaaatcttctaggtgatagcttatgccctatagagtgggctaatgtagggaatattgcaatttgaattggctaacagataatggttgtcccagtcttacctcttggtggttggtcggcaaagttgataaaacatgtagttagataaccgctagttaaggaacattgtcatatgttatatgcaactactaaatgctaacaaaacaatactattcggatgtacaaaattaattgctcagctagtcaaggattgacaaaactgatttccagatatttggtctagaaaacaaaactaacttttgcagaaatatcaaatggctgacaaaacacaaaactagaaatgttagtagttgagaaaactagacatgagaacttgttttgtacttattattgatgaggtattcagatgcacatagtcatgcataaaattctaatgagtaaagtccatcaccggtccctaaacttgtaccgctgtgtcatcccggtccctaaactcacaaatcaaccgttcaggtactcaaacttgttcgactgtatcatcccagtccctaaacatgcggatcactcgtttaggtcctccaacttgttcagttgtgtcacctcggtccctaaacaggacggtctaaaaactttatatcaaaaaataattcataactttttcatgttaactctaatgaagacaaactttatatcaaaattgtagccctcaacgcgacctacaactttgtagttgaaaagtttttaaattaaaactgtttagggtcccaaaatattgttgcatatttatagattttgtaattttaattttaaaattacattttgggacaaaaatgacttaaaataaaaaaaaattcaactacaaagttgtagatcgcgtcgcgggctacaagtttgatatatagagtttatcttcattagagttcacatgaaaaagttatgaattatttttaaatataaagtatttagaccatcctatttgacccatatgatattcaaatccaagtttagggaccggggtgacacagctgaacaagttggaggatctaaacgagtgatctgcaagtttagggatcgggatgacacagtcgaacaagtttgaggacctgaacggttgatttgcgagtttagggactgggatgacacaacgatataagtttagggaccggtgatagactttactcaattctaattaaagactacctttggagctcttgacactagtctagaactagcacaactactcagtacacctaaaaatgtactagaaaaattacaaatgggacacaaaaaacaatttattttggcaaaatttagaaggttaacaaaaacacagaaaagacaaaaccaaaaccaaaaacataaacagaaacagaaacacagagcaaacaagaatacaatattttgctaatgattggtctttgtgtaggtactgaaaatgacattgagatagtatgcccgatttcttttcagaatccacaacaaacaaaactgatactaatcttttaaaatttacccaatattaatagcccccaagttcagatttttgaacacaaatatcagtgaatttgcaggacaaaacctgctaattttcagtaaataatagacaaatcaatacctgaacataggaaattagcccatggacgatatgttgcttaatttcttcagaatccacatccaccttcatggataagaactgacatcctccatgcatagctaaaactctccttgaaaagaattagagtaaacaaatcaagctaatcaaattcttttaccacaaacttgaaccatatagaagttctaatacttttgaacatgtaaagaaatcaaaacttctgcacacagtgacagaaatgctgaccaaaatcaaagaagtatccaaacatatgaacacattgcatgtcccacacacaatattctgactaacaaccacacacacaaatgaactctgtgtgaaggacccgagaagaacatgcaacaccatcaccaaagaagaatagcaagttactaactactatctcctgcagagaagactgtgacaaacaacaacaaatcagtttgtagcatggcctatagtactattctgtgaattgtacaaaagtactacaagttgtggtaaaaatcttaaaaataaaaatgtataggtacatatgtatgtatgtgctcgcgagaacttttacggtgtttgcattccaaaaaaggtaaaaatccaacgctcctcaataataggtaccatgtgaaaagtatttaagtattagtataggtacttagatatcaagggtaaaaacataaatatacttgttgagagaaatggtagaattgtccctaaatttatcggtaccgcataggtaccggttaagtgatttgcttggtactagctgttctcatttgcatgattttctatagatttatgttgtgttctttgagattctcatctgcatgattttctttatatttacatacgttttgttccgaagaaaacgttattggtgtaaaagttttcatttgtgttcccttgtctagatttacgttatgttctcaagaacatgtcaaaatccctccgtttaattcttttgagatttatatcttttttactagaagagatttgtattgtgtttcaaaaacatgaccggttaaaatatcaccgaagatttgcgtcgatttaaattatataatattttatcaatttatccctataaaacatgaaacttcttccttgactacataaacaactaattaactgcgtaaataagtcatggatatctctaaaggtagctagagaagaaaggaaatgtgatctttgattttttttctctctctccgatacagattgaatcaatcgctaaattaacagggtagccatgatttacgttttcatttactcatctcctatcatgttacaataattttattccgtacctgacccctccgttgatccacctttaagtacctctaagtacctcgcaaacaccgtaaaagatctctaggaattattgtgtagagtattttaaatcacatacaagtgtgtcacatcatcacgtactaggaattattttatagagtatcttaaatttcatgtaaacatgatatatcatttataattttgttgtatttttagaatttaatatgcgagcaatgtgaaattatcatctccatatcattatcacattatttaaacatatatatctatcttttatattatataaaatatgcattcatccacatatcctcagcaaaacgcggaatatcaaaactagtatagtatgcatttcaaccttgttcgacgatcgctcaggtttcgatgtcatcgctggagaacatgagcacggtcccagactgcggtgtgccagacatcaccacctcctacttgaggtcatccaagagcaccatcgacctcttcacggcagcagctggctcccctgtggcggcgcacagcataatgtcgccaccgcagttcatgggcgccattgacagggaggccagggtgcaccggtacagggagaagaggaagacgaggcggttcgagaagaccatcaggtacgcgtcgcggaaggcgtatgccgagacccggccgaggatcaagggacgcttcgccaagcgcagcgacaccgaccttgaggtcgaccagtacttctccaccaccgccgactccagctgcggcgtcgtgcccacgttctagcgagcagcttggccgcacgcctggaagacaatcaaagaagctcaggaatgaatatattctcccactgtatagtacatcttggttgcttagctatatatatatatatatatatatatatatatgtataattcgccgaatcgcctctaaatttgtgggaggtatgaggcttcagctgtaggtatatatagatgctagaaagatgctccttgtaaaattgtgcaggagtaaatgtaatcatgtagtcatccctccttctccaatcctttacaatacatttctgtttttttattcagcttaaaaactacgttttgttttttctcccgataacgctattgatctgatggtaaattttgatcaataataattctcgttcagaaaacaagacagttttgagtcccttttcgcacactatagttactgcgtgtgcattgcttggaaattccatgaataatgtttgaagaattgcgttgatgcttcaactttgggccactttggttctcaaccctaccaattctttagtactgagagttgacttgattacatttggttcgttacttatagagagccagtggtggatgtaggtttaaaatatagatgggacgacggagctagccctaattagatgatggcacaatacatacaatccatagtcaccggctgatggcggcagagctaactctaattaggtgatggtacaatgcacacaaaccatagtcgccggctcatgacactggcgcagcagtgcacgacacggatatcgagaaagttaacaacgaaaattggtagtcgaacaaatatatatgatttatatgtagagagagaaaaagagaaatgttgttagataataataaggggaaccactttcaattggggttataaaacaagatgaaaaattatttaggggtttaagtgcttcgccaaaatagttcaagtgagtaaaatatatttttttatatatttaccaatttaactatttactgtgaattgtatagaaatagaaaaaaattatatatagtcaaaatcaggaacagtcaaaatggtactacttacacagaaataatacttataagtcacgaattttcataaatatttttgtctctacttaaaatatttgatttatctgattattcaatagtagacggatgaataatgtgttaaaaataggtctacaaataaggtttaggggcgtagctgcgtggggcgacacggatcatagctggaccggccgaccctccctgcctaatgggtgcgtccaccactgtagagagctaatgttgccaaactaacctttgtgttcaatctaaaccacaaaatagagcctaccaaaaggttggtagggcacaaattgcacatcaatatttaaaatgtccctttctcttcttaaatagaggtacggtgtgtgcaatggcgtcaggagtgcacctagcacaatacgcacgtgtccccacgcctccaccactaagcactaagcataatttgttataataaaataataaataaatagatgcgttgaaagttttaatatataagttcaaagtttcaaaagttaaattgaaggtttcagttttgagttgaaaagtttcaaaaattcgagtagtgttttctaaaatttcgagttgaaagttcaaattgttagcagaaacttccaaatttgggttgaaattttgaagttgtcagggttacgaataaggcataccctctatcctatgacttatggaacatcccgataaggtataccttcacatgtacgggttgtttccgtatacatgtaacaccctgaaaattcgacgacaacaatctaaactctaaaaatatgggccttcaaaaactttttaaataaattgcatcatgccaattttctccgcctatttcattggaatttggtttcgaagtttatcaataacgaataaggaataattaattaggaataaaacctaaaattaaattggcaaaagaaataattaagatataatttaaaataaagatgaggtgaggatagaaatgaataaaatattattgcgaccatatttgtatcaattaaatttaaatgcgattgaataggaatttactctaattaaattcaagtaaaattttataaaaataaaatatcggtaaaataaatctagagtggatccattggttggaataacacaaatattgaataaaccatatttatgcaaaatttaggatttatagaatcaaatttaaataataaataggctaaaatcgggttaaataagaaaagacactgttcattgcactctaggtgctcgacgtggtcccttaacccagcccctcctctttcccctctctctgtcgccaccgtcaccacgcgccgccgcccgtcgcgcctggccgcctcgcgcctcaagccgccgcgcgctgtcgccatcgtcgcctgccgccgtgccgccgtcgccatcgccgcctatcgccgtcgccatcccatcgccgctgccgcgccgcgcgccgtcgccccgcgcctcgagccgtgccgttgccgcgccgcgcgccgtctcgtcgcctcgcgccgcgcgcccgccgcctcgctccccgcgccactgccacgtgcctggccgcctcgcgccccgagccgcgccacgccgtcgccatcgccgcccgcgtgccgcgcgccgtcacatcgccgcccgtcgtgtcgccgcgcgtcaccaacgccccgagccccgcgccgcgccgcccgccgtcgtgtcgccgcgccgccgttgcgtcatccccctttctctccctctttcccctcttccctataaacacccccacccctctccattgttccccactccattttcctcttcctcccctctttccctccaccgcgccgccgtcctcgcaccgccgcgccgccgccctcggtgtgccgccgcgccgcaccgtgtgccgcgccgggtgtcgccgtcggcttgcgctgccgtcgccgttgtcgccgccgaccgccgctgtcggtaagccgccgccttttcccccccttgcgtccaccgctttcgccgccgggagggcaaagagccgagagagagaggaagggagaaaggagctgggagagaagaaagaaaagaagagagaaagaggagagaaaagaaaagaaaaaaataaatagaaattaggggagatcagggaagtttagaaaatttaaaataattagaatttaattatagattaattatagttgtagaattacaaaatttaatataaattatggattattcttggcaatttctataagaaatcaattcgcggtaataatttagatgtagttaatgactaaacaaatagatgaattcttatagattattatagattatttttgggtaatccctataagtaatcgattcacggtagaaattcggatttaattactagggattttagccatgtattatatttaatcatttagtcatagactaaattaaatcgtataatatttctaggatttcgtccgatatttagctcgcgatagaaatttctaacctattatatggatataatgctcgggtagattaaattaaaaacttatgacaacaaaatatttatacccgcaaaatagtttgaatcgaaattgggtttgccttagttcgcgaatagtaaagttaatataaaggaatcgactttcatttggatttatttggatttttatttgaattctgaattcaaatcaattttcgcacgtaactatagagcccgagggagttgcggatccaagcgatggtcaagacccgcaagactttgagcaaggcaagtcatcactattctttgaacatgttgatcccaattacgaaattatttttatttacaaataaaaattgcatgcaatgatgaacattctacttgtgattatgccatgccttgattattgtttacccttaaatccttgtaaccatgatttacgtataagtccctagtcaactatgacaaatgcttagaaatgctactctagatttatgcatactcatatttatcaaatgctatatgcttgggcaattacctttgggaaggtaattgagatgcggcatgtggagacatgagcgccacattgccatgatgttgatgatatgatttgtgaaaggagaaataaaattaaacaactgttttcgactggggcggacggaggatttgggtggtatctggaaaaggctagtaccgtccccggtcaattaaggaccgagccatgaagttaagcatgaaacgacccccgtacaatcgtacttctcgtatgggtatagacctagcggattagatagccgagcggaggcagtatccctgcatagatggttcacccctgagtgaggcaggtgcgctacggtgggacagccgttgaggtagggccgagaggcgtgccctacatcggtgtcgctataggtaggactgccataagtgtgtgagagagagaacttaacttgaaccataattcaatatgtgtgtgagacttctctttcccgggagcgccagaactcctctcactgctagaaacatggacgcctagagtgcatgaggatttaagttcatggagcgggtactgccaatgcgaggttatcgaaaagctttgccgtgacgcgtcccatgtgttgggacgaggcttatgtgttgggcagtcacggagtgcgggtaaagtgtacatccactgcagtgtaagtaaatcaaatctattcgaatagccgtgctcgcggttattgagcatcgggacatgtattacacttggctagactctaaattcttaacttgtgtggaatgggatattgcatgatgatttctatgctaatggagccacttcctaagaggcgggaaggtgaacgtcctcagaaaaccatgacgactcaatggcgggaagctatccttgggatcacaatggatggtggacagaatcgtcattgtttaatatgaacactggtaataaaatttgatcagtctgtgctaggtcttaggtttgtgaaaggaattacaaaacttgctttgcgcaaaagaaccatagtcatcctttgaatacccctgtcatatgcattgttgctgtggtggcttgttgagtacggttggtactcacccttgcaatatacaaacttaatcagaggccggagatgaagcttcggaggatccctatgcctattaccaggagggtgacgaagacgatggtgctcagtaggtcttagttacggtcgttgcctgtggcaatggcgtgccgctgccttaactccgctgccttaccttcttctgtttttggaatgtattccagaccgctcggtccgatgatttaagactatgcctgcgggcttatgatgtaataattcgtactagacactcgtgtatgtgcacttggtatttcagctatgaattcgtgtgtaccagactactcgatccagggaaatggtactgtttacacgattgattcctgttataaaaaaaacgggggtccacaatacgccattaggaatctatcttaaattatgaaaaatatctctatgagttaagaaattgccggagtcctactcggaaagggtaaaatctctggttatatcgtgccagtttacatatccctaagtcttacttgggagtcaaggtattccacggtataaaagggacccctagggggaggcgaagggcatcgaatctcatcgccaacacacccaccaaagtttacgaagcaggagtacgtggagccgacttgccgggaggtcttgtcgaatccctcgactacgatctcgtcggtatcgcctgtttcagttactctctttgtaatctgttttcatcatcatcaatcccatataaactggattagggctattacttgacaaggggcctgaaccagtataatccttgtcttttgtctgctttgatgttgtactacgtagacccctgctccaacgtaccccaatactctattcatccggtccatgagtatcactcgtcgacagtggcgcgccaggtaggcagacttggtgctcaaggatctaccagtatgacttcaagactttccgacaacaatgtcaccgccagcatcgatcaaggagcttctacctcgacaccgctggtgtggactcaagtcggatccattgtctttccggtctataccattacaccaatgtcgactggcccaatcatcatcgggaacgagagaggtacaacaacgactgagagaaacgacaacccgccgacaattcctcccacttaggtggagaacggaacatcgatggccccaatacctgggaggaaccctcaggcagctgaatttcacctccatgtgaaagataaaagccgacaaggatgaccaccctaaaaccgagaacttggtgtcctgtgcataagacaaccaagcatactctcgagggctgcccggtgatactccacgtgcaagctaaactctacacctgttgggaacgagggatttagtgtacttcaccgacgggagccacctactgtccgatccacacatctagatctcatgatcttacaagctgcagaatcttcctcaaaaccctcaaaccaccgcatcatcgcgtccaacaaccacgagttccaaccccatgtgttgccaaggaaccagatgcggcgccaatcccagatcggtttgtggggttcgttggcactgttgacggtcgttatcgatcagtttcgaccgtcaatattatcagaatagaggagaactagtgatgcttgcaatgcataaatatgttagaataataatattcccctagtagtaggtatactaacctttctgtagagaatgacaataaagtggaggagaatcgacatcaactcagacgataaatcaatcggacgatgtcgagaactagacttatgtatgaatgggccaagaactcagaattgacacgatgaattgggtcaaaattcacaagtctacaaagtgaagcaatagaggaggccgccagccgaagatgggccaggaaggcccagcccatggttcggtcgaacccatcctggcaccgttggatgcagggttcggcgtggacgtccaagattgcatcccaatgatggttggagggcacttcggacaattccccttccacaaccgtcataaccacctctatataaggacttcactctcttcacttcaacacacacctcaagcaatagctctctcatttctctcaagtttagtttagtaatatctagctagtggaataggaatagagtagaaatcatgagtccggaagccttcggaagagttcggatatagctctagtaggttttctcttctcttttgtaagctttgtacttttattagaatactcttctaaatacatttatggtattgaaatactttccaagtatatgagtacctactttacattatgttcatgttatactgaatatatggctagcttatctgggatatgctttggtgtgggtataatgtttgcttatgcaattactctatgtcatgacgatgatattagagtagtatctggtagtttagacgtggtgtctagattacgggatatcattatttggggttatatattgcggatgagaggtgggccgctgatggtgacagctcagtacgggtattgctccgcgccagtatataatccgaagttaattcgatggggagggtattcctccgtatttagacccggttatatggtcatgacgggttgtcgtaaggaacttggcagtcaggggtggcttctcgaagtaccaggagggcatcggatagagggtattagctagtatatcagttaactagaatgtatggatactatgtatattagaagtataggaatagatttttttttctctttcctttccacttagctcagataatatattatgagaatgagtagtaatgcttgtgtgtcactctacccttggattatcttaacccatgcttagaatttgattatcacaagtaatatataaattattagttgagttctctctacatgatcttcccacgggataaaataaatacgatacacttggaataccctcgggtaaaattctacaatggtatatccatgcgcttgtggatgaactctgtaaccataatataccaggagtttttctgcgccattgctgggaattatatttctagtaatgttgttaagaaatgccaacaagcatttctggcgccgttgccggggaagattcataatagagattacttgaactaatactttatatttacctctgtataatcattttactttttgcaggctaaccttggttgttttcactgtttgctgtggaaacagggtagtgcatgactggtttcatcctgccggaaaacttcaaagaaaatccagaagctttcttccggatcgtcatgccgcgagtcgttgctccgcagaaaactctaccgacagagaaaccagccgtaccagcgccaccgaccttcaagactatggccagcaagactcttcgcgagttcactgctccctctgctgacaatgtggccataaggcaacaggtcaacataggggacgtggattttgacttgaagtccagcctcatcatgatggcgcaggctagcccgttctgtggcaggcctaataaggatgccaatgctcatctgcaacagttcctgaagatctgtagcacatacaccatcaagggcgtcagtcccaacgccgtcaggttgtgactgtttccgttctcccttcttgggagagcgaagcagtggttttatgccaaccgtgctgccgttaacaccagggacaagtgctctacggcattcctctcaaaattcttcccgatgggcaaaacgaatgcccttcgtggacgaatttccagtttccaacagacaagggacgagtccattccagaagcatgggaacgactgcaggagtacgtggccgcctgtcctcatcatgggatggacgactggctgatcctgcagaacttttacaatgggctcaccccaatgtcccgcgatcacctggacgcgtttgttggaggagccttcttctctaaaacggttcaaggagccgttgaactcatagggaagatggtctccaatgtgggttggagtgaggaacgactccagacccgttagcgaggcatgcacaccgtcgaggagacggagttacttgctaccaagctggacctcctcatgaaacgcttggacgaccacgagaaacaaccacaaggcaccgtcaaggccttagactaacacgtcacgtgtgaagtctgcagcggcacgggtcattctaggaacgactgcccggaaacccgtgaggaggcgatgtacatgggcaacaacaacgggtatcgtccacaaggaggtcaggggtgtaaccaaccacgcccatattatctaggaggtaataataacggtaacttctctaaccaaccctccttgaaggatcttgtttttgcgcaagctaaaaccactgatgtgctaagcaaaaagcttgctgctaatgataagatcttagagaacataaatgtcaagctagatggctttgcttccgcatttcaaaaccagctgagctttaataagatgatagtaacccagtttgcttagttggcatctttagtccctgcaaatgaatccgggaggatttcggggcaacccgacgcctccactgaaaatgtcaaggcgatcacgacaaggggaggtaagtccactcgtggtccgccatatcctaaccctgcagaaactaatgagatatcaaaaggagcgccatctagtgactcggttgacatggaggttctgccagaaaagactatgccgcaggagtattgagacacacggttgctgccgtttcctcaatggggtaggaaaccatcagtggacgagcaattcgctcgttttattaaagtaatccagaagatccacatcaacgtgccgttgttggacgctatgcaagtgccaacatacgcccgttatcttaaagacatactcaagaacaagagaccgctcccaacaacagaggtggtcaagctgacgaaacaatgtagcaatgtggtactccacaagctcccggagaaggaatcacctgctcgatcggggcacaacaattcgactaggccttgtgcgaccttggagccaatgttagcgtcatgccaaaagacgtgttcgacaaactcaacttcacggtattggcaccaacaccgatgcgccttcaactggctgattcatcagtccgttacccggtagggatagcagaggatgtgcctgtcaagatacgggatttcttcatcccggttgattttgtggtgctaaacatggacacggggaaggagacgccactcatccttgggcgcccgttccttagcaccacaggagccaacattgacgtgggaacggagagtatccgtttccacatcaacgggaaggaagagaagtttgagttccaaccaaggatggacaatgctccatggtcagggtaaagtacgggccgaacccacagaatatttaagtggtcgaagtggagccacccaagacggacagcctggtgaagtttatgcagaatttcctggagaaggaaacaacgatgcccaggaaccgttattggaggatgccggccaagaagttagagcagccgactcagaagaagccgtcttccgcaccaaaaccaagaaaggcatggaaggaaaagccaaagaggcccgctccatcacctccggagacaggtggaaaatccgtgaactaaatcagaaggaggtacggtcttgcacgtcggactttaaacgacgcgacctttgccaacaggtaaattggtttgtatccgcatatttgctttcaacaatttgaatttttgcatcatcacatgtttgaatttcaaatttgcatttaggatttttgaattttgaggaaattcttcaaatgaattttttaagagcaaacaaaaaaaaatttcaacgaaaattaactgtgccacgaccacactgaccgtttgaatccaacggccgaaagtggggccggttgggcccaccaggggttcggccgaacaccctggtttggccgaaccggccaggcaactgctaccagccgcttttggcagggtaacagctagtgggtcccacatgtcatttctgtccgttatgggtaccctataagagccagccggccgagagagggaattccaccccatttcaacacattttcattccctctccaaagtttgctctcaagttcattcaagctttgatagtttccctcaaattgaattatttagttgcatatatacaagttgctttggtgaaactaactggcgggtgaaattcttgtcattcctaacccccgccgagttagtccgttcttgctctattgtgcagtatgaggaggcaactgtcttgtctgttcaaggggtttggctcttcatcaagtcatcatggcgaatctagcactcattcattagctgatgtctcgatggaagacgccgaagctccgcgatgactcctgaacgacaccgacctcgaccttgtcagtgatcgggagagacaagcctactacatgctgagcgaccgggaatatgctcacactcaagaatactctctggagctgctgaaaaagataggtttggatgttgaatttcgttctatttggaaagctgttggttggcagagatttgttgtggtagatgagcctggttctcgtttgcttactttgcaatttctatgcactttgaaagaaatagaagataatatttcttttcgctttttctgtaaggagttcacactcacatggaaagggttaagtacacttcttggttttcacgattcctgtaaaatcgatctccagaaaggaatttttgggtacgagaaaaataggttttgggaagacatttctggtgctccaatttgcaagaaacctagaacgaatgatatccataatcctacacttaggctcatgcacaaatggattgctatgactttgtttcctagaggtgatctgagacccattaggggagatgaattaattatcatgtttgccatggttagaaagatcaaaattgctcaggtgaaatgtatgataaggcaatggttagaaagtataaagttctatgctcctgttgagtgtacttctatgattactcggatagcaaaagggctaagtgtcgttagcgaccaaattgcttttatctcagccgctcgtccgcgtattgatgaggcttattaagtgcaagggcatattatggaacatggagtagatggatctttgatttactttttcctcggttgtacaaatgaaatcccgttgccaaatgcgggatatcatttgtacaactgccatgaactaaccattcccctgcaaaccatagaagaatctcgtgcaggtggaacatatagggagacgcgcaacatgacaaggaacgaacgagaaagttcatcatcctcaacacccgtacagatgtatgaggcaggatgggcaccaactggggatgcactcggatggtcctaagctccatgccatagcatcggactctcaacttgggcaagcgccagtgaggaccggtggcatgcgcctcatgacatccaatggggggacaatcaacctccccgatcgagtggtgtgcctcaatctccaagtgaatggttctcgagttcctctcgttgggacttgggtgaaatcactaggagaatggacacccttgatccagtacaacctcacgaaacacatagctcaaacgctagaatggtaacaatctgctgatcctcaattcaccaacatcaacaacatgatgcagcaacagcacgatgaccttcaggcgtactttcgttttcaggggttcaatccttatcaaggaccctgagcgaaagccaagcttgggggggggagacatcgctccccctactgaggtaacttgtatcacatttcatatttccctttccaattgcatatttgttttccaattgaatcctataaaagttgaaaaaacaacataaaagtttgcaaaatagaaaataccaaaaagataggataggtttgagtcatgctaggtaagacaagctagttctctttgttgaaatgatgaatagttgctctgttttatatctctgatatatgggttcttggtaagtgctctctcaaaggttaaatataagtagccaacaattatccgggaacctgaggtaaataggctgcacttgctgatctaagtctaagttgttgcgagatatgagatagtaatatgagttactatgatcctgatactagtttcacttgaattccagatgttttgtttttcaaaatgataaaattggaagttcctcatttgatataaattcctaccagaaaaaaatgctataatggttaaaccatatacattttggttacttgtcattccattgaactttgtcaaactcttgtgacttctgtagatacttctcatgctctatgatcaagatcatatacccacatttatgcacatgctaaactcctacactgggagctatacaaaattccattccatttccatattaccaccaaaataaattctccatgctttcatgtgctttcttctcctaaaaagaaaagaaaaaaaatccttttgaaaaaaaaaagaagggagggaaaggcatggttatgaaaaataaagttatgctccatcaagcataagcatgatgtagaaaaaaaaattgtagccatgccctcttctaatcaataaaaaaaaatgatttttaggagaagaaagtaagcacaaaggagaaccatttttcttttattttttttcctcatataccatttccaccagataccacacacaaattttgcatgaacttgatcttgagtatgtttagttatctgctctaatcgaagtttttgactcagtaataaatgtgaatgcaagtatgccatgtttgatccctaccgagctccacatatcaaaccttagagtaggaatcaaaaaaggcaatatttggtgaggaattcatattgatacacttacagagattgagtgaatcaattgaggaacttggctttcttttgcaaaatcgtttgaaaacttccggaataagaattgaagaaagattgggttattggtactctaaattgatgttctgtctttcaactgcccaaggcaaggagaagcagtgtctcgtgggaatcaagggtaagggtaagctaccgtgccaaagattatttaatctgagagagagtacatataccttgcacctgtatccttgagatatgcagcatagtagcaactcctgatcaacaatcaagtctttgtttcctttcgtccttcactcgggacgagcaaaggttaaagcttggggggttttgttgacggtcgttatcgatcagtttcgaccgtcaatattaccaaaatagaggagaactagtgatgcttgcaatgcataaatatgttagaataataatattccactagtagtaggtatactaacctttctgtagagaatgacaataaagtggaggagaatcgacatcaactcagacgataaatcaatcggacgatgtcgagaactagacttatgtatgaatgggccaagaactcagaattgacacgatgaattgggccaaaattcacaagtgtacaaattgaagcaatagaggaggccgccagccgaagatgggccgagaaggcccagcccatggttcggccgaacccatcctggcaccgttggatgcagggttcggcgtggacgtccaggattgcatgccaatgacggttggagggcacttcggacaattccccttccacaaccgtcataaccacctctatataaggacttcactctcttcacttcaacacacacctcaagcaatagctctctcatttctctcaagtttagtttagtaatatctagctggtggaataggaatagagtagaaatcaggagtccagaagccttcggaagtgttcgggtatggctctagtagcttttctcttctcttttgtaacctttgtacttttattagaatactgttctaaatacatttatggtattgaaatactttatattatgttcatattatattgaatatatggtaagcttatctgggagatgctttggtgcgggtataatatttgcttatgcaattactctatgtcatgacgatgatattagagtagtatctggtagtttagacgtggtctagattacgggatatcattatttggggttatatattgcagatgagaggtgggccgctgatggtgacagctcagtacgggtattcctccgcgccggtatataatcctaagttaattcctcggggagggtattcctccgtatttagccccggttgtatggttatgacgggctgtcgcaaggaactcggcagtcaggggtgtcttctcgaagtgccaggagggcatcggatagaggttattagctagtatattagttaagtagaatgtatgtatactatgtatattaaaagtataggaatagattttctttctcttttctttccacttagctcagataatatattatgagaatgagtagtaacgcttgtgtgtcactctacccttggattatcttaaccccttcttagaatttgattatcacaagtagtatataaattattagttgaggtctctctacatgatcttcccacaggataaaataaatattatacccttggaatactctcgggtgaaatgctacaatggtatatccgtgcgcttgcggatgaactttgtaaccataatataccaggagtatttcaacgccattgctgggaattatatttctagttatgtcgtaaagaaataccaacaggcacaaacaagccatccgtgttacacctcatggaaggctacgaatcctcttcgcagtcacccagagatgtgaacgtggtcgacaatactgagacaagtgcgtctgcagttgcgggaacgctagctcacgaattgcggaacctggatacgatattgagggagagtccttttgatccagcagcaaacccaggcgccaaccaatgggcagagcgactacgggagactgtgacgaacctcaatgccgcatttgctgaagcagcaggtggcccagagccgcgcagggacgaagagcgacctaccaaggacgcagatggagaagacctcgtcggaagacatgcctccggcgaccattcacctcgatgaagacgagatcctacaccgccgcgccgtgaaggtttagatcttcgtgaacatctaaaccggcgccggcggaataggagggatcgaaacgagaatgaccgtcgtcgtcgtgaggacggtactccgcatcgacaacaccgtcatcgctctccctcgcggcgagaaagagatgatggccgagggaatacccccaacgaagatcgagaccgttggccccataatgaccgacgcgacaacgacaacaatcgagatcaggagaataatcgccgaagacaggagagggacagtgacaaccgacgagatcgaaactcccaatctcctcacccgagtcgagatcgaggacacgatcatcgctcgagaagccgagctcctgatccccaagcgacccctcatcctcgtcttcgtcgtcctcttcggatcggcttcaacgacaacgtcgcgaccacgggccacaccctatcccaggcaacggacgtagggcattcacacccacacttcgcaatgtgcgatggcccgagaagttccgaccgggatcgattgagaaatatgatggaagtacccagaagaatttctgcaagtctactccacagttctctatgctgccagtgcagacgtcaacgccctggctaattatctgccagccgtgttgaaaggctctgctcgttcatggtttgtccatctcccgctgaacccgatttcttcgtgggaagacttatggcagcagtttgtcccccacttccaagggacatacaagcgccacacgatggaagatgacctacacgctctaactcagaacccgggcgagtcattgcgggagtatattcggctctttaacgagtgtagaaatacgatccccgagatcatcgatacttctatcatacgagcattcaaatcaggcgtccgagatcggtacaccagccaggagctggcaacgcgccgaatcacatctgctcgaagctattcgagatcatcgattggtgcgctcatgcagacgatgctgtgaggcgcaaggagggaaaaagcaaggcaagagatgagaagaagaagtcgaccgacagggatgcaccagagttgagcaaaaagagatgtcgcaagagtgggaagcgcaagtcctcgggagaggtccttgccatggagtaagtggcaccttccaggcgctccaacccccagagcgacgactcgcgcaaggcatggtgcccaatccacaagacaagcaatcacgccatggaggactgttatgtcacgcccggaaattcactaataatttccgaagtaatttgtgcataaaatcctcgtccaggaatcagccgaggtacacaaactgacaatttaatatacaaatccatcataataataacgttacatacttacaaaagaaaagaaaaacaacagcagcggaataacggtttagcgatggcttcagctccactcccacagggaactcaactggggtataagccaaacgtcttacatactcaacaagccacacagcaaatatgcaagtgcacaaggataccaaaggatggcataatataggctcatttacaaaagcagcatttagcaaacatttaagagtaataaaatagtagagtactttaatcattaattttaatcaacactgaacaacacgcccatgctgctcaggcccaaccattctgaacaaccatacccggctgtacagatctatctccaaaccaggagctaagcaaattattaccaattatagcatcaataattattgtgagaggtgtgagactaatcacgaaaaacattgctcaactcgcccataaccgcgggcacggctattcgaatagttttactctagccagaggtgtaccactatacccacaagacacagcctcaacatcatgtctaccatgcgtcgcgatactggaaagtacccgaatagaggctgtgacaataccccatgcacaacataactcaccacagtgcaccattcctggatcataatcaccccctctataaatataacaagaggcatggactccccagcgacccccatggacttctcgccgcttctcagtctggtgccccgcaatgaatcatgctatacaaaaggtaaagccgttgcccacgctggcttgtggttggcacggttaatgtttcacaacagtagctcgcgaaccggtccttaattgtcatgagcacgaccttcaaaaccatgtgctcacaacccacctttaatcaagttttaattatcaattaattataataacacaattaaccatcgtgagctaccattaaatataaccataagtaataatatagtataattcaccccattaatgatgctaatgtttctaagcatggctaagcaattatatatatatatcatttagctgaaccaaaccaatatataaggttctagctaatcaaattataacccataggaaaataaagtcatcttcggccattaattaattgggaaaggctcaccacccgatgacattcgaaaataatgcataagttgaaataaaacattagctttaaacgggttcaacatgctcaaagggttgtttgggatctgtgtgacttgccttgatcttccgcaaacacttctgaacctttctcaatgaaaacgctctcctccggaacatcggaaactaaagcgaaagaacaaaatcaacaaaacagtacaaaaacaagcaaaaacagtacatgtggatatttttaacatgtagatcatgattttagatgaatttagagacttgaacggcctcattccgacttcatatgaattagttatgaatttttacaagattaaactgattttaagatttaattttagaagggaaaagggctttatgacatcacgatgacgtcatcaccggcgagaggctcgggacatcacggtcaccggcgatctaggtcacggcggcgagaacagagggcaccaacgtgacgagcacgacgcggtgaactcaccggtgcaagaaacaacaacggacgacgacgaacgacgaccggcgacgagctccgaatggcggcgaaggctctccggtgaccggtggcgacggcgaaggggcggccgagcttcccctcttccacgcgcacccgacggcgacgtgaggaggcggcggcggcggctaaaacgacggcgcgaggcggctgttcgccggccggcgacggcggcggtttgggtggcgcggcggcggcactacggggcacgagagagctcgggagatggggcaaacgaaagagaacgactaggggatgctatttataggcttggattgaagagatcagactccaaccgagaggaatcgaagccggaaaatccgagggttagttggagagataaacacgaatcgagctcgattccgcgttgatttcttcgggataaagtccgattcttgggggaaaagatagaggaggataagaggaatatttcccctcaactaatttcgcaaacggagcacgggatgcggcggatttggtggaggaagcggcggcagcacaggtacaggacggctggctcgggctctgtccaagcttgaagacgacactgtagcagggaggcgaattagactttcgtattgggctggctgaaaaaaaaggaaagaaagaaagagaagagggagctcggctggaccgacttgggctgcacagccgtgcacacaaaagagggagatgggctggaaagggcccaagactaggaagaggattattattacttttccaattaaattaatcactgaaatgatatttgaattgttaaaaatactttcaatgctcgaataatttcaagaaaaatcctgaaaatacttgaacactataagtatttaataaaattataagaagaccatttaatgattaatttaatatgtgaataatttctgaaatgctctttgtattaggaattgagctccgaaaaatccgagaaaatttcagagagtataattaaccatggagaatttaataaaaaataaatccatccatgctttatatttaggaaattttatttcccacatttaacttcacttgtaaattaatgaacatttaatataaattctaataataatttattaaataatttataaatcctaaaacgaaaatcaggatgtggcatgttatgtcatcaaaaaggagctcacgagacaactagcgatcgagagagggaagcgagtatgagtcgtcgaaacgacaaaagaagccgccggcgacaactctgattccgcctttccagaatacgacctacatgtctcccacatcttcggtggatccacatcatacacctcaaagagagagtacaagaaagcggaacacgaagtctgctccacctcacagacgactactaccaagatgaagtggtctcaacacaagatcaagttatcggaagcggatcaccccaaaattgcgactacacctggcagatatccgatcgtggttgaagccactattcggaacataaaggtggcaagagttctcatcaacggcgggagctcgatcaacctgttcttcgccagcaccttagacgcgattgtaatacctcaaagcgagctgacgcccatagatcagcccttccattgaatcaccccggagtcgtcgtctaaaccgttgggaaaaaacacgctacccgtcaccttcggacacgccaaaaacttctgaaaacttctcaaagctggcttcataagagaagtcctctatccagagtggctcgcaaacccagtaatggtacgcaaagccaacgggaagtggaggatgtgcgtcgacttcaccgatctcaacaaggcgtgcctcaaagaccagttccctcttcctcgaatagaccagttggtgaattcaacggctggttgtgagttgttaagcttccttgacgcttactccagctaccaccaaatcagcatggcaaaagagggtgaggagaagacagtgtttatcacgtctttaggtgtattctgttataccaagatgccttttggattaataagcgcacgcaacacatatcagcgcgggatccatggagcactcggtactcagctcggacaaaacgtcgaggcataggtggacgacatcgtcgttaagatcaagaagagcgactcattgatcgatgacctcagggaaacattcgacaacctccgaacatatcaaatgaagctcaacccggacaagtgtacgttcggaggaccgttagggaagcaccttggtttcttggtttcaggacgaggaatcgaggcaaatcctgagaagatcaaggcgatcgaaaacatgaagtcgcccacaaggcttaaggaggtccagcggtgacaagatgcatggcttcgttaagccgattcgtcgcaaggatgggagaacgaggacaacctttcttcgccctgcccaagtgttggtatttcttaacgacattactggaaatataattcacagcaatggcgcagaaatacttctggtatattatggttacagagttcatctgcaagcgcatggatataccattgtagcatttcacccgagagtattccaagggtatcgtatttattttatcccgtgggaagatcatgtagagagacctcaactaataatttatatattacttgccataatcatattctaagctggggttaagataatccaagggtagagtgacacacaagcatttaactactcatcctcataataaataatctaagctaggtggaaagaaaagagaaaggaaatctattcctatacttctaatatacatagtatacatacattctagttaactgatatactagctaataacctctatccgaagccctcttggtacttcgagaagccacccctgactgccgagttccttacgacagcccgtcatgactatccaaccggggctaaatacggagaaataccctccccaggaaattaacttaggattataaaagaggaatgggaagctactagagccatacccgaactcttccgaagacttccggactcctgattcctattctaattctattccaccaactagatactactaaactaaacttgagaggaatgagagagctcttgcttgaggtgtgtgttgaagtgaagagagtgaactccttaaatagagattcactccctat

SEQ ID NO: 80023 - DNA, 1173 bp, Oryza sativa
  unsure (1)..(1173): unsure at all n locations
tggttataatagacgaattgtaatggcatttttctgaatagctaaatttacagtggcatggatcaaattaaccctatttaaaaatgaagtatcaagtaacaaaggttatttatgctgtgagtttgcgatcctttttgtgcggtacattatgcagagagaggaaggcctctccaaaaactggacgagcatttgatatcgacacatggggtagccttttaggattcattcatgtcgatctcananaatatggcttcaggtcatgacatgcaatggctagggctattgatttgcatcttgatttgttcccaggatatctgatttgactggagccaatcttagcaaatcctgagcttgaccggttctttgaggcttggtcggcttaggactagacaactggtaccttacactgacctttattgaactgggagctattaatgaataactcacaactgttttaagcatctgtttttttgtgtgtggaaaagattgcaatttcttgccttattcttgccatgttctagagaaccagaaaaccaaaacaatggttacagtctccggtgagcaaaatcaatctgctccaaatcaagccgggagtacgagctgcttggctcaacacgtgtagctgtacacagaactatccaattctctgagctgtaccgtaagaacgtgaagaaaatacaaacatgatattcagcacgtgttgtgttacacatacaatgtatagacaggcttgcatgtgtgttgcaagaaaaatatacggccaatctcggccttggtggtgccatacctgagacaggatatgtttccttggaccatgggttaaatgcattgtatagcaggtgctgtgacaagagtccaaggggaaacactcgggcccaagctccccaatcctgatcagatatctttggtacggcctgtgggtgagcatgcatgaccaactcaactcagcccaaatgcatgactctttagtaaattttggactccaatgtctccttgccagttgccacagcgatcctgtatgattgcatcagcaagctgaagtacaacatttctgatgcatgtgccagagttaactgactaaataagtaataactgatgaaagccaaggtgtgtgtagaaaaaaaataactgatgaaaggaatggtctagattttatactacctccatcccaca

SEQ ID NO: 80024 - DNA, 624 bp, Oryza sativa
agaacgattcaagctgtgaatcttcctgatggtatggacaaccaattgtattcttctcatatcttttcaggcgtgttgatatggccattctccctctctcgccctcgccgccgccgccacccacatctcctccttcattcttcgattaaagtttttagcgatcatgagaaactaattattgcgcgcctcctgtacgtttttgtttggagtgagaaactaattatcaatgaaaattttgtttacatgctgccaggctgctggaatagtggaagctgtggagggtctactcagatgttgatcgaaatggtgctggatttgggagctgttgttctcaattgccgtgacctatcagtgtcagaccatgggtctgttgttgcagtcaacatcttcctagcgctggtatgcacttgcattgcaattgggcatctgctagaaagagaccagcgtgtaaactctgtgccgttgcactccaggtgtttgtggttttgcttatgtgaagtggtttgaattttgttttgcggtatggtgctttcaggggctgatcactggaggtgtgattctgcttgtcagttgagggaagaattcacacacttgtgttcactgaggacatcttctcaacctatt

SEQ ID NO: 80025 - DNA, 19232 bp, Oryza sativa
  unsure (1)..(19232): unsure at all n locations
tccttataagtggaagatcacggatattatctccgttataaaatatagaagattttatctatataagtaagattaaatgggtaaaatctcttatattttataacgtggtatataattaattgtctgtactttatacgtcacacataatgcaatggttaaaaactctaatattattactccacacgaatgtgcgcgtacattgcttagctagtactcacatctttattcccagttataacatgctaaggctacattttatagccttgattattcatccactgcacgctgaaacatccacagacacataatacgttgaacattaatacgtacgtacgtgatgtgtttgcaacttttgcatgcgcacatcaccatgtacgtgcaactaaccatggatgcttagcggtgcacaacgatcttggtgtacttggtcatgtcagtggtggcgctgcgtgcgctggtggcgagcgggaagtagaagggatagatctcgtagcgcaccctgcagctactgtagttaatctgacatccctgttgtgcgccgcagtattgaccgaaccttgacaccgccgttgacagacactgtgcgcaagccagcggtgacaagtcctgtgtgcactgtgccagcccgtagatgttgatgaacggcgtgtactgatccttcgtcctacccagcccaccactcccagcctgtgatgcctgcgacgttgccttgcccataaccttccctaccgccttctggaacgccttgccgttatccatcgcctgcacgttcacaagaatcaccccggcatctgtgtccgtctgcccgatgaagttctcgttctcgaaccgcatgaagcagtagtcatacctgcacgtagaataattatagttttgaagtttatcagtcgcctgaattcattgttttttcgtatgtttgtggtcatcacacttggcatatataccatattcttgagtcggattggtagttgcagctggtgaggatctggttggcggcggaggcgaggcaggcctggcagtcgctggtggagacgtcgccgcggcattgcgcgagaccgtagatgacgttgttggctttcccggcggaggacgtggcgaagccgccgccggtggagcccttggcgacgaggtcggtgaggacggagttgatgcttgccacggccttgctgttgccggccaagctgttccctgaacagtagctgccaatggagtccatggccatgctcagtgggagcaaggcaaatgacatgagcaccaagcaacggcaagctttgctactgaatgccatggctatgatcactcaagctcactctcactctcactgtcactgctgtgtatcacacctagctagttagaagtgtgtgtggggggcttgggttcactggggaggaatggttggatcttataaagatgagttggatatgggttaggagcgatgtgattgcagcctttttttgactctttaattggttgcatgcaatggttgatgttgacggtcgtatatggagactactacgagcttaactattgctgagtcggacatggcaatgtcgatgcactagtttctgcagatattgcgagccagctggctgattggctgcttgctacgagtcgttgactagttatatttgactcggttaattaggacgttatccacaacgactaacagggactgtatactgtgaagcaaacgaaaatatgtaccaagcttaggatgcaattatgcaaaactaattgttaatccaaactggctaggatgtacaggccatgttttttaatccactagcaaaatatctatgttatatcatcttcgttttatattataatttattttgatattttttctaatcaattattttagcttaatcaagtttatagaaaaaaaatatagcaacatagataacacaaaacaaacatattttcaaaataaatttaatgtaatatttaacgaaactagtttagtgttgttttgttgctaaaattttctacaaaccgatcaaatctaaaaaagtttgaccagaataagcaaaagccttgtgtatcttttgtattaagagaggtgaaatttttaaactttacaaactttaactataaggaaaaaaagaaaaacaagggaacacaaaaggcgtgggtctacatctcgcgacaagtctggcgactgatcagcggacaacgcctcaaatgggcaggtcagctgcgcgctagactgttgctacctccgcggccacgcttgcgctacttcctcccataatttcctttcatagttgaacacccaattgtttcattccttccaaattatccaggctactagggtgacaaatggtgtcgaagctcagtttgtttgctttgtcaactttctttctagcatcacaccaccactcgaagaaaacactattggaagggaagcaaagggcttgcaggatgatggcgaggacatgccaccaaagctgtttggatctggggaagcggacaaggccttgcaaatatttggactgccgctctcgacccaaaagctgacgaccacagcactgcaaccgctggtggactaggttgcacgtcggttgccatattcgaaggccgaacagctgcaacctataacatgaaacgaagggagtagtacctagaaggttcatttgtaaaatatgtcttggagggcttatgttatgaaaattaaactccaaggttgacaaaaccattcaacattaactaaaactaaacaacattaatctgaactcaaccatagttaaccaacaacaaactctgctcatcgatcgactccagcaattgcattgccctctggtgcagcagagtgtgaacgtgatcgctgtcgccccgctctccaggttcttgctccgaccacctcaatgacacgaatgttgttgacggtccttaagtatcaaatatgactgtcaaatcctcaataagaagccggagcccttcgaccaacaactatatccactacactgacagttgcataaacattcaactgtgtcaacaactatatccactacaccgacagttgcataaatattcaactgtgtcagacatcggttagtaccccttcttccttattagggtgatcggctaagttcaattaagtagattaaagatctacatatttatattgctatctactccttttgtactaaacaaacaaatctagtactaggatgtgtcttattatgagacggagggagtaccggtcaatttgctcatcagcgagggcggttggggccgagcaggcaaaccggttgggccgtcaaacacatatctgaggcccgtcgcgtctgggctcagaggacggtttgtttagcaggccatccaggccctttttgccaaacactcaactgggctactgcatcactgcttgtcctcacctgcaggctgcagctgcaaggtgtgtgaaacacggacaaacacgtgcggcctaacatagatgcggccatgggggtcgacgggatcagatcgtacgtgctagtggacagccagcgttgctattgaccaatcgtgatatagaaacaggggctgcttaggcggtatatccggttgaatcgcccctaactctctgaatcttttggtcttttggttacgtatatatgtcacgtcgtctctgcaactagctcgtcgtgcggcccatatatctggcacgagttttggagttcacgatatatgtgaactctctctttcgaagcatcgacccccctttcagagttttcgacgttgatttggaccatcgatgcaactcatgccaatagcagatgctctatcactgctactacagaaaaccggattggtgctggttggggtccggtcttaggtgacagataacccaatcggcacacatagtaggcactaggcagcacccatatatatgtggctcctttctttcttttcttgtttgagaatttcagccatatacactcttcccatcaacccatccacataattaaaaattggtaaccttttaatttcgtgaactatgtcatgatcatatgacttacaagtcgcagctataaaaaattaaaaatgccttccaagctggtcctaacaagttgaagatcaattttcagtagcacataatatataagtttaacacttcgataatattactgctccacacaaacgtgtgtacattgctttgctagtacacattttattcccggttatagtatgctaataaggctacactttatagccttatattattcatgaaccgcatgctaatcaaacgtctccacacacattgtactatagtttatactttagtatgtgatgtgtatgcgtacaagcatgcatgcacatcaccatgtatgtgtaggtagttcttagtggtgcacgatggtcttggtatactttgtcatgtcggtagtggcggtgctactggtggcgagcggaaaatagaaggggtaaatttcgtagcgcaccatgcagctactgtagagtatccggcatccctgttgcgcgccgcaatattggtcgaacctggacaccgccgttgataggcattgtgcacatgtcagcggcgataggtcccgcgtgcactgtgcgaacccgtagatattgatgaatggcgtgtattggtccttcacccttcccagcccgccgcttcccgcctgtgacacctgtgccgtcgccttgctcatcaccttccccaccgccttctggaatgccttggcgttgtccatcgcctgcacgttctccatgatcaccccgttgtccgtgtcagcctgcccgaagaaattctcgttctcgaaccgcatgaagcagtagtcatacctgcacataatacaattattacagttttaatttgctatctttcgtatgttcgtggtcatcacacttggcaagttggcatataatataccatattctggagtcggattggtagttgcagctggtgaggatctggttggcggcggaggcgaggcaggcctggcagtcgctggtggagacgtcgccgcggcattgcacgagaccgtagatgacgttgttgcctttcccggcggtggacgtggcgaagccgacaccggtggagcccttggtgacgaggtcggtgaggacggagttgatgctggccacggccttgctgctgccggccaagctgttcccggagcagtagctgccaaggggatccatggccatgctgagtgggagcaaggcaaaggagacgagtagcaaacaacggcaagctttgctactgatgattgccatggctgtcactatagctcgatctcacagtctcaatgctgtgtgtttcacacccttagatagttgatcaagtgtgtgtaacttgggttctctcgggaggaatggttggagcttatatagatgagttggatgggttaggagtgatgtgattgcagccattttttgactgtttaattggctgcatgcatgcatgcaatggcaggcagatgttgatggtagtgtgagagtatgagactatgggcttaacctagacgtagaaattactttcccaatgtccatgcactaggcagtttctcatgcagatattgcgagctagctggctgcttgcgatgactcgttgactgtatctttgattcggttaattaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggccttaggacgttatccacaacgactaacataggctgctgaagcatgcaaaccaaaatatgtataccaagcaagcatgcaaatattcaaaagtaattgttaatctatacatgcttgtattttttttcaaataatctcatacatgatttgatgattgtaaatttcctgcatctaaatatatttaattatagaaaaaagtacgaactacccccaaactattacagcagtacccaacgaggtccgcctccgtcgctggtcgcccggtccgccttcgccaacccatccctaaattgcttcaggccaagcacgcttaacctcaaagttctttagagatcggcttccggaaaagaagttgcaacttgttgatatgagtattctattaatcctattaaaccctggaccgggatgtcacatccaccttcgccacccgccgcccagacgaggtccacctccactgccggctgctggtccgagcgcatgtgcaagagagagttggggggactgaagggattgggttgagggttaagtggcccagcgagttttttttattttgttttgctgactggattgccacgttagcgccacgtgtgtaatttatatataatcaaaaccactcaaaacagtgttagggggttatttgttcggtttcaataatcgagggtgtaaaatgtccggttttcgagttcaggggtgtaattcggtcaaccacgatagtaggggtaatttgtactttttccttatttatacgagacaaacttttgatcggatggactaagttacagcacatttgcagacaaattttcattagaagtccagagttgaacaaaatttacatactactacaactaataacaatatcatctcgaaaaactaacacccctgatcccgcgttctcgacaacttccagattatagattatcacagacacactttctaacttcctaaacagtaatttattaatgaaaaactttcttcatcattattttttgagagttttgtttttttaaaacaaaatcaagctatcaactttctgaatttaattcatttgtttgtgttgaataatatgatcgtaaactcatccatcggccataatctattagctacgtcccctcaacgctgctcaacttagtgtgcccatatgcatggacaccctctatgaattatacatggtcgtctgatgtatgacactacctcatgttgcatcgagctatgtatttacaaatgagcgattttattgtctttgagtgggtatctggatatatcatattttctaatgtaaaatgtatctgggatgacataattattatatatagaaaattggtaactctcaagaaccccaaaatgtatcatctaggtaggtagtaagtagagtaaagtatgcggccggtccttaacgtgttagagcgaggtatcacttagattcatgatcttgaaaaatcgatattagggtccgtgatcttgtttaaatgactcattgagatccaaagtacctttgaccgggttgactagcttacgtgaccatccagagtggcatcatatttgcattttagccccctcgcatccgatccaacacttcttccccaaatcttctttcagcactagtggtgaggacgacaacgagcggctgatggtggacaacaacaacggcacggccaatggtatacaacgacggtggtggcgaacggatgacggcacagcgcacgctgttgagggccgaggagaggggagcagcggtggagggcagagggcgtcgagctccaacggctgagttctatacaagctttaggccacaatggcataggttggaccggcgacaactcagagtgtggtggcggcagcccggtgcggcagcggcttatctcggggacgacacgagtgagctcgccagaggtcactctcgtgctgctacttcgtgtcgtccacacacaactagccgggagacaacgaggggatgacgagcggtggtgaacgacacaaagcaagaagtagtagcacatcaagggccaggagacgacgaggggacaaccagccgcagggatatgaccgcagctgggacggaatccgccggtgtgcgtgtcgccgcctagcgcggtgacgtccacggccttattgcggccgtcgttgccggatccgacggataactcgatgacatcgctgtcattgaggctccgatagtcgtcgaacttgagggaggactggtggatgaagaggtcctcgccgtcgnnnnnnnnnnnnnnnnnnnnnnnnnnnnnngtggcgtcaaaacccttcaccgtccccttcaccctctccgacaccatcttgccctcaccgccgagccctagaagccgctcgccgccccgcttcgctggccagccgctgccaccgccctactcgcccttccgcttcccttcgcctggggcgacctcgactcggccagttccgggtacttgaggcggctcgcctagcgcttgcaggtcccgccgcggccacaacaagcgatggcgagaagggctggccgccgtcccccgcccttctccccgccagtcgcctcccttctccctctttgcgcatgctcgccaacccaccgttgtacccgcctccctcctcgtcgtcattgtcgtcgtcactgccgccgccgcgtttccactgccaccccaatcggcccgcaaccgcaaaccatagaaatcacactaaaaaaagatttagggaagaagggttggatcggatcccaaggggatgaaatgcaaatatgctgtcactctggacggccatgtaagccagtcaacccggtcaatttttcaagatcatgacctaagtgacacctcgctccaactttaaagactggccgtgtactttagtaaatacatgatgccacttggtcaatttgtagaagaaaaaaagggagaaggttacactaagaagttttaaagcagggataaattatagaagtgtcacattgcatctgtgtatacggaaataggttcccccactcccaccagtgtccactgtctagcacgcacttgcgttgtgtgcagtatcgatcagttatactagggatggcagcaggtcaggtcgggcacgggtagagcaaaaccatgcccgaccccatgcccgtcgtcacccacccgaaccctacccactagagttagcagacaaaactccgtgcccatacccatgcccgacgggcacgggtatatccggcgggtacccaatggatctcacataaataataattcgaaagatagataatttaacaaagagaaataaaattaacaatttaccaaattttagttatcgacaataatttgaattacatcacaacttattattagttagtatcacaaatgaaccaagagaaatgggtataaaaattaagagataagttgaaattagctaatagatatgtatcgggtcgggcatgagttaccgacaggtaaaaaatgaaacccgactgttacccacaatgtcttcgggtatcgggcgggcatatccacggataaaaaatcacacccacacccatgcctattgggtcgggtatccgcggatacccggacccatgagcaaaattgccatccctgagttatacggtattacaccttgactaattttctacatcagttcggccgatggccacggctcactgtagctagtggaaagtgaaccaaccagtagtacacgcccaatctgtattccacagagcttaagattaggtaacgacgcatgcggcagccatcgacgatcatgggccatatcttttgctctacaacatatatatatatcatcgatgctagaatttaaatcttaaaacttaattttaaagtttttatatcgtagtttttttaaacattaacgcttaagtcattaagaacacacgcgcgcgcgcgcgcgcgcacatatacacatacatacatatatacacacacacatattatatatatatatatatatatatatatatatatatatatatatatatatacacacatacatatacatacatacatacatatatatatatatatatatatatatatatatatatatatatatatatatatatatatatatatatatatatatatataagttttaattataaattaactctctatcactcacatatcgtttgatgtattatacataattggtcccagatggcggcccaaactaccggcctactgctagtactgtgagaactggacgacagcctatacaggacaggacgcgtgcacgtcggagcacccacgccggcagcggagacacggtgaggttgatgccaaagatcgattggtcgttttttttttttctcttttgtaagggaacatgcgaaatgctctcacgtctttgtattaaggaacgtgacggttggtcgtcgttctctcgatgatgaattaagaacggatcgtgagctcgttcgggtttctattaattctatttggctgccacctaatgacgactgaatacttaatttagtcgtcctctctccatgtggaattgtggatgcggcttacctgcagcaacagcagcgacgagcgacctgctccatccaccgacggcagcagacaggcagtacacccagcattcagcgctgcgccgcgcatcgtccgatgcatgagccaggcaatggaataaaatccagagatctactaacgccgggattagtaccagtgatagtgtggttgaccgatcaatacgatccagtgggcgacctcgaatggatctgggtctgcctaaatatcaatcccaacttctgcaaattctacgggagatttgtgggcagcaggctgtgctctcttgggccgtgtttagattctaatcttttttttcaaactccaatttttccgtcatatcaaatgtttgtacatatgtatggagcatcaaataaaaacgaaaaaaactaatttcacagtccgactgtaaattgcgaaacgaatcttttgaatctaattacgctatgatttgacaatgtgatgctacagtaaacatttgctaataacggattaattaggcttaatagatttatctcggagtttgcaggtaaaatctgtaatttgttttgttattagtttacatttaatactttaaatgtgtgtccgtgtacttaaaaataaattagcacacgaactaaacacagccttggtaaccaagtcaagcagggatccagtagaagatactcccaattagggagtttgactcgtagtaggttttgctcgagctctagacaagacgaatccgagccatctgtcaaagctcacgagctttatcgggctaagctttagctcataacgagcctaacaatatatgagttttatttttttaataaactagtagattaaatatgatataatatacgcacacaatgaaatagcttgtattggtattatatacttcatccgtttcaatttttataatgtatgaccttctagaattgtttatatttatataaatgttaattaatctagacttacatatatgagcgaatatgggcaatactaaaaagtcttacattatgaaatagaggggatcgagtatttattttttaagagattatcattgaaatatatgttgtactacttatgaaccaatctcgatatatagtcgagctgatcgagctcgactcgaatctggctagaagttcaaaggttaacaggctcgagttgagcttgtattgagctcgagccggtcggctcattgacggaagagcagcccatcagcaggtctcgaaggatgaaggggagatctcctccgaaaccagatgaaagaaaaatataagactaatggtaccgagaccaaagcaacttggcagtacgtgaaccatatgataatctgtctctctgcatgcaactgctaatttgcacatgtttacatctaaggtctgatgaggatggttgaccttttgcttatactgtaagtctgtaataaccaggaaaataatgtaaaacaggctatggcctgcccggccggctggttactggttactatcatactcgtttcgatggaacctcgttgctaatgagtaatgaacgtagagcccattaccagcccaggtccattaaaaacttactaccaagtgagttttttctttatgtagctagcccatcaagctcaaagctctcaaaagaggagcaactttattttcattttgcggaacacattaattctgtagcttatcaaagaggctaacagtaatttgtggctcaatcttactcgagtggctctagattagatggggaatttaactatttgccacttttaggtttggcaattatccaaatacctctcttaggctcgcgcttaataatttgccaaaggaaagacatgatttcttaattattttccacttttacatacgtggcgtgcccgcgtgaaaaacaacatggaccccacccgtcagccccttctcgctcattctgctcctcctccggctgccaagtctcatccttctctagatcttggcagcggaagcaagctagcatcggcggcgccgtcggaggcggacctcgcgcagctctcgacggtgaggaggtgcacggggaggagcggcctgcggtaaggtgagcaaggacctgatccatggcggcgatggcgcactgtgttgtcctagtgcctgtcctcgtcatcgcctcctcccttgttgcggcggcgtacggggcggccttgcgttcgctcagtgccaacgaaggcaagggagaggtcaacaccgacaccgccgtcgacctcatcaccaccagccgaacctcaacactgacgcagggtggtctcgccagagccgtggccatcgttaggttggtctcacctttgtctcctttttttttaatccctgcgaagtccaccttcgatgccccgatgccacgattgacgttgccgcgtcgctggttgatttcgtcgctaagatttggagaaggaggctgtgacggccggaggaggaaaaggagaggggaggggctgacgggtagggtcctcattgatttccacacgggcacaccacgatgacatgtcacgtaggcaagagtgacaaatagttaagaaatcatctatctccagtggtaaattattaagcgtaaatctaagaggggtatttggataattgccaaatctaaaagtagtaaatagttaaattccccagattagattggggatgcgtgaagttcaggcgagcaaggcatgtaaacactgacgcaaatcgcaatcacgcaatacatcactacagcagcagcggatcaaagatcaacaactccatttcccaaaatttaatccataatgaaagacatacactgatatacaagagcctaaacatttactaatcatcaacaaaagatagctaggaattaattaaataatacagctacgccaacagtgcgtacgtcagcaccattcaccccacgcttttttagcgcaatgtgtagccacccagcggcattgtcagaaaaagttgagggcttttttggtgcagccttggagtgttggactacaacaactcagtgcgcgaacgaaaacttttagcgtgttatatggatattaatttaaagtattaaatgtagactaataataaaaataaattataaattttgtctgaaaactacgtgacgaatttattaagtctagttaatctgttattagcaaatatttactgtagcaccatattgttaaatcatagagcagttaggtttaaaatatccgtatcgcaatctacacgtaatctgtgtaattagtttttttatatatttaatacttcatgtacggatgtgacagggtgaaaaattattgtttagaaactaaacaggctctaaattataagcaccgcgatattatcagaggtttgatgatgaagtcgatggtcatcatcataatctctctcaacgtgcctgcgagtctcattgccccccaactcccccgcccacgaaatgattcccctgctcgccggcgtatgtcgcaagcaacacagcgatccaacaacgagcctcgcgccctcgcggctccaccacctgcgcaccgccgcatctgcgttttctccgtgctccgaacccgacatccttcgccaccgggtccgaccggccggcccgtacccaaaaagtcaattttcccgggccccacatgtcagtgaggtaccagcccatcccccggtcctaaacaacttaaccaccggtgaacaactgagcaccgatgccccacctcgcagagataattataaagtattagggcctctttgaatcgcaggattgagaaaacgtaggaataggaaaaacgtaggattttaataggaatgtaagtttaaaacagaggattgcaaaacacaggaaaaacataggaatgaccgtttgattgaacggtgagagagagacttaaaggaaagttagcaagaggttgaagctcttgctaagggcctctttgaatcgcagggtagaaaaaaacggagaaataagaaaaacgcaggattctgacaagaattgaagtgtaaaacagaggattgcaaaacacaggaaaaacacatgaatggtcgtttgattggagcgcaggaaaaacgcaggaatcggataagagagatagactcaaaggaaattttccaagaggttggagctcttgctaaatttcctccaaaatccacatgcaatgtgtcattccatacgaatttcataggatttggaaagcttcaatcctttgaatcaaaggcccaaataggaaaatttcctataggatttaaatcctatgaaatttctacataaatcctttgatttaaaggggccctaaatttcctccaaaatctctataggattgtccattccatatgaatttcaaagaattggataggatttaatcctttgttttaaagggctttataggaaattttcctataggattgaaatactctaaaattcctgtgttttcctccaaatctaaggagcccttaaccggggaaatcgctacctaatctggcctaaccgaggtaattatcgagtgggattaaccttcgttcggggcggtgctcgggtcgggcgtccagatctcgggctcgctgagctgtcgccatcgacccggagtccctcccgcaccagctaacctttgcttccgttggaagcgccagccagcgctcgccgttgtcacctgtcacactgcgttgcacggattatcgtttttaattaatcgtcaccagattgttttttttctttctttttgcaaatctcgcttcgcttttggagtgggaggaattaattgtggagttgggtagatcgatcaggggcagcgcgagcgaggcccggttggtagcagtcggtgcgtgtttgtgcgtgtgcgcgctgcttctgcttgcatcgtggtgcgaggaggggagaggaggggtgctgctataaatacggctcagatctgggaggctttcttcctcgtccgcctccggtctaatccgattcaaacccgccgtttccaagcttgctctcctctcccccccaatccttccctcccgagtggcagggtgagcattccgccgctcccgtgtttttttttttgatccatctccgtggtggtggatcgcgatcgcgtgtgtggggttgaggggggtttcgattttgtggtttgggtggtgttggttttttttttttttttgggtgggggggggggaattgtgacgatctgagtgttggtgacggtggatctgtggcgtttttgtgcgtaccaggtgctcgacgggatggcgcagaaggaggccaatggcagcagcaacggggagcacaccacccgcccgccgccgacgccctcgccgctccggttctccaagttcttccaggtgattttgccgggatccgatcgctggatctcgccgtatacgtggcccgatcgctcgacctggtctgattgttcgtgggtgtttgtgtgtgtgtgcaggcgaacctgaggatcctcgtcaccggcggagctggcttcatcggctcgcacctcgtcgacaagctcatggagaacgagaagcacgaggtacggatgagatcctgtagtacgatccgtttcatttttgttcggcttgcttgtctattggggggtttgtggcattgacttgtgccggtcggtgaggtcaagctccgtccgttgtgaggaacagtagctagatctgagtgatctagttagggactgagggttcgagatctatatcagaaacggtaatgaatggagatgcttctgccagatctctggggtgcaagcttttctgctacgttttgcatggcgtggggttggggcatttatgtctgaaacttaagcttgaagcttctctcgagtctcactacctgagaatgttttccacaacgagagagatcatagatatcagtgtcaatgcttcagggatcttgctaggagtacttcattatatgccctgagctttagctttggatctgtttgagaatgtgagagttaatccaagatccagtagcaatgttgtagagatctcgctgctagtacttcatccatgataagcagagtaccatgctaaggcttgagatctttcttgcgcagtgcatatgcttcatattcacaagagtttgtactttgtagaactcaacaatgttgcattgttgccttgtgtgactgcttggcagatttttagctgagaaagtgcgggcctttgatcatgtgttcttttctgttcaggtcattgtcgcagacaactttttcactggttcaaaagacaacctgaagaagtggatcggacacccaagatttgagctaatccgtcatggtattgctacattctcagtgcatttagttcatgaactattgttacatactagtaataaagttttactgctagcaagttttttcgttcaaaatttgagaaacactatagatcttggttagtaaattacaaacaaagcaccgtattataattttggctttgagtcaatgcttacacaaatgcagtcttgagttgtctgttcaacagaatgtacggaatttctgcacttgtcattgaacctctcttagtcaagttcatctttctatcttattagattagattatgagtatgtttatgtgactttctattggtaaattctgttccaacttccaaacaaaagtgtatgctttcatgcttatatagttatatttatgacttatgaaaaagggtgtttggcccaaccatgaaaacaggctgatagatgttatcctgtgctcatcttgattctgtagtgtacttaagacactaaactttttttgcgatcagttctatcgtatcttcaaaagtatattattgtgagatattaaaattttgaccttttttttattcatttcagatgtcacccagcccctgcttgtggaggttgaccaaatctatcaccttgcttgccctgcttcaccaatcttctacaagcacaaccctgtcaaggtacagtctctattatatatataactctgttaagtccaactattcaaatacaaatcttgttcatgtcctgttctgatatttaaatggatgtataatcatgtacagaccatcaagacaaacgttatcggaaccctgaacatgcttggacttgccaagagagttggagctaggttggtgtttttttaatgctgattaacttgtcctatgcaacttatgagaactatataatgaagggaggtttttatgttgtactgcaggattttgttgacttcgacctctgaagtttacggtgatccgcttgagcaccctcaaacagaggcctactggggaaatgttaacccaattggtacgtctgttctatcacaaatacactacatttatcctatattttcttaatctagtgcaaagttcacttacttgaattgatttacttcatcaggagtcaggagttgctatgacgagggtaagcgtgtcgcagaaacactgatgtttgactatcacaggcagcatggcattggtaatatttttagttcatacctttttgtcttgtgatgtactggattgtagttctccttaataagtattttccaatctatctctgtagagatccgaattgccaggattttcaacacctatggacctaggatgaacattgatgatgggcgtgttgttagtaacttcattgctcaggccgtacggtaatgctcgctgaacttctttcaacattctctcaggttgtgtccagttggtcctggagcttattttcatacataattttacagtggcgagcccctgactgttcagaagccaggaacacaaactaggagcttctgctatgttgctgacatggtttgtcaccccttttgaaatgtcattaattaatagctggctgaaactttgatatatcattgcatcacatcatcactggtaccattttaatgcaggttaatggtcttattaagctgatgaacggggacaacactggaccaattaatttgggaaacccaggtagatttacctctgcattcgtttgatttttctctacatgtggtaatctgtactagcaatcctgtggtaatgaaattgattttcacgtccttgtcactaaatggtcataatatattgtgttgtaggtgaattcaccatgctggaacttgctgagaatgtgaaggaggtaagatgaatatcctgttgccgaacatcattccatgggatgtttctgaatggcatgctaagtttccctgcttttaccttgcagttgatcaacccagaggttaccgtcacaatgactgagaacactcctgatgatcctcgtcagaggaagccagacattacaaaggcaaaggaagttttggggtgggagcccaagatcgttctgcgtgatggcttggtgctcatggaagatgatttccgggagcgcctccaagtgcccaagaagaaccaggcctaagctgctgcatcgcatttggcgaaagatgtcactggagcatacttaatagttgggtttcaccattatttgtgtcgcagttcattgtggaatttgggttccaataaattctgatacacctttgttgttcacctgaaatattgtgttactagaatcgtcatacggggctgggctatttgtatcattaccgcttttggagaactctttatacttttgtttgtagcctgtgtactcgcctaaatcaattatagcaatgttgatgaatttttagcttgtttgttttattactgctgagtaccgtttcacatgtctgcctatttctttgctgagtattccaactctttggcctcaaataatctctttgcgtcagcttggaacgtagaattttcttcgatctctgcacaaactaaactaattgttgtgatttcacatctctagt

SEQ ID NO: 80026 - DNA, 11503 bp, Oryza sativa
actataattacatctgtcaaatttttggggaaaaatttgtcgacaaatgtataggtagtcccctctggcatagaagctggtaatggtaaggctgtaactaatcgagaattgagataagttattagtgtataattaatttagtattagttattgtaaatttaaaattatatttattgtattttgtaaaaaagtttatatacacattattttataaatgcatagtttatcagtttgagaaatatgctatcgagaaacaggaaaattattaaaaatttagcccaaaatgaaaaggccctaagctcattgtctcgtcaatccgtcggcgtcccctgaagaaacggggaacgtaatttcggtttgaactgcacactatcaagaaaacaaaggcttccagagtttgttgcttttttaaacgtactataaaatataaagatcattgcatcgacacctctgtacgtactaaaatatcggaacctaaatatctcatcgatgggcgatggcagcggtttctctgtctcaatcttaatttggtttcgattcagagcatatatcatccatcgctgatgatggaatgtaagggagaggatacgatcgatggatcagtggtaatccctccgtcccagtatagtggacgtcctaggataatagaagcaaattatgtttaggtaaaattgaccatattgcccccaaattattacatgcagttaatcatttcaatccaaagagtgcactgccactcctgacacacaacgaatatttcattttgcaattaattaatgaaaggtttgtcccaggcagcaaagcatacaagtactgtaatttgagtttactggcgccaaaacactcctattacatggtggcatagttatctaaacaagcccttgaattcaaaatactacaaacatatgctactttgccgccaaagggtgcccctccattccctacaaatcctcaaggagccagtcaaccagtcacttcccattccattgatcagcttgcaaagcaactccatgcccacaaatcacaatggctatagatttaaacatactagcagatgaagagggagatggaggggctttacctgacctcaatgaagcacaagtcaatctggaggaagaaggagaaggaaggcatgctattgaagcagaaggtggaggggttgtacatccttttgatctcaacttgagggcttttgatcttaacatggaagttgcaggagaacaagaacaagtgcatccaggtatttgacatcatgtaatctttctcaatgcataaatgaaatctttctcagtcaatgcttcaatgcattagtaaatatagttcaaattatactccctcatcagcacgcacccatagaatatgtgaacaaaacaaggactgctactgtacaaagattaccagttatagttgcattctttcaaatgatgccaaatgtgtaggatttcatattcaccaaaagaaaggcacatgtttacatgccaaatatttattgatggttagatggtcacttacttgtgaaattggatttgtgaaagcatatgcagcataactccacctcccaaccccagacaccatatttttgcacttgtttctgaaaataagcagtcactgaattaagtagctgaggaaaaataagaacttttaaaccactaaagatagagcaaaacaaggacacaaaatacattattgcataagcattccagacaccatatttttgcacttgttgtaaataagtaatcactgaattaagtagctgagaaaaaaaaagaacttttagagcactaaagctagagcaagtatgtaattaaacaaggacacaaaaatacattgttgtataagcattccagcaaatcatacctgccatactagcaagatgtatgaataagtcatggttcttgacatggaagagatagtactattgtgacctacagtcatgtatcatgactttgcaaatcctaaacttattcaatgttctttgtgtctacataaagggcactgaccaacaagtaattttttttttgtagataatgatcagcaaggcatgcagtatgacatggatgttaatgcaaatggaaatgaggaacaagaaattgaactaggtaaagttcatgactttatgatcagtgccgaacattttctatccttggttttaggattcaataaatctgcataatctgattagcacatattaacttaccaagtaaataattttgtagacgacgacgatgctttgcaacatgagctagaagccttggaggatgacattcaggattatagtgtgtacgctgatgctatcaatgttgtgctcgaagaaagaggagttgcccgactcagatgaagaagaaaatgatgcaaatgcaaatgagccaatcaatgccagagaattgacaaacccacaaaggcgaagcatttatgaattgttgcttacaaaaagtctggatggatacctagaaaaaggcagcacacgtgtagttgctgaagtgttcaatgtgagcattcgtacagtccaacgtatttggaagagagcacaactttgcattgcacagggagtacaagtcaatgttgactcaaggaagcgttataattgtgggcgcaagaaggttgaaatagatttgtcagttgtagcagcaattccattgcggcaaagaagcactataaggtcacttgctgaagcgctaggtgtgtcaaaaagcacattgcataggttgttcaaagaagggcatctacgacgtcactctaactcattgaagccttatttgaaggaagccaataaaaaagaaaggctgcggtggtgtgttggtatgttagaccatcgtacgttgccaaacaaccccaagtttattgaaatggaaaacattatccacatagatgaaaaatggttcaacgccaccaaaaaggacaagacttactacctacatcctcttgagccggagccgtataggactgtccaaaacaagaatgcaattgagaaggtaatgttcttgtcggcggttgcgagacctaggtttgatgatgaaggtaactgcacttttgatggaaagataggcatttggccttttgttagaaaggtaacacaaccttcttacaagtgctgtttgcttatatttatttctgtttttcatgtttgaacctaacttgtttgatgtactaataggaacccgcccaaaggagcagccgcaatagagaaagggggacacttgtaacaaagactattaaggttgatagagacactatgaaatcattcatgatctctaaagttctcccagctattagagcatgttggccccaagaagatgcaagaagaacaatatttattcagcaggataatgctagaacgcatgtcccaatcgatgatgaacaatttggtgttgcagtaggtcaaatgggtcttgatattcgcctcgtgaatcaacctccaaattcccccgatatgaattgtctagaccttggcttttttgcctcacttcagtccttaacatctactagggtctctagcaacatggaggaactaatagagaatgttcacaaggaatataatgactacaatccaaacactcttaatagagtgttcgtgacactacaaagctgctacattgaggtaatgaaagctagtggagggaataagtacaagatccctcacatgaacaaagagaggctagaggcacttggcattcttcctaaagcgctttgttgtgatcatcagctgtatgagagagccatacagcttctagttgactaattgtgcacttgtgtcatctatgtacatatgcgtctatgtaattgtggaaactagatatataagttgtgcgtctatgtaattgtggaaactaaatatataagttatttgcttgtattaatgttttatcctaggttatattaacaagttgattgttcatatgcacaatcacataaaaagaatagtatttcattatacaagttgattgtattgctatcgaatagagacatagcatttcattaagatgttttcataaccatatttccaaaagatgccaccaaaacagaaccacaacatatagcatcataggatgaactatgcagcccaatcattatgagttcatactttagactaataacaagttggaggtagatggcacactattcatgtcacataatcagaacactactttttttttggttggaaacactggatgtaacctgggatcagtagacgaagcatttccaacttggtgtcatcaatgggctcgtattcttcctcctgtgaataaccaaactgttccacgccaccaaacacatcaccaccattttctttgtcgttgggtatcttctcctcgccgtgtatctcctccttgttgggcatcagtgggttagacacgtcctgaacatatatgaaaacaaatcaaaactaaaagttacatcaattaaatagcagtgagcagtacactctatgttcagtgcttgcatatttgaatagtgggtgtgtgaatgtcatttctaattaaggctcatgaaagaataaaaggagatatgattatctatggaaatctattataagaacatcataaataaaacactttgtatagcacctgtatagtaccacagaaaatccctaaaaattgattcataaatatataatttcatttatttttttatgtacctagctagctgattttgggcatgttcgtgagttcgttgatgtgctcctagatactacaacaaatctgtacctagttagagagaagaaaaataaaaataaaaactcacatccatgggacgcaatagcactgagcctcttgatcttaaatctcgatatatttgtgggatgccctcgagccatgagaggcactaaaatctaaaattttaatagatgtggtggcactgccatggctgcttacaacatgtatataggagatagtacctcatctatgacagtgtgttgtgtgcccaaagaagaggaaacatcattttatttggatggacatgaatatgaacagttggagaaacgaaagaattcagaagttacgtagtagtattaacgaacaggtgggaccatgccatgggggggttaaaagaataaagaagatgagtcggtagtccagcagttagattaaatcccatggctctagattgaggtgacatttgagggatcatacaggtaagaacgtatctaaccaacagatcgaacggctcacaaattccagtgatgtggcttcatgattttgtagctttatagcaataagtaatctttagtggttaccaattatatagaaagaaatgattgctaactgaaagaaatacaacaaaaaggttgtcgggagcttacattcccttttaatcaatacataatgagccttacactattaaatacgatatacagtacgctgtcctatggtgatcaaatggaaaactgggcttaatatgttcaaaaactagcatttttttcaaccaatacaacccaattttcatgtctaaatttaacgattaaaagcacgcaccttgctctgcccgctaatattggaggcctccaccatgatgtgcttgctcggtccaccaccttggttggccattgtcccctgccgcaagtcacctccctgtgggtaaaaagcattcgacgaagtggacaccttcatcgaaccatcgaaccaatcaagtatcaagccaccaccttcatcatccaaatcaggccagaactcgtactcatccaaatcaggcccatcctggctatcaaagattatatttttgccttcttctaataagtagccggatttacgttcaaaccacttgcctcgaatatgccatccgcccctccgggcagcagtccgtgtccctccatcatgtgagtgccccatgctgctgccaccatagatctcaccacccttctcctccactttcttacagtcctgaatcacatcgacattctcctccgttaccccacaatcttgaatcccaccacccttctcctccactttactgcactcttcaatcctaccacccttctcctccgcttccccacaatcctggaattcagtctcgggcacaaactcctggtccaaggagaactgatggtcctcggcttcatcatcggaatcagggatgaactcgaactggtcatcgtcggacccatcttgtgtatccaaaacaaaattcttgccttcttccaataagtgtccgtatcttcgcgagtaccacatgcctcgacgccgtttcttactgcgcatcagggaggcactccgcagcccatctccgtcgtcaccgccacaacccaatctcttgcgtaagcctccgccaccgccagaaactccaaaacccaaccctccgccaccatcatcgctgccgctgccgccgccgccataacccaaccctaggtcgctgtcatcgccgcggccacaacctagccctccgtcgcccctcctaggcttgctactgccgctgcccctagggcctccgccaccaccgcccctggggcctccgcctccgccgctcctggggcctccgccgccgcagcccctggggcctccgccgccgccgcccctagggtttccgccgccgctgaacatgcgcacgctagatgtgttgcgcgtggtgatgagagggagaagccgcgtggagaggaagagagcgcgatggggtgcggcttggtgaggggagggaggatggggtgcggcttggtgaggggagggagaagcggatcgggtgcggcgtcgagagaggaagagcacgcgatggggaagaagaggaagtgcgattgagataaggtagagcgcttgcaagaaaaaaattcgtgtggaggaggacgcgatggggaagaaagagaaaatgtgattgagataaggtagcgcttgcaggaaaaaaaattcgggtggaggagaaaaatcccacgctactggcccacttcttttttttttttggagcactttcgctcttgggacttgggcgcgccaatctttctggaacagcatctacagggtagaacgaccgctatactgggacggagggagtatctgctgcggtacgcgtggcgtcgtgatcgggtcgtcagtggcgccctcgacatgtagcccgcgtggaggcgctccattgggacaccccagtccaagcagcgtgcggcgcacgtgaacagagctaataagagttcgagatagcgaaagcgacgtaccttcgctcagctgctgcatgctgctgctccattatcctacacttctcggtcgccgtgtatcggtgtatgtacatgtaattaactagggggcagacatagatgctcgcctgtatgcgactgtgagtgagtgcatgcaccacaaacgtacgatctccctgacgttgtaccggtggaagcttcttagattaatcgacttctggacgttggatcccccaatagcttcgtcgttttgctcttcagcttatctttttttttttcacaatcacgcaaaaaaaatgtacaccaatatcttagagagaagaattttttttatacacaatgcaattcagtcagaccggcttatgtcagagaaagaaaaaaaaagtaaaacaaaattattatcctggtttatttttagtattggtttttaaatcgtaaatatatttatacaagagttttacatataaaatatcttacggtttataatcatatcagacggtaggcgaaacgatggctggtgcagtggccgccgcgccgatggatggagacatatgtgcgtcgtggtgggatgtaattataccgagggcgatgttgtgtatagaagcggtggatggccgcatcagtggaagcactagtagctatggtagctagcgctagaggcagcaagcttagctgccggccgccggccaggcacgatggacatgcgtgacacaccgcccggggcgcctggtacattatccgatctctacgactcctctcctcgccgagtgatcaccatcggcgctactggtgcgatggaacacaccaccaaccggactacccctgctccctacttccccatccaaagagagctcgatctgagtgcatgtaactacagtacacgtgcgtgtttgctcgctccatcgattagtgccttcccatcagattcagaaagggggtgaaaaacggtcggaaacgatcgaatcggtagcatttcttcgaaaacgatcttcgatcggtcagtaattgaccacattaatacgatgtagaaagaattgtgaaaaaacaacatttaaaaatagtcaaaaatagtatggtcggaaacgatactccttatatagaaacagtgctcgatcgatcaggaatttccgtggccattttcacccccattcagtgcatctttttgttcacggattattgcacacgcatgtgaaacttttgagacggaaatgataggcgaccatgcgtagtacggagtacacgagtgcgcgactcgatcggtggggtggtggccatgccgatcgacctgcgcgccgccgacgtacgtacgtacgccacgcgtgggggaccaaggcgatcacggccgcggggaagagagggaagagagtagcgtgcgcgcgcgacgtgctgtgcctcgcgcgttcgatgggttcgaggagtgcatgtgtttcgaggtgtttcgccacgtaacgtacgggagggagagatgatgcgcgtacgacgcgctgtgcgcgcggcgcgcgcgggggggagggcgctgtcacgggacgcgcctctctggacgacgtgtgcatgcactgcactaccaactggttttggagacagaattacggccggcctcccaatcggctggttgatcgataccctcatcttgatccgtccctgtttggcgccgctactgacgccaactcaacggggctagctagctcaatgatactgatgattggaacaacttggagtctaagccgatatatgttctgttctgatctgtggggattatgctagtagtgtgcatcattcggcgaacgctgtttagtgtttacaactgcgcggctgctggtccctggcttatcccttgtgaacgtacgttacccgtattcgtccaagtgtgtccaatccacactatccgacttgacgaagaattcattctcgccaacagagacatacatttcttagggcgtacgttttttcagcttggtatttctgtttttagataatgttatcgatttctattagccgactttttttaattgttaaacggtgtgtttcattccaaatcaaataaattcatttttaagtttttaataaccaatactcaaataaacatatgttaatcatgtttctttttttatgcgcctaatcatccattttaaagcactttaaaacgcgccttagttgatggtgtatccacacaatcaatgcatgtatcctagcgtgtctaaaagttgggagatttacatataagtaagtgttatttgctcttttgagaggttcttccacttccatttctacgactcatctgtgttcaccagctgcccccggccaaactgacaaaggggaccgcacatttcccgctaaaggagttcatcctctgacacaatcaactttgcgtatcatgattttgtctgtacaaaattaagaacgttaacttctgtacatatacttgagttttctagctctagctaacttgatgtaactttggtctgtgctgagagtttcgtgcacggtacaccaagtttctcggtggcctgcaaaaaactaggcggatgcatcgccggaccaccggatcattgtgtgcatcccgcagaggcaggtgcgtttgtcatcgacgttcatagtatatggccattctgtgatgtgaagtgcaacatgtgctgccaaacgaatcgctactacaagtggttagtttcaatgttgcatggggacagtttgtaccgagcacggcagtagattgtagccagtggtgaactcagaaaaaaaattaccgtagatctaatacatactaattatctaattattaactaatatattaattaatataatgtaatttatataggatttgaataatctatccggtgtcctatgacaccgggtagtatagtgtaggcacgccctgattgtagctagcttgagcgaggacgcaatataggccacgtcgtgtcatgttcagaaaattaaaacgagcaacacacataagcacacgtcgtttttagctttctgcggttctcatttgctatttgtccgactactttggtttgagatatgatcaatttgatgaaaccacatggctgttcatctgatcactcttcgataaggcttgacaagataagcctcctctaccatatcggcatctatcccgggcccaaataaggcacattaatgggtgaggatagaagcacgtactccatccttcgatcatcatatatgtttatgcactaaaactaaggataatttaaatcacattaattaagacatcatgtatatattctctcacaatgtattcatcaattaaaacaccataacaattacaccttagtatatacacattttcttatgccgtattaattgtactctgataaaatccatgtccatacagttatattttgatcaatttaagaaattttgaattccattatatgttgatcaatttggaaaggagggagtaccattttagcaattaaagcaagctaggtcattactgagaaacatccagggtcttccggctagctccataaggtggtgagctagacaatctggtttttagcctcacatcttctaattatttgatattaaatcattcgctaatattcgcgtcttttttgcaaggtcaccaaagcgatctgtggaaacatttgtgaagaagtttgtggagacagtaacaccattttagggcacgttccaaccggatgattggataaattacaggcaaaggaaacacgcttatatatttttttaagatgataaaaaatttaggtctttacttcgatagaagatataacaaatgcactaatcatctcaaataataacaagggttaaaaaaacaacaaaatccagatgaaaagacattatttagaaagcaattgtttgtctaaatctccatccataaatagtggaaattttatgaccatcctctttagattttgacatccaagttgtatgtttccttatcatcctcatacttgtgtagctggactcggaattaaatctatattatctatatagttgatgcccactaacttctaaagctcaatatgcaagtgtaccatattatcacctactagcaattattatataaaatattttaaatcacatgtaagcgtgtattttaaatataatgcaaacatgacatattatttacaattttgttgtatttttagaatacaatatgcaaaaaatgtcaagtcattattttcatattatctaaacatatacatctatcatttttataatgtataacatgcattcgttcacatatatgtaccgcagcaaagcggggagtatcaactagttcaataaataagcaagagcaatatcatgtcatggtttattttcatattatctaaacatatacttctatcatttttatcaatgtataacatgcattcattagcatatatatcccgcagcaaa

SEQ ID NO: 80027 - DNA, 2180 bp, Oryza sativa
aattcgagctcggtacccaaatagattatggacagataaactcatgtaaatgaattaaatatcataaatgctctgaaaaaaaatcatctaattaaagttgatataaaaagcttctgaagagattgtacttaagagaagcatggcgtaaataatcgatatctccattaacagtttagaacatgctcaccagtcaccataggagaggaccgggacaacaagaggaaacaggaaaacggactgattaggaggcaacgacgtgtaatgaaaactgttttattggatttaaatgagaataatgttgccagtgaaggtaataatgattcagagaaaaaaagatcaattaacctttgctaaatagtgattcgactatgtaaagtatagtgactgatatagcagctgtcgttatatatacacactcctgaatagcagcgagaggcaagaatggtcattccacatcatgcacgcaagataacaatgagttagtttcaaagttatttcctcaaatttcaggactccttcagaacctaggatttgatgaaaatctagtcaaaattcataatttaataaaaaaatagtaaaataatcgtgacacaattatttgcatgaatgatctaatatttgtgttaaacataaacatgctaatagtaaagaccacatctactaatatgttcaacacaaaagaaataagcactagattaggataatacctgaaacgactattggccggagcaatagatccgtttccagtgttttgctcagtcgtcatgggcagttgttggtgtagtcaaacgtgagcagactaggaagaacatgagaacaaattgatgcagccccttccatccagaacagcgggaagaaaaagagcagatagcagtcacgcagagaagcgctctcagaactcagaacttgatcgtccgtttacctgtgcagacccttaggaggatggagttcagaatgctcgtatagaaaacccatacgcacaggtcttccgaaatggtaatagcttacccatgcaattacttatgagaacggagttccggatgctcgtacagaaaacccgtgcccgtaggtattctgaactggtaatcactaatagcaacgggaaaacttgatcgtctatttacctgtgtatgtgctcagatgcgcgcagttctttcgaaccgggaggcttaactgtcctcaaacgttgccagtagtgaacagtcgctataagttcaccgccatactctgcttgtcaacatatatgcatataatttacaacccattttaattgagtactaatatttattctacttagcattaattacaagtttttggatttactagaattaaatggacaaagtccaattaattccaacaggatttcggtagaatgtgtagttctattctctgagaataattctaagaatgcctccgttcgaatggaggcataaacgcaataccgctgcatatgcccgcaaatcagcttgcggaggctgtagcacattggttttgttgcgatgaaacgtctgcgtttgtttggatctatcgtttaaattttataagatcacgtcagcaaggctaaccaagtctggaatcttgaaagtaaccttcggccattccaagatcgaaccttgttgtaggatgacttggaagcttttgtgctgtggattttagcccgtggtatttcaccatggattcggtaagggtcggtgctaaactaactactaattaaatatgttcgtatcctttggatcaagggtcgaggcgtcaaacattcttatcgaaagataagctgaattccaaaccatacgcataaactattatctaggtagcagaggagcatatataaacatatgcttagaaaaaaaacatgtgcgcccttgaatacaaaacgtgaggatatgttgcccggtgtctacatccctaaattgtatggtccagaaccagaagttagctgcataataatacccctttcctatcacaaattccagggccggaaaagaacgaaaaattaataaagggagaaacaaaatcattggtaaatacagggaacttctcaattgtactgtttgttagcctttctttatacatgtagaagacttaatttgatacaggaatatctacgaacaatagcactataatctgtactctcaaataacatgcaaacaaagtcacacattgttaattaggattccaaa

SEQ ID NO: 80028 - DNA, 2211 bp, Oryza sativa
gatgtgatagaaaagttggaagtttgtgtgtgtagaaaagttccatgtgacggaaaatttagaagtttgaagaaaaagttagaatctaaacagggcctaagttttatgcacggtccagccgatagcattgggaggtcagtgcaggcgatagcagggaggttgcccaaccgacgacgtgggaggacgtggtggcatcagggaggccagtgaaggtggtgtgccgcagaggcctgcggcagctgaccggcgaggggcattggttgagcgatgtcctcgcgttgacagagacgaggggcgttggttcagcaatgtcctcgcgctgacggaggatggcatgtggcattggttcagcaatgtcctcgcactgacggaggatggcctgtggcagagcaatggagcatgcagatcgatattggttcagcaatgtcctcgcgctgacggaggatggcctgtggcaaagcaatggagcatgtagatcgatattggttcagcaatgtcctcgcattgacggaggatggcctgtggcagagcaatggagcatgcagatcgatattggttcaacaatgtcctcgcgctgacagaggatggcctgtggcagagcaatggagcatgcagattgatattggcagggtgacaggtgtaaaacctagctcagctttgtcagcccgacaatgataacattttcggtatcgtttacctttttaggagcgctgtcgagatgtccctctctctctggtggtgttgtcgggggaaaaccctatcttcgttctcctcgagaccttgatgaatgcaacactgctcatcgctgcttttctccatggagatgtcgtctaggaggccctcttgccaaatcttctcttagatagcttgtttgtgctttctctatacgtttgtcctcttatgatgacacactagctaatgcaagctaaccatgttggcgggccttgtggggaagagcggttccatccttctcggggcatttaactttctaccacttttaagatgtggcaattaagaatttgccactagcaatctatgatatgtgggcctagtggcaaatagttaattattcctggttttgggcgattcggttatagctactttattgatctagtggtgactggtccggtgccaaccttctcttgggttctatgtgttgtcggtgcgaggtggtggttttattctttcgcgactactgccttacagagtgctagccttgcaattttttcttctctattcaatgaatcatcgtttcgtctggcgttggtcgttcaagataaatgaaattcttatactacccctaaaagttgcaacataagattagatgatgaggcggaggagagataggatgagtcacccccttacgcaagggaccatctttacataaactttcaaaacaaagtgagatggtgtgagagtgaagcaataaaaaaataattggatttttatgtgttggaagtaaattattgtatacgttgcctcttaattaatactccctccgtcccaatatataagaacctaggatcggatgggacattttctagtactacgcatgtccagatttgtagtactaggaaatgtcccattggcatgtctagattcgtagtattagaaaatatcccatccggtgctaggttcttatatattaggacggagggagtatgtagatgatataattaaatttagagatagcagtcattcctattataaaacttgcacaaacagagctgagcagctgctactgcttgattgattaattgaatatcaggttgtaggttgtaccgagtaccgtacgtacgggttaacaaccacatactgtaacaaaagattagggctacccaacaaaatctggtcttggcattttccgcaaacaaacggacgaatcagcagctgtcgtgctcagaggtcagagctgattggtctcccctgcggccttcctgtactgttcctaatctttccgggctgttcttgtacggcttcccagcgcaaggaaatctaggagtaacaacattttgcacggtctggagcattggttgcatgcatgatccaaagggtggagtcgtcttgcaacagcgcatcacaatcccgacacaacaccagcattgctaagctagcggtgacctgacctcatgatattatatggaacttcaattcgttgataatactattttttggattgtttgtttatcaatgaatttttattctctctaa

SEQ ID NO: 80029 - DNA, 18259 bp, Oryza sativa
ccccctcccctcctccccctccccctccccctcccgcatcacagccattcgccacttcaccaccaccaccgccataatccgtctcgccccgatccagccggctcgtcaccgacgcgacgccgccgcggccccccagatcccgtcgtgcgcgcgcgcgatctgctctcggtgagcgcccacttctcttcgtctccgtcgtttttttttccctaggtcggtgtcgggggatcgccccgcccggccgggttggactcgtggatcctctcgtctgaaatttgttctggcgccttgagggggggatagatctggctggcccgtgcggttgtgcgttgtgatctggtgtggcgcggggttctcgtgcgtgcgcattccgcgtttgcggcggggagagggatctatctgtctacctttctggtgcaggggaggcggtgagtggtgccgatcaccgttgttttgtggttcgttcgttcgttctacttggttgtggatcatggtgagcattgccgttagttagtacatatcacaatcacaattgtttaacgtgaagaatttgattatttggtaaattgaaggctagatcatgaagccgaggtgctgtttggtactacgagagagacttcgcacacacacactctctctctctctctcagggatccatgtttatgtcgctccttttctcaaataaatcgatactagatcagttgcggtttttgttttttcttcattttccatgggtgttaactagatctgctttttataattttaactctgtcttggggtgccttttatgacgtcacatgtgaggatactcttctgatgccattttgtacacatcagcaggcgaagatggcggcttacgagcccaagaacattcttataaccggcgctgctggtttcatcgcatcacatgtggcgaaccgcctagtcaggaactatccgcactacaagattgttgtcctcgacaagctcgattactgttccaacctgagcaatctcaacccttcacgtccatcgccgaattttaagtttgtcaagggtgacattgcaagtgctgatctggtgaactaccttctcacaactgagtcaattgacactatcatgcactttgctgctcagactcatgtggataattcatttggcaattcctttgagtttacaaagaacaatatttatggtacccatgtccttcttgaggcctgcaaggttactggtcagattagaagatttattcatgtgagtactgacgaggtgtacggagaaactgatgaggatgctgtggttggcaaccatgaggcctcacagctgcttccaacaaacccatattcagctacaaaagctggggctgagatgcttgtgatggcttatggaagatcttatggccttcctgtgattacaactcggggcaacaatgtatatgggccaaatcagttccctgagaagctcattcccaaatttattcttttggcaatgagaggcttgccccttcccattcacggtgatggctcaaatgtcagaagctatctgtattgtgaggatgttgctgaagcttttgaggtggttcttcacaaaggagaggttgggcatgtgtacaatattggtactgtgaaggaaaggagggtgattgatgtggccaaggacatatgcaagctctttggcttggacaccgagaaggtcatcagatttgttgagaacaggcctttcaacgaccagagatacttcttggatgatcagaagctgaagaaattgggatgggcagagcgcacactatgggaagaggggttgaagaaaacaattgaatggtacactaacaatcctgattactggggagatgtcgcaggtgccttgctccctcatccaaggatgttgatgacacctggagttgaaaggcataactggactgatgagatcaaatctctttccacttcaccagatgaagctaaggaatctagcactgcggttcctgcagccactgccaaaagcaccagcagtgcccctcaaaaggcctcatacaagttcttgatatatggtaggactggatggattggtggtctacttggtaagatatgtgagaagcaagggattccatatgagtatgggaaaggacgcctggaagagcgctctcagctcttgcaggacattagaaatgtgaagccaactcatgttttcaatgctgctggtgtcactgggaggccaaatgttgactggtgcgagacccataaacaggatactatccgcaccaatgttgttggcaccttgaaccttgctgatgtttgtcgtgagcagggcttgttcatgattaattatgctacaggttgcatatttgagtatgatgctaagcaccccgaaggatcaggaattggttttaaagaggaagataagcccaactttactggttcatattattccaaaactaaagctatggtacgttcaagtcgtgtttttaagaactataacatctatccttttatttctctcaggtactaacgtatcttttattataatgcgatgtaatgcaggttgaagagctgttgcaagaatatgacaacgtctgtacgcttcgagtcaggatgcccatatcatcagatttgagcaacccccgtaacttcatcacaaagatagctcgttatgacaaggtggtaaacatccccaacagtatgacaattttggatgagcttttgcccatctccattgagatggcgaagcgggactgcaggggcatatggaacttcaccaatcctggggttgtcagccacaacgagatcctggagatgtacaagaaatacctcaaccccgacttcaagtggaccaacttcactcttgaggaacaggccaaggttatagttgcaccaagaagtaacaacgaaatggatgcatcgaagttgaagtccgagttccccgagctactgtccatcaaggattctttggttaagtatgtttttgagccaaacaggaaggttcctgctaactgaagatttacgggcgcgggcgggagttatggaggttacgagcgcgggcgggagttatggaggttattgcacggatgcagttgtgaccatacttttttttgtagtttttggttatatctggtgttttgttaagatacatgtaggtgaactacataccgttcgatacttaacctatttatttatatattcatagcaattcgtgtgcacggcatgtgcatattattttttttgctttggtttgtgcggtggttcagaatgtatctcacctctacgttgtactctttgaactacttactctatctaaaaaagggcaattcttacatattaatttgggctcaaaacttttgtgattgattgatgagcagccgacgatctggtagcgtgagagtgaatcctccgttcggcatcagcatcggatgatctggtagcgtgagagtgaatcgtccgatcggcagtagcatcggtcgatccggtagcgtgagtgaatcctccgatcggcggtagcgtgagtgaatcctccgatgctccgatcggcagtagcatcgtctcatttctaaatgtattagtcaccttaaagtggtttctaaatgggattagtcgccttgcaattttgcgctacagtatacaaaattctcgcagcaactaaacattaacttccctacaggccgcaatcgacaaagcatggtcaaatacgacggtagtaggtacaacactgcacgatcacgataccaaattacaaattacatcatatgcttttaccatcgaaaccgtgacaagcgaaccgcaaaaatgcagcaaccacattaggcacgcctgaagtatgcatagtgaaaaatggccaacgcatcaaacaaaagactcgcatgcaacaaaaatgcacaaaccaaattaggcacgcatgagatgcagtttagcatagtgaaaacgcctgacgcatcaaacacaattcaatatacggtatttaactggcaacattgttcttgcaaaggccactgcgaaaacatgttcaccaaaggaagaagtcaagcagatgacagcaatgcttgagggcaaaaaactgcaacgcagaataaacctcaagcctcaattacaacagaaggagcaaattgaaatttccacatctatcacctaggagctttccacattgcaaacccaaaaaaaaaaaaagtaaacctattttgctttatgtaattgaatctgggcaaagaatctaaacgattatttcaattccagttaacctaatgccatctaaatgatgactacaccgtaccatttccaaaatactgaactgatgccattgacattgcctgacaaacatgaccatcgagccagccatcaaaatttgcctcttataaggttatgaaatttgttattcaacacctccaatcaagtaggccaacacttggatgatactcaaataatcaataaactgagaaatccttattgatgagcaacaagatggatggatccttctgttgaaaactgagtgcaacagttgaaaactgaacggcagggcagaaacatgagcataatagatggatcttcccagcacagttacatgatcatgacatacctagttgggatactaaaggagtttgatggctatttttaatgaaaatgaagatccactgcaatgctaacatcacacagaataagaaggcaatggatggagggccaagaaatgaagtccaaagcctacatatgctgttaagacttgaataactatcaaatatcaatagcaaattttaaatcagaatttgcacctcgatgcttcttcaaactgacgatcagctggctagaagatagaataatcatatgacggtgcagattttgcaaggaggaaatcaactttaaaatgaaagtgacccctccagccgctgtcatatgaatcactaacgggtagaagaatattgctaagcccaaaatcaacaatagcagaatgataaataacaaaaaaagcaccagccacctgcaagatgagaataaaagaacctttaaacacatgaaacagaagcaaataaataaaaagaccaataaacagtagtaaatatagataaacagataagagatgatgcatacctcattgaggatggctgagccttataacccttgtacagagaggaacaatgtccaaataaccatgcaacaatgccgttgaagatgatgtatgttaaaggagtcagaagatacgagcacctcatacatcttcagtaacttctgtatgtggagcaactcgagcaggccttcactccgcagaaaaaggaacataagtggcaaccaagtaatattcataacagtgttcaccagcatccacttaactctagttctatgtagacacataaaaccgtacaattcagtaaaccaagacccgacaaacaaaggttttgttgttgccactgaacatggtagcacaaatagcaggaacaagcagataaacatccttcagatttcatgttgaaatatcaacaccgtgaagatctagttggtctgcatcgcatctgcatggtatttctccaagtcagcatcaagttcttcagcagactttggctggctacgctctttgccacggcgaccaccggatccaccaggaccaccactgcctcctccgccaccacggcgcctcccacccccccttggacgaggtctaccctgcggtagtccagctgggccaccccttggtgcactgtaacatttcaaaaacaataaaggtaagttggcaagatcttatatgaactggagaatgatcagaagtgcacacaaaataacaagaacgttttgaaaagcaaaaaaacaaatcaatcgataatgagatatcaacatctctgatacatagatacaattttaggcttttagcaacaagtgcaattataaacaattaacagaaagcatcacaaacaaccaatgtatataatcagtcaccatgtttgacttgaataaaaaattcatgtgcaagaattttctgaagatgatgaaatgaaatgaaaaatcatgcaagtgttattttgtggagcacagatatcaaattatagaaaatactcagtagtattttagcatcagccctcacaatcaaaatacatcacagcagtgatgagcaatcatgcaaaactttagcatacaaacaaataaaggataatgtagcaatccgaacatacctcttagcaacatttctaacgtagcctccgttatttgctggaagagcagctgcagctgtaggagtattggtcccaagaatctctattttcattggcttaccatcaagttgcacattgttatatttcttcactgctgcgacagcatcgccacgccttgcaaatacaacttcagctgttccctggaagggatagacaaaagtcaggctatcacataaaaaacaaaaaaaaaaacaaatgcatgtaaagaagtgtaagattgaatctgtaccttagacctcccacttctgtcatagtgaattacgtatttcttaagatcacctaattcagagaaaagctcctgcatcattaaaaaataaataactcagaaaaatgcttaagggaaaaacatgtcacatgaagatttcaggcaatttctactggctaatgatatctacttaaatgatcacattgacatggaatttgatgaaataggacagtaaaaaaatatcctagaagtagacaataattaattgtcttaaaaaattcaaataacccatgggtcaacatacaaatcactaactagagcatatcactatctttgcacaaattaatcaagaccttttttcagaggaaaaaagatcagatctcgatggaccagaattatttaacatcagatcgaagctagcagtatgaacaaaaccaaaatattgctggaattttacacatgttcatgctagatctggcgaatagcttaagctaatcacatatgcaaccaaatatctgctttcctctagcgctaattgctcagaagcgactaactcaacgcgattattatataccttgatatcctcggtcgagacgccgaagtccaaattggagatgtagagcttggtgccagtctcgatagccgagaccctcccgcctccgccgctgccgccgccgccgcctgccgcgacatccgagtacatgtcgtgctgccacgccgattcaggggcctggatcgcgtcataccacagtgagaaaaccacccgaccatccatccacatccttccccgcctcgccgtcgaaaagcggaagcccagctcctccgccgacggcgcgcagcaaaccctagccccacgttcgatccgttgctgttcgtaccttgggcggctggtagggccccgccctgttccccgacctcttgaagggccgcctcgtcggccccacgccgccgccgccgccaccaccaacacccccacccccgccgccgccgccgccagcggcagatccgcggcggccgcggccggacgaggggttggccttcttgttgttcttgatgatgtcgtcgagcgtcatgtcgagggtctccgccatggcggctgctcgggggcgggtagatctggcgcgctagggttgggcgagcgagcgagctcgacgacgaacgaagaggcggcggattcgggatttggggggtggaggcgagagcggcgttagggttggggaattgggagatttttttcgtcttttcggtggcgggcgcgataaaaataaaggggggagacggacgcgtagggataacgcgtggtgaggcggtcgcgagagagacccacgactccacgagggcgtgatgcggacgggaaggagaggagaggcactgattggattggatattgggatgcctgcagtgccgggtcggggtctggctcggggtcgcctcgttccgttgttccgagtatttctcgctggagtatcttgggttcgacctcgagtgcttatcttcctcatgttctttttttttcgtggcaagtcggcaaagtcggttgactagtactcactctctgtttctcaaaatatgaaggtttttaatattcagactttatatcataatataagcaattcaaaattcaaaaggtaacaaagtgacttaaaagaaatctttttgacgtaaacttagtatttcctagataacccaggaatccttatatatcgtaatggaggagtatttgggacaaccacatgtcgataaaaaaaatattttaaatgatatcatttaaagtactccatccgtttcacaatgtaagtcattctataatttcccacattcatattcacattcatattgatgttaatgaatctagacatatatatctatctagattcattaacatcaatataaatgtgtgaaatgctataatgacttacattgtgaaacggaggaagtaatatacatatataataaaatttcctactgcacaatatagaaaagagctagtaaaaaatgattgtctactagaaagagaaggtacgagagatggaaacattcttttatgtacagagatagaggtagcaagcgcataaggggaagcaattgaaatcaaataaaaaatgtgatgccatatttttagaaaatgtgaactaatatggacaattgtgttaataaaaaaacatttggattatgcatgcaagatagtgagttaagtctcacgcattgatctgttgagtagaaaaatggacaaagtaacaaaataaaactcttatatgtatgtgtccttagtgtttaaaagctggagctagaaaatacctctaaagtttcaatgttcaaaatttagcaacagctgataagcaaacaggaagatacggaagttcttctacagatagatgcgagaaggaagaagaatactagtgtatgatatgtgtgggcagtacaagtttagccaccaacatggcataaaaataggtgaaacttgcccaaacttgaaagtccaggtgggaaatactcagtccggtagcacgtgatgaaaaatgaacatccggcgaagtttcgaaggccgtgaataaacatgtgctctttcttaaccccagttgccactagatggtcataattaatctcagagagaaccttggaggttggggccgtacatagcacaagttcagtcttttgcatgaaacaccttgtgggagaactggagaagacagtggaagatacttttctcaagcagacaccaaaactataatttctcccatgtataaaaggagatccgatcgtttcgatgctagaaagagagagagaaaaaaaaactcccgtctactgctccacatggccgtgtttgggatccaagttggcgtgcatgtgctcccaccaaggcaccagccaggctccaccaagcctgccttattcttggatcgattcactgattcactcattaatctatcttcattgtctgagtgcgtgcgtacagtctgttcatgcacgcgtctgatttttggtagagatagtaaccgccactgaactgccattagcaagagacgcatggagttttggacacagaaaacaacggcagtaaactatacaagttctggttttatatttattctgcgagtttgatttgatcgcaacaatgtttgcttacaactgcaattgtgttgctgttcatgatgataacgattgtatccgagcaaaaatttgtcttttcggtcaaatgccaagacagcttcgatccaaccagcctcacattccatgcaacaaaaccttccaagagtggactcagggcctgtttggttggtgacctgacacacatgcctgatgaaaactcatgcctgaagctagcctgaaagtttaaagacatttgcctgaccaggcagcctgtgagatgagttgtttggtttgaaccatgtgcctgagaagaataatgcaacgtcaaactgtaataattactcttaacagataatattaactcaacaaacatgatcaatcggtgggaagaatgaaaaaagcaagaaaaagaaaaagtatgtaattaatagtgggacccatagctttcacatcaccttaatcttgctagcttctcacttgtctgagtcaggcgttggaatttcgtcgcctgagccaggctaatcaaagcggctagctgtcaggtcaggctaccgcaggaacacccaggacgccaaccaaacaaggtacaggcatgtctcaggcaagcatctcaggtcaggcacaaacacgagggcagcaaccaaacaggccctcacacagtcagcttcagcctggaaaggctggattagtaattaaaaaggataatacgcgtcatgtcgcatcaaaagatgtcgagaaagtaggcaataacaaaggacgtaaagcctatcagtgcctcatcaagttgggtggattggcgccaaacaaagaaaagcactataacaacacagccaaccgatatggaacatgttacacactggccttttggacagactatcaactagagcaaataatggaagagctgatacagctgtaggaggtccaagacaaaaaagaaaaaaggaaaaaagaaaaaaaaaagcagttgaaacaataaagaatatgagaggaagtttgtgtagattacagtttcaatttgacatttcttagtaattgtgatgacagtttcagatgagccccattgaccccggaacataccactagacatagttgtaaacaacgtacaaaaacacaaactcttttacttgacccttttagtatcctgaatgatacggaccatcggacgctcacactttctggcatatataacttctccaagtataatatatctctagaaagaaatcaacctcagcggaagccgccttccgtccaataggagccaccggtggttccgttctgattgctccccttgctgggggtgctgtgattgtaactatcaaaattgtcatccttcccatcatcccagccggcccaggagtcactgctttggcgttctttcgcaggctcatccttcttgactggctcatcccaatcatcccaggaattggaattgtaattctttgatgaaccatcatgagaagaagaattccacccattaccattggtctcacgctcaaacctatggtaaggctcactgccctgctccctgcgttgccaatcatccccccagccattcccaccttccttggcatactcctcaaccttttgtgacgctaacgccattacccctttcataattccccatgttctacttccaatctctgcggttttattggcaacaacatttacagtttcattcaccttctgatcatagcccccttccctcatctgcattccagacaagcacaaatcattaactgtgtaagacaaggacaaagctctccggcaaataatcttaaacacaacatgttttatttagttcaatatagtccatagtaacattgattcttgaggagtaaacgatgatcacgagatttcaataattaagtccttgataggaaaatgaggtgggaaatataagcaaaaatgtactcacttaataatgctggtagaagaatatggctcaagatacagtataaatgatattaagagattaggcttgatgtaagacaatatcaaggagacacgccagtaaagatctattcatctatattccagtattctgatgagtgcaggttaatatatcattacaatcagattgaaccatgcaactaggtaagcacagtaaactcagagaaatccatgttctataaaaaaactatactctggaaattcaacttgggatattacaaaatcagctgacaaacaaaaggtacctttgattggaactcttttgtgccaacttggacaacactggcagcagactgggcagcagatgctgcaactagtgaaagccgtccaattccctggagatgaaatggtataggagttaaactgatggacagatgaaaataaaaggtgtaatactggcacaactgcgtctaactagatacacacatcaccctaatactgaataataataatatcaagaactgtttaaccaacacacagatttaacctggactcaacaaagataatgatatatgctattttgtgggcatattaggaagagtattacaaataaaacggcttaagcatgcttaactattctatatattgtccatttggcacagcgaactctattacaacagtgtcttcaaaagctacattttagtcgctgcaggaaacagggcatatcaaattttcaaggtgatgctaagacctattggcaaagaatgtatagcttgacaaaggccacccaagatacaaaagtaagcttaaaaaaagagcagtgtaattatatctaagagagaacctcagttcacaatttcatagcataaaattaacataagtaaaagatgatatatcattggcaacagaaatgacttcagggaagaaagcagcaagtgatgttcatgtaacaattgctgcaatagtgcaatactgccattcaacctcaacctagtaataccatgagcatctatagcgttttatcacttgtagatctaaagaaaccagatttacgatacaacagtatatccctttgcagatagatgatctaaatcccttaactacgaaaaatacgttacaaactgggtaagcacaaatttgtatttactcctttgaagaaagatgatctaaatccctaaacttccacgttataaattgggcatgcgcaaaactgtttattgcaacagttagctaaacatatatagaagtatagaacaagtaataccgacgtagcaagaatttttacctgggagacgacctgcatgacatcaccctgagcagcagcgccgttccgattcgccgacggcgccgggctggagccgaacccgacgtatttcccaccctgcgagggcgggatcccctcgggcttcgactcgttctccgccatcctcctggcgaagaagctgtccttgttggccgccgacgcctccagctgctgcctcgtgtacatgtcctgcgtcgatttggacctcggcggctgcctccctgattccgcccccgactcaccgaacgaccccaccgactggttcctcctcatgtcgggccggaaatcgtcgtcccagtcatcccatccgccgccgccgccgccgccgcctccggcgggcaagggtggcttcctggtgggggcgggcgcgccagatccgggggtctccttcacgacgggcgggtcggtccacgggcggccctcggcgacggcgacgatgcggtcgcggtacgcggcggcggcgttggagttgtacttggcgacgtggggggtctccttgggcacgccccgcgcggcgaggaaggcgttgaggcggtcgttgccgccggcctccatcttgcggagctgcgcctcggtccacgagtccatggtgacggagcggacgaagctgatgtgcacgccgagcccccggtgcttgcccgagcactcgaggcacatgaacaccccgtacgagacgctcgcccactgcgggttccgctgcgcgcagtccacgcacgtcttgttccccgcctgcccctgcagctcccgtagccgcctcgccgccgtcgacgccatcgccgccggatcggatctcggatccgggaggagaggaggtgggtggtggtggtggtggtgatggtggccgcgggacgcaaggcgaggggaaagggggaaagagtcgccgacacgagacggggggattggtcaaatacgggctgcgtggacgcttttgccccccgtcactgcccccgggcggtggcgaggcagtcccggtaataacgctcgctcgagcaggggtaggtttgggagttcggtaagccgtggccgaaccggagaaggggtatcctctcccgtgtcgccgataccccgggcccagcgcgcaggtggtagaggaggctgctacacatggaacgtacgatatttagcaaaaaaatcggacgttgttcacccacatatctgactatatataaaaaaaactatagtagttaagcagctacgctgcaagcctataccctactctcatgcatgtatacatgtaatctctctctttattttctgtaccctttaaactttttcgttctaaattacttatccgattttaccattgtgttctttacaattaaatttttacaacaaaatcttacttggctatatttctgataaaatttataaatatgattatattactaactgaaacatttatatattaatagaaaaaatacacgtgcgttgcaatgggagaaggctattttaatcgtattattgttagattttttttatttaaaaggtatatgggatttttattttggagtatagatatctaattcagaatccttattaggatgatggttagttggttacatcctgtacatgctttattatggtctggtgagaattttgaaacaattaggagtccgactctcgtcccaagttagcatgcgagatttttaaaagaatttcttatacgactacttatgtatttccaaaaaacgaacaaacttaaaaactaactcaaataaggacgacgtatcaaagtatcagcggaaacatcttcaatttttataatagtagagatacgtgaaacaagaagttataattattaaaacattagaaaatattcactgcaacatcccaatcaacacgtgcaacatttataaatgaattaccgaaacatccaataataccacatgcaacattcacaaataaactagtgaaacgtcagaaaaatatttattgaaacatcgaaataatgccatgcaacattttatatgtgttttagaaaaatcaaccttttgttgcaccataaaattgttttatcacttgtacggataactcagcccactctaaaaaaatatttctgagagatgtaacttataaaaattactaaatgcaacaataaccaccgtcacatgaaacattaggtcccaactaatgaaacataaaaaaaagattcaatatatttgcaaatattgatttgttaaaattttatatcattcttgaaacgttaacctgcaatttttgaagcataaaaaaatatttgctgaaacatataaatagatcatgtgcaacaataactatataaaaattattggctacaataataaccaccattacatgaaacattaggtcctacatttgaaaacataaaaatatatataatgcaacatatttgcaaatactttattttgttaaaattttatatcactcttgaagcgtcaagttgtattttttgaaacacaaaatatatttattaaagcatataaaaagaccacatgcaacattacatctgaattagtgaaacatgagtaaatacttattgaaacattggaataacattatgtgataaaaatcatcggaatattgtcatgtgagatcttgttataaagagttaattgtaacaaatccaatagtataattagttcataattccgataaatagtttaagagaaaagatcatttaaattttaaatccatgtgacttgcatgtacttgtcatttaaattggatgcatacacttgtcatgcacctgcactactactactccattggttgcatgcatttttcctccttcctcggaagtatgatgataagcattttcgggagagttccagagtttgctggtggtggtgggggaaaacgtacgaaacaatcggggatgaatgaatgggtgattgattcggttggcgcgtcgtagcgagcgagcgcgagaggcgcgggtggccaccggacgcggcgttgtttcggggcgacgcacaggtgggtgggtggatggcctccgagcaccgcgcggcccgcaaaacactcccatccaacgggggcggacgctcctcttcctcatcttctctcgcacatcacaaagaggctgagacgtctcaccatttacgagttcctttttttcgtgaaccaaatcacacctcgcctgcagtgtctcgtgtcccagaacgcgattgcgttttttttttgcacgtttggtttccatatccctcgtctcttgtactcccttacccacatttggcctagccggaggcggtagccagggcccagggctgcttcttatggccgcgcaggagatggaggttatgatggttgcgatggcggcggaggcgccggtggctgtggaggtggaggcggttccggcggtggcgggggggctaaacgcgacggtgcccgcgttgtacgtgggcgatctccacgaaagcgtgcgggaggagcacctgctcgaggtgttcggcaagattggcaccctcacgtccgtgcgcgtctgccgcgacaatgccacgagcaactccctcagatatggatacgtgaattacctctcccaggctgacggtatacaaaaaacctgtgcatgatctgtgtcttattaatttatctcatgtgctattagcattattttgatcgggttaagtgcataattgagttttgcatagaggtggtctcagtactcgtgcaaatcaaaacacttggtatatttacaaatctgcatgacattttgtatgaacaatgtgtcactgaacaagttaaataacccagatcatcgcacttattttattgacagtgtgggggttgatgcatgcatgctatcatattaaccgttatactattatccatagaagtagttggatgtattttaggatgtatagcttgtgttccgctagctgctgccacatgatagaattcttagttttaagaatgtgtgcgggcatcgcttgttcctttctttcaactaaaaaggtgcgaaaatctgatcatatgcccttcgcctagattaaaagtatttacccttttggcccacatgcaagccaatctcccaaaacaatgtgttgttcactaattatgttaaacaaagaagttacagaggaattgaagttgatgtggtcatgtcaaataaggtttagtacaatgtatcctgtatcaacatgatgaggtcgattatattgtttaacatatatcttcttgttacatttgtcactttgatttttaagagttgtatttgtaatgagatgtataatgatttatcttattcttgaaaaataactctttatttttttaatctacttttattagtttgtatgcaagtcattaaattgaccatcgctatcttgttgtgactttttattttgtaacatttgcttatattttgtattattgatttattttgtattgaaatcctagaagcaacttatccaaccatgtgtgcctttcaattcatgccatgttttatactaatgatttagcacttactttaatgttcttgttatctaaccaacttttcttgctaatggatattgataaaattctcattactttttaaacatttgatagctgcaattgctttggagaaactaaatcatagtcttattttggataagccgatcagagtaatgtggtctaaccgagatccagatgctaggagaagtggggttggaaatgtgtttgttaaggtaaaaaaacaaattcctcactatatactttcttggtgtatattgccatatttaactgctactttactatggcattttgcagaatcttaatgatttagttgacaatgtaagtctacaagaattattttgcaagtttggagatatattatcttgtaaagtcgctaaaaatgaggatgggacaagtagaggctatggatttgttcaatttgcgttgcaagaatcagcagatgcatcaattcaaaatcttaacaactctcatttttgtggcaggcaattgtatgtttacttctttattattactcgtctttgttatttgtttattctttgtccggtcatagtttggtttacaattatgatcatatttatgcaggcatgttgctacatttattaagaagagtgaacgatctacaaacaatgatgacaaatatactaacctatacatgaagaaccttgatgatgatataacagaggaacttattaagttaaagttctctcagtatggtttagtaattagtgtaaagataatgaaaagagatgatgggacatctaagggctttgggtttgtaagttttcaaaacccagaaagtgccaaaagagcaaaagaatccatgaacgggatgctacttggtaatagtccacttatgatattaaaataattaaatagtgaaaattcattaagtagtgaaaccttattattctattcaatttgatatacaattgtttgtgaattgttttattaggatcaaaaaccttgtatgtagcaagagctcaaaagaaagctgaaaggaaacaatatttgcaacgcttacacgaggagaagagaaatgaaataatcaccaagagcaatgtaagttccatttgccctctacaatctgtttttttcatctaaaaatgcatctctctttttttaggggtcgaatgtctatataaaaaatattaatgatgaagttggcgacgatgctctccgtgaa

SEQ ID NO: 80030 - DNA, 1145 bp, Oryza sativa
ctgttttttttcttagtactccctccgtcctatattttaatattttgcttgcactatttaactattcatcttattttaaaaattttgaaattattatttttttacttactttattatccaaagtaatttaagcataactttttgttttttatatttacataatttttttaataagatgaatagtcaaaagtgtaagtaaaatgtcaaaatcccttatgttgtatacagagggagtaatagtcagtgttgactgctagtagtgttttaactttgatcattattatcaacatgtaattgatttacaatacttcctccgtttcacaatataagtgattctagcatttctcacattcatattaatgttaatctagattcattgacatcaatatgaatgtgagaaatgttataatgatttatattgtgaaacggagagagtagaatagatgaatatgatgtttgcatttttaccatacgacacattttaaaatacggcatatatttttataaacttattgctaaaaataaatagtcagcagaaaaaaaataaaacgtattgtctaataaagtattgtgaaacgaacagattaatagcatcttaatttacctttcactgcatctaatatgtcactttgaatgttgctactccgagctagctaggttcattatgctttgcactaaagcagcaaagcatgcaatgttagttctggctgcctatatatacgaggccatctgacgagcagaacacaagtgcaaacgtgcagcagcagaggcagcaacacctcccctgttcttgctctgtttcctcactctgttggtacacaacaaaaagaagaagcttaattaggtggtttttgatctgatcacgcgccatggtggcgatcacggcgccgagctccatcgagcacatcccgctggtgaggtgccccaagggcgccaatgccgggccgcaagctgtcatcccgtgcatcgacctgtcggcaccgggcgcggcggcggcggtggccgacgcgtgccgcaccctgggttcttcaaggcgaccaaccacggcgtccccgcggggctcgccgacgcgttggagtcgagcgccatggcgttcttcgcgctcccgcaccaggagaagctcgacatgtccggccccgcccggg

SEQ ID NO: 80031 - DNA, 8741 bp, Oryza sativa
aggtgcgtgctgcggcggatggtggtggggtgcgagggcagcgacgagatgctgcgggtgaaccactacccgccgtgcctcctcccgccgggccgcgaccgggacgagtgcggcgtgacgggcttcggggagcacacggacccacagatcatctccgtgctcaggtccaactgcaccgcgggcctccagatcctcctccgcggagactactcctcccctgcccgctgggtccccgtgccccccgaccccgattccttcttcgtcaacgtcggcgactccctccaagtacgtactacgctacccgagaatagagttcttaaaatctacaatagatctggtttaaataagaatcgaggctaaaaaaattttcggtttaaaaagcccaagatacttttcgatatttagttccatatttctttaccagtttacaacccgaaactataggggttacgaactgggagaagaggtatttttcagtagtattagggcttattcactttgctactatttttaaccttaccaagttttggtattaccaaattttgataagtttaccaaaattttgggaaggttaccaaattttagcaaaatttcatatgtacttattaaaatttggtaacaagctaaatgtagctatttttttataactttgtaaaaaaaagtaaggttgaaaatagtagcaaagtgaacaaacccttagttgaaattattattgctctatgccttgtttttactatcatttttattattaacgtatgtgtgtacgtgtaggtgttgacgaatgggaggttcaggagcgtgaagcacagggtgttggcgccggagggggaggagtcgaggctgtcggtgatctacttcggcgggccagcggcgtcgcagcggatcgcgccgctggagcaggtgatgcgggagggggagcagagcctgtacagggagttcacctggggggagtacaagaaggccgcctacaagacgcgcctcggcgacaaccgcctcggcccctacgagctgcagcacgccgctgccaacgatgaggccgcgacgaagaaataaatcgatcaacccgacgactgtgaacaactgtgaagtgttactgtactagtgtagttagctccgtggtactggtagctgtgaatatgatcgagatcgatcgatcgatcgatctatccttgtgttgtgttacttttaacccatttctggtaactaaaggccgccgttgccttggcttgcttggccagcccaaaactggcactggcgagctgcctcctcctgcatgcctctgctgtgcagtagtgcagcagtactcctctgtcctggggttttctgcagcagagcagtggagtgcagttcagtgcagcgttgtgcatgttgtgtaaaatagcttgccgcatgcatatgtgattatgtgctgctcctgtcgacgctgccgccccttttgtagcatggtttttaccggctgggcggtcggcaggtgcagtagtagctaatgatgcttactgcgccatacgagtgtacctatatgtgtgctatatgtgtgctacctccgttccaaaataagtgcagtcgtggatatctgtgcccaacgtttgaccgttcgtcttatttaaaaaatttataaaaaatttaaaaatatttagtcacacatataggtactatttatattttatcatctaatagcaataaaaatactaatcataaaaaaaattcaaataagacgaacggtcaaacgttgaacgtgaatagtgcaaaactgtacttattttgggacggagggagtataaacaacttaaacaagaatgtgtagtactccctccgtcccacaatataagggattttgaatttttgcttataacgtttgaccactcgttttatttaatttttttttgcaaatataaaaaacaaaaagttgtgattaaagtactgtagataataaagcaagtctcaaataaaataaataataattttaaaattttttgaataagacgagtggtcaaacctcgtaagaaaaacttaaaatctcttatattatgggacggagggagtaactgtattatatatggcttttacctatactttcgaaatgtgcacgtcgatcggttggtaatctttatgttattggatctcgtcttctgaatgaggtcactctgcgttcgcaaaaatgaatgaggtcactctgtcgtcgatgaattcaagtaatcttccgtgtatggattcacggatccggcgaatccgggccatccgagcatctctcgatgtgatttgggatcgatgggaatcaccactggcggcaggtaggggcccgtgcctccctctctcactcgtgttcttgatcttttcctaggacaaactttgcctgaacgaacggaccagaaaaaacggaactgatgaatgagagcctgacttcgattgatcgggtaggtcgggacttgtgccattagctagcatactactgtagttgctaataaggcttatttggtttgaagcccaatttatatcatatcaaaatgtcggtagtgttaaaaaagctagagaagtattgatactatcaaatttattagagtacaatttataaatttgatatcaaatcaaacatccataaaatatattagtaatgaagttatcaaagatttggttaggcatagattggcctcaatcaaacaagcccatagatctctctgtagcttgtatcatgagagacagggaagactagttaattggagtactccctatgtcctataatataagaaattttgagtttttacttgcatcatttgaccactcgtcttattaaaaaaaattgaaattattacttatttttttatgacttactttattatccaaagtattttaagcacaactttttattttttatatttgcacaaatttttttaataagacgagtggtcaaacagtataagcaaaaaatcaaaatctcttatattatgggacggagggagtagatacgtaccagctaattataagtaggtagtcagcatagctgcatagactatggacgaccgatcgaccaccgtcatttgacctggacgacacgagagccagtaatcacgggccaggttacgttgctttcgagtttcaacgacataccggataaggccgtgtgtgctcgaatctattctccaagtggcaacagaatattactgcatgcaagccatagcgccatagcaacaagtggagtttgtaccatgctagcgatgcgttttgtacgtcgtgcatgcatcgccccgcggcccttttgtttcccatgaattaatccatcagttcgcaagctggtactggcgactcgtacaactcacctgtacacgtacggctgtaatgagattattttgcctcttttgagataggttactgcgtgttccattgggagtccgtgttccattcgaatctctatcccttccggtctactctctctccctcttgtcccaaatactatatgagtattcaaattgttccttatcttacaccaagcattaattctcccattttcgatcaactcacacttaatgacacgctataaatctataattttttcgtgaaccttaattctcctaaatgacgtacaaatgcttatagataaaaacagagggagtaagatttatgtcgtggcatcatcctagaggtggtaattaccaagcgagcatcgatcctaaggtctgattttagataggtgtggacggcggtcaagcatagcgtgttgtgctggatggcttcgcgacactaggccgcgtcggccaacgggaagttcgacggtttgcggaagacggttgtagtgcggcatagcagcatcacgacgcattagaggcatgcagaatgcgacggccgacggcgacgcaaggggattcgaaaagttacagcgaacaacatacacgaaagtttagcaccagatggtggttgcgatccgcagaggtgaagatggtgcagcggcggatagcacatactagttccgattatccccttccgcgctctcgtgctgtgacgaaaagataagtcactaatgaagttggaagctactcccttccctccgtcccaaaaaaaacttaattcataggtttccgtgtctaacgtttgaccgttcgtcttatttaaaaaattatgaaaaaaaattaaaaagataagacggacggtcaaacaataatgttttatcatctaacaataataaaaatactaataataaaaaaatttcatataagacggacggtcaaacgttggacacgaaaaccgaagaattcggtctttttgggacagagggagcaagtcactaatgtaggaggtttagagtttaaaaactgtgcattgtgtttttttataccctgtgtagatatagagattaataaaaattccaaagaaaaacatggcgtggccatccagttgcatgcgccgtggcaaaatcggtctcatcacatggtagagtacagcctcccgcacgcggtaccgggacacgcctccgtcgcggcccgggcttgccctggtgcacacgggacgcccggcgcccgcgcgtaagtgggtcgggggtgagaattgtattcgcccacagagtgcgatctgcggatctcctgtcaccgcgcggcccggagtgcgcacgggaaagatagcctgcaggctgcaggttagtgtgtacgccgcaccgcgcgcgcgcggggccttcgcgcgtcgcgtcgcgtcggtcgctgcgggggcacgggggttaggcgcgcgtacgcccataccagatatagcatctcgtcttgtcccgcccgtggatgggcaatcctattgccggttgatttttttactcctctttttcttccgctcttggttaatttgctgcaatttcggaggcgattttgggagctcgatcgatcgatcggatcgacgtgcacatgcatgcatgcgttggtataagctaggtagatcgaggaggacatgtatggcttgaatttgaatgcactgtcacgtcgtatcgtatcccgggaggggagggcagggcaggcaatgctatgcatcagagtatcaagctgcgccagaaacaagctcaagcaatgcaagtggggtgtactctggagtctggactgcgacaagagccagatcgaacttttcggtgatcacgaccaacgccagaacttgcggcctctacaatcatttcgaccccgtttagtcgtcgtcggtagagatttctttccggacctcctgccctaatttctcccactgatcgaccagatctcgtatactcccagtgatcaatgagcttagggcctgtttgttttccagggacttattccaagttcatgtcacatcggatgtttggatattaatttggagtattaaacatacactaattacaaaacacattccatatccttggactaattcacgagacgaattttttgagtctaattatgtcatgattttgacaatgtgatgctacagtaaactttttataattatagattaattaggcttaaaaaattcgtctcgcggattagctctcatttatgaaattagtttttttattagtctatgtttaatactccaaattaacgtccaaacatccaatgtgacatgggctaaaaagttttagccccatctaaacacccccttagtgcatggcgcaacttgtggattgctagtcaaatgcacccagcatgcatgggagcgtaaaaggtgcatggttactagaggtggagtactaggtagtagtggcagcgagtcacatgggaataataccgtttccttggattagggacgtcattactgaagatggagcaggcagtcccccacctgaagattcactttgtccagcaaaaggcacgaatcaggggggccgctatccaaaccgtacaggattccaaacagtccaggccatgcatgcacctcctttttcctagtagaaacataggagtaattctcaatttccctgccaatttcttacttaaaaaaatctatagttggacagtgtttcagaaatggagcagaaaactggaatcggcatagattctaccgacggaacaacatccgtaattatttcgttggattttttttgttacataacgtgagttatatttagtttctactacacatgttcgatgaccacaaaacggctcaatttggatgaattttcagatcaatgacctttccatccaacattattactcccgtcattctataatataagagattttgaagagatgtgatactttctaggactgtcaatctggatagtctcatgtccagattgatagtcacagatgtcacgtccctctaaaataacaaaagcgagcaggcgagcacgcacatgcatgcgctggggttgtatataccgtttacaccagcttagcaggatatagagtgtacagatcactgagcagcgagcatcagtgaccacagaagagaagatggcagtggcacacagagcgtatcgctttctaacacatttctccgacagaaaaacagttgtaactgaaagacgagcactgttcactgttcagtattattcacctcaccaattaaaaaccatacgaaatcaatcatgcatgcattcgcatcgttcagctcgtccgtgataaagctctagagatttgccgtgcagacaatgaccgctggcgccgacgcgtaccatggttagtttattgtcaaaaactgccgcgaaaccatggttaatttgctcaagaaaactgccgtgaaaaatggctcagaaccaatagacgtactaggcggagagaatctcaggtgcttattagtgccgtgctaccgtgttgtactaaacttaaaaggtgcataaaaacgtaatgaaaaatattaaaagatttttttcacatttcttttgactttgtttttacactttttaagtctagcaacactatagcacaacactattcggtagctcctaaaattctctcgtaatataagtaattagtactacatcgagtataggttggagagacgtctatgctatgtatggtgtggtgtgagcagggttttacgaggaggagcttatcgcacctcggtgtaagtcccataaccgtccaattatatcgacgaacagtaaaagccgaaagaataatataaacatttatatttttgttaaattccttttgaattaggtgggtttatcatgataaaaccggttaccgcattaagggaaacccttgggtgcgagagggcgaggctggcaccacctcgtcttgtctgcctttggggagctgccatgaaccaatgcgagcaagccgctgtgtacctgctcctgctgcagctgcagctagcgcgcgattcgatcgatccccggccggatcggatgctctccggttttgtccccaggggaacaatgccagagaatctctgccgttcgtgccaggtgtaagtggcagctagctgggatctcatctcgtctcctctcctctcctctcctctcctctcccgctctagctagctttcgcgaatccgattggacttgtcaatgaaggaggcacatctagcaagacttttcttgccccccgatttcaattcgattcatttcatctcgtgctagcaggtgttggcgtacgttggtttcagatgagagatcgatgcagcttgctagctagcgtttcttttccctcgtggggtgtatgcatgacatatcagcatctcccatcgatcccattcagtcagctacatatcttagcgccagccggggcctccgagagtgaaggtgcgggtgcatctctcttctatatatctctctgtaacacatggattttgtttacacctaaatttaacacctatgaacgaaatataagaaaattatcaaagtttagaaagtgttgggtttccttcacagagctgcgattgtatttgttgacttatatcacaaaaagttaccaacagttttatacacggtcccgagcgagcgatagctagctagtagctatactggttgaggtcctagcttgctgcatgaggtgcaggaccgatatatgccagagacaacgaagggtgaccaacgtctactacaacattctacaggacacatgttaatcgtgaggaaggatgtgtgcgtgtatgtgttgtcagaataaagcagtgctagctatatactactagcacatatgcagttgtccaaaattcgttggaaaaagaatataaacagtacagccctatgatctggagagttagctagctagccagccagctctctggaacatcatccttagccggaccacaacaaaaaatttctcaagtgatggagctgattgggcaggatcgcatgaaacccgtgtaacacgtacacacagcgcagcagtactgcaacataacttgcagcaaaaagcagagatcgatcctggtagggtacaagcagttgtttgcaatttttttcgaacgcgcaaaataattacacgtcaatatattagaataaaaaaaatatctttttttctatgccaaagaaaaggaagaaaagaaacaaaaactgcagctagacaaaaaggaaagagaaactactgaggataaaagggttgaggcccagttgtttggttgacgcagcccgccagaaactggaatggccttgtagcccgcgggcccacgcggcctggctggccgagccggcctctgtccaaacgcacggtctcgtgtgcatctctcgcgcgattcgccggcccgcgcgtatagcaaccttccacccaccaaccaggccaccgttttcttcggcccctcccggctcccgtgtcgtgccgggcgcggacggcagcaacacggcacattaccatcac

SEQ ID NO: 80032 - DNA, 3687 bp, Oryza sativa
tcggtctacttcatgtcttcatcatgttggtttttagtgtttttgcaacagtgctctatttcaattagtttcaaacttccatagtttttttttcaacaacattagtctctactattgtaagcaaaagcttttatgcttaattgtaagtttagtattattagattatcatactcactagatgttgttatgtgacatgtcactatgaactaagttgttcattggactttgtagcattttgttacgaagagtttaacatgctatccttttgaatttacgcagcgatttagccatgctaagtatattccaaatgacatcatggccaatggattggctattcatcatggtgactctatttcatcgatgaatgacgcttttaacaacctgctagctactgctccacccgaggaacagaagaacatgcttgggaatagactatatccgttggttgagagacatcatgtaaaatattttgcgcatatgttacattgacataccttttcacttatatttggaatattaaagggacatacttttatattaatatgacacgccttgttttttgcagcctgaccttgccagtaaaatcactggaatgttacttgagctaggtaattctgaagtggtcatgctactttactcatcaaacatgttgtctgccaaaatagaggagtgtgtcaaactgctccaagaggtaaaacccaaacctgaagatcaagaggccctgcaccctggtttcctcctagactctgctggtgtaaacgccaactaagaattcaatgccaatccaagcttttgaccgtgctaaatatattatgtatttgtgttttagagatgctaattagatagatgctctttatttcatagtttatggaactatattattgggcttgttatagaacttactaataatgcctaggatttaggtagaaatctcgggagtttttcttaaacggagcttgttacgaatcttagataataaattatatatgatggtgttcttgtgttatatatattttatttggtttagtgggttggttcttaatttttatggatgattcgaaagtgtttggaagttatgctgcctataactatcttaatcaggttgatcgaaaagttagagaccaaatactcattgtatttatttatttccttttcttttcttatcaagacattgtacagcttaggtaaaatacaatagaaatagtgttttacttggttacatgttggtagccgattggcttacgtagagatagtggtgaatgtgtttgacgaattgaagtgtattgtatactacatgtgtcttccacagacaattgagtctttgcacaaatgcaccatgtaatgcatggatgttgcaagcttgcattatatgatagctcattgtggatggcttgttttggcccaattataaagttgcacggttactttatcccttccaaaaactatggtgtatactatattttggttggtaaaaacataatgaacataaaaaactattaaaaacagaggtggttttcttttgatgatgaaatgaaatgctttccaagaaagaaatacatgttaactgtagcattcagttgacaatattccattcatgttctatagtttgtttcatttctaactccattgagttacttgctattagcttctcgagcgtcgccatccatcggaaactgattggacttgctttttttttgtctcaaacttgtggaagccagaaagaatttgcattgttgttggtagtacatcaaagttggttggataactctttttttaaaaacttaatggtttttagttgattccctattaaagttaacattttttggaaagaattccaatgtctttagaactcatattctaatctcagaataagacatgatttgtgttgtattgagttttgtaatgcaaacaatgatgtcggagggtgaactcctcaagcgggggattatgagaccccccccctttagtttggttgggggcagcgggtgagaatcgaggatacggtggaagatgtgatgtagaaggggtcgggccctgttacgccctgaaattcatgaaccagaatttctaagctgaatgtgcattaaacccctatccaggaccagccagggtacacaaacgacaattgttgacatacagatccacgtcttacaaaaatacaaaagattataaatgcagcggaaaaggataaaagcgagctaagcctgaagacttgacacctgcagcgaggcgactccattccaaagacatccttgacggcagcgacgaaaccaacttcatcgagacatctccaactgagaagaacttcaactctagggtgggggaaaagagagcaagactgagtactacccactgtactcagcaagtcataccggaagaggaggtatgatgcaggaaatatccaagggaggctaaaggtccttttgcataaagctagcatttaaaagcaacagctgaaagcagtaaaacagctgtagtaattaatcaatattaaccatcactgtcaacgctacaccatgttgagtcaggcccaaaccaccacctgaactaaccagttcattagctaactagggtgagactaatcacggtgaatctggtcgactgcccataaccgtgggcacggctattcgaatagttttactctgattagaggtgtacaactgtacccacaagacacagccccacgacacgttaccatgtgccgacatgccaccacgacataccggaaagaggccgtgacaggacccttcgcataaccccctctaaccgatcgcaccacaccttagggttcggccccgtccccaacaggcaacgggcagcccccctttcgtgccgcggtgaatccggaagccgatcaactggacaccccggccgacccaactccatcacgcccaccctcgcctgggtacgtcggctagaggaaagctacactacaagcccagccgttgcccacgctggcttgtggtaagtacgataaattcttctagggcctctcgcgaaccggtccttaatcgccatgggcacgactagcaaaaccatgcacccacagcccaccatgtagtgtattttaattaactaacacccttgcggtagcactaatccaaagctattgccaataatcaaagtctatgcattaatgtgattcccccattgtgtactagttgaactaagtatggctaagcattccgtaaaccaacatctaagcatcttaatacccaagttatcaatggcataaggtaaacaagatatggctgagtagtaggacccatcccacatgatattgtaaaacaatgcaatatttaatagaaatgcgggacatttgtaaattgggtacaatttgatcaatcgtaatgcatgacttgccttgctctcgcactaatgagaccacagcaacgtcttcgagaaaccgcagatcgacgaaacgaccgaaatctatgcgacaaacaaagcacacaagcaaacaggctataagactactgaaacaggaaaaaaaaaaccatttttaatggattctacgcatttttatgaatttactgagacttgaatggacttaatcggagctcggatgaattagatatgaattttagaagattatctatgtttattactataaaagaaaagccttaatgagttttattacgcaataaaggatcccggatgacgtcagcaaaagggggggggggtggc

SEQ ID NO: 80033 - DNA, 634 bp, Oryza sativa
caggacgcgtcgttttctttgcacaatttttcgtcgccccgggacccgggtgatcctatcacctcgcatgcctcgcttggatcggcaacaacgcgtgcgggatgtgccatttgagtcccagtttttatccttgatgatgaggatgatgattcagctagcgtagcgttgttaacttttccgtcctttgcagagctgtgaggctgcctgaattcagccagaagaaacgaaggccatgattgagctacgtgcctaacatatcctaggttagtgcatatcatctctttaaaagttcaatccaatattttttatttgcggggaagttaaatgacaaaaaggccgtgctttatgggattacgagcgagaggcgattctccagtaaattccgcatccgctggtcttccggaactgggctaactgtgaaccgccctcccattagagcaagtttaatagtatagccaattactagctccaaatcatctataaccaatgtaatagctaattcatacaatagttgcttactactcctttcgtttcacaatgtaagtcattttagcatttttcatattaatattgatgttaatgaatctagacacacataacatctatataaatgtgggcaatactagcatgactt

SEQ ID NO: 80034 - DNA, 24382 bp, Oryza sativa
ctctttatacgtcaacacttgcaaacattttcatcttgatgttgaaggtgatttgcatcttttaatcatcccaacctctccttcagggttctactggcattcagttattatcattattttctggttacatgaaagacgacgtgtcatcagctgttgagactcagcttgcagaatcttgtcgcctcgagagtggtacacattttagatgatgcaaacacccctgagaaatcaagaagcattgcaggcagctgattgcgatgcaaaggttaaacaattggccggccataagccctccctaagagcaaggctagcaaagctttttgacggcggtaacatatgtccatgtcatctagagttgatgattgtagattgcttatacaaaggacaaactataagttggctttatataagcgtgaattggacttaattattatatgcacagatgaacaaaaccaagctctatatctatggtccaccgtgcttgagctgttgagcataaaactaacactgaaccggaggcccacaaaccatataaaatgtttaatatggcctaaattatcgtgctaccacccggcgcttcagcaagcactcgctctcttcgttttcatgttttctccctcctccacgtaatacaacgatgatgtggatgttgttatcaccgactgaagaagtgctattatacctgctctaacggtgtttggttcatcggtcatttttgtctatttacttaatcattatcttgagcttgaactgatcctgacatgttaaacaaaaccaatgagggatcgagcaatggtcaaccagattcagagttccagaccagcatcgtcctacctgacactcgttgccacgtggcagggagagggagagacaagagcctaatccaaaaaacatctctttttttcctctctcactgctgcaacgatcctgccacagccggtgcagcaagacgccagcaactgatcagtaaaatactaacagacagtaacgcagtttgcagtagtgcaaatctctctcagaaaaaaaaatactgatgtgattatcattattagaggttgtagtagtaataaagtgctagtactaatcagctactaatcatatctgcatgtaaaaagaagtcaaggcgaaacggccatgagaggccggagctgaacttatttaatttttgtgagaagtggcaggccctcctattaattgtggccaatcgatccgcccagttttcccgtgtgctcctctgaaatttctcggcatgcttgtgatctcttcccatctcatgtgtttgatttggcaaagcttggaggttataattagcagcagcctgagttaaaacggcagcatctgagaggagaggagagggaggccaagcaaacgacgcaattaagcgctctgcttacgccacacacgtagcagcagaggagtatttagcagccattgctatgccttctctgccgtagcgtcgacattgctcttgcgatctagtgcctgcctgtgcctgcatcctcccattgtaagaacttttgccggtttatgttctactttgtttgggccatctgcattgcaagagaattcagtagaaagacacgagcttggttgttcttgttcgtgtcaaacctgtgagcttgatagctgcttctgtttctttctgtgatttctggatcttgtggtgtattctgggattttaaagatgggcaggtcttagtttattggattgattgtgatgaattgtgtgtctctgaaaaataatacaaattcatccagaagagcttgactctgttctggttcttcttttaacttttgagcaatgggtcttctctgtttcttgtctactctaaactactattgattctttttcctcttaactgcaactgaacgttgtgaacttgtgatctttactgtaattctctaggtgttgaaacctgcaggcttctggtgctgagagcataatcatagataatgtggaactgctctgcaccatcgtctctgctcataccgttcactgacgatacggtaatttcccaactgccatgacattttattttcttctctgtcgaatttatttaacaggtttcttcagttgcagtgaaatgcgaagcgtctaattcaccttccacaactgtaggctttgacagaatgtaagtgttggattcggtagtgagggccttcaaatgatctttcaattcaatatctttttttagataatggaaatggtatacgatctttcaattcgcatgaaaccactgaaaatttcttcgtctctttggtcaggatcgccgcggactatgacctgttccatcacatgagcttctcgccgtcgcttcagaatcttcagtcaccaacgtttttcaccacgagaagttcagagagctacttgggtaactccactctttcgaaatgctttctgcgtggatggtgagattgttttactttgatactatttttctgatgaactgataacaacaggagagagctcgatctatggcggaggcgccaggcctgcactcgcgcagttcagctattcccagccaattgctgctacttctgctgctgtatgtaataatcctcttcgcctacctgaaaccttgtgataatatcatcaagccagtgaagtttgtgttattaatttttacgtggtttgggaaatgcttgtttatgtcgtcagcatttggtgagatggacggcggccggggagccgatgaccggcgacggcggtttcaggagctccaagaggctcaagacagcaactacggcgacgacacaacctccaaggcatggggtgaagtgccatgcaaagccaagaaatcaaactacgaaggtagtatcatttttgagtatctgatagtgaaacaattacagttcttgtaatcatcacttcatcagtgttgtcagtgtaggggctttctctcgttcatattggctatcttttccctctcactgccatcgtaaatgcaggcaacatgtaagaagaggagccagaaactgggcgacagaatcacagctctgcagcagttagtttcaccttacggcaaggttaattaatcaacgacctagctagtgttttctatccatgttaatcatcagtgattttgctgatctgagagcgttaattttctgaacctgatcgtccgagcagacagacaccgcatcggtgctccacgaagcagccgcctgcatacggcaactccaccaacaaatccaggtaatcgcgcgtcagacatcgtagccaggcacgacgagtccatgaccaaggtttacaaaaccttacgagtttttaaaatcacgataaacctcatggtaatagtacaattttcacgataatcacgtggttaccataataaccgttttaccgtaaaatgatgataaccccacccaaaataatttggtgaaccctggcatctgcaacccaatggactaagtcgttttcgcgtgtttcacatgataaaaaaagcctgcagaatctcagtgtttttcacttcctcttcagattctgacagcgccttaccctggaacaagctcctcctctgcatcgtcgcagcagcaggtcgtattttctgttcttgaaagttgcagccatgtcatgtccttctttactgcaattgcaacagttttgtggctgcaggatgccggaggaggaggaggcacggcgacggagcttcgccggcgaggcctgtgcgtggcggcgctgtcgccggccgtcgtgagcctcgcggcagagggcggtcgccgccgcacggacgtcgaggatcagaagaggatctggttcagtaatcagtagctgcaactgtaaattaaacgagacgtggcagctcgtttgaacttactctaatcggagttacgggaatactactagtttggatgtttgattagcagtcacgcgtccacgaagttacggggctgtttggttcccagccacactttaccattacttgccaataaaagttgccacaccttgcctaaggtgaggtgatcaaattgttagccacaacttactaagcctaagggaatcttgccacacttttttgagccattgacacgtgggacccaatttgttggaggggaatcttgccacaactgtggctacaaccaaacacctgtcaaatttgcctaaccttaggcgtggcaaactgtggcaaagtgtggcttgcaacgaatgcattaggcgtcctttgagtcaataagaagcaagcattacggctgtaaaataccaaaattgggcatgtgtaaaggtagcagctagcaacacaatgacttctccaacattgagcaaccttttcatgttcatgatattcgcatgtatttctggaaactttgccgtaagcccgtaaccaactctttggccgagttaatatcttgctaccatatgtgttgtaaaagtaattcttgtttgtcagcgtttcaagatgtttacaaattgctacatcgatctagcttcaaatagactatagcctatgtttatttgggataggttacatgctcaaacaacctctattgcacttgtgttcacgtggcagcttaacttttactcaattggaaagtgttaacaaccctcttctccaatcagaaattgcaatagtatcccattcaactataaagtgtttggagaggttgaagaagaggaaactaggagatacacaaggtttgagaaagattctagatacaaactagaactagaactgagatatgaccttgaaagaagtagggaggatgaggaagtcggtgttgtctattgatgcctgagcacgagcattgcagaagtgtgtgcttttgttacccgtctcttgggcctagttgggcctaacgcagaccagattgtagcccaacaacatgtggcaaagagattctggtgccaaccgatacatggcccgtggtaccaaatctaaagcccgtcgctaccagatcagatatcccataggtaccagtgataccctgtcagtaccaaagtttgatacccatttgtaccagtcgatacccatcggtactaggttagtacttgttggtaccatgaggaagaagagaaagctgcacgcaccaagagcacacgtgttgtcctcttccttttctcctctctctcacccccacatcacaagacccccgactaaggatcagcaaggtattgttgactacagagaaaagaataatgagcttgagaggaagaagaagcttgatggaggatgttgaatcagaacgtgaaacgacagcctcgaaggaagacactacatgagataatgaaagccccaatatcttcctctgcaatggtaaaaaacaaaaaactaatagctcgatccttcctccccccccaacctctcctatcttttatgtttttctcctttcttcctatcttcctccttctatggtcctagaccgagccctgactcctctctcctctgcaccacatggccgggagaatttgtggcatcattgtcgccaccatcaacttgacccacactgtcgcgacaaaaattggatcgcttccatgccgcaacagccaccgcaaatcgttgcggtagccacatgccccgtcgagctcatctcctagcacgagggagggagtcacaaataagatctcatcccatccgaccctcgaacgggatactgtaatatggcattcccaatatgaatacaaccacaatttcgcttggtccatcttatttttcttatctaggttggggcttaggagtagttggatggtgtccaacaaacatggtcttttggaatatttgttagatattgatcatttaggtattactagtaacatatccttgcactataatgggtctggtcatataaaatagggatggattgtaataagattaaggataaaacattggatctggtgaatacctatgtatgctaaccgtgcgagcacagtgggagaagggggtggaaagaggacaactccaattttaaagcagtagagattagttagaatattttattctacatccatcactgcttgtgccacatgacagtatccagtgattatgttgatagatcttgaatatcaaagtagcatgctagctagacattttctcgaaccgaagattgatctaacttcatttaactttttgtcacctttaagatgtggcaattaagtatttgcctcaaagtctttgacatgtgggtcctcatgtgcctataacatgtggacccagtgataaatccttaattatcacttataagagtggcaaatagttaattattcccccaaacatacacataggtctgcacataccgttgttactttggaagtatggccgtgtctagttgtttggcctaaattttttttacgtatacgaacacacatttgaaatattaaacgtagattaataacaaaacaaataatagatttcacatgtaaactgcgagacgaatctattaagcctaattaatccgtcattagcaaatgtttattgtagcactacattgtcaaatcattgcgtaattacgctcaaaagattcgtctcgcaattttacatgtaagctgtgcaattggtttttttttctcgtccacatttaatgttctatgtatatgtctaaatatttgatgtgatggaatttttagaagtttgaagggaactaaatacagcatatatgttttttttttctcccgaaaaagaaaaaacaacaacatagaattgactgcgcacgagtccacggcccaagacctacccgctcccggccctctgaccgtcagtccgtcaccaacccatgggccccacctgcttgccgcctccaggcctcgcaccctaaaaaaaataaaaataaaataaaataaggactaaaaacccggcccgctcccacgctgtgtcacacccacctgccacctcgccgcgacgaccccctcgccgccggccgccaccgcgcgtcaactgccggcgatgccgcccccttccctcctgctcctccatccacgcacgccgctgccgcaccaccaccgctcctccttccggacgagctctccgcggccatccaggatggtctgcgccgctgccgaggggtttatctccgcggcgccgatcctcctccccgacggcccgtggaagcaggtgggtaactggtttccggtgaagccgcgggggcgttgggctgtgggtttttttttttcagtatgctgaatctggtggctggttgctgatcgggtgcgggttcaggtggaaggcggcgtcacggcggcgaaggggttcaaggcggcgggtatctacggcggtctgcgcgccaagggcgagaagcccgaccttgcgctggtcgcctgcgacgtcgacgccactgtcgcgggtaaaggctatcaccaacactttctattcagttcactcgtagtagcagaagtttcttcagagttcagacttcagtttcacttctcgttaccatttctcagcaactgctaacggctgcagaatgtgtatcaatgcgtgctcgttaggatgaacggctgtgaatattttgctgttctgagttctgagttgcgttggtgtatcggcttgtgcagtgccatatgaaatctgtcggttgggcttagttattgtcctgttgggttcttttcaggagcttttactacgaatgttgttgctgctgcaccagttttgtactgtaagcgtgtccttaattcatcaaaaacagtaagttaattctacctctcatctcaccttttgacaaataaatggaagtaataattcattgaggtattctatgttttcaatgtattgttttctaggctcgagctgtgttaattaatgctggacaagcaaatgcagcaacagtaagtgtttctgacaaccgtatccgttccgctggctctgtactgtattcgaaaacaccgtggctagtattgatatacttatctaaataatttatctcagggtgatgcaggatatcaggatacagtggatagtgctgatgctgttgccaaggtacttacttgccgattggatgcctataagttggccaggcatcaatgatgttttctctaattggctatcggtttttgcagcttcttaatgtgagcacaaatgacatactgatccagtccactggtgttattggtcagagaataaagaaggtacagtgctgccacaaccaaactatggttgagtgactgtactaaactagtaggctaacctagtacaatttcatctgacgcttgggttttgacaatgcaggaggcacttgtaaattcacttcatagacttgtgggctcactgtcttcatccattgaggggtatagttagcacgcattgcatgtaaaatgcatctgcaagtgtcatttctatatgactatatctaacttattacctctgcccctgtcacagtgcaaattctgcagctgtggccattacaactacagaccttgttagcaagagcatcgctgtacagacagaggtttgactttcttagcctcgtattattctcattaggtttatttggtttgacattatctttgttcttatcatctctttattgaaaagttagattggaggagtgcctatcaaaataggaggaatggccaaaggttctgggatgattcatccaaatatggcaacaatgcttggtgtaagttctgtatcaatctcattttccacacagtcctactcctctattgatccctttctcaaggcatgtatgagcttcattataaccctttttcttacaggttttaacaactgacgctcaagtcagcagtgatgtttggagagaaatggtccgaacatcagtgagtagaagcttcaatcaaataacagtaagtactgagaaaccattcctcttgagttgattagcatgtcaacagttactcaacctacaaaagaacttatcaatcttaattactcacatcacatgggtaaatatgggcaaattaaactgtaataacaaacaagagaactgtctgcaaaatgctcctaaatttagcaagcattgaggtttagttttctttgtgttatggaaatctaacgggcataatgcatcctctgtctactaatttggtatggttgttatggcaatttgatcctgaaactagtaggcaaacatcttgattgtttacgtcataattctttaggtggatggtgatacgagtaccaatgactgtgttattgctctggctagtgggttatctggtttatccagtatccttactcatgatagcactgaagctcaacagttccaagcatgcttagatgctgtaagttttacttcccccaagcttttccttttcatgtgactccaggctccatgttcttgtctccatatttattttgaaatgcacttttctgtagacttatcagattactccagtctgaaatttcttttcttagcttcccataggatggaccgatatgaatcttattttcttcttggttgcagagtttttgatgtatttttatttacagcaaactgtacctataaaggaaaaagatgctgacctatttatctcctgtaggtaatgcaaggtcttgcaaaatccatagcatgggatggtgagggtgcaacatgtctaattgaggttaagcgcttagcatttcattcacttcgcaccatcagcatagtatgctgcattttcttttagcatgatgacttgacgtttgatatacaaattgagttatctggcaactgctgcattcaattattcatcatatcaaatttcctttcttaatttcttcggtgtgacacaagcttctaaagtgcccattccctttgtaggttactgtagctggtgccaataatgaggctgaagcagctaaaattgctcgttcagtggcatcttcctccctggttaaagtatgatactgtttagcagcaaaattttgctaattaggagaggattgacacccctctgtcattcgttagcccagaaagcctgagttgttaaattattttttatcaggccgctgtatttggaagagacccaaactggggacgtattgcttgttctgtcggttattcaggcattcagtttgatgcggaccagcttgatatttcccttggagctattccactaatgaaaaatggtcaaccactcccatttgacaggttaagaaaccttgacaacatagaattattttttttattgacgactttgaatgaattgtaatttgtgtagatcttacaatagaatttaaaatatctactgtttcttcatagatctgcggccagcaagtatctgaaagatgctggagacatccatggtacagtgaacattgatgtatcagttggtaagcattcaacttgttgcataactcgacttcttgttgcgtggctgaatctgtagtatgttcttgtgtcacaatgttagtcatggacttctggttgcatcatttctctagaaagcacaaatgtgcctcttgcatccaacatatatttgcactgaaccggagtagttttattggcttgatgcatttgctttggggtatcctttcttattccttgatttcctatttggcatggcacctttagttgaagaaaacttgaacagttgcgcacaaaagtaaatttgtttttaggaaagctaagattacgtcttgcccagccgtgttttttacctgaacaaccagatgcttcattatcattgtcttgtacgaaattgtttgagactggcatatgacgcatgttcgttgtgtttatctgccagggaggggaggaggaagtggaaaggcctggggctgtgatttaagttataagtatgtcgagataaatgcggaatacacgacgtgaaagtcttacactgtctatgaagaacggtctccgcttgatggaaatggaacgctgttcggatgcagctaggcatctgagcgatctgtatcatattgagactcgccctttgttgtatcaatcggctgaacgtgcattcttttgtaagtgtaaggaatgcgctatacaatgttacggcacaataagtaagctgtctgccatgccatctgattcaattctaatttataacagtgacaggggatgtttgggcgcacgccgaataaagtttgtatttttgtgtgcaatcatgtatgtatatcgtttctttgggggagaagaatcagttaagctccaaattcggcttgctccatggcacgggtttttggcccggccaagcacggcatggcccgactgatgttggccccgtgcttgggcctttgtctcggcacaataggtcggcttggtccaacgatctggaggcaaaatagatgagggagctaaaatagacttattccaaccttttaaaggcacagtctaaagagatgagagacgcaaaatagacttattctagtcatataagaaacggcccaaagagatgagagaggcaaaatagactttttctaaggaggagcacgatgggctttcgtgccttcgggtcggcccagcacagcccgagtcttattgggccgtgcctggaccgttggtgcaacacgtgggcgagtacggcctagcccgcgtgtaggtcgagccttgctaggcctactaacctcgagccagggcctggtcttgcctgggccgagcaacccctttggccatctataatggaattttttttatttatacttttttttattaaaatatttacaaaaataatttgttgttttgaaaatttacaaatctaatcgcctgccgccctttgggagggcgatttttaaaaatcgcccttccacagggcggcaagggacctaaatgtaaattttccagtataacttgttagctctatgattttacaatttaaaattatattatataaagtcagatgaaataaaactttatatcaaaagtgtagagctcaaggagatctacaattttgtagttaataactttttcatttaagatgtccaaatattcgttacaaaatataaaacacatttaaaaaaatctcagatctacatttcaaacgatattggatggagataaactttatataaaagttgtagatcttgatgagatctataactttgtagtttatcacttttccatttaaaatcatttggagtatcgaataagcattattagtttttaagcaattaaaaccggtgggaagggtttgaacacaaataaaaattttatatttagatcccttgccgcccttggagagggcgatttttaaaaatcgcccttctagagggcggcaggcaattagatttgtaaattttcgaaacaaaaaattatttttgtaaatatttttataaaaaaatgtataaataaaaaaaattctctataatggcaggcaagaaacattgtgcactctctcgtgcactgcatcatgtacctagacccaatatcaagttaggttggaaacattgatgatgctcttagtgaatagatcaaacgagatagtgtgtgtttaaatcatgatgcagaggagaattatatgctagctaagaacattcatgtgagggaaatttatggttcaagtatttggatatcagatagcatgattagctagggcttgaatattggtggggtttccaagcaaagtggaactttgaggttcttctatatgggccctttctcgaccatatgggccgggatctataatagcaacccatgtatgaagatggcttagggtttggtccatgccaaaaaatgtatagagtacaatttttttacatggacctaaccatgagccatctccatacactggccgctatcatagatcctggcccatactactaatagactcattattgcgactgtcatagactcttgtatcggttcaacggagttcttgtggaattcgtgttatgagatcatgttgacaatgtgtgattcatttccttgggcttgtatatgtgtctatggaggctgatactccttttggaaccttttggtagatgcaactattttcataacctctagcttcccaagacaattcaaattctcattatagattatgaaagtttccttgtgagtggaagtgagcttgatcaaagtttggatggagtttgataaagccgccctaaaggcctaatgggcggaatagtttggatagttgtgttgtccgcctggttactaaacttgtctgagcaatcgaggatcaacatgctagacaatctgtcttgtacatattggcgtacgagacagtatgtttgtcaaagtcagagttgtataggctggacagttcccttgtgcaaattggcgtacatgacaatatatttgtctaggctgatgttgtacaaatcggattgtctaggccaaccagattgtttgggtgaagttgatcatcgacaggctagatagcacgcttcaatggaccgtattgtctgaattgagataggataatccaccagttgaaaggtcctcggactatccacctcttaatggcccgatagttagtttctcatcgaccgttgctacggtgtaaagggccgagctatcaaggctgaggcgatgactagtttgagtgattgggctataaataccaaatgctataaacttgcttcaagatttttgaagtaatgactagtttgagtgacatgagcaactaaggccctgtttctttcagcttaggattattataatccaacttattgagtcagattattataagctggattattataagctagaggaaaataagctgtgagcttgacggagcgtggggctcctcaccgggagaccgcgcgggcccccctttgccggttcggccgggggcgctaggtgaggttctaagcactcgatctgtggaatgtttcgcgagagagcaaatgcgcaagacacgggcgatgtagacaggttcgggccgctgagaagcgtaataccctactcctgtgttctggtggatctgtgtatgaaggagttacaaagagctggagagcaagagagttcaaactctagaaaccctcttcctctttctctcctctacgagctcaggtcttctcccccctctttcccgagctccccccttcttaagtgggcaaggtcttccttttatatctcaaggggatcccacatgcaccacttctacctactcttcttttgggtggggactcaccctatcttcccaaaaaagaaaaactggcttgcgccttcgcctggaagctaaatcacaacttgtctttgagtgaggcccagcgtcatcactcgcctgacaccggggatctccctgttactccctcattaatgggcggagatttgccatggctgttgtccgaatgaccctctgatgggatgggccatacctaccttcactccgccggaagcaggcgcaacgtgggagcacggttgtctgccgatgacgtgaccggcgtcagaccagtcacaaaccggtcattcttgtctaccacgcgtcagtttagcatgccacacgtcagcccttcttcataaaatgacttccttgtaatggttgcgatgaagcctggtatgaatctagccgggactgacgtgctaactccaggagtcagcacgccggctccggctagggacgagtgcctagaggctctcatcattccgacgggacggggcgaggcgtgcgaaaggccgcctgttgccacctaacccgcgatctgaccggtctgtgaccggtcacacactgtgacctgtcacggaccgaacgagtgtgctgcgctgcattaaatgcggcgtggggcgctcgtccaacccgcaataaacgcggttaggtgagcgccgctgtgctcacctaacccacacacgtggcgccaaacccacagggggtcggggcgccccagccctcggggccgaaacgggagcggcccgacccctcggggagacagagggaggggcggccacatcaccctcgggcccgacccccccgagggggtcaggccacgtgggtgactgcagctgccccaaacctctagtcaagatacccccggtcccatgtcaccgacagagctgtttctttctctagattattggaaacctggattattgagtttgcatggctaaagtctagaatgccctcaactatttttggatgcctttgtcatcattcggtgactttatacaacagatataaatttgatgtagataaataaaaaattgacaaatatttataattatacattcatgaatatttcttccacatatataatagacttaaaaccaaattattatctcttagcaaataaagcatcagcaatactatcacggaaggcatttgcgtccccatcttcgtctcccatgtgactggcattcccttgagatgaaggcatcggcatgtagttttcatcattatcacacagatcaaactcttcatcactcaatttgctatctcgaataaaattatgcagcgccatgcaagcatgtattatttttgtttgcttgagcatcggataacttggtaagtccaatagaattctccatttcatttttaaaacaccaaaagagcgctcaatcacattacgaagcgatgaatgcaagtggttgaacacctccttcttgccactaggacgtggaccctctcgaaattccggtaaatggtatttggtccctttatatggagatagatatcctagttgatttggatagcctgagtcaacaaggtaaaatttccctgttagcataaacataaaccatgagacattattttataattgatgctagttcgacgagactgttaaacggataagagaagttaccaggtggtggatgagggaagatagcggcatatttgcgcaaagcatcattgaacaccctcatatcatgtgccgatccaggccaccccgcaacaatgaatgtaaacctcatgtcaaagtcacaaatggccaagacattttgcgtcggatatttatttctacccacatgttgaaccacctttgatgcgggcacaactactggtatatgtgtcccatctattgcacctatgcaattgttgaaatggggctcaaaccgatcaccaagtagtcttgggtgaatagttgtgaagtttgggtctctaggtttgacaagatcttttgaaaggagatagatactctgcaacacttcattgaattttctactgattgttccttttgacctctcaaatcagttcttaacttgaacaaatgattgtggagccccaatggtccacaaaaacattcctaaagcttcaactgaatccatcttactagttgacttcagaccataagataagaccaacaaattatgtaacctctcaaagagtggcctactcattctaaacatgtcataacaatcttgtggaacttcaaggtttctcataacccaagcatgacccgctaaattagcttttttatacttggacttgttcaaataattttcagcatagaacataccaaatgatgtcaacaccggtccaaattttctcatcatatctagttgtctgctagcaacaataatagtttcatcctcctcctcatcgacatcatcacttccatacatgcccatctacaaacaatgcaacaaatgatatcacctcaatagtcacagaaagaccatgttgatggatcactaaacagtagttcatccaatcaaaattaaggcgccatattacatggccaggcaatacataagttcatgcgaataaataagtagcaatcttgctaatacatattgtctgacaaagtaaaaacagagataactagttcatgcatataaataattagcagttttctactgctgcccttccttctcgcaccatctctgcaaccaagagagccttcccgccttggtggtaagagtcttgaacatatcacgatgttcagctttcacaaataatcttgtagccatgaaatgctccgcacttccttctgctgccccacaatccaccaccaaatccatcacctccttaatggaattgaacctaaattcaccttgcatcaccttgttggcaatatcacaattgatatccatagtggtttgaatattcctcattatcctaaccatggggttcttaaccttcttgtatggactagtggcggtgctggaagaccctcgcttcaatggttttttacccaatgagcaatctaccggtgtgtcgccaaggtcatgtacatcaccacttgcatcatcccctccagcattttctccaggtacgttaatccagaaattaaatgttcgggttgtttaatagatttgctatacaattaaatagataatccacgacaataatatccttaacaatatataaatcaattgaggcataagttgccttctttggatatggttcctttctcgcaactgttatattagaagttccaatatagaaggaatttccaattcttttgtcgtattatcctatctacttccacttataacatttatttagcttatagttttaaattcgctccgttacctccctctaggccggaaccaacaaaaagaaagtttaaaacagtagggtgaaaaaaaaacaaaacttccaaactcaccccacctctttccttattttttttcaaaagttatcatacaaaaatccaatccttaattattctcttccaaaattttatcaacatgtaaggtgtgtttagttcacgtcaaaattggaaatttagttaaaattagaacgatatgacgaaaaaattagaagttggtgtgtagaaaagttttaatgtgatgaaaagttttaatgtttgaagaaaaaaattggaaataaacaagggctaagatgtactaatcacaaaatcaccaaatcctcgtgttcacagctcagagcgccatccacctcaccgtccgcctgtgtggcgctgcttttttccccaaaaaagaacaaccatcccgcgggcgggaaaacggacgcgcaaaaaaatttcgtgctcccaaattccctctcctctgattggcccatccgcccctcccacggatcgcgcccccgcgaaccccatccgagccgtccaaccaccccacgatccgaccgtccatctcccctcccacggatcgacgggcccaccaccctccccttcccccaaccgtttaaatacgccaccccatcggcctcgtctcgccatcgccatatcgcattcgactaaagaaaagggaaaaaaaaatcctcctcgccttcgacagcagcagcaaccagcttagctaggctagccatggacgccgccggagccggagcgggtgggaagttgaagaagggagccgccgggaggaaggccggcgggccgaggaagaaggcggtgtcgcgctccgtcaaggccgggctccagttccccgtcggccgtatcggccgctacctcaagaagggccgctacgcccagcgcatcggcaccggcgcccccgtctacctcgccgccgtcctcgagtacctcgctgccgaggtaacaacgctcgcccactcccccactttgtcgtcagcctcatctgcagatttcgatttgtggtgctgatctggtggtgtcctctctgttcgattgcttaggtgctggagctcgccgggaacgcggccagggacaacaagaagaacaggatcatcccgcgccacgtgctgctggcgatcaggaacgacgaggagctcggcaagctgctggccggcgtgaccatcgcgcacggaggcgtgctgcccaacatcaacccggtgctgctgcccaagaagacggcggagaaggccgccgccgccggcaaggaggccaagtcgcccaagaaggccgccgggaagtcccccaagaaggcctaggcgtcggcgcctcgctttgcttgtttagctggagtagattggacgggatgtgtgtctgttagtagtctaatgctgttgatttaatctatggtggtgtcgttgaaccttgtgatctgtgcttgtgtctgttcaagaagataaatttaagagatgttaaatttttcttcagagatgtttccattcttgctccttatgctttggctgtggagatctgaattttctcaattgtcagatccgatcttgtgagatgttcgaatttggttgcttgggttgggcgggtaacttaaaatcacccaaatttgttggtggtgtgttgggcttagtgccgcctcaaaaatttggtgtttggaatggaaatcaccgaatgcctaagtatgggtatctcagcatctgtgattttgttggatgttgaagtgattggttggaatttgcattttgggaggcaatctggcgctctggtttgaattagtggagggggggaatggcgggaagccgggtacgaaatgaaaatgtgtcttgggatttcgctatggcattgggcgggctaaatccatggaagtttggtgctacttggcgcctcaattgtgtcttgagctgtactccatttatgggccaacaggcaaataaacttgctcctcaattccgctatgaacttattttgggtcaagatccacatccttatgaatagaccatctctgtatttatgttactacctgtcattttggtgttgaacacgggtaaaattaaatgtattatgattgtgatttgttgagaatagaaaataggtgaggatattaagaggtagaaggttgtgattggttgaaaaaaaaagttattatatttagggataaatgtactcctaatttgttactcattctgtaaaaaaaaaaagagctaacctagtaggggatatgatcagacctactatgaatctggacagccaggaggaaggagtcacatccgcttctaggttgatttttttggacggaggaagtatattttaggacaaatgaaataatatatttgaaagatccatttttgtaatagggtcttgtttgtaccctccttaagcaaggacatttattttttagaaaacatagtacaacataggcgctcataatacgcactcactctatgaatacgcacatatatatcctaactctacgaacaatcatcatgagtacgtcgtctaccattaaaagaataattagtcgtaaatgtaagtaaatgtgtcaaagtctatgtgtcgaatttgagtgagctagttccaccataaagaatctaaccatttaagttacactcatttcgtcaagggtatttaattttgatcaactatataacctttgtacctatttccatatctcacagagcacgcttaatttttcctgtagtgaactaatgatggattataatattatatctgctagtacaatttaattttgaagaaatggttgtatgctcctgtaaacaagaaacttccggcacatcctcaggccaaggcaactcagtagtacaagatttttttaaaatctttttatatttattaaaaaattaaataaaaaaaatcatagcacaattggaatcgtccccatatttggactggaggaattttatacaagaattgaactaattactgcaaaattcctacatagaaaggagcccttacctatcctaggttaatcagtgcattctaattaatttaattgaactaaagtgagataatccaactttagccatgcccatagaactataacctcttagagcatctccaatagaatggccaaatcactcttcaagttaaattctagcaagttttgagaaaaaaaccactccaacagcctctccatccgactggccaccaaattggctcttggctacgccaaatttggccatcccgcctgcctagccaaattggctgctagccatgggccccacgttgctcccccccccccaaatctctcctctctctctctctctctctctccccgcacagatcaatcgccgccgccatcgtcgtaccgcgccatcgccgtcccgcgctgtcgccgcctcccacctgcaccgtcgtcgccgtccgatttcctccgtcaccaagagagctccgcgatgacgaggcaggagcaagggaggctgtgttggcgacggcaacgagggagcagcgatgatggggaagaaggggtcggatccctctccggcggcagccgctttgccttcttcccccgtgtggactcctacgcctccttcctcgccggattcggccggcggcgtggaatcagggggccgcgcgacctccgccgccgtctggccgccagctgctgtcgtcgccaaggtctgggccgccatccttcgccgtctggagctcgacggcgctcgactacggggagtagttggcggggagagggagagcacctcggcgagcgtcggcgttggggggccgccgtccatcggcatgcgtcggcaacagcggtccgctgcctgcgccgatttgccgcgtccgcgtccgccgcctccccgcatcgtcgtcccaacgtcgcgccactccctagcgccgcctccgccgcctccaccgccgccggattcagggtggggggcgtgacctccactgcctctgcgcggcctccggccccgcgcgtatttggccggcggggtggattcgggggccgcgcggcctccacctctgctccatggccgtcgtcgaggtaaccgttgcaagccgccgccgccatcgccaatcaccgcgtcaccgccgtcgccaatcacctgcacgggaagagggccgacagaagaggaagagggagagaggagtagaggctgacgtgtgggtcccagtgtcataggcttgtaatgaagagtgtagatgaaaagaatattggagtgaggaataagtttggcttgctaaatcgactgaaagctgactatatgggtatttagagagtttaatttggagagacagttggagatgctcttaggtaatgtgttcataggtccacatggtccacatgtcaatgatcacattactctgacgtagggtacaaagccatccaaaaccagttcatcggatatacatcacggctttaatacttttgagatcaaattcaaacaatatcgctttatagatgacacagaagaaaacggtggaagaaatagctagtggagcaggggcgggtatatgggtcatccagcattctacgcacatataaccttccagcccgggttcataaattcaacctaaccttccaacaacaattttcctgtttgaaagctttcttttgtcttaaaaaaaaaacaaacaatgttgttcgcaaaccaatactgggctcaacaaaagtcacaaaattacgcattcaggacaggagaagtgctcataggtcttgttggaactgagccagattagccatgtacgagtacggtttaaggcaggaaaactgcaccagttcagcaacgatggtgatagactatgccctatgcagttttattcttttgcaatttccacaaaaattagtcttccacgaatgatctgccaaagaaaagatttattgaaagtttagtcttacaataaaacagactaatcaggggaaaaaagaaggctggtttagtataaatctatgctgaatacgaatcatttccacatgaagaaagatctgaatgaatcccaaaataaaagcattctgcagtgacaaaaatggtggagggccaacatgctagcaagatggatatctaatctcaaagtttatggccaatctagaagatattttctttgggattaacagaataaaaagaactatataagcaacacaatgttcacaatgttcctcacagaaggaaataaaccacacagtttggtccacatggttttacagaaaaaggcagcaaaaagtttgcttcacatgatttttacagtaaactagccaagttctcaatctgggttgaacgtaaaatactataaatccctgcttagtgtctcgatctcatagaactacaaaaattagttctgttccacaccatgcagttatgccaaagattacaaacatgcaacacattatatcttgaaattaggtacatcagttttgcaggcaaattgtccttttcatttagtactccaggtaagtgcctcagctaatgtagttgtttgtaaagagtctaatcagcggagagatcagttctgcagtcaacttgtccttttcatttagttgtccagttaagtgcctcatctaatttagttgtttgtatcagtggattttttttatccccttagtatctgaagtagatcagagataacatcacaaatgaggcccactcaatctacgagggtaagtgttatcatgaatcacgataaaccactctaggcttcaagtaattaagctagaaatgtgtgtgtggtgtgcatgtaccttcaattccaattgaaaaccaggtagaaagtactatatacagattttcagaactcttctcagataaagaagaatcaaaactaacatcagaaaggtaaattgcgggtcataggcaagataggggatgagcagagcaaatacccgtccatccatttccttaacagctttctctccgtctgcttgagaagaatatttaacaaaaccaaatccttttggccttccagtttggttctcttaccaatcgagctacgcttgataaggtagataaagcagagtgaaacttgaatgccaattaagagcaacaacaaagatttaaattgcctgtgctgaaaagcatgtgactactgagtactgactagtaccttcctcaacagcgccaaatggtgagaagacatttttaagttcttcctctgttgtgtaaaatgatagccctacaaaatcccaaaatgagtgaatggatgtttaagctgtatgagcaagcaacatcaaaacatgatagaacgagtggacaatccactaagaacataacttgcatggctttagcgtgcacaaatagcagaatatctacagacaacttatgtgttctactcatggtccatgtgaacaggtgagcatctcacaggctcagcagattagggacttctaagtactctatcaccaagagaataaatcagcatctgtcaaactctatgagctctacaacaacagctagctagtatgtatctaggctgtaattctctaacccgctagaaagcatcctctgatcgatccttcattgcaatcaaaaggaatcatattctgaaagcaccaagcctcaacaacttaaggcatgccatagctatcatattcagaaaaaaagaagggctaaaggacacaccatttagtgctcatttcatccaccacaccccccagaatcacaccagatcaagaaaccccattcactcatgaagttctgacgcacagatcatcacaagcggacctgtgaagcagcaggacatcacatcacaggctcacacagatccaaacattttgcaaaccacaagattattacgtaggcggcgaaaatttaattacatggagatgaacttactgctcacaaatatctccgtgctgaaaggcttggctccaaccatccgagaggccaagccacccagccgcccacctcgcagcatcatctcctcaaaccctagatccccaaatcgcaatcgcaaagagaaaagaaaaacacaagatgcgaatcagccaccgacaataaataacactcgacacgtctattacttcaaatccaagctgcccattatgatcaagcacaatttacaaagcaggcacaagtttgcaactactgccacctagcacactgcacacgaggggaaagggaaggagagaagcatggcatcgaaaccctagagagacaggcctagttgctggtgaacttggt

SEQ ID NO: 80035 - DNA, 23619 bp, Oryza sativa
  unsure (1)..(23619): unsure at all n locations
ttctatgtgtactctaaactcatctttcaatattctttaatttttaatttcaaatttcagattgtattcctatattgactttaaactcttcttcccatgttattcttaatttttaattttagttatttgtaaattgtatttttatacagactctaaacactacttttaattttattatctttattccgaattttaattagttttaaattcctatatgaactctatactctacttctaatatttcttttttttaattccgaatttctattttttcctaattgtatttctatatgaactctatactctacttctaatattctttatttttaattccgaatttctattatttcctaattatatttctatatggactctatactctacttctaatattccttatttttaattctaaatttcagttattttctaattgtatttctatatgaactctagtctcctcttctaatattccttattttctaattccgaatttcaactatttctaaattgtatttcaatatagactctagtctcatcttctaatatttcttattttttaattctgaatttcatctatttctaaattgtatttctatataaactcatctttcaatattctttaatttttaatttcaaatttctgttacttctaaattgtattcctatattgactttaaactcttcttcccatgtttttcttaatttcgaattttagttatttgtaaattatatttttatacggactctaaactctacttttaattttattatgtttattccgaattttagttagttttaaattcctatatggactctatactctacttctaatattcctaatattttaattccgaatttctattttttttcttaattgtatttctatatgaacactatactctacttctgatattctttatttttaatttcgaattctagttatttcctaattgtatttctatatggactctagtcttctcttctaatattccttatttattaattccgaatttcaactatttctaaattgtatttctatatggactatagtttcctcttataatattccttattttttaattccgaatttcagttgtttctaaattgtgtttctatatgaactctgcattttttttctccgattaatgtgggaatttctaggccatgagagcgaacgtggaggctcctttttctattcctttaataatataactagcatggtggcccgcgcagattgcgcggctagcatcattatattttctttcatataatagcatatatattttctcaatgtattattcaaatatattaaaatgacaacataattttaaattttgaactaactttacgaaactactgatgtgtaatattcatattgtattttatatacatgttagntattaattatttttaatattaaattttagttatttgtaaattatattcctatattgactctagactcgtcttttaatatttcttttttttaaatccgaattttcgctaactgtaaattgtacttctatgtagactctagcctcttcttccaatattatttatttttaattctgaatttttattattttttattgcatttttatgtggactctaaactaatctttcaatattctttaatgtttaatttcgaatttcagttacttctaaattgtattcctatattaatttagacacttcttcccatattttttttaattttgaattttagttatttgtaaataggatttttatatgaactctaaactctacttttaattttattatgtttattctgaattttagttagttttaaattcctatatggactatatactctacttctaatatttcttatttttaatttcgaatttctattatttcttaattgtatttatatatggactctatagtctacttctaatattccttatttttaattccgaatttctattatttcataattgtatttatatatatggactctatagtctacttctaatattccttatttttaattccgaatttctattatttcctaattgtatttctatatggactctatactctacttctaatattccttatttttaatttcaaatttcagttatttcctaattgtatttctatatggactctagtcacctcttctaatattctttatttttttattccgaatttcaactatttctaaattgtatttctatatggactctagtctcctcttttaatatttcttatcttttaattccgaatttcagctatttctaaatgtatttctatatggactatgtttttttctttttctccgattaatatgagaatttctagttatttcctaattgtatttctatatggactctatactctacttctaatattccttatttttaattccgaaattcatttattttctaattgtatttctatatgaactctatactctacttctaatattccttatttttaattccgaatttcagttatttcctaattgtatttctatatgtactctagtctcctcttctaatattccttattttttaattccgaatttcaactatttctaaattgtatttctatatggactctatgctctccttccaatattatttatttttatttctgaatttttattatttctaattgtatttctatgtggactctaaactcatctttcgatattctttaatttttattttcgaatttcagttacttctaaattgtattcctatattgactttaaactcttcttcctatgtttttcttaatttcgaattttagttatttgtaaattgtatttttatacggactctaaactctacttttaattttattatgtttgttctaaattttagttagttttaaattcctatatggactctatactatacttctaatattccttattttttaattccgaattttttttcttaattgtatttctatatggactctgtactatacttctaatattccttattttttaattccgattttttttcttaattgtatttctatatggactctatactctacttctaacattccttatttttaattccgaatttcagttatttcctaattgtctatatggactctagtctactcttctaatattccttatttttaattccgaatttcagtaattttctaattgtatttctatatggactctagtcttctcttctaatattccttattttttaattccgaattttaactatttctaaattgtatttctatatggactctagtctcctcttctaatattccttattttttaattccgaatttcatctatttctaaattgtatttctatatggactctgccttttctttttctctgattaatgtgagaatttctaggccatgagagcgaacgtggaggctcctttttctattcctttaataatataatagatagatagatagattcctctattttgttttgaagtgaaacttatcttgtgttccagatgcagccttatgataggttatggccatgggctttatgtcgtctgaatgggcagtatgcaatttggaaccaagaaagccgctgctggtgctgggtaagaaatgaatatggccctatttggaagcaggatatcagagaaattcacagtacttccacacatggctcaatatctgccaggaaacggcagcttataaacgaacttaccgcacatgaacccggaggacgttatgccttcggggcattggcagtctagcccatcgtaggtgacattcacccgacaccagcggccgctcctcgagcaatcttcgcagtcgtccggccctgccgtgtagtcgagaagaaacccacccttgatgagccgctcgtagtccttggccgctgcaccgtcgtaccccagcaccgggatcatcgacaccgtgcagttccccggctgttgtctcaaatcgtcgtcaggcttgtacctccccgcaagccaggcatacgagttgggcgattcattttccgcacaactcacgggcgcccaagaaggtggaagctgctgcaaccgactctggttgcagttgtagaggaagatgagctcccggtttatggggctaatcttgaacggcgtgaggccgaggtcggaggaggcgttgacaaagctctcgatgacgcactggccgtccgtcaactgctcgtttgtgaccatgaaggagctgttgtggtagaagatgtgctggatttggtacgtccagaacccgttcttgagggaagcatttctgtggtcgcacgtgacctgaaaagctcggtagccacactccggcggatgcttgccggcgagccagaacggatagccgatggtaaggttcccacacctcgccggctcgcagaacggcgatgtggtgttggtcgtgtttatggcatcaacagtggagctagctattgggagagtgagcagtagcatggctaagcagagcacgacagatgcaggggcaggaaacagatgcatctcctgtagtgcaagtgatcaagaccacggtgtactactcctcgatcgacgcggagcagatttgggcgacgctagtcgagaagataattgatgccacgagtatactgaagatgtgcagctgattgagcgtggctgctactggctagtactatatgcggagatggtgccttatgcagtagaacagctagtccgagttgaaagctctgttattgtttgacgtgtggaaacttccgcgtgcatatcggttcattttagcgaaataacactattgcgcgtgtggattgccacttatttggctcaacttgcaccgcctgaaaaaactcggaatttggtctctaaatttgtgtgttcaggccatgaacaaaggctgtgtttagattcaaagtttggatccaaacttcagtccttttctatcacatcaacctgtcatacacacacaacttttcagttatatcatcttcaatttcaaccaaaatctaaactttacgctgaactaaacacagccaaaactagagtagaccgtgtcgtctgtagactatagcagtattgacagtttgacaccacttggaaggaggccgccaacacactggtccacaagcggtgaccgcatttagagctacggcaagtcacgcactagctcagatcaagacgttagcagctctgccttttaggaaagacaaaaaacaattcactagtgcgtaatactactattttctcttcctgtcttccattaccttatcatgcttgactgtgctgcatatactttctccgtcctataaaaaacgaatctagaaccggatatgatatattctatgacatatgtccagattcattctactaaaatatgtcatattcgatactagattggttttttatgaaacggagaaagtaccttggaagttccgacgtggagcaaggcgagctgccaaagtccggtgttggttggtaaaactttttttttccatatttgtttcaaacttttttaatagatgcttcgattttcattattagtactgactggtttaccacttggttccaagttgccaccatattatttggaggttcatgtagactaagcgcgtgcactgttggatacttgctcaaatggatgagctcatgaatgaagatacttgatcaaatggataagctcacgaacgaacttaccagacttctgcggcggcggcggctgccatgtcaagaggaaaccatatcactgatgagctgctcgtagttgctcgcgtttgcctcgccatctctgcccctcaccggcacgatcacggcgtcgcagccctctagtaagtgtacagactcgttgtaactctcctcgaggcgagcgaacgtgttgttgcttcatttcgtctcgacgagaccgaggagacgccgcaccgccgccgtcggaggcttggtgcagttgtagaagataagattatggttgacacggctaatcgagaatggccaaccgaagcttggaggaggtattggacctcgggacatggcagccactggagttgtcgaagtcgtccatctttcggacatcggtgacaagcaaggagctgttgctgtagaagatgtcgatgatctggaacttgaactgccggttcttctgagggtaaccgagataagggcgaagagggacggggttgtgaatagagtatataatgaattaatatcatgtgcttaaagaagctaactcatcttcttattgtgacttgttactgatctattcgctcgtctataggacatggccggttagctggtctccaaccgctgtggttttcttgtttgaaatggcaggaggaaagaatcgaagagatgccaataaacgtgttcgtaatagtttcagtaatagtttcagcctttcagggaggctgggagggtgaacttaccagaagatgtcactggcagctctggcggtggaggcactggcggtggcaggttcccccatgttatgaggaagcctccacgcacgagctccacatacctgctggcgttcgccttgccatcaggcggcttcagcaccggcgagaagacggtgctgtttctgctgcagccttccaaatagtacttgtcgtagtcgccctccccgtcgtaacgccctcccagccgagcaaacgtgttgttaccgcatctcgtctccacgagccccagtttttgctgctgctccgccggcggcgccttggtgcagttgtagaagacgaggttgtgattggaagggctgattgtaaacgtgacgggcagcttggcgaaggtgttaaacactgggatactgcagccggtggagctattcaggcgagctagcttatggacatcaaagacgagcatagtacggtccccatatgatatgttgatgatatcaaacccggtgtccgtagagctttgaagagttgcgacgccggtggagtagttgcaatatacctggaaatccagacgaccacacggcttatccgcctggccctgggtgatccagaacggagaggagatattcaggtggccgcatttctggctgcccaggcagcctcctcctccttcctcctcggctcccctcgccgccgcggcgagcatcagcggtaaccagtataaggcgaaaaagcaagtaggggccattggactattggaggttggagcatgagatgagattcggaagatttgtactggtaacgaacagggagttcataaattattgaatcgatcgatgacgcgttgtgtactggtgacgcaagtctgaccttttcttcgatcacgttggtttaggccgtgtttagattcaggcgcgaaaagttcgggcgtgccatactagatatgcgaatactttgaagtattaaacgtagactaataagaaaacaaattacagattccgcctgtaaactaggagacgaatttattaaatctaattaatccattataagtaaatatctactgtaacaccatattgtcaaattatggaacaattaggtttaaaagattcgtctcgcaatttacacgcaatctgtgtaattagttttttttctatatttaatacttcatacatgtatccaaacattcgatgtaggaactaaaaagggccttagtttgcgccatgggaattggaaatatctcatgttttctttctttctttctttttttaaaggaaatctcaaatgtcttctaaacgaggaacggagaccttgagatggggtgcctgaatttaaacaagatcactgcatgtactaatcttttttttgcaaaactcttacaaacaataatctcaatcggttgatttaaatagatgaaagttatagataacttagctgtactcacagcgtgacatttagtattaataagagtttataataagggagtagctatatttatagcgccatatttttcaccaaaaaatagtcggcatgtatttacattgtaagtccctacattacatatgtaattttagtttatttacgatgtaagtctcaaaattacatatgtaagtgggatgtaactactgtgtaaatttatataaatatatgatgaaaagtggggaacgcctacggatcggtcgccccggaccgatccggggctagggaaatcgggcgctagcacccgatttacgtgcaaaactactttaaactgattttttctcctaaattacttatccaaatcataatccgattgcaccattaaattcattgcaattaaatcttcaaaacaagaccacatatggatatattacgacgaaaaaaaatagcttattattgaattatttttaaatgttgcacgatgttccaccagatatatcggaattgtttcactaagtagatcgaaaatgtttcactcgtttaaatcggggtgttgtttcaccttatataaaaacaatgtttcagcaaatagtgaaagaatgtttcagttcactgcaacattagatctatacatagtgaaacattgtgagtacacaatgtgaaacatttttcggtggaacaaaaaataaaccaaattttcttaatagggggtttccaaaatatgtgcgttttttttgttgcaatggaatgttttgttcactgcaacgttagatctatacatagtgaaatattgtgagtacactaggtgaaacatttttagtggaacaaaaaataaaccaaattcccttaatagagagtttccaaaatatgtgggttttttgttgcaaaagaatattttaatttaatgcaatattagatctataaatagtaaaacattgtaagtatactagatgaaacatctttggtagaaaaaaagagagagaagtaggtgggtccagcagatacgcacgtgggggaaggggcgcgcggggggagcgcccgatccggctcccccccgcaccggtcgcccggagtagagcattatcgtgaaaagtggtattttttttcaagaaaactatcgactaagacataacaattccgtatataaaaccaatcagaagatcaggtggatgcagctgccgcagcgtttgcatgtgaacaaatccaatggacacggaaaccgactaagatttgtgaaaaaaaaattgtcgccatctttatagcaattccgttataataattttgccccgttcgatctctcaattgatagaaaaattttcggtgcacgtaaaacgagaaatctcattagcacataactaattaaatattaattattataaaattaaaaaatgtagttatttgaatattttaaacaacttttacacaaattttttttatcaaaaacgtataatttaagagtttgaaaaacatgctaacgaagaacaagaaagttaaagtttggagttgagaaaaaaataatatacaatattaattataaattaattatataccataatatacaatattccttatattatggtgatctgattcaaattaatgtatttttgcccatgataagcccttttttatatgctaaaccgtatttttcttagatacgtctatatataatttctcaaatatttggtgtatagtcaactgctacaatggtcaaatcaggggcaaaagagtcatttgaagtcccctttagtgctggtaaagctgacatggcccttcccttagataaaattggtaatttgtaaaaattcattctctcctgtggtatttctgtaaatttggaagagtggcgatgtcaagagtaccgcttcgtaagagtggcaaatagttaaaaaccccctcgatggatggcggctgattcatgcatcgccgccgccgccgccgcgggcggcctctcccgtcggcgaactccctcgaggttttggtggctctcgtctcacctcttgcttggtttacacgctcttgagggtatattgttgcatcaagacggcggccgccggccggtaggttttattttatccatccgccgcctccgtctcttcagcgcgacactgctgccgtcgtctagggaatcagggcatcggatttcagcggcgttggctcagatcgacctcgctgatgagaccaataccgatagtgtcgtgctgttgcaggtaggggctgtgagggaagcaggacaaccgccgtctcctcgcgtgacaagaaggggcggatgaaggtggtgtgcttctgcaacaaacttccagactgggctggctgcagatgaccccaggtatgtgattaattcttgatgaggacacctatctatctatcgaactgaattgtgcacctctgctaaaacaactttgccgaacaggttgttaagcttttggggcaactttgccaaacaggctgttgagcttttgggggtgagtttagttgttgcgataagtaataaatttaatggcttaacaaaaacatacttccattcatttactttagctgagtggcggaacatatatagaatgaatcatcccaaaagaaaattcttagttaagaataagatgaaaaatacgatggcgctgcatgacatgaaaggatcggcttcgggggcatctccaattcgttgatgttcttctccagcatttctatgaccttactcattgaaggacgatttcctgggggcagtttgtatgcaccacaggccaactagtgtgatcttcctcgcaatctcttcattctcgcatgtgacttcatggctttgcaaatctttcgctaaatgatcataaatccagttggggaaatatgcactagaattatcagtatttgttttaacatttttccttccttctaccatctctaacagcatcattccataactgtaaacatctgacttagttgacacaactccgaagcctcttgaaaatacttctggtgcaatgaaaccgatggtacctcttgcttcagccattgagatggcactatccttgaggtggcaaagttttgccaatccaaaatctgcaattttaggacataagtcttcatcaagaaggacgttgtgaggcttgatatcgaaatggatgatccgggtgctgcaaccctgatgcaaatactccaatcctcgtgcaacgccaattgctattttctgtaaactttccaatccaatagctaacctcaaactctcagaataaatatacttccccaaagaaccgttagccatgtactcataaacgagggctcgcttagatctctctaaacaaaagccaagtaaattaacaatgttgacatgagatgtcctaccaatactagtaacctcatttaggaattcctctccattgcctttagccccttttagaagtttcacagcaaccatacggccatcttttagattacccttgaatgccgtaccaaacccaccttctcctaatttttccttgaaacatttcgttattttcttcaggtctgagtacctgtaccttttgggagacagagactggtatctctttaattcctcttctgtatttgactcatttccagtgtacttgtggtgaatgataaaaccaagtgtttgcttccgtcggtgcattatccaaacgagacacataaaaaccacgccagctgtagcggacaaggaagctggagagttatacaaaaaatgagtgaatccttgtcatacaagatgtgcttgtgttatgtacattatcctttgtaaatgtgaaaaatcttgaaaaatatcaggacaccaaaaaatttagttagcggtgttccaaaatatgacatttagcaatctgaggcaaaaataaatagcactagaattagtcattttagtatcacaataatagagcatggaatggagctggggtgccagcggaatcatgtgattctctgtatgttcacatagcttattcaccaacaaaagacatacctatcaaaattgccctgacattcagcttccgattactccaatctgcaacaaattacggttaaatcaatgaaaaatttcagctgttaaaacatgcaaaggaataccgattgaagaaaagctcacattcttttttatatcaattcgatttttatgtaagctagctaggcttaattgtgagatatataacggttctccgtactgctctaatgtctgacggttcgtggagtcgtgtagatgatgtgtgttgggctcacttcttattcatgaataaaagcacttttttttttctaaaaaaggccacgaacagtttatatacataactgcatctaaattaacaacggctactatctgacacagagagaaactcagcaacaccaaggcaacaagctgtctgacattggaaattcagaacagtagtggatctctggattgcatatttgcattgatgaaaaagagagagaaggaatttgagggcatctctttggagaaattgaagcaccttcctgactaagtgtcattggctgccaagccagcttccggagacatccttcatcaactggtggatgaatgcaagaaaatagttccctcagaagtagagaaaaggctttgacacagtcgtcatcttggtcgcctggtcaatttggaaagagcgcaataacagggtgttcaaacatcgacagcgctcgtggagggaagtggccaaggacgcagttgatgagtgctgtgcgcccccccccccccccccggggcggtcgtttaagtaatatcgcaagagataggcttcttgttaatttccattttcctttttttaagtgttgaccgttgttatctcaaacttctctaaatcttaatacaaaagatgcacaagccttttgtgcattctcgggaaaaaaaaaacaccttcctgacttcggtaagcctagcggtacagttttgtaatttgaactttgaagcactatatttttgcctggtctattttgttactagattggtaagagttgtagatgttggactgctactaatgaattcaaacagaacatgtactagaagcaagtgtgggagagtactgaaattagtttcattgtcttgaaaacgaaaattgggagagcgttcttacatggagatgtcgaattcgagcagatcaacccgtggcagctgacgcactggaacataagttgttggaacctgcactccccgccgtttcttctgcatgcgtcgcagtctggatctcttgttaccgccctctgccactccaagacgaacccatcactgatcaatcgctcgtactgttgaattgacccattaccatttccaccaatggacccaccaccatcaccatgaatgatagttctaccaccgatcgtatcagcgatcaattgctcgtagtgttgatctaacagcttcattccatctccaccacgcaccggcaagctcacggagatgcagttccctggaatccccgacggcggcgtgctgttccaccgatcggagatgtaagctcccatcgtcgtctggtttgcatatggccgttgcagccgagtgtcatcaggaagcgtgcagttgtagacgacagatgttgctgatgatgaatgggtacggagtgaggctggatgtcacgttgaaatccgggatggggcagtcggcgtcgccggcgaaggtggtctgcacggctgccaccagcgaactattctcgtagaatatattgtcgatgcggaacaggtgctcccggaacgtcctgctgaggaaggcgtggccggttcggttgtcgcaggtgaggtccaacaccgggtagccgcagtagagcggctgcacgccgctgagcgagaaggggtacgtgatggtcaggttcccgcatctcgccggcgcgcagcttgtgttgttgttgctgctggtctcgttgccaactgctgctgcgacatgcagcaaggaagctgctatgatcatggctggtaacaactggaaggccatctcaagtgtttggtagggactagggactggatcactggagattggagtgatcagttgttacttattcttgctggtgagatgagaagaggatcggtttacatttctccaacgcggacccgtttgggcgctattcattccatggaattactacatttcaagtccggctctgctggaactcttgatcaccaaatactagtgccaacgcatactgacccatctttggttgaattaactatcctgcgcgtggaatttgctgactaatgtactttctccatcctagaaaaagtgaatctaatattgaatacgacatatttagtataacgaatctaaatataggtattgtcgaaacatgaattcggcaataataaaaggggtagcgcacgaaacctaaaagtggatggatgcggagacaaaggatttagacaggttcaggccctctcaatgagaggtaataccctactcctgtttggggatttgaatccgccgagtgtatatagatctgacgatctagttgtctcatgccccctagagggcttcctgcccaccttatataggatggggggcagaattacaagatagaaaccttaaccaatacggtataggtttcctaaatctaatttacaatattatcaaactaggactttaggccgttccataatatacagggaaacgtaatacccaagtcatgatccgttacatattccatagatataagttatcccctataaccagtcgaataaccatgccatgtgggtatggggtacccataatctccacagtagcccctgagaccttcacagtcgaaaagataatcttctctcgaactagattattccaaagccgagtgcttcaatcatcttcgccttgatctctcgagtactttaatcaaatcagaagactgtggagggctgaaaaataaagtcaggtgcatcgactagatgcacctaataggtgtagccctcgactgtgtggttaattgaacaaacaaagcatatagtcaaggaataaataatccaaccaaccgagtggcttcgataattatagtcaaccaagcgactcgatattaatatgtagcatatgcggtgtgaatccctgaataacatgatccgagtgatataccgactgctttgtaaaatatgataagtgtaacctaaagttggctacatcattgaaaattcacatagcaaaacagctataaagaagcttgtatgttgtgaataaagaaatttccaaagtattgggcatacgccatgcgcacactactttaacagatgtgcttaagtccctaaaagacacatggtttcaccacacctgaaaatatatggcatatgtggtataaaatccgagtaaataaactcataaaggatttaacaaccgcctggaaaatgaccaaaatatataatcagcctaagccataatattggtcaataaaagtgcacacttacgtggcaaaaagcaatgatattgtatcgaatcaattgctttacgaacccaaacaacgccttgacttatataaaaaagtcagcgaacagctatataaagcattactgtttggcaccttttaaaatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgagctgcagacatattaggcctaagccaaaaaaaaatatgctttcgacaccctttaaaggatgacgcatgtaacatgctcccgagtgataaatcttccgggtgatatagaccaagtacagctcatatgaatagcttctgatctgagtgattatcccttatgggatactcccaaatagatatagtaattgaatcccgactggcgcaagtattcggttgataaccctgacggggaataataaatagtccagtctttgagcatagaaaataaactcatgatcataaattcatgttgcatgtatccggaataagtccaaattgaaggtatgatacttgtgtttgagctagtaaacccctgagcatatagtttgtccttctatcgtagtcacaattgtccattgaaggtagctgacgcagttagcatagagacaagacgaccaatatagagataatattgcccaccagaggtggcaaaaatattggtggtagtgaagatagtgataccaatcaaaagtgatgaagttgcacagccgtggaggcgaagaaaccagtcgacaacagtcaggtcagccagcaatgaataggaaggcgcccagtgataaagtgacatgatgaagatgacgatgtcggcgatccagtcaatagtagtgtcgcaaccaatgataatgacgaagacgctcatcagcatttgcatagtaggtcaaccgtgaaggtgaaataataagtcggtgaagacataatcatccattagcaacagcggagatgtcagggccgatgaagcagaggtgatggtgatgatgtcagtgacaataatctatcaaactgttgagaagatatcaaagcttgagaagtttccttgatgtgagcgtgtgcataaagaagactgatgcaacgccccttgattaatgaagatgacagtagaacttggtgttatagctgctgcaaatgcttcacttggaggaaagtagatgttgttgtccaactcgtcaaaactgagttgattggttgataactccaaactctggtgtaataatcggagtcgctgaaattaaatgtcggctctgaagtgaagacgaagataataactccccgagttgactcgtattgattgattgcttcatcttgacataaagcttgtcgaattttgagccgtgtatttgtgtagccccccgactctttggttagttgggaaacacctgaacatagaatcgaaaactatagtttcttgtcgtcaagtaaccattgcttgagtgaagatgcatgttgaagatgtccgagtagaattctcttgtagtcgtcgtggttggtgaagtagcaaggcttgcgaagtagaggcaatagagtttgccggtgccgaagataataaagatgaaatcgctctaccatggtgacaaagcaatcaacgacggaagaagtagaatgatgacgaaaacgcgcagccgtggaggtgaacaagccagtcggcagcagacgtagacagcttgcgttgaatgtgatgacgcttatttgcggggcggcgacgcgcagccgtgaagacgcccaacaacggcggcataataggccagccgtgcaggcggaaacaccagtcggcggcggacgaggcggccggtcggtgaagacgtggacgcccaacaacggcggcataataggccagccgtgcaggcggaaacaccagtcggcggcggacgaggcggccggtcggtgaagacgtggacacccaacaacggtggcataaaggccagccgtgcaggcgaaaacactagtcggcggcggacggaggcaagccggtggtgatgttctgactgatccattcctgaagcgtgggagataagcttaaagccattaatccctattatgcatatctggatctggatcctgcagaacaaatatataggatgagtagtatctgatgtaaatataatacttgaggaaaattcaagtattttaaaatgtttataagtatgtatttctcctctcgtcaattttgatttccccgagcagatgactcattacgtttaaacactctgcccgactagtcataaccatcaagcaccgggagtcggcctaggcacttcccaaacatgcatatgagtgatatgagttcgtcattaatggaacaaagtttcacggatcggagtttactactcgggtacttttgcaattataaagagcagaaaataaatttatcttatctctatgcttttgatttattccaaataatacttagcaccttgtgttactcggtccatccaacgagcccccgggtgctaggaatcggcccaaaggcaactatccattggcaaaccaaacggaaagcataggaaaatggaactccataactcgataggcacttttgtactcagattatgtcgcaagcaatcaagatgaatattatggaaattattaaaaaatatgatataacatctgtagccccccgactccctagtcaacggtgaaccagttgatgtagtgaggcagagggaaaggaaaatatcatataaggaaaaatgatgatgacttagctttgtaatattccccttgatgatggcagaggtggccaatgtggaatcaaagtcgtccatcaatgacaatgaagaaatcaatcggcggcgacggaggcggtcgacggtgaaagcgatgcccaccaacagcggcataataggccagccgtgtaggcaaagacaccagtcggcggcggcaaaggccagccggtcggtgaagacgtggacgcccaacaatggcggcataataggccagccgtgtaggcggtgacaccagtcggcggcggcgaaggcaggccggtcggtgaagacgtggacgcccatgaacggtggtgtgaccaaccaaccgtataggcgaggacaccagtcggcggcgacggaggcaggccggcggtgaagtcgtagacgtccaatagcggtggcataataggccagccgtgcaggcgaaaacaccagtcgacggtggcaaaggccagccggtcggtgaagacttggatgcccatgaacggtggtgtgaccaaccaatcgtataggcgaggacaccagtcggcggcgacggaggcaggccggcggtgaagtcgtagacgcccaacagcggcggcataataggccagccgtgcaggcgaaaacaccagtcagcggcggcaaaggccagccggtcggtgaagacgtggatgcccatgaacggtagtgtgaccaaccaatcgtataggcaaggacaccagtcagcggcgacggaggcaggccagcggtgaagtcatagacgcccaacagcggtggcataataggccagccatgcaggtggaaacactagtcggcggcggcgaaggccagccggtcggtaaagagatggacgtctatgaacggtggtgtgaccaaccaaccgtataggcgaggacactagtcggcggcgatggaggcaggccggcggtgaagtcgtagacgcccaacagcggcggcataataggccagctatgcagacgaaaacaccagtcggcggcggcaaaggccagctggtcggtgaagacgtggacgcccatgaacggtggtgtgaccaaccaaccgtataggcgaggacaccagtccgcggcgacggaggcaggccggcggtgaagtcgtagacgcccaacagcggcggcataataggccagccgtgcaggcggaaacaccagtcggcggcggcgaaggccagctggtcggtgaagacatggacgcccatgaacggtggtgtgaccaaccaaccgtataggcgaggacaccagtcggcggcgacggaggcaggccggcggtgaagtcgtagacgcccaacagcggcggcataataggccagccgtataggtggagacaccagtcggcggcggcgaaggccagccggtcggtgaagacatgaacgcccatgaacggtggtgtgaccaaccaaccgtatagacgaggacactagtcggcggcgacagaggcaggccggcggtaaagtcgtagacacccaacagcggcggcataataggccagccgtgtaggcagagacaccagtcggcggcggcggaggcaagccggtcggtgaagacgtagacgcccaacaacggcggcttgatatgccagccgtgtagacggagacaccagtcggcggcggcgaaggcaaaccggtcggtgacgatggctccagcagtacatgtaaagagaaaagcaatctctaattagcatcaagaaaattaatcttgtgtacgtatgtctgcatatatgaagcatgcatatattttttgattggccgattgatctcctgtagcatgaacagtacacgcatccacacatgcacgtcaccagacagattgcaggctgccatccgtgcgtacagatcacgggtccgagtccggatcaaatccaacttggaggctttacgtgatgggaatcagactcaggtgaccatggcgcatgcaaaataaggaatcacagatcaaactgagattagaaaattaatctaatctaatctagttagtacacactagaagattaattagaagtatatgcatgcatgattaggtagatcgtgcatgtatgttgatctgctgaatcaactcatgcatgcatgaaatttctccgagcaagctataggcggctgctcccatgtgcccgtggtggcgtggtggccgcaacgcatccgtcggcgctgctcctggcgatcgccgtcaacagctccgttttaacctcagccgaccagccccatagaaagcaaggaaaacaccagaagagcaaatcacaattagaaattaatctaataacagttagatcaaaacgccgaacccgactgaagatttgagccatcgagattaatctcgccgtttcttctgtagttgattccatcacacttttcgatgggtaattcgacgcagcccctacctgacgcgccaactatcgaaatatgaattcggcaataataaaagggggtagcgcacgaaacctaaaagtggatggatgcggagacaaaggatttagacaggttcaggccctctcaatgagaggtaataccctactcctgtttggggatttgaatccgccgagtgtatatagatctgacgatctagttgtctcatgccccctagagggtttcctgcccaccttatataggatggggggcaggattacaagatagaaaccttaaccaatacggtataggtttcctaaatctaatttacaatattatcaaatcaggactttagtccgttccataatatacagggaaacgtaatacccaagtcatgatccgttacatattccatagatataagttatcccatataaccagtcgaataaccatgccatgtgggtatggggtacctataatctccacaggtatgtccaaattattagtactagaatatgttatatctagtcctaaattgattttatatgagacggagggagtatggttcaagctttagagaagtgccctcggacgagggcaacccataattgaccaagtctaattctccaagtctactctaagtctaattctccaaagaagaatgaacccataactgtgactagaaaatcacattccgcgatcgagactactcgtcatatattactgccttaactacattagacacgtggttcaggcggtaattctgaaaaaaaaatcattacaaatgcacggctgcagagagaagacaacatactagtgcttctttttgagctaggaagacataatactccctccgtattttaacgtatagggcagctaccgtacgggattccgttgcaacgtagcagccacgggataagatctccattaccttatctccttcctttcccctccacaaactctctctcacacaggagaagaaaacgagagcgcggagatgaagctggacaggaggaaggggtcgtcatcgtctccggcggccatggatgacgacgtcacggcgtcggtgaggtaggggcggcgtcgagggtgatctcgccgcacctccacgacgtcgtcctccgcccgctgcggcgccgcctccacacgctgtggcgctgcttcttccactagcgctctcgtcgctgccggcgccggggcctctcccctcctccctcgcgctcctcgccaaggtcgccgtcgtccttgtccgctactcccgccgcctccttgccggtgagcgcaggtggctcctcctccgccgccacagaagcagaagaagccggcggtctcctcctctccactctgatacctggtaccttgggtataaggtatctggtacctttggtacctggtacctctggtaccgactgatacctttggtacctggtaccaggctagtacctagtatctagtaccgtgatacttggtacccgtgatacctggtacctgatacccgtgatacctggtacctggtaccctggtgcttggtgcctggtacctgatacccgtgatacctggtacctagtagcctggtacctggtaccctggtgcctggagcaggaagagagagagaaggaggcagccgcgtggagcaggagaaggaggaggcgcgcgaatccggtggtcggcgaggcgaagcgtggaggaggcagcggcgaatccggtggtcggcgaggcggggcagccgatgagaagaccgacaagggcggggagccagagcggcgctgcaagggaggcgagcttgaggacgacccttgccgaggccgcgccgtcgtcgtcctcctcggcggccggggtcctgagccagcagcggcttccccggcgccggcagcggcctccgcgccaccgctcccgctctccctcttgttcaccgcacccgtcgccaagctcctcgtcgtcgccgcctcccccgcggcggtggccgccggctccgacgaggggtggggcgagggcaacggggacgacggcggccaccggctccgacgagtggtggggcgacagcgatggggacgacggtggccactggctctgatgatttgggggagaagagtgaggtaggaggaggggatcgatccggattactatcccgtctccacaggatgccgtggaatagattttctgtttaatgtatgacgtcgttgacttttcgatcaacgtttgaccattcgttttatttaaaacgtttgtgcaaatatgaaaatatttatgtatgtttaaagaacatttgatgacgaatcaagttacaacaaaataaatgatagttacataaattttttcaataagacgaatggtcaaacgttagataaaaagtcaacggcgtcatacattaaaatatggagggagtagcttggagttacggtccctacttataactgacttaactgaggttgtgtttggcagcggcagttggaaactaatccctagtgcacgcgcaaaatagagagactcattaacacatgattaattaggtattagctattttttaaaataatgaattatatgactttttaaagtaactttcctatagcaaactttaaaaaaacacatcgtttatcagtttgaaaaacatgaaagaggaaggtgaattggaaaagaagggaaagaacgccgccttagaccttgtttggagataacaataggtatagaataaagggacaattgcttatttgaccctattttgaactgtaattgtcgatttggccctactttttaaactttgcttatttgaccctctttttcgagtacgaagcttccgtctgaccttcttttgatgactccgttagggttcgatttttttttaaaaaaagaaaatgtttcaagagttcctaatgacgaaaataccctccaaaccctattttgactctctctctctctctctcactcgtgcctcacggtctcagctctctctcactcgtgcgtgcagcggcggcgacgacctacgcgtgtggcggcggctagctaagggggcggcggcggcgagctgagggggcggcggcggcggcgtcaagcactgccccgccagcgcccactcgttgtggtggagggcggcggcggcggcgatctgagggggtccgagtcggcgccgatctgagggggcggcggcaacgatctgtgggggcggcggcggcgagctgaggaggcggcggcggcggtctgatggggcgcggggcggcgccgatttgtgggagcggcaacgccgagctgtgggggcggtggcgccgagctgtcgtggcggcgacggtgagctcgatgacgaggaggagcaacggtggtggtggagctcaggccatggcggtgtgcaagcggtggatccggtggctgctgggtatatgagccgcagatctggcggc

SEQ ID NO: 80036 - DNA, 868 bp, Oryza sativa
cccgtcaaggtgtgagtttctaagcactcgtccccagctggagctagcgtgttacatccagagatggcacgttaactccgatcgatatataccaggcttcatcctaaccattacaggcaaggtgttacacaaggaagggcaaacatgcatgttgttaaactgacgcgtggtggacaagaatgaccggtctggcactggtcgcgtcagcaacgggcagccacgatcccacgttgcgcctgtcgtcgccgggagtggaggtaggtgtgggctgtcccatcggagtgtcattcggacagcaaccataccaatctccgtccataaagagaagaaaagtccagtttggaaaggggaggggtgcatgtggtatccccttgaagtataaaaggaggaccttgcccatagagagggggttgggtggattcttttccagatttagagcttagaacggggggggggggagttggctcacactttgtagctcattcatacacaaatccacaaaaacacaatcgggtcacccataaccctcggtcaccacgttcccggcctggccagtctcgacatgcggatctccccaggcactagccccgacccgcgcttttcgaggactgggacttgggcacgggcccttatttcaagctaagacacaaaaagaccacggcacagatcatcctcatctcatatatagcaaaataaaactaatacaaaatttttttcatcatttctcattgcagattaagttaaattgtacaaaaaagaggcatgaaggccttagaagaaagaacaagaaaaaagttaagattggcgggggcctgggggctcattcaaatgcgcccgggtcgccggcctcgttgccaccgtcgtcctc

SEQ ID NO: 80037 - DNA, 15898 bp, Oryza sativa
agaccggcgacccgggcgcatttgaatgagcccccaggcccccgccaatcttaacttctatcttgttctttcttctaaggccttcatgcctcttttttgtacaatttaacttaatctgcaatgagaaatgatgaaaaaatttttgtattagttttattttgctatatatgagatgaggatgatctgtgccgtggtctttttgtgtcttagcttgaaataagggcccgtgcccaagtcccagtcctcgaaaagcgcgggtcggggctagtgcctggggagatccgcatgtcgagactggccaggccgggaacgtggtgaccgagggttatgggtgacccgattgtgggtttttgccgattcccccccggagttcaccacgccccggggcacggctcggttctgggccccgtttggcgattttagctgaccgaaccgagcccccgagggcaaggttgagcacgagtgacattatttcaagtcaagattcttcaaaaggaaaaaacggcacagacacaacctttagaaaattgaaactgcttttattgaaatgctgaaataaaggaaaaagggatatatgtgcatgtgtggtagcccccggccaatcctgcacacccgaggggggtgcggggttggcccgagccaaaacctgatacccgacccccccccctttcaggggtagagtagaagcgacgaaggtgttcgatgttccacgggtttggcagctccgtgccgtcgcccatggccagccgtaccgagcccggccgggggacaccgatcactcgatacggaccctcccacattggtgagagcttgctcaatccagcacgcgtttggacgcggcgtaggatgaggtcgtcgacgcagagtgatcgggcccggacgtggcgctgatggtagcgccgcaggctctgctggtagcgcgcagctcggagggccgcgcgccgccttcgttcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatgttgaaggtcttggttttgaggcctttaaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgatcgcaacatacagatactcaaacccgcccggggctcgtttgaacggtcccaggatatcaagcccccagacagcaaatggccatgacagtggtatgatctgcagggcctgggccggctgatggatttgcttggcgtgaaactgacacgctctgcatcgccggaccagatcgactgcgtcattgagagctgtcggccaataaaatccttgacgaaaggccttgccaaccagggtacgcgaggcggaatgggctccgcactcgccctcatggatgtcagcaagaagctcaacgccttgttcctgaggaaggcacttcaggaggattccgtttgccgcgcgccgatagagggtcccttctaccaacacgtagcgtttggaaatgcgttgtacgcgttcactcccttcgcggtcctcaggtagagtcttatctgcgaggtatgtttggatctcagagatccaagcaatcaatctaaaggagcttggagcgctcccttcgggtcccgaggcctggactccgacgggcctcgggggccggtcaggcgcatccgtctcccctaaggggtcgggtcgcgccgacggctgagtaagcctttcttcaaaggcgcccggtggggtctgggctcgcgaggacgcgagccttgagagttcatcggcaatcatattatcccgtctgggcacatgccgaagctctatcccgtcaaaatggcgctccatacgccgtacttggcgcacgtaggcgtccatctgcggatcagagcaccggtactccttacagacttggttaacaaccagctgagagtcacctaacaccaggaggcggcggatccccagcccggccgccactctgagtccggcaaggagtccctcgtactctgccatattattggtcgctcgaaagtcgaggcggaccaagtatctgaggacgtctccgttcggagaggtcaacgtgacccctgcaccggcgccctggagagacaaagaaccgtcgaactgcatcacccagtgggcggtgtgaggcagctgagaggggttcgtgctggcctcgggtattgagacagtctctggagccggggtccactctgccacaaaatcggcgagggcctggctcttgatagcgtggcgtggttcaaagtgcagatcgaactcagaaagctcgattgcccactttaccactcgtcctgtaccctctcgattatgcaagatttgaccgagggggtaagacgtaaccacagtgatccgatgcgcctggaaataatggcgcagtttcctcgaggccatcagaatagcgtaaagcatcttctgggcctgtgggtatcgggtcttggcgtcccggagggcctcactaacaaagtagacaggccgctgcacctttcggcggggccgatcctcttcgctagggaccgtacccccggggcgttcttcgtccgagtggcccctcggggcgcactcgtcttctgtgccgatgacctcggggtcggaggacgacaggagcggccttcccacagtggcctcggggccgtcctgggggtcgggggctcctggcgtcatcggacaagcgggcaaagggccaactccggtcgtcaggggccttaggccaccgttcggcttgggggcctcttctccctgctctctcccgggtcgaatcggtacagggttagcctcggggtcagagggcgataggtgcggcctccccgcagtggcctcggggccttcctgagggtcgggggcgcccagcaccgtctgacgagcggggagagggccgactccggtcgtcaggggccttaggccaccgttcggctcgggggcctctcctccctgcttgctcccgggccaagtcagcacagggtgggggtgcgcggaatgaggattgtcttcatcgcgctccacagccaacgctgcactaactacttggggggtcgccgctaagtaaagtagcaggggctcatttggctccggggcgactagaaccgggggagagctgagatatgcctttaactgagtaagggcatgttcagcttcctccgtccaagtgaacggccccgagcgcttgaggagcttaaacaagggaagcgccttctctcccagccttgatatgaaacgacttagggcggccatgcaaccagtgacgcactgcacatccctaagtttgctgggggggcggatccgctctatagctcgtatcttctcggggttggcctcaatgcctcgggcagagaccaaaaacccgagaagcttgcccgcaggtacaccaaacacgcacttatcggggttcagttttatgcgggcggagcggaggttctcaaaagtttccgctagatctgagagtaaggtctcttggttgcgcgtttttacaaccaagtcatcgacatacgcctcaacattacgtcctatttggctacccaaagaaattcgagtagtacgctgaaaagtaggacctgcattctttaatccgaagggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcacggatgaacccggcctccaaaagtttagccacctcctcgcggatgaaggcttgacgttccggggcttgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggccatccgctgcctcggggcggtgggggcagaggggccaagcctctcgtcaccaccctcgggcttggacgcagcagcgaggcggtccgcgcgctgctccatgcaagcaagcgcggctttaaggtcgccacggacagagatggggccaccggggcccggcatcttcatctggaggtaggcgtagtggaccgccgccatgaacttcaccaacgcgggtctccctaggaccgcgttgtagggcagactgaggtccgccacatcgaagctcacccgctccgtgcggaagttggcgggtccaccgaaggtgaccggtaggtcgatgtgacctaatggccacgtgtgccccggcgtcacaccgatgatcggttgagacggctggagcaccatccccggggccttgatagcatcaaaggccgcgggggaaaggatgttgagagccgctcctccatctatgaggacacgtcccaacttcacgttgcagatggtgggggaaaccaccatcgcagcctgccctccccgggcaatgcacggtgggtggtcggtctggtcgaaagtgagggcaacctccgaccaccgcgcccgacgcatcgcctcatgggtaggggccatggccagaagctctcgcttcatagccttgaagctccggcgagagacgtgagcacatgctcctccatcgacggtggcaatggtggccccaggttcttggaaacctaggtcatcatcaccatcatcgatgtcaacagcgggggccttctgcttggcctcacttcgccgtttgccggaaggaaccgccggggacttgccctcacggcgttcctgcctcctgtcctcctcccatttcctcgttcgctcggccaggtttttgaccgcacgacagtccgcgagatcgtggagggaggtgttgtggacagagcaccacctgccggcgaggcgctccctgctgggtgtaccagcctcgttctttttgtcgctcgcaggcctcccctttcgagtggcccgcggagcgccctcgacggcgaggacatgaccctcgtcgccggaacggtccggcctcttcttcctcctcctgtcacgccgccctgtctgagcggcggatccgggggcggccgaagctgccactccggaaccggaggagttccaggtccaggcctcctccttacgagccactcggtccgcgagctgaaaaagctctgcggtagtctggggctctttggaggcaatcttttcgagcatgcggttgtgccgcacaccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcgggccgctgccatgcgtaataccctactcgtgtgtcttgcgggcagacgatctttccagatacagagggagagcgagagcttgagatctcaccctaagcccccggccgaactggcaaaggggggcctgcgcggtctcccggtgaggagccacgagctccgtcatctggcgcgccaggtagggggctcagcgtgtgttttctgagctctcagactcttccgtgtgcgccaagtttttcttgttcagcctaatggccgagcaaggaaaagcgcacgacctctctccgagtgtgagcggcgacgacggggagccgaatccacgccgtcgagctcgtactcccccacctcctccgcgccaaagccctaagcagggggaggcgcttgagagggtcgacaaatccgtggcatcaccagtcgcaggtgatgcaggagaacggcgagatggggagcgtcgcctcctcgtctacggcgacggcagcacgcctcagggtgcgcttcaggctgctggcgcgctcctacgacacccgcctgtcgtccctgacccggagtctccagcccaacgatggctggaagacgtggccaacttggtcatgacggcacagcagcgcctgggtgctggtggacggtccgccaccaccaagacctccggcgccgctaccaccggctccgtgtcatcaaggcggagggcgcggcgagcggcggcggctgcacgtcatccagggagagaaattggagtcccgggcctggtaactcgctagcacgagttcaaccgccccccgggcgaggtccctcgaggatgacttgatggtcttctcgagctcctcggggagtcgttcgaggacccaggccatcctgttgaggtgcggagcgaggccttccagattggtggggggcaccgtcgtctggcctctccagaggcctgcttgccgaccggcgcgcttcatgcgggagaccgcatcccaaagcatgtcgggcccaatctcgcccgccaagcgaagggcctcggcctccccggtggaggagtccagcgctcgctgcatttccgcgacggtgtgttcggcagctgcgaggcgggcggctaagtcgctttcgcccgcggccgccccgccgataggcgcccttgcgtccagctccttttcccgcgcctcgaggtcagcagcccgctgctccagtgcggctctctcggcgcggacgcattcgagattgcggcgcgcctgctcctcctgcgccgcctcgcgaagggacaggctgtccgccagccgtttggtcctggcctcagcctcctcgagagctcgctcccgctcagcgagtgcgtcctcgcggaggcggagcgcgcactcctcctcggcgcaggcggcctcatgcgccgccagcgtcgcctctcggagaccagcggcggccttgcggtccgtcaagcccctctccacggcgccggcgtgttcttccagcgccatggcacgggcctcaagggcctcctcgcgccgccgaaacgccgcttcagtctccgttacccgccgctctcgggcagcggcggagtcaaggaccccttgggcggcgtcgagctttttcttcagctccgcctcccagcttgcgtgctgaaggcggagagtgtcttgcgcctcgatcatcgcggtggtagagatgagggcggccgcccgctcctcctccacctcacgggcgatctccgccagcgccgctttccgggcttcaagctccgagacatgacggcggtgagccttacggcccacctccaccatggcgtccaccgagcgccgcccctcctcaacacgcgcccatgcggcctcgagctccgctcgttctgcacgcagggcctccacttgggtgttgaacccatccagcactgcggtgtttgcggcggccagggcctgcagaaggggctcggcgctcagcggggcgacagaagatgaggagaagagccgccttggagaaaaggcgacgtggcttggccccccggaggatgcactgggctcggggatgtcccccgggcccgtttggtcctgggcgtcgcccggtgaggtaggcccaggcgatgcgcccgcggcctcgtcgcaagccgcctcggaggatgtcgcctgagggccgcccgagggagtaggcccaagtgacgcgccagcagcagctgtcgcctcagcctggcgagaccgggcggcctcctcccgagcagcttcttcggcttggcgagcccgggcggcctcctcccgagcagcttcctccgcttggcgaacccgggcggcctcccgggcggcctcttcagcttcccgaaggcgggctgcggcttcacgccggtcagactctcgcctccgctcctctgcggccgctggatcttcggcctcggactggccggatttggggtggcgggaggaatgcgacgggacatcgctgaagcagaagaaaaaaccaaaagacgaacaaaatgagtaagaaaaaacttctctttgggagaaaggtggttgcaatgagagtgagacgaacctgcgagggggtcggttgaatgaccaccttggaggagaaatcaggttcccccggcatggttccgtctcccccgtcttgcggagccgtttcttcttgcgctccccctcgggctgcgacgtcggcgcggccccctccgggcgccgactgttggcacgcgccgccccgccccctcggggaggagatgggggaggtgttcctcccagcttcctcttcccctgggcgtcggcagggcggctgctccccgagcccccggcgcggggcccagaagcacgaccccctcctggggcagattgttcccctcggcggcgctcgcccgcgccgtcgtggcccttaggggctctctcctctgaggccccgacctccatcataatggttagaatggaggcgcggtcgggatcgctgcagagggggaggatctcctgaggaatgcgagatgcctccgcggagctaagattcagcaccctttggaccacgatcttgaagtcctcgggagcccaatcccatctggctccctggtgggtccgcatgtagtcttcaggcccagtgtactcccaggcgttccgggcgcgccgttggagcggcgcaatccggcgacggaggtaatcgccgtacaccatggccccggtgagcccctgggatcgcaggcccgccaggcggtcgaggacggcgtcgtagtcctcccccagatctaccggtgcccgccagctggagacctgcgccgggggctggcttggaagtcggaggcgcgcttcgttggcgaggggggtgtagaaccagtcgctcttccagtcgtcccacttcttgcgaaggccgcaggggatgtagcggttcaacaccggcccccgcggctggaagtagcagccgccaaccaccgacggcggtgacaccgactgcacggtgaagaaccaccggaacagctgaagagaggggcgcaccccgatgaacatctcgcacagatgcgcgaagatggccaatgtcatcaccgcattgggggtgaggtgcgccatctggaggtcatagaactccaggacatccatgaagaaatgaggaaatggcgggaccagcccagccatcgcgaaggggaggaagaagatggaccgccccgggtagtctggtgccgggcgcccctcgcccagcatcactatctcccgaccggtggcggactccggcatgaagcggcgcggcagtccggcgtgcctctcattcacgatgcgggaaggcggtagtacactgccgtcgagcagagcagagccccgtgccatggcggcggaggaagagatgattgagaacgagcgcgtgtggcgaaagtagggcgtagcagagaaagagttagagctcaggtggcgaaggcaagaggaacaatggcgaaaggaaggaagcaaatccttttctcgatgcttttatacccttgccatcgctgggcctgactcctcgtttctcgcgcccactacctcgctccctcgtatctcgctatctcgctccctcgtttcccgtgcccacgcttccactaatcccattcgcccgcttacggcgcattgagtggatatgcggttgtggcaatcgaaatggattgtatcgtgcgcgcgttaattacgctcgccgaccgaagcggcgttaccatatctccgggcgagacgaatctgctcatccagattcgcgcgctgctcaagtggtgtggcagtcttgaatagaccgcccattatggacaaccaaagttaccaataccaatgtgcatggattgagaccgttcggtattttgcccaactacggagaccggtcccacctgtcacagggtggcgtcacacctgaccgcttcccttgggaagggaaattgctctggcataacgccgggggctactgtcggtgatatgggaccgggagtatcatgactagaggcttgaggcagacacaatcgcccacgtggcctggcaccttcggggacgtcgggcccgagggtgaggtgtccgccctcctcctgatttcccccgagggggggtcgggttgcgtttgccccggccccgagggccgaggcaccccgacccccttaaggaagtctgcgccacatatatgggataagtgagcacagctgtgctcacctaacagcatttattgcagtctggtcaagcgtgtcacactgcatgcagcgcagtacggcgcgttcctttatccggtctgtgaccagtcacagaccggtcagatcacgggttaggtggcgactggcggtctgacgcacgccttaccccatcccgtcaaggtgtgagtttctaagcactcgtccccagctggagctagcgtgttacatcccagagatggcacgttaactccgatcgatatataccaggcttcatcctaaccattacaggcaaggtgttacacaaggaagggcaaacatgcatgttgttaaactgacgcgtggtggacaagaatgaccggtctggcactggtcgcgtcagcaacgggcagccacgatcccacgttgcgcctgtcgtcgccgggagtggaggtaggtgtgggctgtcccatcggagtgtcattcggacagcaaccataccaatctccgtccataaagagaagaaaagtccagtttggaaaggggaggggtgcatgtggtatccccttgaagtataaaaggaggaccttgcccatagagagggggttgggtggattcttttccagatttagagcttagaacggggggggggagttggctcacactttgtagctcattcatacacaaatccacaaaaacacaggagtagggtattacgcatggcagcggcccgaacctgtatacatcgccgtgtctcgtgtgtcttgcgggcagacgatctttccagatacagagggagagcgagagcttgagatctcaccctaagcccccggccgaactggcaaaggggggcctgcgcggtctcccggtgaggagccacgagctccgtcagagtgatataccaactgctttgtaaaatatgatgagtgatatagcaaaatagctataaagaagcttgtatattgtgaataaagaaatttccaaagtattgggcatacgccatgcgcacactgctttaacagatgtgcttaagtccctagaagacacacggtttcaccacacctggaaatatatggcatatgtggtgtaaaatccgagtaaataaactcataaaggatttaccaaccgcctagaaaatgaccacaatatataatcagcctaagccataatattggtcaataaaaatgcacacttacgtggcaaaaagcaatgatattgtatccaatcaattgcttaaaaacccaaacagcaccttgacttatataaaaaagtcagcgggacagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtaacaggccacacctgaaaatatgggctgcagacatattaggcctaggccaaaaaatatgccttcgacaccctttaaaggatgacgcatgtaacatgctcccgagtaataaatcttccgggtaatatagaccaagtgtagctcatatgaatagcttctgatctgaatgattatcccttatgggatactccaaaataaatataataattgaatcccgactggcgcaagtattcggttgtaacccttatggggaataataaatagtccagtctttaaacatagaaaatagacccatgatcatgaatccatattgcatgtatccagagcaagtccaaattgaaggtatgatacttgtgtttgaactagtaagcccctgagcacgtagtcacaattgttcattgatggtagctgacgcaattggcatagagacaagacgaccaatacagagataatattgcccagcagaggtggcaaaaatattggtggtagtgaagatagtgataccaatcaaaagtgatgaagttgcacagccgtggaggcgaagaaaccagtcggcagcagtcagatcagccaacaatgaatatgaaggcgctcagcaataaagttgtgtaactatggcagcgaaataatcagtcggtgacagacgaggcaaatcaaaggcgatgacgaaatccaccaatcatgaagatgaagaaaatacttgacgacgacaaacgcaaccgacatgatgaagatgacgatgtcggtgatccagccaacagcagtgtagcaaccaatgataatgacaaagacgctcatcagcattgcatagtaggtcaaccgtgaaggtgaaataataagtcggcgaaaacataatcatccattagcaacagcagagatgtcagggtcgatgaagcagaggtgctggtgatgatgtcagtgacaataatccatcaaattaatgttataactgttgtagatgcttcacttggaggagagttgatgttgttgcccaactcgtctaaaccgaaatatttgaagttgttgaagtagaatgtctgctccgaagcaaagatgaagataatgactcctggagttgactcgtgggttgatgaattgacataaaatttgtcaaattttgagccttgtatttgtgtagcccccgactctttgattagttgggaaacaactgaacatagagtcgagaactgtagcttcttgtcgtcgaatagtcattgcttgattgaagatatgtgttgaagatgtccaagtagaaatcctgaatattggagagccacttgttgtagtaaaataacatggcattgcatgccgagatgtcgaggttcacaaagacgtcgtggttggtgaagtagtaaaacttgcgaagtagcaacaatagagtttcccggtgccgaagataataaagatgaagtcgctccaccatgatgacaaagttgtattgccgtaatgaagtgaacacaagtcggcggcaacagaagcaaaccggtagtgaagacgcgcagttgtgaagataaaagcaccagtcggcgacagcataaccagtcggcgacggaaaacgatgatgtttatcagtagtggtagctgtctaaaccagacgtagaggtgagggcactagtcagcagcagacgagacgaccggcgatgaagatggtaaggccaatcaacactggcagaatcatgcagccatggaagtgaagaaaccagtcggcagtcatggcaaacgtaggcagcttgtgttgaagatactgatgcctattagtagtgacagcgatgtagccggccgtgaagaagatagcatcagttggcgttataacaggccagccgtgcaggcggtgacaccagtcagcggcggatgcggcggccggtcggtgaagacgtagacgcccaacaacggcggcataaaggccagccgtgcaggtggaaacaccagtcggcggcggcgaaggcaagccggtcggtgaagacgtagacgcccaacaacggcggcataaaggccagccgtgcaggcgaggacatcggtcggcggcgacaaaggcaagccggtcggtgaagacgtaggcgcccaacaacggcggcataataggccagccgtgcaggcgaggacaccagtcggcggcgacgaaggcaagccggtcggtgaagacgtagacgcccaactacggcggcataaaggccagccgtgcaagcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaaacaccagtcggcggcggcgaaggcaagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgcccgactagtcataaccaccaagcatcgggagtcggcctaggcgcttcccaaacatgcatatgagtgacatgagtttgtcattaatggaacaaagtttcacggatcagagtttactactcgggtacttttgcaattgttaagagcagaaaataaatttatctcatctctatacttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaatttgtttaaaaaatatgatataacatcaatagcccccgactcactaatcaacggcgaaccagttgatgtagtgaggcagaggaagagcaaaatatcatataaagaatcaatgatgacttagctttgtcgtattccctcggtgacagcagaagtagccgatgtgggaacgaagcagtccatcaatggtgacaaaaacaccagtcggcgccagtggaaccaagccagtggtgtagataatgaagcccattaacggaggcgaagtccaccaaccgtataggcaaaaacaccagtcggcgccagtggaaccaagccagtggtgtagataatgaagcccattaacggcggcgaagtccaccaaccgtataggcaaaaacaccagtcggcggcggcgaaggccagccggtcggcgaagacgtggacgcccatgaacggtggtgtgaccaaccaaccgtataggcgaggacaccagtcggcggcgacggaggcgggccggcggtgaggtcgtagacgcccaacagcggcggcataataggccagccgtgtaggcggaggcaccactcggcggcgacggaggcgggccggcggtgacgtcgtagacgcccaacagcggcggcataataggccagccatgtaggcggaggcaccactcggcggcgacggaggcgggccggcggtgaagtcgtagacgcccaacagcggcggcataataggccagccatgtaggcggaggcaccactcggcggcgacggaggcaggccggcggtgaagtcgtagacgcccaacagcggcggcataataggccagccgtgtaggcggaggcaccagtcggcggcgacggaggcaggccggcggtgaagtcgtagacgcccaacagcggcggcataataggccagccgtgtaggcggaggcaccagtcggcggcgacggaggcaggccggcggtgaa

SEQ ID NO: 80038 - DNA, 5416 bp, Oryza sativa
acctgcttcaggaccttgaagatgtagatcttgtaggtctcgacgctcttcttcgccttcttcctccccttcttgtcgccggcgccgccctccttggacgacgccttcgacgccggcagccgcttctccgccttgggcttcttccccgccggcgccttctccgccgacttctcctcgccggctgcgggcttcttctccgccggcttcttctctgccttgggcgccatcggagctgcctctcgagggatcggctcaaatggagagagagagagagagagagagagagagagagagagagaggcgggattcgtgaggaggaggaagaccttttcccttcgcgtggagttgaggcaaaaggggaagaaggcctcaattatatataggcgcgtggtggaaccccattggtcgacatgggtgggaggcggatcgatgacgtagaatttctccagagccgttggatgcgggagggggagtgaacgctcgggattgtagtagtactaaacaggctacggcccgttgtgcttttgtaggggcctaaaatttggatgggctaatgggcccaactagttttgtacggcccaaattggcgtgatatatcgaggagaggttttttagtggcggcgatggagcagcggcgtcgtgtggccttggttgcttcggaatctcaccacccaacccgttcggattagatagcccgcttcctcctctctctctcagctcaccacacctcgagtcgccgccgccgccgccgctgctgctgcttacctcctccgcgccgcgcactccttgcactagcccatggcgacggctatgatggctgcgaccgccacctcgtgctcccctcgccgcgcgccggtcgtcgcgtcgtcgtccgtgcagccgcccaggcggcagcagcagcagcaaccgcggaggggattgaagcagctgccggggctcgtggcgacggcggccgtggccgtggccgcggcgccgctaccggcgctggcggagcagatggagaaggcggcgctgttcgacttcaacctgacgctcccgctgatcgcgaccgagttcctgctgctgatggtggcgctggacaagctctacttcacgccgctgggcaagttcatggacgagcgcgacgccaagatccgtgccgagctcggcggcgtcaaggacgcgtccgaggaggtgcggcagctggaggagcaggccgccgccgtgctgaaggcggcacgcgccgagatcgccgcggcgctcaacaagatgaagaaggagaccacccaggagctggaggcgaagctggacgaggggcgccgccgcgtcgaggccgagctcgtggaggcgctcgccaacctcgaggcgcagaaggaggaggccgtcaaggcgctcgacgcccagatcgcctccctcagcgacgagatcgtcaagaaggtgctcccatccgcgtaatggccgccccgccgccggccgttcttgcctcccaaacaccaaccatctctcgtaaagattttctccgtgttttatccgtgtgtatacgctgcttctcctaagaatgtaatttcagtgaacttctcgtgataagtataaaatcaatgatccttttgctagaaattggattgaaattataaactgctttaataagtgcttactgcattatttgtgaggattgtgaactgaaacaatatatcaataagttttttacaacttccatatagaaatttttttaaaaaaacacaaggcgaaattgcgcatgaaaaactactcttcgtcctttcctatagaacacaacctacttgaaataagaaggggaggtcgcgtaagtctatatggaggtgggagctctatacgcgatagttgtggtatagtgtgaggagagagacacactatatcacaacaattaatttcaattgcagcaaatttactttcttcaagctatcaaatgaacataagttgggataattgcaccaaatttactttcttcaagctataagtgcgcataagttgcgccaatacgctcaaacataagccggcaaggctggaatatctatatctgcgactgacaagcactgtcataaaacgataaaggatatgtaacatctattttagttttcaatagcgatactctactgctaccttgtcccaacatgctgggcttttgcttcagaagtttctccaatgatctggatggctcgatgatctatccgctggaaacgagttgttctctcctatgcgccatattttggaccggatggcgtgtaaccgcgtaactccagcccactctgctatgcggacctggtcaggtcgaacccgaacccagcagatcggtcggaccggggatatccgcagcaccgcaccagagccaaggcggaggtagggttttagccggcggccatggcgctctcctcctcgctgctccaccgcctcctccgcggctctacccccgtctcttcctcctccgccgccgcctcctcaatactccgcgccaccttctgctcctcctcctcgtccgcccccttgcccaccgagtcgcccctttcctccgtcttcggcgacggcgccgaggtcagcaacgtgccgccgctgaccgcccccaagctcttcatcagcggtaactctcccctccctttgtttcacatcacatttttctgcataagatggatatatttgttatgaagatgatttggggagcccgatttctcggtataatttgggatggctgtgtgtactgtgctgcgatgttatcatgttttatgctaaatcagagcaaactagtgtgtttgctttctacagatctgtctctgagtatgcttcttaatctcatgctctattctgctctttgtcaatatctttgcccgtatatgcttacatgaacaactgaacccactgactaataatacagctgagtcttgtcggcattcttgaggaagacatcatatcctgtactgtcgaattctattacgtttctatatttgttgttgcatgtactaatactacatttatgtatttgaattagactttattttttatgtcatgctgtttttgtttgcatgctcacatatgcctaatgtgatgcaacacaggcctttcaaggttaacgacggatgagaagcttaaaaatgcctttgctccctttgggcagctacttgaaggtacaaagcttgatccaagtagtaaatgttttgaccactggtagctttcttcacaactcatattgatgtgtgttatactgttatttattatcttttggcctcgtgtagcaaaagtcattacagataggatttctggaagatccaagggattcggttttgttagatatgctactttagaagaagctgagaatgctcggcaggagatgaacgcaaagtttctggatggatgggttattttcgttgatcctgctaaaccaaggcagcagaagcctgctcctcgtcctgacactgattcatcacacactggcttcacaacaaacaaaactgtaggatggtgtggttagtcactgtggtgttatagctaaaaaacttggatacacatgtttccatgcctcattacattccacagttgtctacatgtctcataatattctgtagttgtctgatagatatgtcattcacatggattataagatgttcatgatcattgttctaaatattgaacaccaaatttaccgccaattgtagaaaaaaaaatgataattgatgattcgtggagccacactattgtgttactttaacattccgtgccacccaattttgaaacttataactttgatttaaattagtttaagtgttcttttattattttctattttttagctttggcttctaaaccgttaagagtctaagtataaaagtccagtcctaagaatataagtttaaaagtccacccctaacattatttctcgttaatttcaaattagtttaggtgttcttttattgttttctatttttcagattcgacttctaaacagcgaagaataaaagtataaaagttcagtcctaagaatactaacaacagaagtatttccagctctaaaattatttttcgttgatctgatatgtcacggcttataaaactgcagtaaaaaggaactcagcaatcagcgacaaatcttctgccctgagatggtatgcataccatacagatacgggatacgggtacaagtgtgacaggatattaatatgcctaattgacattaagaaagtaaggaactgagaacatgtgtggcaaatgatgtacatcacacacgcaaccctctcagcagagtatataatgtcagagacgcttctattcttaggtacttcagcttcgaatcattcactcgacgttaatcacaaaaactactcttttttttagtatttcttttgccgattactacttgctaaaaaaatctactgagatgcctctactctcttctctatacatcttgagcctcgaaccatccattaaaaagatggcaggctacaaaaactgtcctgttgctctccaaaggtaacattttatcctaaaaaccgcgtaatcggtcttctcaagcaagtgatttctgcaccaagcttaggttcgcaaacatcaccaagggatgtgccatcagcatagaatgcttctgtcaacaagcacagcatcaatagtgcaatgtcagtactgttgttggagagattactgttgttggctagtacaagctaatgttttcagcaaccacaggtaatgcacaaatacaaggaagggttgtattacctgttcatctgacaaaatagtgtacccaagtttctcagaccagattggtgccatttcaggatcaacaggtgccgtaagaagacggacattccaggcctttaaatgcgcctcaattagacttagaagaagcgaaaaataaccctgcagagagacatgcaatggctgagagcaaatgcctttatcacttcaagtagtccgaaaaaaaaacataaaaagcctgattcgttaccacctgcaggctgcagttcggcaactaacaattgtgcaacttaatttttggcatggcaatagaaacacttccaaaatgaggctatctatggtagtactccaatatttttaaaaagaaggaactggaaggaacaaaaatgatcaaggaattccaggaatgcgaaaaatgctgcatgaagggtctgcttatgcctgtggttccataacaacaaaccaaatataagtcatgatcctttgttcaaaccacaatccaaatcattaaatttatgttttggcttaagctaaatccgatccattgttccgtgggtttctaccttttcagggaagaccatttgttaacatttccaagttaggtgcacagcatctctcttcttaagccaaagaataggtttgcctttgtgcaaatatgcaaactagattacaccagataaataacagagttcattatggactaaacagttcaaatatttcc

SEQ ID NO: 80039 - DNA, 11406 bp, Oryza sativa
ttttctaaccctttgtgttgatatcaaaatggatttgagtttagagcattatatggtagtagtaataatgtagtattaccggaccaatgaacattttacacagccacttccaatgcatagctatatggtagtagtaataatgtagtattaccggaccaatgaacattttacacagccacttccaatgcatactaaaagaaagttcatgagacagtcctgtaacagttgacggtctatcatgtatgcattgataattcaatttcgctagcagttccaaagtaataaaaaagttaggtcttttctaatcctaccactagagttctgtagctaaccacacaagcagtttgtattcactgttgaccacacaattcctcaaagattcagttacttgcgatacctatctagcaacaccacatctgatcattgtgtgattaatactgggagtggctacagtccaacgattatttatgtggtttctcatgccacagcttaattcatgtttacaatgatgtgcagacatctgtgaaagagaaactgcagtattccttttcttctacctgattgctccatgatgttgccaatgatcaatatcaatgtataccatattcatttgtattgttcgtgcaatatattttattatgtttcatttaatgtgtttgctttatgcagtatatcttcatcagaccttgtttcaaaatggatgggagagagtgaaaaacttgttgcaaaccttttccaaatggctcgagaaaacgctccttccattatcttcattgatgaaattgattcattgtgtggtcaacgaggagaaggaaatgagagtgaagcttctaggagaatcaaaactgaacttcttgtgcaaatgcaggtgaattttagcttatattattaacttttcttaatcaggtgcctgctacctgaatactttaaatgtgtacttggacgtgttattcttagaatgataatgatcctgaaagttcagagcttcaattggagacgcacaaaatgctgttatatttgaaacttatatagttcgttaaggatcaagttattgaaacagtgcttctaacttgtatatttgaggggcaaaaaggaacatggtatattttcatttcacattttagttctaagatttgttgccacaccgttttagctaatactggcgtactggaccggctacttcctctaataccagtaggtttctagtaccaagtccaaacagagttgtactagtatcaggtgtcttagttagggatattagccaggccagatctgaagctattccatccagatttggaatcataaaagtgaaaacgtgctaaatttccaagtagatcagatgcgaattggctgattagttgctttctagatacatggatattgatgcatggcttgaccgcttgaccataataatcgaataccacatttgatgggcttcaaatactgtccatcttttcttagagcatgtatcatgttattccttgttatctgaagcattccatggtttgttaaactatttagatgccctttttgttacaccaacttacttaccttttgctttgtttcgctggtgaatgtccagggtgttggccataatgatgacaaagtactggttcttgctgctacaaacacgccatatgctctagaccaggtttaagaagatctataaaactgtgttgcaccattcagaactgtcaaaattctcttgttccattgaacaatttagtacttacttaaatccattatctcaggctgtgcgccggcgctttgataaacgtatttacattccactacccgacctgaaagcaaggcaacatatgtttaaggtgcagaattgtccaattcagtttcaagaaaatgtcatgttctgttgttacaatctttggctgagggcaaacctttaatttatccaggtccatctcggggatacaccacacaacttaaatgaaagtgattttgagaacttggctcgtcgaacagacgggttttctggttcggatattgctgtttgtgtaagttgttttctgcaacattctcatgtatccatgctctgttagcatatactgaaatctcgttgctcttttttctttcaacaggtaaaggatgtgttatttgaacctgtccgcaaaacacaggatgccatgttcttctttaaggctgatggtgatatgtggatgccttgtggaccaaagcaatctggtgccgtacaaacaaccatgcaggagctcgcatccaagggccttgcagcaaaggtaagattgattgacatttcctccactgcgcatgttagaagaggcttctgatgattagcaagatttatttcctgttatgtagatccttccaccaccaatctcaaggacagatttcgagaaagtcctcgccaggcagagaccgacagtgagcaagaaagacttggaggtgcacgaaaggtttacaaaagaatttggcgaggagggttgacaagattatgcgcactcacttatgcatagctgctccacagaaatgtatattttatgacttcgattgttctggttggaagttggattcacagatttgtacaattgatagcctaactatgattaattacaacctgtttattgcgttaggctatcattgctcctctgtcgtcaacttatttcatttttactgtcacttatacttgaaattttccacaagtgtattaattaaggaataatacttaacgtggagcccttgtggtgcagcttgtatagtttgttctcctctggtttccgattcctgtcatttttcggttctattcagtgcttgttctttgcccaagttttatttggcccccaatcgatcaggtctggtattcaaccctcaaacgatctccttttgttcatgtgagtttggtaagtacttgtagaggcttgtagcaatgattccttcaattttaccagacagtctctgttgaatgcaacacgctggttctgaatgttttggcccttttcatctgatcaataaaagctgttgtaacttgtatctcaacatttggaatcaactgtcgttatcatttcatctgacgtgctttgtactgaacacgtctgatacggttggtttggcctcatcagggtctgcccatagtactattttttgtccaaacttgcttggtaaaattcattcggtttctcgctgaaatgtactgaacctgaactttttgacaggccggtttgctggagtggaggcccgtgattctgcagtgcaaaacccatcttatcatctgcgtgcactcctaggtactacctgcactgtcaagcatgtgaggcagcaatatgattcagccaatcaagctgggacatcagtcgatgacgtacaacgtagtactggcactgctcataatcgagcaaactagaggccaaactgttctttcaaatgggccaaactgttgttccaaatgattcagtgctgatcgatcaatggatcatagactgatcatcagtgaagcgatgacagccatgccatgccatgccatgcatgcatatatatggttgcagccgtcagaaaattcagaacacatatagatacaaatggacatatactgcatcttgtgtccaaagcaataggacgattactagagcctttctttttctctgaacatggccagaaattgagagatgtactgtactccaaatttgcatatatgaaccaattattgcttctaaaatctattggccggtgcagctgaatttggggtggtggcgtagtacgctcagtactacaaacgtacgcactcttctgaaggctcttgctcgtcgttgtaccgcagaagtacagtgaacacttgcatgcatataataggtcaggaggaaatggccaatctctctggagtattcatcaagatcaatgcttgctttgctttgcttgcccggtctcctagctattagtctccatttgattgatgcttttgtactaattaactaccactagtaatgctattatactaattaagtatatgtgcatcaacatagttaattaattcctagcagcctctatcatatcctgacgatttaagcttgtagcattatattagctaagcttttgcagtcaggagtacgtggacaatgactgacctaggagactcttgcttatgggtgatttatatgcatgtgtctcatgagatattatcaaaactgtcatggcagattaaagtatgtttatttatgcttctggttaatatgttatggctgcttgagaggcacagttgtagaagaacctaccacaatcttcccatcttgtgatttttgtcgcttctcgtaggccaattagggatgcaaggaatcggggacttaatctcattaattaatgaaatgacaggacagtagtagacccttgctaatcccggccttctggcaattatatacattgataattttgataatgacacaatccctaaaatttagctttgacctgatcgaatgccatgatcatagtattatggaaatgttttagacaaatctaccagcaccattatattttcacatatatcatcgtctttgcatgttcgtatatatatcacaaattaaaatgaatactatttgcttgtggttaattagcacctcaactcatggttcattttatcgcttgagataaaaattcgggataaattaaccgatcgagattttctaccaagattaagcaaaatatcgtcaacaatttttaaatggaaaaatcgtcaaatattgcgaaaataccaatggatcaacttgtatgtcctaattatgagcactcttaaaactccaagaaaaaaaagacaaaaatgctgaagtgtgatgcatgcatttgtacatattgctcctcccaaatggccgggagtattaatgaagaatcgaaagaaatcatttctttttctgtcttgcattattcatttaaatccaacgatttcagttggtgaattgaacttggtcacctggagcacctttccaaaaagtttcatctctgtacagactctcaagaaaactagttggcaagtggaattctttagtcttctctctaccccggaaaatatcaagaccagcagctagctagcaacttatgaatattttttaattaattatccccattgatcaagtgctgattttaattataacgtgccaaaaagtttcagccgccaatgacacatgcatagacaaattgatttactacaaaaatgcatctgctaattgattaacaagtcggcaacatgcatgaacaaaccacgcacacacatatataatatatatacttgatcctagcttccttccaggaagaagtaaggatcatctcatataaaatgtgtgcacttttcatcatcaatcaaaacacttctagcataacaagtgtacaactaaacaaataatttggagtccatgaatgcatgaacagctaaacacatgtgcacacaagatcacagcatcagctaaccccaggaaaaggtagtttgattccaagacggaaatcaattaacaaccgactaatccttgtcaaagcaacgtttaattacttactagtatactccaaatggatccattgcccttgaccaatactgaatccacaaagcatgcatattacgcatggactcttgaaactaacaaggcatattgcatcggtttctctctgacaaaggcttgcatgctagtagcttggaataaaaaacccaaggatatagcacttacatagtaggagtactatagtacaaagagatagtagcaaagtaataataaattaacacacaaatgcttaattaggtgggtggcaacatgttaattaaaatcagctccttgcatgcagcctttgacgccatccacagaattgacatgcatggcgacgtggccggacagcatccaagaagcagatcctttgaactaagccaagtagctagtccatgttgcatatgatcacccagctgaaacccaagtggatcaccaatccattctttgaaccatcatctactattagctctctctctttaaagttgaagcagaggatgacaagccagcagcacagctagtagcagcaacttgcaaaaaaaaaatttcaggctagctagctctactagcctcttcttacacacacacacacaagagaggaggaggaagaaggattggattgggttggcctggttggattggatggcaatggaaacttgagccggtcactgcagctgctaggatccagttgccaacttggcacgcacacggtatgaaactgtgtgctgtacgtctcaaactgcctctctagtagccaaacaagctgtgtggtttttccactggaaagctacactccccttgcaacttgctgctgctagctgctgttgctgcattcttgcctggtgagctaaaaggcattttgtgctcatccacattgtcttggattcattcattcattcatgcaatgactacctcttgatagtagtagtatatgaagaattcatgtatctgaatgcatgctgtgcagcctgcagaaatgtatagtaatctgaatttctggtggtttttattatacaggtgcgtataaatattatttatatgtatatatacaggagggctttgggatcgtgcagatatatatgtgctgagccatcgacgagaaaatccggtcggccggtcggtcatacttggggtgctgcgtacctagactttgatgtgtttttcacgtctttgtcgcaactaggaagtgtcgtgctcggttgataaaaccatgaaaaaaattgattggttgttagtaatttggtggtcttcgacttctatgcgtcctagctacattaaacaagaggatgattaaatttaattaaattttgaactagctagtttgagttttttccccctccggcaggtctaaaatcgtatcaacactttttgaacataataaagaatattttttaatttatgttggatgggaatgatgtctgaatttatcttgaaaaaaattctatagtgttctaattttgttaggtttgtaaattattttctgacagaaattacagtgcaataaaatgatatgcactttgaaaatcatatcaatctgcacgcaaaaaaaagagagaagaaaattgtatcaattttcaggacaaatatgttttcatgacaaggaagcatgatttcatttgtgacagaaagtttttaatggaatgaacatggtttctgccagccttttcaagagactgagggagggagagagagagaaaaaggagaataacaagttgctcctcaattatagggttgcaatgatatatattacctttaaactaaaggtctcttagccattgccacatatgtaatgtaatttaaattcaaatggatattaaaggccattccaagtcacattccgcgttctcgtggtcataccgcgtgaacctagtgatggagaagagatcgaacccggtcatacttgggcgctagcttgatgtaagtcattgtcacaactaggcgagtcgtgttctataacaatgtagaatcgaagtaaatcaattcttgaattgtctcgcaaaaaaaaggggtgatcttgagttgaattttatcaattttaggcaaaattgggtgaacaaggaaaatagaagagatcgataaaaaagactgaaaatggagccaaaattttctaaggtgagtacatagtaaacactaagcaaaattctcgagtactatatatgatatgccaattgtactatacaattaaacgaaaacaacacgcgcacagataaaagttaaatatggattggagtgtcttccaaatttaatttttatgcatttaaaatttatgttgcaagtcaaataatcatctcttgtagtcatgttccttgttgtgttggttgaatttgatgcttgattgagtagctagtctctctatttctagaacactttctgctaacatattttcccttttctggcctcatcctcctttttctgatgcagcaccttttttcacactggcaagaacttattagagagaccatgcaagcagcaagctgaaaaagctgcagattcaaatgtagtaatggttcaggataaatctccacttattcaaatgtagtctgttttctttcatattgttgatcacagtacagtattatatagccagctagagggaaatcaacacatcaagttgctgtctgtacacatgccatccctacaagatcaatgcaaagacttgattcgttttcctgctcatacaacgcgcgtgagcatgtattgaccactgaccattgcttagaaagctactgactgactgaattgaagcatatgcatatggctttgtcgcactggatcaacagctagaaagaagaaagcaagagaggagtggatgaaacacacaagagggaaataaatctccattaatctgttagacacatcgttcagagtcatcgtttgagttacggctgatatttattatatatataaagcgtgaaaaaaaatgaacgaagaaactaaaataattataagtaaaagttttatatatttctatccttagtgatttaaaagtcaatattaaaaataaactaaaaataaaaaggaaaaatatctcaaaatcaactctaaaattaagtttcgacattcaaaatttgtggatatgtagcttctgatgatctaaaaggcaaacgatatgttgccttgattaagctacttctgatattctacatcacgcaatgcaaagtacaacatatatatagtcagcatccgtacgttaggaaattaggtatacatatctacaaaatacttttcagttttgatcaaagctgattaaacagcacaagagcagttaacataactttgaatatggatactgataagttaagcattttttataacaaatctagtagctagtgtcacacttatgatacacaccaattagatactgtatgtatttccagaaattaatattacttataacatattagtagtacgtagtacctcgataactgaaagtttgaaagtattcgatcgcaaactctacattcgaatcattttgtggtactatactccaaggtcacctttgtacattgaagtcttgaagcaacaacacgtacgtaggactactatacgctagctaggtcgccctagctagctgcatctgccttctttttctcaaagaaaacctaataccactactgtatcaaattaatctgatcttacagtacacacaagtagctagtatctgcatacagcggttccgcatacagctactaacagcctcagcgtttgaaatatgctgtaatttatataaagcgaaatggtttatcaacaataaaagttacttcctccgtttcacaatgtaagtcattctagcattttccacattcatattaatgttaatgaatataaatagatatatatgtctagatttattaacatcaatatgaatgtgggaaaagctaaaatgacttacattctgaaacggagaaagtaagatatatatgtgtctcccttgtcttaggagtttttttctcttttaagtagttatatatacgtgtcattagaaatttagaacataccaatgcccaaaaataaacaacgataaaaagttcgaagtaaacttttaaaatttaaatcatgattaacggcttaatcatgataaaagctaagatatatatgtgtctcccttgtcttaggagttctttttctcttttaagtagttttccttttagattcttttatttttccaaggctccccccccccgcgcacccacccggcaatagcgctttaatttgtgtaagctaaactctgctttcgtttaatatattttcgcgaaaaaaacttttatatacgtgtcattagaaatttagaaaccaaaaaataaacaacgataaattaaaaactcgaagtgaacttttcaaaatttaaatcatgataacggcttaattataagctagtagtagtaaaagacaaaacgatgtgatgaggctgtaaaagatgttaattaattaatgcataacactgtataatcacgcaatacgattagcacatggattaatcaggcattaagctgtgctcgatcgatcgctaaaagtggagctatggcgaacgttctgcgatggtctccaagaatcttctagaaactatatctcggacgacttttcaaagtctttggagtcgtcgggaccgggccggtcgaatgccacaacgatttagtgatatcactgcaaaagtttataagattaagatgagtacgtaagctaaccacatggccaacgtgctcgttgtacgtaattaattaaattaaactgatacattaattgcaacaagctggggttattctccccttgaggttggaaaagaaccgaatctacacaaaatcaatcacttacgacaacaaattaataatattcgtaaatgcaacatttgtcataaaatataagtatattctaacatttgtcataagaggaattttacagtactctttgttagaacctgtgggattctcctctgtttctaacagagaaaacttacagtaatgttaccctgatttacaaggttgccatcctatatgtgtgtcgagaacgacaagctctactagtagtattattattttcagtctctgcatcatgaatgcacatagctagacagagctactacttggtttataggtcaagaaagagagagatttatgtcaatcgacaaccagtactcagactaacagaatcgcacaagcgtagttatgtcgttttgatgcaacttgcaggtagatcgtacagagcacagcaactcgaaaaaaaaaataaagatgtgaaagatcgatcgatcggttaatgtgatccatgaaaattgcaagctgcaggcagatgagtgagtgaaacagcaaatgttgtgttcagtgcactgaaccttgctatcctttccatcgtgctcatggtgcaacttgcctgatgtacttcatccaagttgcccaagtagctataggcctatagctgcagctcgatctccagcaaacaatgcaattaaggagcactgttatttttaagtaccccaaaaaaaacatacaatttttagggactagttcagtttcatcctcagaagttggttttttaggtaacagaggaatacgttatcactactgttgctatatttaaatatatttagttaactgatcaatcacaagaaagcttgagaattaagatggattattgtaaatattgcaagttcgatcaaggagtggttttttaatctctatctgagaaattgttttagaatataaatgatcaccctgcatgctaacttaaatgtctgaaagtttagtttgctgactgagtgacgctctagatcgaaaatctgacccgcaatagttctgataaaaaaaaactatatgcacatatttatgagcaaatttgtcgaaaagatactacaatggttcttcacactttataactttattctgaacatgtcaagttaaatctagtggacaagtggacatgagag

SEQ ID NO: 80040 - DNA, 22161 bp, Oryza sativa
cctcttttttgtacaatttaacttaatctgcaatgagaaatgatgaaaaaatttttgtattagttttattttgctatatatgagatgaggatgatctgtgccgtggtctttttgtgtcttagcttgaaataagggcccgtgcccaagtcccagtcctcgaaaagcgcgggtcggggctagtgcctggggagatccgcatgtcgagactggccaggccgggaacgtggtgaccgagggttatgggtgacccgattgtgggtttttgccgattcccccccggagttcaccacgccccggggcacggctcggttctgggccccgtttggcgattttagctgaccgaaccgagcccccgagggcaaggttgagcacgagtgacattatttcaagtcaagattcttcaaaaggaaaaaacggcacagacacaacctttagaaaattgaaactgcttttattgaaatgctgaaataaaggaaaaagggatatatgtgcatgtgtggtagcccccggccaatcctgcacacccgaggggggtgcggggttggcccgagccaaaacctgatacccgacccccccccctttcaggggtagagtagaagcgacgaaggtgttcgatgttccacgggtttggcagctccgtgccgtcgcccatggccagccgtaccgagcccggccgggggacaccgatcactcgatacggaccctcccacattggtgagagcttgctcaatccagcacgcgtttggacgcggcgtaggatgaggtcgtcgacgcagagtgatcgggcccggacgtggcgctgatggtagcgccgcaggctctgctggtagcgcgcagctcggagggccgcgcgccgccttcgttcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatgttgaaggtcttggttttgaggcctttaaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgatcgcaacatacagatactcaaacccgcccggggctcgtttgaacggtcccaggatatcaagcccccagacagcaaatggccatgacagtggtatgatctgcagggcctgggccggctgatggatttgcttggcgtgaaactgacacgctctgcatcgccggaccagatcgactgcgtcattgagagctgtcggccaataaaatccttgacgaaaggccttgccaaccagggtacgcgaggcggaatgggctccgcactcgccctcatggatgtcagcaagaagctcaacgccttgttcctgaggaaggcacttcaggaggattccgtttgccgcgcgccgatagagggtcccttctaccaacacgtagcgtttggaaatgcgttgtacgcgttcactcccttcgcggtcctcaggtagagtcttatctgcgaggtatgtttggatctcagagatccaagcaatcaatctaaaggagcttggagcgctcccttcgggtcccgaggcctggactccgacgggcctcgggggccggtcaggcgcatccgtctcccctaaggggtcgggtcgcgccgacggctgagtaagcctttcttcaaaggcgcccggtggggtctgggctcgcgaggacgcgagccttgagagttcatcggcaatcatattatcccgtctgggcacatgccgaagctctatcccgtcaaaatggcgctccatacgccgtacttggcgcacgtaggcgtccatctgcggatcagagcaccggtactccttacagacttggttaacaaccagctgagagtcacctaacaccaggaggcggcggatccccagcccggccgccactctgagtccggcaaggagtccctcgtactctgccatattattggtcgctcgaaagtcgaggcggaccaagtatctgaggacgtctccgttcggagaggtcaacgtgacccctgcaccggcgccctggagagacaaagaaccgtcgaactgcatcacccagtgggcggtgtgaggcagctgagaggggttcgtgctggcctcgggtattgagacagtctctggagccggggtccactctgccacaaaatcggcgagggcctggctcttgatagcgtggcgtggttcaaagtgcagatcgaactcagaaagctcgattgcccactttaccactcgtcctgtaccctctcgattatgcaagatttgaccgagggggtaagacgtaaccacagtgatccgatgcgcctggaaataatggcgcagtttcctcgaggccatcagaatagcgtaaagcatcttctgggcctgtgggtatcgggtcttggcgtcccggagggcctcactaacaaagtagacaggccgctgcacctttcggcggggccgatcctcttcgctagggaccgtacccccggggcgttcttcgtccgagtggcccctcggggcgcactcgtcttctgtgccgatgacctcggggtcggaggacgacaggagcggccttcccacagtggcctcggggccgtcctgggggtcgggggctcctggcgtcatcggacaagcgggcaaagggccaactccggtcgtcaggggccttaggccaccgttcggcttgggggcctcttctccctgctctctcccgggtcgaatcggtacagggttagcctcggggtcagagggcgataggtgcggcctccccgcagtggcctcggggccttcctgagggtcgggggcgcccagcaccgtctgacgagcggggagagggccgactccggtcgtcaggggccttaggccaccgttcggctcgggggcctctcctccctgcttgctcccgggccaagtcagcacagggtgggggtgcgcggaatgaggattgtcttcatcgcgctccacagccaacgctgcactaactacttggggggtcgccgctaagtaaagtagcaggggctcatttggctccggggcgactagaaccgggggagagctgagatatgcctttaactgagtaagggcatgttcagcttcctccgtccaagtgaacggccccgagcgcttgaggagcttaaacaagggaagcgccttctctcccagccttgatatgaaacgacttagggcggccatgcaaccagtgacgcactgcacatccctaagtttgctgggggggcggatccgctctatagctcgtatcttctcggggttggcctcaatgcctcgggcagagaccaaaaacccgagaagcttgcccgcaggtacaccaaacacgcacttatcggggttcagttttatgcgggcggagcggaggttctcaaaagtttccgctagatctgagagtaaggtctcttggttgcgcgtttttacaaccaagtcatcgacatacgcctcaacattacgtcctatttggctacccaaagaaattcgagtagtacgctgaaaagtaggacctgcattctttaatccgaagggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcacggatgaacccggcctccaaaagtttagccacctcctcgcggatgaaggcttgacgttccggggcttgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggccatccgctgcctcggggcggtgggggcagaggggccaagcctctcgtcaccaccctcgggcttggacgcagcagcgaggcggtccgcgcgctgctccatgcaagcaagcgcggctttaaggtcgccacggacagagatggggccaccggggcccggcatcttcatctggaggtaggcgtagtggaccgccgccatgaacttcaccaacgcgggtctccctaggaccgcgttgtagggcagactgaggtccgccacatcgaagctcacccgctccgtgcggaagttggcgggtccaccgaaggtgaccggtaggtcgatgtgacctaatggccacgtgtgccccggcgtcacaccgatgatcggttgagacggctggagcaccatccccggggccttgatagcatcaaaggccgcgggggaaaggatgttgagagccgctcctccatctatgaggacacgtcccaacttcacgttgcagatggtgggggaaaccaccatcgcagcctgccctccccgggcaatgcacggtgggtggtcggtctggtcgaaagtgagggcaacctccgaccaccgcgcccgacgcatcgcctcatgggtaggggccatggccagaagctctcgcttcatagccttgaagctccggcgagagacgtgagcacatgctcctccatcgacggtggcaatggtggccccaggttcttggaaacctaggtcatcatcaccatcatcgatgtcaacagcgggggccttctgcttggcctcacttcgccgtttgccggaaggaaccgccggggacttgccctcacggcgttcctgcctcctgtcctcctcccatttcctcgttcgctcggccaggtttttgaccgcacgacagtccgcgagatcgtggagggaggtgttgtggacagagcaccacctgccggcgaggcgctccctgctgggtgtaccagcctcgttctttttgtcgctcgcaggcctcccctttcgagtggcccgcggagcgccctcgacggcgaggacatgaccctcgtcgccggaacggtccggcctcttcttcctcctcctgtcacgccgccctgtctgagcggcggatccgggggcggccgaagctgccactccggaaccggaggagttccaggtccaggcctcctccttacgagccactcggtccgcgagctgaaaaagctctgcggtagtctggggctctttggaggcaatcttttcgagcatgcggttgtgccgcacaccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcgggccgctgccatgcgtaataccctactcgtgtgtcttgcgggcagacgatctttccagatacagagggagagcgagagcttgagatctcaccctaagcccccggccgaactggcaaaggggggcctgcgcggtctcccggtgaggagccacgagctccgtcatctggcgcgccaggtagggggctcagcgtgtgttttctgagctctcagactcttccgtgtgcgccaagtttttcttgttcagcctaatggccgagcaaggaaaagcgcacgacctctctccgagtgtgagcggcgacgacggggagccgaatccacgccgtcgagctcgtactcccccacctcctccgcgccaaagccctaagcagggggaggcgcttgagagggtcgacaaatccgtggcatcaccagtcgcaggtgatgcaggagaacggcgagatggggagcgtcgcctcctcgtctacggcgacggcagcacgcctcagggtgcgcttcaggctgctggcgcgctcctacgacacccgcctgtcgtccctgacccggagtctccagcccaacgatggctggaagacgtggccaacttggtcatgacggcacagcagcgcctgggtgctggtggacggtccgccaccaccaagacctccggcgccgctaccaccggctccgtgtcatcaaggcggagggcgcggcgagcggcggcggctgcacgtcatccagggagagaaattggagtcccgggcctggtaactcgctagcacgagttcaaccgccccccgggcgaggtccctcgaggatgacttgatggtcttctcgagctcctcggggagtcgttcgaggacccaggccatcctgttgaggtgcggagcgaggccttccagattggtggggggcaccgtcgtctggcctctccagaggcctgcttgccgaccggcgcgcttcatgcgggagaccgcatcccaaagcatgtcgggcccaatctcgcccgccaagcgaagggcctcggcctccccggtggaggagtccagcgctcgctgcatttccgcgacggtgtgttcggcagctgcgaggcgggcggctaagtcgctttcgcccgcggccgccccgccgataggcgcccttgcgtccagctccttttcccgcgcctcgaggtcagcagcccgctgctccagtgcggctctctcggcgcggacgcattcgagattgcggcgcgcctgctcctcctgcgccgcctcgcgaagggacaggctgtccgccagccgtttggtcctggcctcagcctcctcgagagctcgctcccgctcagcgagtgcgtcctcgcggaggcggagcgcgcactcctcctcggcgcaggcggcctcatgcgccgccagcgtcgcctctcggagaccagcggcggccttgcggtccgtcaagcccctctccacggcgccggcgtgttcttccagcgccatggcacgggcctcaagggcctcctcgcgccgccgaaacgccgcttcagtctccgttacccgccgctctcgggcagcggcggagtcaaggaccccttgggcggcgtcgagctttttcttcagctccgcctcccagcttgcgtgctgaaggcggagagtgtcttgcgcctcgatcatcgcggtggtagagatgagggcggccgcccgctcctcctccacctcacgggcgatctccgccagcgccgctttccgggcttcaagctccgagacatgacggcggtgagccttacggcccacctccaccatggcgtccaccgagcgccgcccctcctcaacacgcgcccatgcggcctcgagctccgctcgttctgcacgcagggcctccacttgggtgttgaacccatccagcactgcggtgtttgcggcggccagggcctgcagaaggggctcggcgctcagcggggcgacagaagatgaggagaagagccgccttggagaaaaggcgacgtggcttggccccccggaggatgcactgggctcggggatgtcccccgggcccgtttggtcctgggcgtcgcccggtgaggtaggcccaggcgatgcgcccgcggcctcgtcgcaagccgcctcggaggatgtcgcctgagggccgcccgagggagtaggcccaagtgacgcgccagcagcagctgtcgcctcagcctggcgagaccgggcggcctcctcccgagcagcttcttcggcttggcgagcccgggcggcctcctcccgagcagcttcctccgcttggcgaacccgggcggcctcccgggcggcctcttcagcttcccgaaggcgggctgcggcttcacgccggtcagactctcgcctccgctcctctgcggccgctggatcttcggcctcggactggccggatttggggtggcgggaggaatgcgacgggacatcgctgaagcagaagaaaaaaccaaaagacgaacaaaatgagtaagaaaaaacttctctttgggagaaaggtggttgcaatgagagtgagacgaacctgcgagggggtcggttgaatgaccaccttggaggagaaatcaggttcccccggcatggttccgtctcccccgtcttgcggagccgtttcttcttgcgctccccctcgggctgcgacgtcggcgcggccccctccgggcgccgactgttggcacgcgccgccccgccccctcggggaggagatgggggaggtgttcctcccagcttcctcttcccctgggcgtcggcagggcggctgctccccgagcccccggcgcggggcccagaagcacgaccccctcctggggcagattgttcccctcggcggcgctcgcccgcgccgtcgtggcccttaggggctctctcctctgaggccccgacctccatcataatggttagaatggaggcgcggtcgggatcgctgcagagggggaggatctcctgaggaatgcgagatgcctccgcggagctaagattcagcaccctttggaccacgatcttgaagtcctcgggagcccaatcccatctggctccctggtgggtccgcatgtagtcttcaggcccagtgtactcccaggcgttccgggcgcgccgttggagcggcgcaatccggcgacggaggtaatcgccgtacaccatggccccggtgagcccctgggatcgcaggcccgccaggcggtcgaggacggcgtcgtagtcctcccccagatctaccggtgcccgccagctggagacctgcgccgggggctggcttggaagtcggaggcgcgcttcgttggcgaggggggtgtagaaccagtcgctcttccagtcgtcccacttcttgcgaaggccgcaggggatgtagcggttcaacaccggcccccgcggctggaagtagcagccgccaaccaccgacggcggtgacaccgactgcacggtgaagaaccaccggaacagctgaagagaggggcgcaccccgatgaacatctcgcacagatgcgcgaagatggccaatgtcatcaccgcattgggggtgaggtgcgccatctggaggtcatagaactccaggacatccatgaagaaatgaggaaatggcgggaccagcccagccatcgcgaaggggaggaagaagatggaccgccccgggtagtctggtgccgggcgcccctcgcccagcatcactatctcccgaccggtggcggactccggcatgaagcggcgcggcagtccggcgtgcctctcattcacgatgcgggaaggcggtagtacactgccgtcgagcagagcagagccccgtgccatggcggcggaggaagagatgattgagaacgagcgcgtgtggcgaaagtagggcgtagcagagaaagagttagagctcaggtggcgaaggcaagaggaacaatggcgaaaggaaggaagcaaatccttttctcgatgcttttatacccttgccatcgctgggcctgactcctcgtttctcgcgcccactacctcgctccctcgtatctcgctatctcgctccctcgtttcccgtgcccacgcttccactaatcccattcgcccgcttacggcgcattgagtggatatgcggttgtggcaatcgaaatggattgtatcgtgcgcgcgttaattacgctcgccgaccgaagcggcgttaccatatctccgggcgagacgaatctgctcatccagattcgcgcgctgctcaagtggtgtggcagtcttgaatagaccgcccattatggacaaccaaagttaccaataccaatgtgcatggattgagaccgttcggtattttgcccaactacggagaccggtcccacctgtcacagggtggcgtcacacctgaccgcttcccttgggaagggaaattgctctggcataacgccgggggctactgtcggtgatatgggaccgggagtatcatgactagaggcttgaggcagacacaatcgcccacgtggcctggcaccttcggggacgtcgggcccgagggtgaggtgtccgccctcctcctgatttcccccgagggggggtcgggttgcgtttgccccggccccgagggccgaggcaccccgacccccttaaggaagtctgcgccacatatatgggataagtgagcacagctgtgctcacctaacagcatttattgcagtctggtcaagcgtgtcacactgcatgcagcgcagtacggcgcgttcctttatccggtctgtgaccagtcacagaccggtcagatcacgggttaggtggcgactggcggtctgacgcacgccttaccccatcccgtcaaggtgtgagtttctaagcactcgtccccagctggagctagcgtgttacatcccagagatggcacgttaactccgatcgatatataccaggcttcatcctaaccattacaggcaaggtgttacacaaggaagggcaaacatgcatgttgttaaactgacgcgtggtggacaagaatgaccggtctggcactggtcgcgtcagcaacgggcagccacgatcccacgttgcgcctgtcgtcgccgggagtggaggtaggtgtgggctgtcccatcggagtgtcattcggacagcaaccataccaatctccgtccataaagagaagaaaagtccagtttggaaaggggaggggtgcatgtggtatccccttgaagtataaaaggaggaccttgcccatagagagggggttgggtggattcttttccagatttagagcttagaacggggggggggagttggctcacactttgtagctcattcatacacaaatccacaaaaacacaggagtagggtattacgcatggcagcggcccgaacctgtatacatcgccgtgtctcgtgtgtcttgcgggcagacgatctttccagatacagagggagagcgagagcttgagatctcaccctaagcccccggccgaactggcaaaggggggcctgcgcggtctcccggtgaggagccacgagctccgtcagagtgatataccaactgctttgtaaaatatgatgagtgatatagcaaaatagctataaagaagcttgtatattgtgaataaagaaatttccaaagtattgggcatacgccatgcgcacactgctttaacagatgtgcttaagtccctagaagacacacggtttcaccacacctggaaatatatggcatatgtggtgtaaaatccgagtaaataaactcataaaggatttaccaaccgcctagaaaatgaccacaatatataatcagcctaagccataatattggtcaataaaaatgcacacttacgtggcaaaaagcaatgatattgtatccaatcaattgcttaaaaacccaaacagcaccttgacttatataaaaaagtcagcgggacagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtaacaggccacacctgaaaatatgggctgcagacatattaggcctaggccaaaaaatatgccttcgacaccctttaaaggatgacgcatgtaacatgctcccgagtaataaatcttccgggtaatatagaccaagtgtagctcatatgaatagcttctgatctgaatgattatcccttatgggatactccaaaataaatataataattgaatcccgactggcgcaagtattcggttgtaacccttatggggaataataaatagtccagtctttaaacatagaaaatagacccatgatcatgaatccatattgcatgtatccagagcaagtccaaattgaaggtatgatacttgtgtttgaactagtaagcccctgagcacgtagtcacaattgttcattgatggtagctgacgcaattggcatagagacaagacgaccaatacagagataatattgcccagcagaggtggcaaaaatattggtggtagtgaagatagtgataccaatcaaaagtgatgaagttgcacagccgtggaggcgaagaaaccagtcggcagcagtcagatcagccaacaatgaatatgaaggcgctcagcaataaagttgtgtaactatggcagcgaaataatcagtcggtgacagacgaggcaaatcaaaggcgatgacgaaatccaccaatcatgaagatgaagaaaatacttgacgacgacaaacgcaaccgacatgatgaagatgacgatgtcggtgatccagccaacagcagtgtagcaaccaatgataatgacaaagacgctcatcagcatttgcatagtaggtcaaccgtgaaggtgaaataataagtcggcgaaaacataatcatccattagcaacagcagagatgtcagggtcgatgaagcagaggtgctggtgatgatgtcagtgacaataatccatcaaattaatgttataactgttgtagatgcttcacttggaggagagttgatgttgttgcccaactcgtctaaaccgaaatatttgaagttgttgaagtagaatgtctgctccgaagcaaagatgaagataatgactcctggagttgactcgtgggttgatgaattgacataaaatttgtcaaattttgagccttgtatttgtgtagcccccgactctttgattagttgggaaacaactgaacatagagtcgagaactgtagcttcttgtcgtcgaatagtcattgcttgattgaagatatgtgttgaagatgtccaagtagaaatcctgaatattggagagccacttgttgtagtaaaataacatggcattgcatgccgagatgtcgaggttcacaaagacgtcgtggttggtgaagtagtaaaacttgcgaagtagcaacaatagagtttcccggtgccgaagataataaagatgaagtcgctccaccatgatgacaaagttgtattgccgtaatgaagtgaacacaagtcggcggcaacagaagcaaaccggtagtgaagacgcgcagttgtgaagataaaagcaccagtcggcgacagcataaccagtcggcgacggaaaacgatgatgtttatcagtagtggtagctgtctaaaccagacgtagaggtgagggcactagtcagcagcagacgagacgaccggcgatgaagatggtaaggccaatcaacactggcagaatcatgcagccatggaagtgaagaaaccagtcggcagtcatggcaaacgtaggcagcttgtgttgaagatactgatgcctattagtagtgacagcgatgtagccggccgtgaagaagatagcatcagttggcgttataacaggccagccgtgcaggcggtgacaccagtcagcggcggatgcggcggccggtcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgcccgactagtcataaccaccaagcatcgggagtcggcctaggcgcttcccaaacatgcatatgagtgacatgagtttgtcattaatggaacaaagtttcacggatcagagtttactactcgggtacttttgcaattgttaagagcagaaaataaatttatctcatctctatacttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaatttgtttaaaaaatatgatataacatcaatagcccccgactcactaatcaacggcgaaccagttgatgtagtgaggcagaggaagagcaaaatatcatataaagaatcaatgatgacttagctttgtcgtattccctcggtgacagcagaagtagccgatgtgggaacgaagcagtccatcaatggtgacaaaaacaccagtcggcgccagtggaaccaagccagtggtgtagataatgaagcccattaacggaggcgaagtccaccaaccgtataggcaaaaacaccagtcggcgccagtggaaccaagccagtggtgtagataatgaagcccattaacggcggcgaagtccaccaaccgtataggcaaaaacaccagtcggcggcggcgaaggccagccggtcggcgaagacgtggacgcccatgaacggtggtgtgaccaaccaaccgtataggcgaggacaccagtcggcggcgacggaggcgggccggcggtgaggtcgtagacgcccaacagcggcggcataataggccagccgtgtaggcggaggcaccactcggcggcgacggaggcgggccggcggtgacgtcgtagacgcccaacagcggcggcataataggccagccatgtaggcggaggcaccactcggcggcgacggaggcgggccggcggtgaagtcgtagacgcccaacagcggcggcataataggccagccatgtaggcggaggcaccactcggcggcgacggaggcaggccggcggtgaagtcgtagacgcccaacaacggcggcataataggccagccgtgtaggcggaggcaccactcggcggcgacggaggcaggccggcggtgaagatgtaaacgcccagcaacggtggtgtgaccaaccaaccatataggcgaagacaccagtcggcggcgacggaggcaggccggcggtgaagatgtagacgcccaacaacggtggtgtgaccaaccaaccgtataggcgaagacaccagtcggcggcgacggaggcaggccggcggtgaagatatagacgcccaacaacggcggcataataggccagccgtgtagacggaggcaccaatcggcggcgacggaggcaggccggcggtgaagatgtagacgcccaacaacggtggtgtgaccaaccaaccatataggcgaagacaccagtcggcggcgacggaggcaggccggcggtgaagtcgttgttgttatcagcaatggcggtggcgaagacaagccggcagagtggactcgcggccgatcgaccggaaagctgagacgcctcgagtccatgaccagcatcaatcgcctcaatagtgccgcgtaattatatgcgaacaacaacaaaaaatagcaagagattaatctgagattaaaaatcaatatgataaataatgataaaaatcagattgagtttccccctgactgatttggatcaagttagagaagaggagcttgaagaagtggtcgacggaaaggaagtgaaaactcccaaagcgaaaacgaagtcggcgactcatgaaattgattccatcgcgctcgttgataggaaactcgacgcaacccctacctggcgcgccaactgtcgaaacatgatttcggcaataataaaagggggtagcgcacgagacctaaaagtggatggatgcggagacaaaggatttagacaggttcaggccctctcaatgagaggtaataccctactcctgtttggggatttgaatccgccgggtgtagtatagatctgacgatcaggttgtgtcatcataccccctagagggcctcctgcccaccttatataggatggggggcaggattacaagatagaaaccttaaccaatacggtatcggtttcctaaatctactttacaatattatcaaaccaggactttaggccgttccgtaatatacaaggaaacgtaacacccaagtcatgatctgttacatattacatagatataagttatcccctatgactagtcggataaccatgccgtatgggtatggggtacccataatatccacagactggtaatcaacgttgatgggaccgctttaccggccgatagccattgttgtcatgttgcaccacaagaaaacaaatgacaaattaaaccctttgttttagagtcgttgtgcttgtgcagttcaatctcactgtgcttatcctgacaatatagttttgttttttacgataaattctcttctactttattaaagtattccatttaattaacatcttaaactatttttcggtttatttttttgtcatttttagtttagttacttaaaaaggttcacttttttctataatagaatagtatttaatttggttttgtttccttgtatataagtactttttaactaagtgagaattttgatgcattgcaacttgtgcctcaacttttttttctctggatttcgtattcagtttctgcatactaaactttcatgaaagatatatcttggaactattgtatagcacaggttatattctcattaatggctctacaaaatgaccaaaaatattttagaatgctaagtgaagcaaggaatagttgaagggagtaaaaatatgtttccctattttttaatttagggtgtgtttgagaaaagagaaatgagaagattaaacaactttcttatagaaatgtaaaaaaaaaacacacatgtttagtactcggatgtttagttcgtgaagcatccgagtgaaagatggatttcttctccctttatcctcctaacgaacgcatccacactactgtataatcatctgaattagtctttttttaattttctcctttcatctgaacagcatgataacaataattaatggagataccgtagttatatatatggaaatttaggaaataatttagcagtgatcgactgcatgaataaatactctgaaacgacatacttatatctgcaagttgcggaaaataattaaattaagctagctactctggataagtcctgcacgaaattcattcagcagaacagtcaataccgtttgtttcctcaattcttatactagtgtgaaaccatgccgctgaaagaccaggatggttgcataaggaagtcctggccatattgaaagaagagcaatgcattatgcatatatgtctgaaataatgaaaaagataggttgaaaacagtaagttgattgttagtgcatatttatatatatattcaggatttttaaactaattaatgaaaaaaaaatgaggagtaccaaagaagatattctcctatgcatatccatccccttgggttcctacctagtacggccggacaggcaacattgtaacatgcatcaagtacattgcatcacacccccaataaagcatccacatcaccatccagcaacttgcatgaaacaaaaaaaattaattaataaaaaaatctactagcacctcccaaccacctgtaatatggtgctttgatagggaccaaaataacaaacaaaaaaaagaattccaaaaagacatggtcgatcacttttcataaaaaaaagcacagatatactaccattaaattattgtaattaactaggctcaagatagatagacgtcgtctctactactcctactagaaaacatatctttgtccaagcaaattaacaaaatcaaatatagcaagaacacgtttaattttgtacacatgctgcgtttgggttggtccaaataaaatacaaagaccagtgtctatatatacagagcacacgcccacagcaactatcactcttcatcatcatcttctttggcttctccctcttcactgccctaattacaacccatttgcttatctctctcctctctctctctctctcgctgcagccatagcttagctagagctagagctttcttggtgccgagatgggggtggtcagcttctcctcgacttcctccggcgcgtccacggccaccaccgagtccggcggcgccgtgcggatgtcgccggagccggtggtggcggtggcggcggcggctcaacagctaccggtggtgaagggagttgactcggcggatgaggtggtgacgtcgaggccggcggcggcggcggcgcagcagtcgtcgcggtacaagggggtggtgccgcagccgaacgggaggtggggggcgcagatctacgagcggcacgcgcgggtgtggctcgggacgttccccgacgaggaggcggcggcgcgggcctacgacgtggcggcgctccggtaccgggggcgcgacgcggccaccaacttccccggggccgcggcgtcggccgccgagctcgcgttcctcgccgcgcactccaaggccgagatcgtcgacatgctccggaagcacacctacgccgacgagctccgccaggggctccgccgcggccgcggcatgggcgcccgcgcccagcccacgccgtcgtgggcgcgcgagccgctgttcgagaaggccgtgacgcccagcgacgtcggcaagctcaaccgcctcgtggtgcccaagcagcacgccgagaagcacttcccgctccgccgcgcggcgagctccgactccgcctccgccgccgccaccggcaagggcgtgctcctcaacttcgaggacggcgaggggaaggtgtggcgattccggtactcgtactggaacagcagccagagctacgtgctgaccaaggggtggagccgattcgtgagggagaagggcctccgcgccggcgacaccatagtcttctcccgctcggcgtacggccccgacaagctgctcttcatcgactgcaagaagaacaacgcggcggcggcgaccaccacctgcgccggcgacgagaggccaaccacaagcggcgccgaaccacgcgtcgtgaggctcttcggcgtcgacatcgccggcggcgattgccggaagcgggagagggcggtggagatggggcaagaggtcttcctactgaagaggcaatgcgtggttcatcagcgtactcctgccctaggtgccctgctgttatagcatcaaatcaaattcatatatagatcaaatcaaatcttcttctcttccatcttttttgttgttcatcgtctgttgtttcatcttcgatttagagctgttctatcttcgactttctttttttgttttttgtctttattttgcatagaagtttgtcaggtcagagattgcaaatgatcgatcaagatcgagctgtatatgtacagccttattaggaaattaagtctagagatcattcaagtatgtacaattatctaatagtacatagtaataagttctgtttctttccaaagttgtcttcttctgttcatctgatgtgaattgaattaattagattccacagaattttattcttcgcaagataattggttatgctgcacttattattaatcgtactatttgctgatgctatgcgctgagtgcgtgtaacaatattaataacatgtgtaatctatcatcagaagatatcatacatatatatggaacactaatttggggattcaggacgacttgcacatttctttttatataatattcagaacactcgcgcgcgcgcgcgcgcgcacacacacacagatatatatatatatatatatatctatatctagctagaaattatttgagttattaacctgatgatctttttctggtacttcctctcttatatatctcgaaactgtgctaaatttaattttagcacacttgctatttgctatttcttggttgagcattcagattgttcgaattgatctccatttgctatatatcgatttaataactagtagttaccacactctggtagtttcaaacttttgttttgttaattagacgagtaattcccatatatctgtactcaaatggagcaaagtgatctatctcttgatggagttttctacttcgttttgttgtattctatgtcactgatctttaatttgcatgtggcccatattttcttaattagctttttgtcgtaaacaaattccattgtggaatagggaaatcatatgttacttatcatgcacctacagtgtttcccccccaaaatctataactacagtgctagctacctggggttactatctataaaaaaggttacttttgctttaaattgtttctgtttatattgttcaaagttttcttttataatctttggttatttggcaatgtgatcataactgatactttcttcaccagtataaatcaagtgtgccttcacgacaactgtaaaatgcgttgtgtttcaagggaaaaagcttctcgccgaagaaatttatttttatgttcttaggaagtatattacgatcgaggttgagtcatctcctagtatgcgttagtccagatctttattaatgcaagttatattttggaaaataatcttacgaaactaggcctatgtttagatcctcctcctcaatgcaaagcactggctcgtcgtaaaactaactgttttggatggtagttaacctattcgtcatgcttttaggacagtctaaatagaggcctggtctcataggaattatttttcgtatattatagtgtataattatgtttcttacccttctatacggtagaaatggaagagaataaattaatccttcaaaaattttatgcaatgaaaatatctttgtagatgtacgtcatcatattttcccccaaatacatgttatataatattttgataatataataagttaatatgttgtaaaaggtataatactaactaaagtatgagaaaaaaaatgatggttttatattaggtctgaagaaattattttatttttcattgtagaaaatcttttcgcagtcaaaagcgatcatagaacaagcatacttaaaaaaaagatggatattgtaatatatatcataagtgctaacataacaacaaaatgttgttatttattttagataatggaatagaatcttggcatttgctcaacgagctacatacaattattacaccaattcaaccaaacacaaacacacctcaacaagtcatatgttattattatttagttacatatgtatggtactatcatgttaggggccttctttctacatatttcgtaataatgcctagctttatgaaaattcatgtttaagctttactttccttcttatcgattaagtttgatgagctcaaagaccaaagaaattttacaattgaaaagtactaatgtttcatgtgcgcacatatttctcccgatcatcactatatatatatgtacctcaaatccaggtaacaatataactcaaaaagacaatctaggtatattgaagatatctatactatccaattaaatacttatctgtgcaattctaaaagaaagcaatggtggtagcaatgaatctaccactcactaagtaatattgtatacacaccgtcccaaaataagttcagttatatatataaatatggatttactagcatgtgtatagtttatatttatatgtgacaaagcacgggtataaatgtagctagttgttccaaatggtatgttctcatcaagggtattctaaatttcaaacagaactagtgaaattggcccgagacattactacaagatcacacacacaatgggaagtcgaaatcatctcactattacttgtaagaaagattattttgtcatgaaagaaattaaatagtacaactaaattaaatgggtgt

SEQ ID NO: 80041 - DNA, 1108 bp, Oryza sativa
aattcctgcagccctgcatgtgcacactcatatttcttttgggggtgtgctgttgattgtgtgggtgattgttttgttatgtgtgtgctacaccacagatgtattaccttgtggttaacactgcacaatagattccacgaaaatccttctctccagttgtatcctttctgcaaccattgaagcttagagttatttacttaagttcaatacacacacaaaaaaaggtgaatggtgattcatgtggtcattcgcatgccagttaaaagtaagaaaaataagtgagaacttacgaattaaccatatttcttatgtcatcaatgtcctggggagctgtttctgcaaatgcatcctatagatacaggataaagtgagacttttgcagcacataagtcattgacatatggaggcatatttaattatagacaaatcaggagttttcaaaatgacaaccagaagcaccacgcaacttactttgaagatctcaatgacctgatgttgcacatcgctcctcatattcgttccatttaaaagttgccaacaaatgttgtatcttatccgtctgagaaaggcaatatcttccctctttttcagtccttcgtgtaaagaagcacgtagcaactggcatttctcacaacacatgaagttgaattgcgtgtattctcccaaaactttcagaggtgcctgaaatgttgttcaagacaacacgtgcctatcacaaatcaaaatgatagccttcctccaccgcatacaaaggacaaggcaacatacctttggtttttgaagtccattgttgtagcacttaacatgcaatgctctctcacactgtacatgagaatacggcacaatttcaaggtgacaatcttatctttcttttttgaatattataagactgatctaagtatcaaaggcaatctgttgtgggagaaaaacattaagcagaacattaacctggttacagaagacaatcatgtcaacactaataactccaagcaccgtatggggtttcctgtcaaaattttaaggtgtagagttacatataaatgagcttacataatcttgacattgcgaccagtccacatattcttattcttaccgacacatataacag

SEQ ID NO: 80042 - DNA, 1095 bp, Oryza sativa
cacctttatatactttcctccggagatgttctccgtcttcttcatgctcctgccgccgtgagcacccctgcctctcgtctcgcggccgctgattgcttgccggtgtacgggatcgtcgaaggagcttaacggcgagacgatgaagccgccgtcgccaccaccgcagcagacggcggcgaccacggcacgaggtttttttaataatccctagatttttaaatttaaatgattttcacggattttacaacgaatacctacaagaatactcatgaaaattacattgtaactagtgaactttacattgttccatcttcgtttcatgaacaggtgatagatcgtatttttgttgcttaggttgtcttcttatgcacaagcgatacttatacctctcgtttttcatgcacacgctccctaaaccgacaaatgatattttttttgcaaaaaagttctatacgaaagttgattttaaaaattatattgatctatttttcaatttagttttagctaatattctgtctgtttcatatgatgagttgttttgacttttttatagtttaaatttaaccaagtttataggaaaatatagcaatattttcgacataaaacaaaacatattatgagaatatattaaatgctagttttaatacaactaatttggtgttattaatgttactaaatttttctataaacctgattaaacttaaataaatttaactataaaaaagtcaaaatgacttataatatgaaacagagagagcgcttaattaatcatgcgctaataagaaaatgacctcttctcccgaatacttgtgcggcaattaggcctactagtaatactcgagtggtctaatgattaaggcccaacaaagatctgcggatgcattggtgcacagatggcgtgccatgtaggagcgaaaaaccaactgaaatcataattttcttatatctatttagttacggaagatatctcttcatcaagaaatcaagatcagttctaaaaagaaaaaaaatcaagatcaccttttatatattttcctccggagacgttctctgtcttcttcctgctcctgccgccgtgagcacccctgcctctcg

SEQ ID NO: 80043 - DNA, 13819 bp, Oryza sativa
  unsure (1)..(13819): unsure at all n locations
gatagaacatggccgcaagttttttttggttgtttggttgatagatagaagtgggatattgccacccggcagagaatattctatgtagatgttggatatgcagctccaggcaaatcggccggatcccacatcccgaagtgggatgagtcgcacgactctggactcgcgcgtgcgctcacctctgccccaatattttatccatgtcactcgcttcctcaccgcatcaactgtagccacaatctacttcttcccttcttccggtggcacagggggcagcactagacggcgcaggggcaatgtaagtggcggctgtcgagggcgctcggcggagcatggcaccgctggacagcgctggggcgttgtgggcggcggagcacgagcgacgcaagtggcagagaccacggagtagtagcagccagcaggtcgcgcgctcggccgtcgaggtggcgtatgccaacaggcaatagcaggtcctccgtagccctttgccgccattctggtgcccgggttcaggagcctggtgatgagcagttcaatgtcttcttcttgttttttttatattggttcagaacttcagatctgatgtttttttaggattgggatggtttttgttatgttctgtgtagatctccgtgtataatctgatggtgtattagattttgatatatgtgtgcagggtgaattttacagagtgaaaatgttatcatttataaatagtggctaaaattaatttacaacatgataaatattactcacaatacatgcaacaagcatacatatgcatcaagatgaaattgtttgccaatgggggtattctccaccatcttatccagtggtaaccataacagtccatccatcctaccaaacaaaaaaattgactcaccatatccacatgtcatccctccaaccaaacaaaaatcttgtttattccactctccttaccaaacataaaattggatggccatatcccatccatgcatgaccaccaaccaaacacaccctaagtgcatgcaagactaaaggcatccctgtggtttgattcaagaaaaaatgactattaattgatgtattgctctatttttcttgtgtttaggatgccacactattaagagggatatgatatacatataattggagtaaacaatagtactcaaaccatatttttcttccaagtgtttgtttagttatggtcaaagtgaagcatgtaggcctacgttgttaattttggtaattaatattaagcactaattgtggactaactattttatttgagtgagataatttaagagagggccacatgatgtgtataccaagaatgattaccggctaccgcagattaaaattgatagtgcaaagcaatgagaggaaggtgataaatatggttatgtttttaacgatcgaagcgttgggtgatcaatttgctaggttttctttatagctttaccgtactatttagagggggtggtaatcttgacaaagaggtgatctaaataacacattagtgcatgatgagggtttcttgtatctttggctttgatctttatttctagagctagccggtcggactgagcctatccagtaccgttttggtgttgcaacgatagcatcgggcaaattgtcttggtacagagcattcgtcgtgcacgacgaacaatgccggtcagaccaagcctgggaggctaggagctggtcggatcgggcccattagttggtcagacctgtgaaagtcccaaattgcttggtagcacggaggccacggttggtcggaccagcccttcgccagcggtctaatggccattgcatttattgcacccccaacatatagattttgaactagtttcagggcggctagccgtttagattgggcccctcaatggtggtcggaccaatagagcacagagttgggggattttgacccccaaagactagttttggtgggttgggctataaataccccccccccaaccagcaggaggggaacttcctaggcacttcattcaattcactagagcccttgcaacactctgacaccagttaagcacatttctctcgatttgtaggtgtttcaagagttgattaagacaatacaagtgcattgcatctttgctagatcttttatgcagttgctcatctctgagctttggttgcgactttttactcttggaggttaccacctcctagacggcttggaggaattgtggcccggtgatccctccggtgaagcttgtggaggtgacctggtgttgtttgtgcatggtttggacctacgaagtggaggaagaattaccggctcccgccttgcccatccatttacgaaggggttcgaaggcttcgtggtgtgagcgatgaggttgggctcacctcaaaggtgacataggaagctagcaagcttccgaacatcaggtgaaaaattcggttgtctcttctccacgattcacatttctagagataattttagcccaaatcgtcctaggcttgcaaaacataatttagttagttagcgtgtgatccctaaaacaagcctagtgtcatgccttgattttcttgcagggatttaaaaatcattaagtaatttatttatataatttattttaaaatgtgaatcaatttacaagtgcgtcttgctacctctatggacttagtccactgtaggtcaccctccctttgagccgccacgcggggcctgctcgtcagctccgacgccccatgccgatacattaaatccactttcctagttaaaaaataaatctttctccatgaggccgtaatcccccgtctcccggagtcctgctatatactttctttgtcctaaaataagttcaattttagccaactcacacgtaccaatataaaaccaaaagactataatatccccgctttatcaaattccaatgtatttattccctactttcacaggcaatgatgattaaaagtaaacttaaattgagataaatgggagagggtaaaaatgatcttattgtagaacggatggagtaactactttcttttgcacgagaagtcagtcaaaaaaatggcagtcttggcagttccatatgtacaccacagtttggttggaagatatctccttactcagctcatcttatattttttccgattttgctaaacatattgcgacacatttttccaataatattagttgaattctggacggttcaatacactttgggatttgtgcatttttatgggccggagcaaatggtatgctgcacgtgcgagataagggaaggtctagacctgcattactccctccatccacaaaagttacacctattacttttatcaccaaaaccaatgagaaattaaatcatcttggatgttacaaaatcaagtagtgaatgtaagcatacaaccaatgagtatttagatgactccttgggttctaatcaaacatttaatttatctatttatttaactcttgaatacataaagactacaaatagaacaacttatttagaaaaactcaaatgtgaaatatgtctaacttttgtggatggagggagtattagattagcgatagtaataaatactttggagatagcctgcatgggcgtagttgcctaacaatcttttatcagggttctctatgatgcttagttttctggatttgctagaaaacttatgcaagttttttacccctaaaacttttagatttgtgaccattagatcgccttgagatttatgtatgaaggaaaaaaatgttagaaacaaaatttcacacatgtcatgcgtaagaacctagtgctaactaaccaaaccatagttgaataagttgtatagtagttacatacagttacaatgtaattacactttaaatatactatagttacatatgaaaatttttgattcaaaaaacttgcggcggttttttaataatccctagatttttaaatttaaatgatttttcatggattttacaacgaatacctacaagaatactcatgaaaattacattgtaactagtgaactttacattgttccatcttcgtttcatgaacaagtgattgatcgtatttttattgcttaggttgtcttcttatgcacaagcgatacttatacttctcgtttttgacgtgcatactccctaaaccgccaaatgataccttttttttgcaaaaaaattctatgataagtcgttttatatgataagtcgttttgacttttttctagtttaaatttgagcaagttgataggaaaatatagcaatattttcaacataaaacaaaacatattatgagaatatattaaatgttacttttaataaaactaatttggtgttattaatgttactaagtttttctataaacctgattaaacttaaataaatttaactattaaaaagtcaaaatgacttataatatgaaaaagagagagcgcttaattaatcatgctctaataaaaaacgacatcttctcccgaatacttgtgtagtaatactcgagtggtccaatgattaaggcccaacaaagatctgcggatgcattggtgcacggatggcgtgccatgtaggagcgaaaaaccaactgaaatcataattttcttatatctatttagttacggaagatatctcttcatcaagaaatcaagatcagttctaaaaagaaaaaaaatcaagatcaccttttatatattttcctccggagacgttctctgtcttcttcctgctcctgccgccgtgagcacccctgcctctcgtctcgcggccgctgattgcttgccggtgtacgggatcgtcaaaggagcttaacggcgagacgatgaagccgccgtcgccatcaccgcagtagacggcggcgaccacggcgcgagtttttttttaataatccctagatttttaaatttaaatgatttttttccctagactttgagaggtgtcaataatctttatagatcgcaagatatacagagctgacatgaatctatactcaagaactgattgcccatagccccatactattgcgtagatgaaacccttcaaaatttacattgcctaggtgatgcatattctgaattttgtgtggcagcacaatttaattcaagcaatggaatcagaagaataaaatggcataattgctcatgtaatcccttttctatgtagaaagttctccacaatatgagtgtacaaaccacattcctgaattctaaaacagtgcatatcaacatatttactgatccaaaattactcttcaagtattaaaccagaaagagtaatacagattcattactttactgaaagtatataggtccataagataaaccacacgctggagcaatagtatgaaggttaatcaggaaaacataatcagccattagcctcattgcctctaacatcgtcaaggggaacaaaaccacaactgcaataagaaatgttaaatcacatcaaattactcaggtgagcaataccatgccaaacattttgataagaacatgctaaatctaaagtatgtaagagtaaatcaggtgagcaatacatggcgcacataacattagtctgggcacaagatgactaaatctggatcagcagtttcaacaaacaatatggtgctctttagtctttacagctgaatatgtattgacatgtatgcaatgatgtttatggctcatgatctgaagatccaagttattttttaaaaattccattagtccatggcccaaaagctgactgtgctcttggaaaataataaatagagatattctaaaccataggattgacagtatatgagatacctaaaggtttaatttaaattatttatgttcattctggatcatatgaaaaggtcaaaatggcttaagtgaatttttattcttcaaatatatgaaaaggtatatataagcataattattgtgcactgaaaaatcttaaaatttgacaacagacacacactgtaggggaaaaaagagaaattggtttaaacttctctataggggaaggggcccagaggatggctggcttaatgctatgaattgggttatttgtggtaaatgccagtacaagtgcaagctacctttcatgagatataatcaactgtttagcttttgcatggttcgtacccaacttgcttttgtgtttctcataacccctaggaaggatgttgggataatgtgaaaagaaataaatccacattgtaaaaaccagtaaagccaatcatagcgtcttcagtgtctctgaaaatatcaacaaaagcattaaagcatgcagatccccagctgacaggttaaaacatagtcaccatgcaaaccaggacaggtttatatggaccattcgcaagaaagtcagaggagcatatatatatagacaaggtagagtaaaccttaatgagtgaagatatatagcctagccatgtgacgatcccttttttcttcaaaacctcagactctaaaagtcctacagtattagtcaatcaatttaccatacaataataaggtacaagaagaaattcttgagaatttaaactaacagagtctgaagtgaaacaatacaaataatatatgtgcttgctgcaatccttccgaatttaataaaggaatcgaactaccagaatctgaagtcaaactataaaaatagtatatgtgcttgttgcaaatgttcttaatcgtgcttatatatagtactgtacaatgtggatctagatggaacagtcgacgtggttgaagaagacctcaggcggcgcatcggtgggtggaaaccagaaggtagctgtcggcgaggaagcaggtggagaggtcgtcgaggggcgcgacgatggcttcgatggggtgcggcgcaggattgggaatttgggagacgagcaagctagtcatcggctgcggcgacgcagaacgcggcgggtgcgaggtccgctcaccggttgatggcgatgctggtgtcatgccccgccgcgtgagctacccgacatgctgctttgttctctcccggtcgggccaccccggcgtgcacggtggagaaccccgcgccgccgagcgagtcgtgcagtaccatccgtggcggccgcggggaagggttcccctctggctcccatgtagccggggattgaggcggcgatggggaggcgccgcggcacagcagcggctgggggcgggggtgccggggatgggcgcgcgcgatggggaggcgatgaggtgcccctgagggggcgccggggattggcgcggatatgaggaggcggtgaggtggggagaaggggttggagtggagggcatgggggaggaagagctatgtggcggcggcaggacgaagacggccggaggagggaatgcctgggttgtgggaaagggaggggatttgctactgctagggaggtggaggtggagcgacgacgagggatcgacggaggatgggcacttgggatcggggcggcgtcggggaacggaggtcgtggcacttggcggagaggcagcgagcggggaggcgcagtggcgctgtggagagcgatgggcggcgatggcgttgtgtggatgggagcggggacgggatccgagtgagaaggagaaggaaggatcgcgccgtggcaggatcgtgaaaggaatctcgtccgtaggatctagcagatctaaaggttaggaataaaagttgcaggaatcaccaccaccattacgaccttgtataggagtagagtatctagggtgagtttgagaagattgggaagatatgcaaaacgaggtgagtcattagcacataattaattgagtattaattattttaaattttaaaaatagattaatatgattttttaaatcaattttcctatagaattttttttttaaaaaaaacgcaccgtttaatagcttgggaagcgtgcacgtggaaaactaaacaaactctctctctttctccacccaacgaacgcagccttagttacggaagatatctcttcatcaagaaatcaagattagttttaaaacatgtcaaaaaaagattagttttaaaaaaataaatcaagaccttttatctatttttctccggagatgttctccgtcttcttcccgctcctgccgccgtgagcccccctgcctcttgtctcgcggccgctgattgcttgccggtgtacgggatcgtcgaaggagcttaacggcgagatgacgaagccgccgtcgccaccaccgcagcagacggcggcgaccacggcgcgggggttcgaggttacctgcgtgaaggatctcctcccgctcctgcagggcgtccccgtcacgtatcgcttcgagaagcacaacgtgagtcgcccatctccacggctcactgacggatggggcccgccccctcccctccccagccagcgcacgcgctcccctcccctcgcccccgcccggccgccgccgggtttcttcctcgctggtttttttttttttgtgtttctctctgttttttttttcctctctcgctcggtgaaataaccccaactccccgcgcgcgcgcgcaggcgaagctcgaggggacggtcgccgccggcggctacgcctgcgcttgccccgcctacgcgggctgcgactaccgcggcaaggtgagatcccggttttttcgcctcccctcccggtttttttgcgcggagagagagggggtgaggatttttttttttttggttcctcaccatcttcttcctcttctccggcggcgtggggggcggctgcggcgcaggtgctgtcggcgctgcagttcgagaagcacgcgggggtgacgtcgaagaaccagaacggccacatcttcctccgcaacggccgctcgctctacgagctcttccacaagctcagggaggtgcccgccgagaaattccccgaggcattccggatggccgcgggggtgcccatgacggtgctcgccgccgcggccgccgccgccgctgaggaggcgccgcgggagcgggggcttgggccggggcctgtggcggcggagcagcccccggcctcggcgacgccccgaccgcgcccgaccatggagatgctgaccgaggaggagaaggccggtttgtctctccttggcttgaggtgagtgacctccgctgcttgactttcgtcgggaaatcgctgcgcagtagtactgtagtggtgtgatttcacggcagaggtgtatttggccttcccatggggatgaattctatagtgactgggggaattgtagggtattttgtcaaagctggaaacaatgacgtgttagattagtaaaattagtaggtagttgcaggattatgtcgggcttaattcgattttttgagcagggcaagtggctcaaggaccgaaataaattccatggacggcattgaagggcttgctacagaagcgattgggaatgcaccaagcagtgaccatgcgatgcttgatgcagaagagatggggaatgcagctgctcagcgacctaggaatagtggtctttccacaaccacaactgttaaagtgccggtgacagcacgcaataaccatgcaatgcctgatgcaaatgaggtgaggaatgctgatggtggtcggtcagcaacccttgctgttaaactggaggttacatctggcagtgaccatgcaatgtctgatgcgaaagagttgaagaatgcagattatgagcaacctagggatagtgtgctggcaacaacctctgctgttaaagtgcgaattggagcagccaatgaccatgcaatgcctgatgcggaacagacaaggaatccagttcttgagcaaccttgggatagtagcatgttaataaccgctcctgttaaggtgcgggtgacagaaaccaagtatcggccagagagtatactgaaagatgtaaggggattgctgtccactggtcttcttgaaggcttcagggtaacctacaagaagaatgaggtccgtgtggttccttcgctgttgaatctgacttgaagtctgcttttgatttatacctgaagaaaaatatgtttcttttggttatccttaggtggagaggattggaagaataaatggacaaggatattcttgtggctgctcagaatgtggatatagaaatgtcagctttctgttgtctctattagcgaaattttttatgtctgttcccatatattatctgaaaatttgacctgacattaatcatgtttgacaaattgcagataatgaatgcatgtgagtttgaacagcattccggtgagtcgtctaacaatcaaaacaatcacatattcttggacagcgggatttctttatatatggtgatacaaggactgaaatacactaaacttgatatgcttggggatgtgattggaaaagtgatcagtctccctccaaatatgattcaatacgaaaagtggaaaggtatttaattgagtacctagcatttacagctttctagcttttgtatacttcaagatgctaagctttctgttgggctatctttttttaaaaaaatttttatgtcatttagcttcgtttcaactggaaaaggattatttcgatgatgcaccttcagatccttgttcaactcaaaggtgagttaccgtgcatgtgaaattttagtgtgtcttgtattcaggtttcccagaaacccattggtgtaccttgatttatatgttttgttcttaaacattgttttccggcttgaacttttcaataggttctctaagccccatagtagtggcagcttaatgctatacatctgccagtataaatgaggtttcaatttaagctcatgtccaagcatgagcaaattctttagtattaccattttgagttgtatgctacctcattttatcaagaacatttaggttatcataatccaccagagactgactccagcattcttgaaaactcaatttctagctcacaagagtcgaatattgccttgacggattccttgaaagactcaaccagcaacgccagttcaatcctcaactggagttcattcaggaggcgttcagataggcagttcaaacgaggaggcactgagacttcgactccaatcttgagtagaagccctgagaaagagatatctgatctatctacaagcacttccatgaagagtgaagaaactcctagtgagaatactgcagggcttctcactactgatggtataaaacataattctgctggacctgttgcattgagatccacgtcttcagagtgtgatcccattaatatgacatttcctttgtcaatttcagttacagtaattcaagatcctccaccagaccacaatgttgactcaaattcaaaagatttggggcaaccaaaagtgaggtaaaaggttaaacctacaacatttcttgacatttgtcacatttaggatatacagctgcaataaatggagaaatcttagctctcgaatcctttttgttttatcttttctccagagataacactttgcacccgatgctcttcaaggaggggggccttccagactatactttgttaacttacaagttgaagaacggagaggtcctctaaatagttaaatgaactacattatcctttcccaacaccagaaattgtaacaactctcaggaacattcacacttccctgtcttgtaggttctaaagcaaggatataaacttgggacaggtataatctgtgaatgttgcagtattgaggtatctgtcccaaacttagcaattgcccaagtttgatctgaggcctttcttnnnnnnnnnnnnnnnnnnnncacgttttttttttcctcttttgaggtgcagtatactccttcacaatttgaaaagcatgttggaatggggagaagacggcaaccgtaagcatcatcattatatatagaggcgtttgaaatattttttactcaaaaagggatcttggtgttttgttcataaatggaggatatttgtggtttcaggtaccgtagcatttatacttcagacggattaacacttcatgagctggcactgaaactgcaggatggtttaagttcaaatgtaaatattgatgaactccctactcttacttcaggtaacttaatggatcttttagttttctgtttatttcatccaagtggcaatgtgcccttatgctttagttatttaaaattttgcattttgagggtcattgcaataatcacgatctctgtagaattattcaataggttctttgtgaatatttgggcatgtatgtattagtgtcttcgtgtttctttgtttaaagaggggaacctatgtatatagtctttatgtttacctgtctaaaagaggggaacctactgtgataatggcattatcagttcatcactttgagcaggaagattatcatgtttttgtccacatttgatctcttgatgactcattgccttcttagttaagaacttgagactataggatcaaagaggtaagagcttgtttgctccaatatccaaggtgaagccctatgtcttaagtttctgggtgaattggatggtgcatacaataaaaatatggtgacagagccaggatatcctaagattgagattaggttgctgtagtttagaaaacaatttcaggtctcttgagcctatgtaagagccttataatgaagcattgggtgaagtagtgcatgaaacttcttaaggagcaagatagccgcattgctgaggtttagtaatagagctcatgctttttatgggcaacttagatgaaaatgggacatctatacttgatttagtacatgaagtaactactcattttctttagacaatgaatgaagtaatattttgtcaagtaaagagtgaaaaatattgaatatatttgcaagatgctgcctcgctgggaaatattcagaagatgattttatattttaattgttgtatgcgcatgagtacctaatcttctgttgctaccatgagttatgttaagctttgcatctaaaattagataagaggtagaaatttaagcttttggacaatccatttacgtgcttttgagccttagatttcttgacagaacctaatgactactttaggaccacgaggtttatatctgaaaaatagcatataactgtttcagcatggggacactggcacactagtcaactaagggtttggaaccttccctcctagcacgcaaaatggagtgacgacttagcgcacgattaattaaatattagctaaaaaaacttgaaaatggattaagatgatttttctaaagtttcatatttatttatttattttgcaaagaactcgctgtttagcagttcggtaagcgtgcgcgtggaaaatgagggggtagaggttagaaaccttcagtgctgaacacagcctaattgtggcagctgaagaatcacttcactatcttactgaggaccaactttggcatagataaattatatgcagagactatgctattcttgcaattcatgcagatctttatggagcatactcaaattttttttctccataacatggtttagaatttctttttgttgtgcagtacccctctttctttcttttttgaagagaacattatcgtttttctgttatgtgccaagattatattaccaaatcattatatattctctagactctacatcataagcctacatataagcacaaaaacataaaaagtccaaggaattaatgctgaaataataaaatatgtctgagggggtaataagcaactccctcattcttgttttatatgtgggactgttgcctgttggctaaagttatgcagaggttagggtaattgggcacagggcatgttgaacagcctgcttatattttacaaagagaacagtccgtttctgttggaatctgtcctttgaactggagaacttgtactctttctctccatgctttctgaggagtaaagaagtgaaggatggtggaatattgcaattttcagagagacattgctgtcttcaaaccatggttct

SEQ ID NO: 80044 - DNA, 17820 bp, Oryza sativa
agtcccgattgagcggccgaagtcactccttggattaggcttggccagccaacccactcatagggcggttggtccaccacctcacttgggcttgtcttggtgaaattgggttaatggccaaggcattggacgtggtcggccggcctagtttaacttggtggctgacccttccaaggggtccaaaggccctccggctaggcttgtcttggtgaaattaggttaatggccaaggcattggacgtggtcggctggcctagtttaacttggtggctgacccttccaaggggtccaaaggccctccggctaaggtggtgaccagcctgattgctggcccttgttctaggtcggtcgaccaccctcggctctataggatgacggctctataggatgacttgtttttctggtcgtcgtatctgcttcgtccacactccaagtcacacgtatgtactaagattacacacatatctattcacgttccttattcgatctttctagttttgacttgtttaatttttttttcatacacacacacctcccatgcacatcaatatagaaatctcaacttcatgtgcaccatgattaatttggcatattattcatgaactgtcttaaccctcataaacctcaacattttggcatattttacatcacaactttcccccaacttttaatcatttacttctattttttgaaacatatatgatttcaagtagtaataatctcaagttatatgtaagagcatatttccaaagtttaatctattttttgaaacatatatgatttcaagtagtgataatctcaagttgtatgtaagagcatatttccaaagtttaaccgttcaaggctcttatcctattcaccctaggagggctaggacataggggtgtatatccagtataggatcgggtctttcccacccaaaaagtagctaatgaaatgagagactcccctacttatatattacatcatttgtccttccataatctatgtgagactatttaacgtatcctaacagataagtataaggtctttggcagcgtcgtgagacaaatacatgtggtgccgacatagggaaattaagctggctagatagctagctagggatgcaggtgacacgtcgacggcgacggctagctgatgcatacattggtacggttgatcagctgattaagtgtcccttaataatttaatgtttcccgatatgatcaatctctctaaatatatcgctaattatacttgtttttttcttcttcttctggcaggaattcaggctcgttcttaatttgattggttcatgaacccctgcaccaacatagcatgtctcaattaacgtacgtgtgtaccaggctaccggtagcttaattagccagtgatggaatttgattattaatttggctttaaattagttccggacaattccctgatccatctatctatcttgtgtgactatctacttccaattaaggcccccggtcggcagatggcaagagtaattagcaaagttccacagtacagatgctccctaggcctatatatagtttaattttgcgctcgtactagctagatagatatcgaagatatatacctttcagctcactactgtttaacgttgttcggcaaagaggagtactcaccaaagtaggcccaaaccgaccaggacttaaccaacagctttatattcaattgagaatttattaatttcatcagcatgcagctgctactggtccaaatagagcagctagcatgaatattgtgtactacagcccggacctctctcgatcgatcgaatatgcaagctagatgccaagatctatcgatcctagctacaccttagctgtttccatggagatgcaacgcttgaatggcaaatggatttttgaaagagggtgactagctataacttgtctctgatcgatctctctctctcgctaatttgaagaaatggtaacagagagttactgttgatatgattcactgaaaggaggatgcttacaagaaaacatcgagtaactaacaaggtggtgtaacctccgcatgttagaaggtttcaacatggcgaaaaattatggtgtgtttcacttctttcatatatatttttctaggtggtttaacgacggacaatttttacgatgtggttttactaaaactagaatacctacatgtataattgacgagaaggggtaccgtgttttcttcttaatctttaactagataggagctaaaggtttagatgatattatttgattgttacgatttatacttttaacttttttagggggggtgtatatataaacatgtaaggaaatgtaatggcaaccatacataaagacaatcgaaagaaagataaagtgattaactagagggaaatatttatttcaagtagatctacatatgaaaaatcagagagttaaaaaattatgtcagcattaggtttcatgagagaggtatcgtaaacccttctttgctttttttttttcgggtgactggtggggagatgagggtccttagaagaggtcattgttagataggttcccacggagttcgtctatttctacacttattttaatactcatgctatatatattgttagatacttgacaaatatggaaggtacacctgataactagggatgttaggatacgtaaaaatgctgtaatactagataaaatttgaattcaaactcaactagcttttaattaattttgaggttttttgacatatatagtatgtattccaatcttgtctcacctataaaacactaataatacaaataaaagtttacacacaagctatatatttttcttctttgtttaattttttatggcttatccggcgaatctacgtagtgtttatcgggatcacatgatcccaagtaaataacttaatgctaactaatttatatcatattaattagtactatattagtagttaataattagagacttcctccattccaaattgatctacatatagtttttttttaggttatttctaaatgatctacatatttgtgtttatttattaaatctatttgttatttgtgcattggagtaaatggacattgaggcatgcatccatgcgcacaagtatttataacccacatgcaatatcttgatttgctattggctaggaaatagtggggatggtgcatgcttcgagtttgttgctagagtaaatatagtatgagagaattattagtttttttttgtcttggtgtacctatgaaatatgcagatcaatttggaatggagagagtaattgatatctatagaatcctcgtaattttttctaggttcgtcactgggcttaggctgtgtttggaggagggggttgggaacccctcctccctggcacgcaaaacgaagttcgttttattacattattaattaaggattaactaattttttttttaaaaaaatagattaatatggttttttaaacaactttcatattagaaagtttttttttataaatcataccgtttagcagtttaaaaagcgtgcgcgcgaaaaacgagagatgtgggttggaaaattaggggggaagaacacaaccttatattagcagtaattcgatcaaataatatgatctatttcctgctagcccggaaactcaggaaatgggcacgtatagtaaagcaagtcgtcgtttggatcggccagtccgatgaggctataaatcatactgaggcggtcaattattaatcagggttctggaatgtaactgatgagatactatgtgccaacggcagactggcagagacagtttatgaccgtaattaagcagccgtgaccacatgtacatatatgcatgttagtatgtgggttatagtagtacttgcagttggtgaacttcatctataatatatggagtgtagtatactagtatatatattatcctatattaggatgcacaacgcgtgtagagaatcttaaactaagtcaatttataggcatttcgatttggatcattagtacacaaaaaaagataaaagattcaacatatatccaaaagcgaagataacttttttcacgctgaaaagaaaaaaaaaatcaataaacaaagaatattgtagttttttttttgccaatagcaattatttgaaaggtaacagtaattattttttaggggttgaggggatcgaatgaatggttgtgaggcacgctacttacactactagctagggctgcattcgttcggagaacatggggaggttggttgtttcgttttccacgcgcacgcttcccaaactactaaacggtgtgttttttacaaaaaatttctatattaaagttgctttaaaaaatcatattaatacattttgaagtttaacatagttaatactcaattaatcatgcgctaatggctcacctcattttgcgtattttcccaatcttttcaatcccctctccctcaaacacagcctagatatatttttacgggggtgagaaggggagcgagtagacggctatgagttggttaaaaaactcatggccgtcatcttagtctcccctcctcaccccagtaaaaatattagaaaatgctttcatgcagttatttgtattaaatttataaagtatatatagagtagtgtcggagagtgaacttctctagcagggaaccatgaggccctcctttgtgagttcggccgggggcagcgggtgagattcgagagcttggtgagcgatgctgtgtgatcttgagggggttcaatcccccaaagacgatgggacaaaaggggtttatacaggtttgggccgctaggaagtgtaataccctactcctgtgcttggttgattgagtgtagaacaccagtgcttgaggttgcaagacccaagcgcgagttcactcggaagttcccccctccaccactaggcatggacctccttttatacctcaaggggttaccacatgggtccaacaacctaacctaactccggtggagaagtattataatctttgcattaaatgcatgtctggtctcttgacttgggaagccaagcgcacgtcgtcttaatgatggggcctgtcaaatcttgccgcctgacacggggggtgcccttgtcagtcaccatttaatgggtaaagacttctgggctcctattacaccgggaaacgggagcattgctttgaccagagcgggaggaccgactccgactggaataagaggatgagaacctctcaccatcattatttgatgggacatgtcgggctgcacgtcgcctgacacacgcgatggtgcgcctgacatcctgggtcccatcagtcattcaaccggtcacagaccggttgagtgcactgcacaccgcattaaatgcggcgtggcgcgaccgctcgggtcgccacaaatgcgggtaggtgggcaccttgaggcagacacctaacccaccatacgtggtgacctagagagggggtcggggctgcccgacccctagtgacgggagggggcggccgccgcccgacctcgggcccgatcccccctcgggggagggccacatggcgcctggggcagcctcctccatccattctatgggaaggagtggccgccgccctaccttgggctcgactcccctcgggggagggccacgtggcatcggggggcagcctcctccgtttaaccttttgggaaggagtggccgccaccccacctcaggcctgactcccctcgggggagggccacgtggcatcgggggacagcctcctccgactagtctttgggaagaattggccgccaccctacctcgggtctgactcccctcgggggagggccacgtggcatcggggggcagcctactccctctaaacctgataccccggacccatatcaccgacagtagtaattagaaaaggcgatgatataatatgcgtaataagaactggatcaatgtcgtgctaaacgacaagaaagtaaattaaaggaatcagtaattctttcagatcgacaagctgctagcagggatcgatcatcgagcaagctgtcagtcagggtggcaatcaatcttcaaccatcaacccggccatcatcaactgactttcagtacattcccgggctgcaactttttgtgggtcgatccctttgatgaatatccagcaggagtaattaattagctcctcaacaaagaataatattaacctcacttaattagtgtgtctccgtttcatctgtccatcacatcatatcggcacagctcgatcacacattttattagaaatgaacatatcaactcgaatgggtccagcctgcctgccttttctgaatgatctctcatccctattcacaatgaacaggctagcatgcatatatgcagcttgcagcaatgcaagtagcaagagtgcgccagcagaaaacttagatgcgatgcaatgcatccatccatccatccatatgtatgcactgcatctggcaacaatggcgatactgcccgggaatgaatcagtgtgtgtgggggggggggggggggcagagagagttgctgctgcatgcagcaagttggccaatggcgtgcgatgcaaatgcatggctcagaatgatcgatagccatacagtatatatcttctctactgttgcctactgttgcagctggcctggctacccctgcctgcctcttgctaattactgatggacagattgatcatagtacattatatatgctaccgcctccatcccaaaataaatacagccatagatatatattcagcatttttgagcgtccgtcttatttaaaaattttatgaaaaaaattaaaaatattagtcacacataaagtactattcatgcattatcatctaataataataataatactaatcataattatttttcaaataagacgaacgatgaaacattgagcatgaaccgtgttaaaactgtatttattttgggacgaaaggagtactcctaaatgataccatcaatattggcagctgaattgcacctggtattgggggtcagtacaccagtactctccagctgctccaattttgactgttttcagggacctaagcagaaaagaacctggtataatatcccacttgcagacgtaggtaggtccaagcccatatggccatattgatctttgtccagacattttccaaactttgcagtgatttctctctctctctctctctctctctctctctcttttctttccaaacagttgcatcagatcagtgcctttgtttcactgtaccttttactgcgttgtgtacgaggcaccttgctgctgtcctctggtactgtgcatgttccttgtctgcttgctgtggacctgatcttcatttgggaggagaccgacttcttcctcttcctttgtttgcatgagagacgctctgaatcctcagacctgcatgctgcacctgctttatgtaggagtgttattactggagtatttctctatgcccacaagtaggcacacaaaatgttaattctccatgaaaacctggtaaaatggaccagtacctcttgaccaattgggtaattaactaaccccacgagctagctatccctacaaactaaaagcctgcactttgacagttgacacattgatctttgtatgtacaaagttgaaaatttaaagacccttaattacatggaaatgctgacacatttaggtgggaaattacaccaatgtctaatcttactccaagattcatgcttcatcttcgacgagctttagcaaactttcacgaaccctaaactttgacagaatacctattggttagaatcttgggttaagaatacaatcgagaagagtgggggtcaaggacgaggaaatgggaggtgtgggtcggtcggaaaatggtatcattattaggtgggaaatgaaagagggatgaaaacggtcggaaatggtcgaaaacggtatcattattttattgtttttttgaaaacgaatggaaacggtcggaaaattttcatatttatgaattcatctatttagtgtcaactttaatgccacgctgacagaaatttaaaaaaaactaaattttgaaaacggtaaccatcggtaaaaagatattattattatattagttttgcggaaacggtatcggtacggtcggaaaatttccataccgttttcactatgtgaaggctaccagctgccatggtagagtagtgaggcggtgatggtattgttcgagccacaagagagaaagatgctgatgggttagtgttggaggcaagacttgtaatacggagtggtgtggagatgggtctctcttcagtcaggggcggaggtaggcttagggcagttaggacttgagccctaaacttatctccaaaatcttgtttaatttttgttaaatcgccatgcaaatttaaaaaaaaaaaccaacactcgattagttgagctctttctttcctcagcctttcataatttctagccccaccactgtttaggaaaggagtcggagccgaggaagaaggtggggtgcgcggcacctcacatctacaatcaaagagaggagagcgatatgatgttactgtatcatgatgtttgctgatgcacacatatatgttcatatgtaccctgcccaatcaatccacccgaaaatggaaagtgacacatctactgcatgccaaaaacgatatgatgcgatatatatatatagtgtagccgccgttaattggctccatgcatgcatggtagaaagttctagaatataattataatctactactcatgctaagctatattgtgttcaagactttgacttgaacacacgcgcgcgcacatgggaattttgacaggagaaaattagaccaaaagcatctcccttctaggtgttgatccaatcatcaagtcgagaaaaaggcaacacaagcaagatattgctaataattcattagtactgatcatatgcatgcatctgcagaaagttggtgtcatcatcttaattaattctccttgctaaatgtattctatttcaaatccattttgtttgctttacattaatatagccctagctatcacggtcaaactaaacaataatatgcatacgatacgagtacatgtttacatgatggtacaaaaccagtgtgtagatatattcttaaagtttatccatggatgcgacaaaagcagaatggacccgggatacagaaaacatgatgcgttctagccggttccaatgggcaaattaaaggtactatagtactagtactatgcatgcatttgtatttttgttctgaatgctcatggtggcttggaccacggcctcactagctagctaggttaaatactttttgatagtattccgcaacagaattgccaagcattaaacacgatgtgaaattttgataatactatattctctatgttatactatatatttatatcagaacggtgacaaggaattcataaaacatatgcattgaacatgtaccatggtagagcgagctcctagatagattggcccctttacaatattgtagtcgagtcattgatcaaacaaaatgttttattcttcttccttttcctactataccatcatgcgacaaaagttccttttataaaagttgtaagtcgatgttaagcttaacatcgatgtttgcccttcgtcttctctctactgtatcaacaaataatttgtcttatcggcaagcctgagggagctcatactgatgactagaataatatttggtttaaaaaaatgtgatcgtcaataattttaaaatttgtagtctaaattgtaaaggaataatatacagagagctggcatgaaaaacaccatttatcttaaacttatttggttgtgctgaacatgttgtatcacaaaatactctatctgttgaaaaaataaaaataaaactggatatgacatatcttaatataactaatctggacatgtttattttttttattcttgaaacgaaggaagtagttatcgaaagttttaaaagttggaccgaatcttatactaaacacgagcatttatgaattatgataggagacagtattccacaaggttcatcgtgaaagcaaaatcttccttgtaagccgaaaagaacaaggaagaaaaatcaaggtgtccgactacgtacaatacggtcgaggaacatgttgaggtagctagctagcttagctcgggagtggagtggatttaatttatttctcgcgacgttttctcatcactcctcgcggcatagcacatgtaggtccgtctagatctcctggtaaaattttaaaccctgtcacatcaaatatttggacgtatacatagagtattaaatatagacgaaaaaataactaactacacatattacgtgtaaattacgagacgaatcttttaagcctaattgcgttataatttgataatatggtgctacagtaaacatttgctaatgacagattaattaggcttaataaattcatctcgcgatttacagaaggattctgtaatttgttttattattaaactatgtttaatactttaaatgtgtatctatatatccgatgtgacacaccaaaactttacgcattgaatctgaacccagcctaaatacagccgtagtacatgaggatgagagagagagacgacgatcgatcgacttggtgcacatgcacgaaaacgagaacgagagagaaaactgatcgactcgaaaacctgcagtccgtgtttaaatttccccggcccctgctgtgttgcgcaggcaatagggcaagttgtgcgacgatcgacgacgatagatggcgaaatggaaaaaccattcatttccactttaatcctttgtttctgcatcagtggcagagagggggtgggggatgcagctagtagtactgtagtatgctcccatcggatggcctattcacctttaaaaaaaaggcaaaatttgaattttcaaacttaattttgatattttcaacgtagtttcttttttagcattggcttctaagtcaccgagaacacatatataaaaattttaactacaaattcatttttattctctaataagccgttttggcttattacgaaaaaaaccaaccgataaggcccgtactcgccctgtctcaatatataacaatctgatttatgacatatcctagaaatacgaatatggataaatacatatccaaatctatagatatcaaacccgatcataggtttttatatatcggaacgaggaagtaaagtagagcagaagacgacaaggtcatccagcagcagtggcagcaataccagtggcagcatcaattcataggccacagtagcgatccttttctggatccctccctgcagccactggacggctggaccagctagcttagctagcggcagctgatgctctcgtacgctgatggatgcagcagcatgcactgcacacacacaaaccacccgggccgcggtttctagcttcccccccggtgtgtggagatgagatgatctctctctctctctctcggccacagccacacgggccgtacgttgcgcgccgtggtttttggatgcccaagttgctcatccgggatggagaaggacgcatgaaccgtaaggttgtctcgctatgatgttacaggacggacgaaaatttttcggtccagtactcgaggagggttttattgaggggaaacagctcgatttccggggttcaccggagggaccgggtaaaaggatgctacccatattttaattggggtccttgtcgtatgcttatatatatatatatatatgtatatatatatatatatatatatatgtatatatatatatatatattaatgatttgtgcagcgttctggggtaggctttttcttattgcttggctacttgtgtacgggtgttaaggaaaatcacatactaatagtagctatcggctttaatttagacctgactactctcttattatctggaagaactattattaccttctcccttattatgtatttgggctctatttactcgctactgaagcctatggacctccatgtcggtcgtcttttttatttcagccccactcgtcccactagcgcgctcctactagccgctcgttgcattcttatctcctttaacccctgaaattctcgtacgtttctgatggttttcgcttaattagatattatcaccatgatgtcgattatatctacatgttgcaccctggtaagtctaaaatccaccctctcgatcaccatatatactttgttcgacgcatccacatgttgaatttctcacacttcaatgtcttaaaatgaacccctaggcatcgtgtcttcctggtcttcggtggtttcagacgccagttaattaactgctcggcaccatcagtcctgttgccaaccgcaggttcacaaccatccatacgtaatcccattctaatccctatttgttcatcttaaatatatgctacttttttcactcccatcctaatccctattcctgaactatttctataccattatgattaattgctgagtttaagagcctactaatttcctttcattccatatcataccatattttagtttgtcctaaggtaaaactggattttgaagaaactaatttgatgattttttaaaaaaataattgaatttatttcggccatgacttctgataagctacatctaattattatagaatttgcaggagtaatcattgcgaattacaaaattacaacttcactagaagcaagaaaactactaagaaaaaccacccaaaagacagatatatccatatatgattggtcaaagtatgcataaccattgtttgcaacaaacggcttacaagttgtatgtggtccttatcttccttgaactagaaatacaacatctccgaaaccagcagtcgatcgaattccgcctccatcaccgttagcgaatgatgtttaaccaaaggggaagaaaatgttggggactagctgagcggtaaatcagtcattagttcatatcttagcaccaccaaaggaacatgatcagacggggataccgcagcaaggatattgcgctctaatttagggcctgtttggatgcattacatcggttgttgggacactaattgtaagtattaaccgtagactaatgataaaacccattttataaccctggactaattcacgagatgaatctattaagcctaattaattcatgattagcctatgtgatgctacagtaagcatgtgctaattatggattaactaggcttaaaaaaattatctcacgaattagctctcatttatacaattagttttgtgggtagtctatgtttagtactccaaattagtgtccaaatatccgatgtgacatggacgtactacattttattctctagatccaaacaccaccttagacatgaatttgtcctttcacttggaagacccgctaccttcttccttattatgtatctgggatctatttattataaaagttagtcgatatagtagaatgacgtctaaccttctcgatcacttcagtcattgattacccaagacacgctagatgacaatatagcagcacacgatatttgttaacgagattcaggccaaacctacatcctcgaggttctgatgatgagcgctcctcctcaatggatatagcacctaggctctacaagtacatggcctcgtcgttatcatctccctacgtgtctacgctaaattgtagtcgttacgtttacattgtggtgtctccctccctatttaaagaattgtcgggttacagagtccgattctaattccaccccttaccacctattacaactctaaatccaattgtaatcaaataggactaatatattcgacacctattcactattcgctctctagtgaagcctacaaacgtccatagatgtagtcttcctcatttcagccccgctccggcccctctgttcaccccactagttcatcccatcggcctctcattgaatccttatctcccttaggtccccgagaaatctccgtgccttttcatttttttaccttatggtttccgtaattttttaattgatcataaatcttactagggaaactaatttattaatttgatcattttcagataaaattcagtccatggttaactaattaattagtaaatccggaaaacaaattaatccagccggtgcgtgtacgtctgtccaaaggtatactatatggaaccaaccgggcatgcatggtggatcggcacgcacatacagtatgtctcaagtactgtacatgacctgtgacgactctgtgagtatttttgtttgtaattaaataaagttgctggatgagccggaacaaggggatggaggccggattggggcatgcatgtacatggtcggcagcagaaaataccaggtgcagcatcatacgtacatatcgatggacagcatcatcatgcggcgggcaaagcatcgcatagccagctgcactagcactacgttccagcatcatccatctgctccccagccccaacacgacaaataaaagccggagagagagagagcaggtataatagataaacagttataaatatattttaaagagataaaagaaaagagagaaaagtaacgggctataaatttgtagccagctacagcatggccttcaagatataatgtatgtatgatagataggaccatatattaatagtatagtaagcaactattatataaattgactattacatcgactataaatgattttagagttagtaggggcctgcactgttaaacttgctcagagagagagagagagagagagagagagagagagagagagcgcgcggcgcctttggttttggttttggtttgctgcagaggggggctgcatttggcctcttctcgctttgcatttttgtggcccagccaagccgcctgtcacctctcccgcccacttgcccatgttgcataccggccgcttccacatttcttacatgcccacgcacctattcatgcatacagccggcccccaccacctgcccaattggacattaatttgcttttcattttgtagatcgatatcctcaaaaagaaaaagaaaaaaagggatggagagggccggagatatatttcttgtaatgattattgtttgccaggtttaatcctctgccatatctagcttgaattttttttccaaatgggctctgaattagcggtcgtgcgagttggaacttggaaccaacgaccacgcgacacggtactggttaggagacaatcgcttgactatagtggttcgatttttcttaagttaatgttttgtgtttttagtcatcgagttaattgtttgaaattaaaagagattgttaatttttcttagagaaaaacacccataaacacaaaaagattgttgttttcccccctatatgttgttattttattaccattaattaattttatatttcttttatgtgctgccactatcagactacagagcttgagggtgagaaaacattagaaacatattatggagtattcagttttccaacaaaaacataattactgccgatcgataacccatagttgtagccttgtaggcgtacacacctagcaaccaccgcctctggctgcaggctgcaactcaatgcatgggaaattaatttttagttccccaaaaaagagatttcttaattttgaattttatgaagttttatttctgagaaatttcgatgttccaaatgagttctaaattagcggtcctgtgagtagaaatcaacctaagtagaaacactggagcggtactaagttagcgacagtttgcatgttcactgtaataatagtgttcccatgttttacgtctttttagtagcaagttgatcatttgaaaaagaaacggctgtttttctccatctctaattttatcctggtcttaataatttttctagtgcactataaaaactactggtagtaattattaagatcgtttaccacttagtttaagataatgcttctgattctctgcgatggctcctatggagatagaccatggaaacagtcttacagctgcatctatcttatcaagacatgagtatacacgtgttgtggacgtttgtgtttgtattgtgtttgttctctgattagaaaaaaaattatactatactatactatagaccttgataaaaggaattagtacaatcaataaattgtggttaagtattttattagtggttatgtaaattaaaaacaacaattaatctcttgatatgttggagaacacatgcatatcaatttatagtagtcttctcctgagaagtttcctattggacgctagcttatccatcagaatataattatgcctacttgcagcctaaatgcttgacacacccatgattcatttctctttctaggaagaaagtttctctttctaagaaccttcttccccctcacacctaattatagacgaatgcccttcgctttcttcacttgtcacaattctgggcacgctttttttagcttttcttattgctagaaactaattttatctgttcctttcttcctccattttgaacatacatatatcacaaaaattccgcccaaaaaataaatacatgttgaacataaatatatacgtctcctaaatttcacgttgtttagagctatgtttaattaattagatgcatccagttagtattatttttcttctagctttttaaattttttttttgtttgctgtcgcggccgccataggattttgcaccttggtccaacagtttttgatttttaataataaattaatgggtgaccagatactctgatcaaaaagattaaatagggatgacgcacacgccaatccgctcaagtgacgacacagtccttgacttccttgaagcacgtgcacgtcaaaccggttagtattatagactaattctttctgtttatgtcactgctaattttattttatctttaattagcacagcttaagaaatcaaattaattataccataacttagggcgtcgatgttttttataattggactgtgtcgaaacatgatttcggcaataataaaagggggtagcgcacgagacctaaaagtggatggatgcggagacaaaggatttagacaggttcaggccctctcaatgagaggtaataccctactcctgtttggggatttgaatccgccgggtgtagtatagatctgacgatcaggttgtgtcatcataccccctagagggcctcctgcccaccttatataggatggggggcaggattacaagatagaaaccttaaccaatacggtatcggtttcctaaatctactttacaatattatcaaaccaggactttaggccgttccgtaatatacaaggaaacgtaacacccaagtcatgatctgttacatattacatagatataagttatcccctatgactagtcggataaccatgccgtatgggtatggggtacccataatatccacagtagcccctgagaccttcgcagtcgaaaagataatcttctctcgaaccagattactccaaagccgagtgcttcaatcatctttgtcatggtctcccgagtacttttaccaaatctgaagactgtggagggctggaaaataaagtcaggtgcaccgactagatgcacctaataggtgtagcccccgacaatgtggttaattgaacaaaccaaacatatagtcaaggaataaataatccaaccaaccgagtggttttgataatcgtaatcaaccaagtgacttgatatcaatatatagcatatgcggtgtgaatcctccaaataacatgatccgagtgtgtcggtgatatgggaccgggagtatcatgactagaggcttgaggcagacacaatcgcccacgtggcctggcaccttcggggacgtcgggcccgagggtgaggtgtccgccctcctcctgatttcccccgagggggggtcgggttgcgtttgcc

SEQ ID NO: 80045 - DNA, 49668 bp, Oryza sativa
ttaaacaagaagaaactaaaggtcggcaggagtacattctttaggcagaaagggatgaacaacatatggattagtagcaaattgtaggatgccaacaaggattggatatgcactggaaatagatctaaatctatggagaaggtgattgtccaccgaaagttttgtaattattgtagatgctcttatagtttaattattagggcttatacgagagccttgcgcgtagatcttccaagaataacgagagatctctcgttgagagatgaatattattcgtgccactgaaattcagtcatgatgatagagaattactctcccccgtggcagctggttacagaactggtggccatcctccagggcctgcttacctgagcatcttcgcgctggcttcgactctctggtgctcctggtctcttggtagctgtggaatgaacggaactctaggattttcgactctacgctctcttcagtctcagtggtctggagtccatccactcggagggccatctgtagtctttagctggcgttgccgcttttgtgggcttgttgggagtgtagagtggctcggccccttcccgctgcttggagtttgtgtttagccgccgtagttttctaagcttcagctttttattttgctttttctcccttcccttggcataagccgtggctgattgcgttgtgtaactataactttttttcttctaatatattgacgtgtaatccttttacacgttcgcgaaaaaattatacaaatttactcttgttattttcacgtattaactggtggctgcactggttggaatattgtatagagatcagttcagatcgcccaagggggaaatgagaaaaaagctgtaatattctaaaaggaggtgctggcttcattaaatttatagttttaacacttttcgagttgttcattaaataacttgttattcttcgaattgaagtacaagttctgattgtgttaactatgcatgatcgatccatccacctagaaaagaaatgcaagctctctttcatttattctcgaatttatttttgtttatgccagcataaagagcactttgtggatacgcatataagtagtatcacctaactaaaacattctaacggagtaacgatcgatggtccaatattgaaagactgcaagccatatctcaatgatctgtacgtactatagtataaatgataaacagcatatcaccacttgaaagatgtggaaccacgcaagagagatgattaatttataaaattgtaaagatctatctgtcgctaaaatcgggctgtatgcatccaagttggatgtagctgccgagtttttaatctattttctaaaataaaatatgtcgctaaaatggtgcaacatgaggtgcaagaaagtaaaaggtggcaaatccattaaaaaatcatcatacgtagggatatgttgttatacaaacataaccaagtttttcagatatgtggaaagaaacaaagcaactaaaaatagattatgagttaaaatttggtatgtaggtatttgacaaagcagttaaggttagtgaccatttataagaaaaaaaaaaggcccaaaacgaaaataatttttaacgcacaggatgttgttcaagtgcatctatgctttacactttcttgagcacttcgcttgtaagattcttgtccgggctggttgttgccgattaattaattcccatatggccatatgtgacatgtgggtgtaattaactttcatgcgtttagcttaaagagcactacagtagtatgtggtaaagagattatagtacctttgaaaattattatcatgacacaaaagctattctgtatattcattcagtgcgaggtgcattggagtagctatataatgttctcataaagaagaaaaggttcttttttacttagtactgtctccatccgagaatacaaaaagattcattctatgtaactgggcaaattaaatcacttagatctcattcggtacaaaggatttttaaaagattattgcaggaattgaaattataggattttttttctctatgcatcattcatttcacagaaatagatcataccaatttactaagaattgtaattttataaccatattccttataatctttagcacgaggtaagacctcttgaaaaaatttctatggattagagtgcatgtaacattccaattatttactttttatattcctgtgatttgaaaatacttctaatcgaataagctcatgtattctcaaacggaggtagtactagttatcagtacacttattacagagttgttagtggatttaggcctgtttggacagcccactatctctggcccatccctgtggatggaacggatggcactggattttactaccaaacatggtagctcttggagattacaggagcaaacaacaactagccacactgaaacagagatgccgcagaggaaaaggataccaccactacatgatgcatcatttgctgtgttccacaaagaccaagcacacatgatggcaaggtagttgcttgcctattaggtgctactcctactgatacttcagtacctctggacaaccagcaagcaggctttggaacacactccctatctctacaaagttaaacctttttaacttaaaatgttaatagcaaaaaaatactcctaaagattgacagcgtaaggataaagttactagatttatcatgaaataaaactataatactccctcattccctaaatgtttgacgccattgattcttttaaatatgtttgaccattcgtcttattcaaaaatttttgtgaaatgtgtaaaactatatgtatacataaaagtatatttaacaataaatcaaatgataggaaaagaattaataattacttaaattttttaaataagatgaacggtcaaatattatttaaaaaagtcaacagcgttaaatattttgggatggaaggagtagtatgtaactatttttatttatacatatattattatttaaagtaatatattagagtctatgtaaatgttatagtccctattctacgacggggtttgggccgatcaatccacgcctttaagggagaaggtttgtaattaacgaatgaataattaaatattgactattactcaaacttaagaaatggatttgttcgaaattttgaaagacttcaatatttttttctcaaaattataccgtttagcaattaaaaaaactcatgtagccaaaatttaaaaagaatgaggcctttgctgtgcctatatttgtggacgagggagtagaaggaaatacatgagtacagtgcatggcaaaattgatagacatggtgatatatgccgtgtttatagttggtttggaaaaaaaattgacgtatacggacaaacatttaaagtattaaacgtagactaataacaaaacaaattacagattccacctgtaaactgtgaaacgaatctattaagcttaattaatctgtcattagcaaatgtttactgtagcaccacattgtcaaatcatggcgtaattaggctcaaaagattcgtctcgcaatttgcatgcaaactgtgcaattggttttttttcgtccatatttaatgctccatatatatgtccaaatatttaatgtgatggaagattttaaagtctgaagtgaactaaacacagagacatagatggacaagcaataagcagactaggtgggtcagtgggtgaaagaaacacaggagactggacgtctccaccatccatgatccatgtctgaatttcctcctaaatcggcggctttcattgttccctctgcagatcgagagggggtggtatagtcgcatgcagattgcagatgctgccattcaagccttctccttccttccctgtgcgctgtggtcctcccggtttctatttttctgggcattttactactgcgacttaagcagaaggtaataggtgagtaagtgactgagataacggaaaaataagcttagaaagaagagaagcgatgaagaagcccctaaatcaattcgcatctaaaattctgaattgggtagagtagtatagtatctttgatttcaaatttacaagttgcaatttcgtttcttaaagccagctaattaaacaacctgtctttacaatatgttgcataaatataccaaaatgtttaggggacgacatcctatccacgcatccgagcgcggtatcatctgtacgatgaacccgagggcacattgtcattgactgcactatcctccacaacgtcacagcgtcacctgtttttctactgccctgctgtagaggcaaaggcggctccatggacgttggccgcttcttaatttgcgctcgtcgaggtgcacgatagtgtcgacgcgttcgtgttcgatgacttgttagagctagtatagcccacttcgagctttaatttatctatagccagtctaatagctaatttatataatattccctccatttcaaaatgtttgacactattgactttttagcacatgtttgaccgttcgtcttattcaaaaaatttaagtaattatttattattttcatatcatttgattcattattaaatatactttcatctacacatatagttttacatatttcataaaattttttgaataagacaaatggtcaaacatgtacttaaaaagtcaacggtgtcaaatattttgaaacagagggagtagttgcttactatactattaatatatggtctcatctgtcatacatgtactgcgtcttggagtccgtgctgcagctggctacagatctgtagcctgctgctcttctctctcatcttttatttctttaaaatatgtttacagctgtcttatattctgctattgtacgtgctctaaggggttgtcattaaatttatccttcctttcttgtacaatcttgaggcgaccgccatgaaaacctagtcgctaatggatactatttgcacatatgaaatatctgtgagatatatcgattctagtatttatatgtattagatttattagtattcatcagtagaaatcatagcattgtaaaacttggatccgtataatagcaacccctaaatataaacggcaacaatatgtattaagtctaaaaggttttgtatttggagtcagagagagttgttaccaagggcaagtagttaaccaacttttagtactccgtccgtgtgtgtggattacagcgctagctcctgtcgcataatttattacagcacatgcttactgtacttctcgtcgtgccacggtaattactgctccactaactactatacataccgttactactactcacttcttcctaaaaaaacaaaccctggtttccatgcccagagtttgaccatccgtcttatttaaaataattaaaaaaaaattaaaaatacaagtcacgcataaaatattaatcatgttttatcatctaacaataatgaaaatacgaattataaaaaacctcatataagacggacagtcaaagttggacacgaaaacctagggtttattttttttttggacgggggagtatgcaaaagagagtttttgacaaatagtgtgacgtgtcgaaatgctcatttgcacgatcgatatatctgccgttctattcttcttccgctgctgttggagagacgcaggcaggctcagctccagatatattctcttaccttgtttacgcatgcctagtagtagtaatacttacaaactggctagtaaaacctgttctgaatatgctgatgcttacttccttcgtctaaaaaacaaatttaatataatcggtattaaaacagatacttcatatgttcataaaaaaagtcaaatcccgactctaaatcgggatatacatatgtttagattgatatataagattgtttattttttattttggaacggggtggagaagaaaggagagcaaaacggttactagtaattgtggagtttatgtgttttaagtagaaaaagaaacggtttgtttcattgtatgggccatgaatcagattggttacttggctcgatctgcagatgtcactaatgcaagatcaaagcttgatgagtaaacagcagtcttttcaagttaagtatagtggtagtaggctagtagcaaaagacgacgaccgtgtgagtgttaagaaaatgtgcgtaggtgacctccaaatcaacacatgcatgttagcacgtaggtggcgtttgtcttttatcaactacagctcgtgataattatactgctactgatagtctgataactgtgtaacaaagcatccgtgactgactgatgataaatttgataatacgcgtcgttagtttcgcaacacatctggcgccacacaattttcaattgctcaccatgattccttaatccccttcacctcgtcgatgcttacatgtgttaacaaatggtgattcgatttagttaaggatgcacatcaatcgtactgtacagattggggttgctcagtttgttaggtttggttaatttttctttttaacctgtcgccatggatggatgaattcatggatttcattgagagcagctggagaagaaagaagaagagtgacgtgatccattcattcgttcgttcaccttgactgaccactgcaacttcgtctcctctccccttaaattccccttcactctcctcactccatccagctcaccaccagcagcagcatcagcagcaatgcagcctcccatcctcctcccgcttctcctcctcctcctcctcctcgccgccgcctcgccacggccggttctctcccgccgccacgcctcgccgccgctcgccaccgagacgctcgacgtcgccgcgtcgctgtcccgggcgcgggccgcggtatccgcggaggccgtgccgctccaccagtccgccgccgccgccgtgtccacggaggtcgtcggggaggagcacgaggaggggcgcctggccctgcggctccactcccgggacttcttgccggaggagcaggggcggcagcggcacgccagctacaggtcactcgtgctggctcgcctccgccgcgactccgcccgcgccgccgcggtgtcggcccgcgcggcgatggcggcggacggggtgagtcggttcgacctggtgccggccaacgtcacggcgttcgaggcgtcggcggcggagatacagggccccgtggtgtccggggttgggctcggcagcggcgagtacttctcccgcgtcggcgtcggcagccccgcgcggcagctgtacatggtgctcgacaccggcagcgacgtcacctgggtgcaatgccagccgtgcgccgactgctaccagcagtccgacccggtgttcgacccttccctctccacctcctacgcctccgtcgcctgcgacaacccgcgctgccacgacctcgacgccgccgcctgccgcaactccaccggcgcctgcctctacgaggtcgcgtacggcgacggctcctacaccgtcggcgacttcgccaccgagacgctcacgctcggcgactccgccccggtctccagcgtcgccataggctgcggccacgacaacgaggggctgttcgtcggcgcggcggggctgcttgccctcggcggcgggccactctccttcccgtcccagatctccgccaccaccttctcctactgcctcgtcgaccgtgactccccctcctcgtcaaccctccagttcggcgacgccgccgacgcggaggtgacggcgccgctgatccgcagcccgcggacgagcacgttctactacgtgggcctctcgggcctctccgtcggtggccagatcctctccatcccaccctcggcgttcgccatggacagcacgggcgccggcggcgtcatcgtggactccggcacggcggtgacgcggctgcagtcgtcggcgtacgcggcgctgcgcgacgcgttcgtccggggcacccagtcgctgccgcgcacctccggcgtgtcgctgttcgacacgtgctacgacctgtcggaccggacgagcgtggaggtccccgcggtgtcgctgcggttcgccggcggcggcgagctccggctgccggcgaagaactacctgatcccggtggacggcgcggggacgtactgcctggcgttcgcgccgacgaacgcggcggtgtccatcatcgggaacgtgcagcagcaggggacccgcgtcagcttcgacacggccaagtccaccgtcggcttcaccaccaacaagtgctaagtcattagcagcgatggcttaacttaattagccagatcaaggagtgattagtggtggtaaatggtaattaagcgcgagagtgtgtgatgtgggggtggggcccagtgccaggctctgtgggctttgggagagacgaaaggcgaggacaaatgccagcctgtcctgctctctgcttgtcgatggatgggggggcccactctcttcttctccggtgctttgctgtttcgtctttgatgtctcggcaaagacgaattaaaatgaatccattccaatctgttcatgtgttctatggccgcttttgtttgatgaaaacgtaagcttccaaaatttccatatctccattgctcctggggatgaatgatttcgtaggtgttcggaccaaatttggaccggtagcgtaatacatttgcatttttttttgttctcgagcatttggtaggtaggtggcgataaccgatcacatgcgtgacgtagcttccaaattttgtcatgcacggcattgcatcattgttgatgagagagtatggacgatggatggatggctgcagcagaatggtttttaaccttgcgatgcaatgcttttatacggcgaatttgtgatgggatccatccgttttttgttgcttttgtccggaaaacaccaccattttgtgtggggactggaggtgatgatggcggtggatggggtgggtgagggattactgcagtgcagtgcttggttttatatttatggagggttggtgaccgttactgtagcattcttcaatgcacctgcagcatgtgacccagatgcttccccagcctgacccaaagcttcctcatatccattgccaaattttgctactgccttgagccatcaccggcttgattacctcccagctccagttctgttcaagatcttttggtagatggagcatctttcaaaatctcttaactcatttagattttctttcagatttgagaacggtaagagtatgaaaatatagaattcagaacataatttagaactcgaaagctaaaaacacagctattttagattttcactagttaattcctatcaactgtttcttagaattctaaactctattccatattccctccatcataaaataaaccaacatcgtgcgggatatgacacattcctagtcaagattcataatactaggatgtgtcatatccggtacgagattgatttattttaagatgaatgaaggagtggagtagaagtagcagtaccgtacagtacgaggcagtgttgtctgctgctacaactgcatgcagctagacaagcgacccggttcagatgggactaattttagtcctatcacatcggatgtttggacactaattataaatattaaatgtatattattaataaaacccaccttataaccctagactaattcgcgagacgaatttattgagtctaattaatccatgattagcctatgtgatgttacagtaaacatgtgttaattatagattaattaggcttaaaaaatttatcacgcgaattagttttatttatgtaattagtagtatatatttaattctctaaattcatccgatatgataggacggcgccacctcacacgggctaaatttagacagcagcagatgctcttgcgtgctttaatttgtcgtcatgcatctcgacttcccttaaaaaaggggctataaaatgcttatgtgtaggagaaaagtaggtccccggaacaatagagctgatcgatcggtgatgaggatcacaataacttgcagtgccattagttggtgatacgtcggtttcatcgaagaacatggcaaatgccaaatggagggatcggaggagcatacgtgctgctgcgccctgtgtattcatgcatgcatccatgcatcttgacgacctcatgtcacaaaagagagagagagagagagagagagagagagagacaacgatacaagattctcgaatctagtggttaattagtccacctctaatctgcatgttggtaaatttctgactcatttgctacttggattgtttggttttgctactgaatctagtgggttggaatactgatttttgcacatggaattaccaggacgaagttacacaggtcacagaatacaattactcacggtgttgacaaaaacacctctaattcctactctaatcttgtcgcgtactacttccactgtttcacaatataagttattctagcattttccatattcatattaatgttaatgaatctagacatatatcaatatgaatatgagaaatgctaaaataacttatattataaaacggaggaagtgcgtacagttacagcaaagtgcagaacaacgtttaacatctctgcgtgcacggttgaagaattattacgagtgtgttgcacacaattaagacacaatcagttgaggaggtgttcgttttcttcaatccgtcaaagaaattacaacgaacaacttcgaaatggagacatcaattttacgcagcgaagtacgccgtgccaaagcttttacggttaggcgtcacgattactcaacagggggatctctgatccgccataaagcctctcatgagccgatgagcccgacaactaataaagtcgatttgatgttcataaaacggtgcactgttcccgtaaaaaaaaaacaaccttagaagtcccctcccaggttaagcaaaggatgtgtttagttcacaccaaaaattaaaagtttgattgaaattgaaatgatatgatggaaaagttgaaagtttatttatgtagaaaaattttgatgtaatgaaaaagttaaaagtttgaataaaaaggttagaactaaatttggctttttttttttggactgtccggtgcatggtaatactgtcattcgagagtcctctctgataagcgatggattgtccaatgaactggatagtcacgctactccctcgtctaacttctaactttctatcacatcacatcacatctaaaacttttctacatacataaactcttaattttttttaaactaccaacttttcttaaatttttaacttttttcaggaactaaacacagcctaaaaaataacctagtactcgctccatcccataatataagagattttaccattttgcttgcaccatttgtcctattcaattttttttacaaatataaaaaacaaaaagttatacttaaaatactttggataataaagtaagtaaaaaaataaataataattctaatttttttaaaaaaataagacaaatggctaaacaatacaagtaaaatgtcaaaatcttttatattagagaaaggagggagtactacatatcctagtaaaaacaaatttagatatagagttatcaagatccgttataatagaatatgtcacctcataataataagaagttattttttttaaggactgagggtgtatatcgctagcagtagcaagaaaataaaaaagcagagacgagagaaggagacactagttgactgacgtggccggatgccacgtgtacagagatccggatcaacgtcggccccaccacgtggacggctgctcttcttcttcctttttaccccgcttccttcgtctgggctgtttcttcttcctttgcgctttctctctctccatggagtatgtctgcttgaccatttgctccagatgagatgagattattgtcatctggtctgccttttttccggccctcccggctacaattatcgcggtcgtctcagaagactcggcacgcactcccatgctcaaactccggcttgatccgcgccgcgcggggtggagagtttttttttcctttccttttaacgccttggacttggacctgatcagagagtgctgggcttatcagctcagaagtgagagggaagaagaaactgagttcggctttactccagcttcttagtgaaggcccaaataatgccatcacaagttgatagtttttgataaggaaaaagtatatttggactccctcaactaccgcctggagtatgattcatatcctccaaccataaaaccagatatatcggctcctccaactatcaaaaccagtacaaacaatgtccctcgatggttttcgaggtggttttggctgacgtgacgcctacgtggtgatcttaactcttaaccgagtctttgtcatacgtgacgcttacgtagcattagaataaaaacaaaaataaaaaaatgtgggatccacatgtcattcacataaaaaagtattgtgggaccactgacatgtgggacacacatgtcatcctccctctccttcccttcttcctccccgtctctctcccttatctctttctccggagcggtggcggtggggacaaggcggaggggagcagtggcggtggggagcggcggcgggcaggaggaggaggagaaggcggaacggatgtcggccaaatcaccgatgctgctccatcggaaggacaagaagaggcggccgatggtgttctgcttcaccgcgtgttaacgaccaaatttggtaatatcagcatcggaaaagaggattagatcgaagtggagtagaaggcaaagatcggttcgagaatagagcaagaatcggctgaagtccggatcggctatgaacaggatcggctgggtccgaatcagattgtgtgagccgatacggccgattctgacaatatgactcgatgtacaacatcgggttgagttgatatgcttcaagatgattgccgcacatggatagagtcctgagaaggcaattgtatctattaattaggatattttatgtaaattccttagagatacgtttgggcaaaagtctgccgcaaagacttgtggtatcttatagtttgttagagataagagacgtgtccgatatggacatagtttgtaattttcggatataaatagaccccgaaccccatgtaatcaattaacatacacgttcaacacaatctcggcgcatcgccgccctttttgctttagttttatttcgacgagttcttgatttcgggttgagctgcatcagtttcgatcttcaataagaggtaaaacttgttatgacggcttgcgttctcgggattagtgcttccatctttatgacactctaatcttatttatgtaattcgtcgagttatcatatatcttacataatctttggcaatatcgctatctaacctacaatcggctaacatctatcggtagagggcagccgattagattaaacaccgacgttgacttggattatatgagatatctactgttctataaaacttccagcggcttgattatcaagatattgttctttttttcatacttaatgctgcatcagttgagtttgatctattaagtcgtgcttagaatatcaatctctagcctgccttctggttgccgattagggtagcatcggaatttcagccgattttatctgatttaactatatttactctacatgctttgttgacacgttaaatctgccctttatgttaagatattattgcatctaagtatattcagcttttgtttggtatattctgtttgttttaacatcttaacatagagttgtatcggagtattagccgatacatgctagatctatctgatcggctatgctatgaacatatataatcctgttattaatatatatttcgatctaagtgatttatactgtctcggcatggcgaccgatctatcctaatcacttgatttaagtatatatcgatataagaattatatattgctaatatctacatccgatcgagtagatttagttctttattatctatttacaaccgccgatcgatttacatatgacatcggctcaaagataaatgatatgtcatcggcacctagccgatcgactatcgtttataggtttaaccgcggttttctttgtttctatttcttgttgattgcaggatcaaatcaactggcacgctaacacacccaaaggcgagctttggacctgcactggagttaagcagatctcccaggcctcgtgtttttcaccaacactgtgtgctgcatcctcttctggctgctcgtcatcgccatcagcgtggccgtgctcatcatctttctcatctaccacccgcagtcgcccaagatgcgggtgaccactgccaccctgaacaccgggtatgtcgatgagcttgacctcgtcggtggcgcccgggcactcaacgccgacctcaacgcgccgacctcaccgtcctcgctgccatctacaacccgaacaccaagctccacgtccccaccgccaccgctcccctctgcctcgtccccaccgctacagccgccgctcctttttgtgtgtgaatgacatatggccccgcgtatttttttatttttttttattctaatgccacgtaagtgccacgtaggataaagactcggtcaagactgccatgtcagccaaaaccaccgaagaacattgtttgcaccggttttgatagttggaagagtcgatatacccggttttgtggttggaggacatgaattatactcgggcgatagttgagggagtcaaagtatactttttccttttgataaggccgataaagagaggtcatgggccacggcccatttatgcaggctatctcgtgtgggccttattgtggtccggcttcgtttcattctgcgccaaggagcatcctcgggtatgtttgtctgcaagtagaccggcacgctgctgctactaactgtcatcaaagatggctgttttattctggtgatagttttttttttgttgtagataatagaatttcatttttctaagtcgagtgtcctgcagatcatggcacgggaaagccctttggcgtcttccgcgggcaccacggctttgcctagctcatgtgctctcgtgaccctactaaaataaatgaaactatatatggggatcccaaaccgttcgactagtattattttttttgggtatcacacaatatattactcctactctactagcaattgtttgttttgaaaaatatgaattgcgtctactcctctatccggaacatcgtcgacgtagatgtaacctatttcgatataacgggattgaaactcctatcgatgttgatagtaaatgggaatgggaagaatatatggacggttacgatgtcattgtcctggctgttcatgtctgcgtttacattctctttatgattgatctttgcagtaagggcagtcccaaccctccatctaggattgtgtttatggcattaactacattatcatataggacttttagtttacgtggcactatattaattaagagagagagagagagtgaagagaggaagcaactgggtctcatgtaagacacagcttcaacacaagaacctatgcagtagacactatcaagttttgcattggaagagaataatggctttataatagatgaagaataaatatgattggtagagaagagagatgatatatttattaatggcccactttaagaaaccatgggatgtagagtgtattttctattgtgatgtcttatcgacataggccctgtttagatcctccaaaatggcaaaagttttgccattttgtagcactttttgccattttggatctaaacactagtagcaaaagttggcaatttggcatttggcatttgctagtccatagtagcaaattgtgctaaaaagtgctttgggaccactccctctctctttctctctctcactttagtgctagaatggcaaaactttaacatgcatctaaacaccaactattacttttgcaatgccaaaacttttgccacaaaaacttttgccatttaccatttgctattctaaatggatctaaacaggccgatagtaccatagacactgcttatgtaccctacgggttagactatcctaaatgggggttacgggctccgcaccgcgtgatcaacagcttccgccaatttactgcccctccgggcctacttgtgtgatttattgggagcagcactttgcgttttgtgtgatttgttgggacggatcaagcaagtactacctctgtattttaaaatgtacgacattgttgacttttcgtttaacgtttgaccattcatcttatttaaaaaatttacgtaattattatttattttattgtgacttgattcatcatcaaaatgttatttaagcatgacataaatatttttatattttcaaaaaaaattttaaataaaataaatgatcaaacgttggacaaaaagtcaatagcgtcgtaaattaaaatacggagggagcaggtactcctcgttcagtttgcgagtagatagatcagtgacagcgtgcacaggtgcgtacgtgatgcgtggatgcctcgtcgccgtggccatgtccatgtgctcgcggtcgcggaggaaaatatgccacgtccgtttctgcgttgctgggctgcaggttggcaggcggcggcacgaacgaacgaacgtgcggcgcaccactcgcgcacaccaccccccgcacgtcgcagaagcagatgctgatatgcggatgcccaccggagcagggggggctttttgtggtggttgcgttgcagccgtgcagcccgtgcgatttgggtttggggcgtgcaatcatcatgatgcggcatttagaacggatcagtggatgagggtacggtgatgggagtgcggcggtggttgccgtggcactgccaatgcccaaaagctcgttcattcattttctctaaaccccgatcattatccgcttgtactatcattactgattcaagagcaacagtatggtcctgtttgcaggttctctccgaattagaaactctcccaactaatacagtgtttattccagattctaagaaactatagttgtagaatctaaaaaaataaactaagccataagctataagccataagctagaaaacccagctttttctagatttttataaactggctactaacaaactgtttctcaactgtttgtcagaatattaaactctcctaacagactctatctatatatgttaccatatgctctagcaccaggcagccactatcactgatatgctaatggttagtagtagtaggttttctctcgataatgatgccaatggagttggtagcggcatcagattagtaaattttaccgcggtcacgtgagatgccatgcacgatgaatcgaatccattcccagccagctgacgaggtgtctccgtgtgtgaatcggatggtagaaaaagctttgcaccaccctccaccaccgctagattcgctcacatcgccgccattactgttgccctctccttcccggcgcggccactccgtccgccgccgccgggggcgaacccgaacgcctctccaccgtccgatccgccagccggatcagatccaacacctaccaacctaccttggcaccttctccctctcgtctccttcctcctcacctcgcccactacacctccacctccggagctcacaacacaaatcgatttctcccaaaccccccctaaactccccaccgaatctccaatgcaggtcctgctgctgccgctgctcgtcgcggcggccgtcggcctcgcgcgcgccgccgccaccgacgaccccttcctctccggcggtaagctcactcggatcagtgggaatggtttgctgaaattgagcttgagatggtagtaatggtgatgggtttggttttggttttgtgttcctcctccagcgccggggaaccacagctacaacatcgactgcggcggcgcggcggacttcgtctcggtgttcggccgacggtggctcgccgaccagttcttctccgccggggggcaggcgggcatggtcgcggagccgcaccggttcccgcagccgcaggagcgcacgctccgcttcttcccgccatcgtcggcgggcaagtccagctgctactccctcccgctcccgcccggccgctactacctccgcctcttctccgtctacgacaactacgactccaagctccgcaccccgtccttcgacgtctccgccgccgccacgctcgtcctctccttccgctccccgtggcccgagccggcatcgcgctacggggcatactccgacctcatcttcccctccgccacctcgcccacctccgacatctgcttctactcgctctccaccgatgcccccgtcgtcgcctccatcgaggtcgcgcccgtgcacccgctcgcctacgacggtgccaccaccggcgcggacctcatcctcgtcaactacggccgtctcacctgcgggaacaacctcttcggcccgggcttcaccaacgactctgacgccttctcccgggtctggcagtccgacatcgatttccggaacaatgacctcaactacgacgccattacggccggggggaggaagattttcggcagcaaccagccgcccaactacttccccaccaagctctacacgtcggcgatcaccaccggcggcgatgcctccaacgagatcgagtacctcatgccggtcgacaccaggatgtcctacatggtctggttgcatttcgcggagatcgatgctggcatcggctcagctgggcagagggtgttcgacgttatgcttgccgggaagaacgtgacgaggattgacattttcaagcaagtgggagggttcaccgcgttcaagtggacatacattgtggagaatttgacgagctccaccatgagtgtgaagcttgtgccagtagtaggacggccgatcctgtgcgggcttgagaattatgcaatggtgccacttgagacgaggacagtgccaaatcaaggtgacatggtttgaagattgcgctctcagccgagaaaattggagaccagcaaaaatttcctcttgtacattctctaagcttgttttttattcatcttggcagtggctgcaatgaaggcattgaaggattccctgaaaattccagcaaggatggggtggaatggggatccatgtgcaccaaggacatgggatgcatgggagggagtcacttgcctccgcaaggacaaagggcttgtgatcacccaactgtaagtaccatttcgttgctccagtgcaattggtatccaccaactgtttttgtggggatgtttctacttagatgtgcagtactgatttgataagtttgccatgaagtagctttggcaagtacagccacctttttattttcttcagataattgatagcgttttcctagaaaacaacgatgatagttttttatgatgaccagaaaagaaatgatacatatgtacctcaatttcacagctgaatattactctactagttaccactacctccgtcccaaatacaagggattttgtccttgtattttgggatgttggcagtactacacaactaatctgaccgaaagcttaattgtcatattcaaatcgcagttaaaagtttcttcttaattctgctttggttgttttgagttaccattttttaaaatggtcaaactttagggcctgtaggtttgttgttgcacatttcttgatatcctttatcgcagtaatttatgactgtcagtattattgtgtgaaattggaagcaggggcggagctagcacaaaatgaaggggggttccacttgcttactttactctagtttgaaccaaatttagcttgatacgggtgcctaaatttgaactgacagagtatatatatggtgaaaatggacaaactatagctaaaattttttttcaaccgggttcctgggcacccccctagctctatgtagctccgcccctgattggaagggagtcagtggacttcctttctcgtaaaagctctattgagcaaacacatattatatatttgtgaaaattatctaaaaaaaatcttgtgacattgatatttttgctgctacaaacttataacctgtatgtatgtggtttctatgtcctttacagggatcttgcaagtcaaggactaaaaggttacatcactgatgaaataagtcatctgacagacttggtaagcttgtaagtatcattaaacctactgaaagtcgatttttcagtttgttcattatcttctttgatatttaaagtatctggatatcaacagttggttttgttatcggtatcttttgcactacgggaatatataaaaccttgaattatcaaagttaagtctcaaatagctctatagactggtttgcattgctcaggttaatagcaaataaagttggagtggccactttcctctagaagataaaaagagcaatgtatcaactagtgaagtacttcccggcttgcctatccacattttctgaacattgtggagccaaagacaaagaaattcccttttgcttttctccaacgtagatattttttcatcctgttaatgatacatttgcttcaccaggaacttgagctataattctttgactggaagcttacctccgggcttagggcaaccttcacttgctacattgtgagtatagctttctgttccataacatgcaatctcgtgattcaaattagaaaatatcttcttctttttttttaaaaaaaagaaaaataggcctgggtggccctgctttttatagaaagcaaaattagaaaatttcttgtgttcagatcacagttcaaatgcttgtcatatatacatgatgctgacagaagcaatgatggccactttaagaaataattttgtgaaatcaaccttctttatacatgtatcatttcaaagagaacttatgaaactaggatgatagagcatgagttttattttattatcatggattgatgactcctgagacagcgtctttcatttgaggaataaattttggaaaaggacatgatatgatatgccaaattggaaaattttaactcaagttcaacccaaacatttggaaacagaaagaaaaagtgaaatcgtgtacttttattcatgattttttttattttccaatgcgtggatcgaatttggtttgagatttttgcaaactggtacatgatgtaatcttacatttctaaacagtatctgaaatttttttcatgaccgaaagagtatgtctatggagaatgataacatgttaatatggtaacatcagatattccttcttccttatagacaatgtgttagcagatcctctacgaatttgagtgatggaatgatgcttttcagtttgcagctatcctaatgataccttatgatcttgtagttctggttctcttgtgagtaacctttatgtcttgtttttagggatctgtcatcaaaccagtttactggaggaattcctggcaccataggttcatcaaaattacaaacagcgtaagtacactgtttgacattagcaattgttgtatattctcaaagcaacacaaacatactgattaccatctcttgtacagtttactgaacaacaatcaactcgatgggcaagttccagaaagactttactcgattggcgtacatggtggtgtgatagagtaagatacctttagtattttcacataaacaagatcttcactttctcctgtaaagtttactagtagttagtagtatatccagttgtcagatatctcatacaaagagctattgttctcaggcttagaattgatcggcaggctcctctatttcatcccatgctccctgctgaagtccaccgcttaagattttaggttccactatgtgacttatgttatgttgagtattgtttagatcagtggtagagcctgctactgggctggtcaggcagccgccctggctcttttttttgtgttcttcactgtagatcactgataagcatggaaaaaagttgtcagagcaagaagcagctcttcgctggctgggttcattgttgctggctccgccactggtttaaatttaacaatgccatgtttacaatatgatacactgatgctgagcgatatatctctgaggttaaactgagtaaaagcagggtgttgttagaaacgtgagaagtatgtactaggccttgactaactaaattggagattttgcatctaatggtgcttaatttagcaaattttactttcttattccttgcaagcaaatgactggagttcaaacatgcacactgtgatcagataatagatcaatggtagatatattgtgaaccatgatacttgcattcattttatctctctatttacaaacacccactgttttaacagtttgtcaggtaataaaggcctttgcggggtgcctactttacctgcttgtgcattattttgggagaaaggagggctgaacagaactggtaaaattgcactaggggcctcgcttgggtttgttctacttgtcacactcatagtggtctacatattgtgcatcagaagaggaccgtacgattatgattttgagttcccccaagatttgacttgtgagtataccacatctcaccttcatactgtgggtcaacctcatatatgactttaagattctttagttttgagtgattattgttttccattgtaagttagtggtagccgttcttttcttaaactatacctaaggccattcatatcagttgtcatgtcatttgaaaaaattatcagtgttcctatgttcctattaacgcaagtaacaatgtttcagatatatcaacctagagtttagtatcccttttatgaacaagtaatcactgtttacaaaccaatttcctgtcttcacaaatgtctaccatgtttaaatttgctactttctcatcctacacagcgatatcagcaatctctgcaaaaaggaataggtatcagagggcgaagtctgtaatgcttgccgagatggaggcgcacggcccggacggttattataccaacgggggcgctcactgaattgatgggcaccggaaatggatatcttcacaggttgttgtatttctacttacagagcaaacactcattgacaattgctggcctgaagcaaggacagttgtgacttgtgactcgtgaacacaattcaccagcatcatcaacatgacgtccctgtaacttcagtcaagcatccatggcattattttgcagttacactcacagcttaattacaaatgtaaaatatgtgcatgttttatgtgtactataatacgatgaagtggtggtggggtggtagtagtagtttggtaatagtagtaggggtgccttattttttgcagaggctttgctgtctcgtattagctttagctttaggcgtgtgcactccatcagcaatgtaaatggaaccaggttgggtcaggacagattcaggcgttgaaatgcttggggggtaaaagctggtgtactcataggtgtattctttctgtataaaacctgacttcgttggcactgtctgacttcaggagattgaaaacattagctttggatcagagtgttgttagccacttttgattatctgttgcttacttgcgtgtcatccagagtcatagacgactcaaattctcacctgctagtatttcaattgtcttcagaatgtgctctttaaacttaatttttccttctaatcgaaccatttggtctggatttagatacttgcattatatcgaagttgtactgcatgaaaccttaagcaatgatgtaataatatcgagtcatctgtaatgtctgaaaccttatttagactatgcagtttgcagttcatattaaagcccacgtaaaataattctcagcccaacaaaatacaaagaataattctaagcccaacgagcccaactgcgcttcccaactatcaaatctgcaccatccattcctcatcggatgccttcacgccgccacgtagcggagagcaaagcaaaaccctagctagagccacacccagaggtatagattccccaccccgccgcctccacgcattccttcgcccaccaaaaccctagccgcgccgccgccgccgacgaccaggtaaggaaggagatccgccgccggcgccgccatgaagcgcaacccacgcgtgacgagctcccggaggaagtgccgcaaggcgcacttcacggcgccgtcgtccgtccgccgcgtgctcatgtcggcggcgctgtcgtcggagctccgccacaagtacaacgtgcggtccatcccgatccgcaaggacgacgaggtgcaggtggtgagggggagctacaaggggcgcgaggggaggtggtgcaggtgtaccgccgtcgctgggtcatccacgtcgagcggatcaccagggagaaggtgaacggctccaccgtcaacgtcggcatccacccctccaaggtcgtcgtcaccaagctcaagctcgacaaggaccgcaaggccatcctcgaccgcaaggcgcgcggccgcgccgccgacaaggccaagggcaagttcaccgccgacgacgtcgccgccgccgccgggggtgccgccgccaccggcgcctcgctccaggagatcgattaggctcgtgggtcggatctgctggtgctcctactgttccccccctccttatctagcttttgtttcgctatcaactgcttctgctaggagttcatgctacctgaacactgcttgctgctttatcgttgaaaatgtctccatgagagttttggatccttgatgttgatctatatctacgatgtggctctgtctgggattttgagttatgaagaaatcattataagtctaaatgctcccgttttgtttgtgttgcctagatatactgaatggcatttcatggactgtgttacctagatataccgaatgattctaggttgataagactctggttttctggatgatgtctagtcccttaatttgactctgagtcacgcatctcaggttgtaacacatcatatatgcttagttttactcaagttgagcatttcaggctgtaacaaatcatataggcttagttttactcaagttgagcatttcaggttgtaacaaatcagctaggctcatagtcctacttctaaattgagcatttcaggttataacacatcactgtagtttaattcgacatggtgttgcactatcatactgctttccttagggcaactggcatttcgtttggatcctacgtgaactaggaagtatctggttgagtggatgactgttgattataccttgctatgagtgtatgacttcctctatattatattcctatattgaatcgatttgaaatgatcttattgttggtatgatatgatgcatacggagcatggcgttagtaggctggactggctggtagcatcttgctttcacatgatgttttgttggcaaagttttttctgttgattcatcaaattttctactctactattgagctttgtttgaaactttgaatggttatatagtactagaatgtagttcaccttagctttctagtggtgacccttccaatacggctacgcatatgctctgtttgaattgctcagctaagacatcagggttaccgatgcatgagttgtctttcgatcaatgtggttttcctgtgctttcacggctgtgggagtgaatttcccttatggtccttctattgtcatgttgtagcaacattttcaacatttctgtgttgatgattgtgcgttccacctttatttaccgcgggattcaggcatttggacacactacatagctagagtaccagatagtctatttgttcttatttagcggctgacatgttaaattatgtgaaaggtttcttacacaagcgcatctgtgagggatggcgttttgattcctcaataagctggccctgtttatgaagtaggtgcattgtggatttgtgatacgggtcgcccctcagtctaatttagttgctgttgtgcattatgatggtttctagtatgcgggggttattaatggcaatgtatttccatggaattttagtcgatccctatgtttatgcgtaagcatgaatattgaaccgtatctgtcaatcgaatatttggtttgcatcagttttgaaaacggatgttggtgataaaaacggtcgaggggatggaaaacgagatcatatggctgtgctctttcctgggcatgtctccgaagtccatgaatagaccaaatgggtcagctcgacgccttatctgtggtgcgagcagatcaagtccactttgactccctcaaatataggtgatatcttgaaccactaacaagctgatgtggcgtgttgactattctaatcactattctaatcgactgaatcagaaaacagcgcccagatatcagcatcacttcctctttcttccccatctctattctctcgtctgttgacgtgcatactcgcctactctctcggtcccataaaaaacctagtatcggatgtgacacatctagacatacatatgtccagattcatagtactagaatatgttatatcttattctagattccttttttagggacggagggagtagtcgcttgctccatcgcccatatgttcaggagagcttctggcagctggatattcttttagaagccacagttgccagaagctttttcaaacagtctagatttttatctggattctgagaagttgtaattgtatagaagccaaattttcactcggattttctagattctcaccagctacttctcaaaatcttaagtttcctcaaatagaggtgacgacgttggctcaccacctttgtcggagacctctggagatcagttgcgaacaggatatacgtcgagcaacgccatgccacgcaacaccgccaccttcactagagacctatggagatcgagctcctcgaccttacacaccgttagcctcccctcctccttcctttccgcctcgctctagtgccaatagcgtgggtgcttgaggaggccagtgatagcttggcgaatcacaagcatgtgatgcagatcgcttctgcggttctgcccttggtctagaaattcttgataccccaaatgtccaaacgatttcatggataatcccaaaacagatacagagtgcatccagagcaagcacctcgatcccctatcgcttgcatcggttcttcaccgacgtcgtcgagtcttccttgtcgatgcagcttgacatcgggggagctgggaggttgtcaatgccgctcctgatgagcttccactttggaagggtcggtcttgatgtgttctcgtcgacgtcgacctttgtcgccgccaactccgacctatcccagaagcggtggtgggagcaagaattgcagcaacatcaaatggccgagtacatgtagaagccaaattctaggcatgatgtggatcgtgctagttgcatgagtgccatcgccccgttctttacccacaagtggctcgggcatccatgtcctctccatgggtgctgctgcagaaaagagacgggagaaagaaagagaaaagataggatgaggaagaagaagggacattgacatctcacctcacatgctaacttagtcgcttggactagttaacgagccacgtcagcggaaatgactctcaaaaccgctaaggaagtcaaactacatcggtttaaatagtttgggggttaagatatccggcatttcggttgagagatattaggatgaaatcggttggaaaaaccctctaccattttcatttgcatatttttttctcgaaaacggaatcgaaatagtagacctgaaaacaacaacaatatcattaatatcgttatatcggaaacaggaccatcgaaacagaatctaccaatattggttggaagtcacgacgaacaatataaacaaagttcaacaatacttcaacatcattgaggaaaccgaaattcaacaaagtccacttgccacaccttagggttaactgagttttcccctagccagttcccattactaataggttgcaagcctaccagatctcctttattcatgggcttccgatgggttgggctggctaagccgctgcggagttttttattttttttggaattttgacggaaattattggacaaatacgattaccgataaaatggtcggaaaaacctccatcccattttcggaagatattaccgtttccatttgtgacactgacaattaccgatatcgactgaaacggtcgatgcataccggaaacgataactagatatctcggaaatttccgtatatttttcacccctagattgatacaaatcgcacatgttcgagggaattaaagttgacttattccccgggcagttgctgttgcaattggagacgagggacccaagaagccaggccatgtccgtgtagcgcccatggtttgtgaagacatgacctcaccgatcgattgatactttgggccctcggcgtcgcgttaacagtgagagcatcatatatagcaagaccataattgccaagttgagccgcctacgtacgtctgtgagagttgcagttgtgttgtacaacaactacaagcctctcactgcttcacgtcatgcatcacgggctcattgtaacatcgcctgcctgcctgattttcgcctggctcggtacgtcggcactgcactcctgatcctgaatatgaatgaaacgtccttcaatttccaagctgaagtaaaaacgaccacacgatttttggtttggctgtcagctactgtgctcccctctcgccgccgtgtcattcagacatccacacacccatctcaactggaccccttgtgtcccactcgatcgatatgattcaggtagcctcagccagccagccaatcagccagccgccgtagcgcccaacactgcagatttccactgtgctaccacatgtacgcacgcatctcatcgatccgtccagtccattcattataccgaccgtcacctggactggtgttaagtagccacacagctgctcgagattccgagaagcagccccgacccgatgagagcccatcccggaaaatccttagcatatgtactccagtttcatgttttgaattctaacactatagattgttagtagaatcttgatggggatatatatagctaggctgttttgaagaggtagaggttactccctccgtcccaaaaaaaaacaaaccctggtttccgtgtacaatgtttgatcgtccgtcttatttgaaaaaaatatgaaaaaaattaaaaagacaagtcacacataaaatattaatcatgttttatcatctaacaacaatgaaaatacgaattataaaaaaatttcatataaaacggacagtcaaagttggacacggaaacccatggtttgccttttttcgggacggagggagtatataagaaactatagcttcagaagttcagcaagctaagcctcagctagctgctatagacatgtactccctctgtcccagaatataagcatttttagagttggacacggttattaagaaagtaggtagaagtgaatggtggagagttgtgattggtagggaagataatattggtggagaagttgttatattttaggacaaattttgagagctaaaagttattatattttgggatggagagaataatacatattgatcgatctatcacgtatttattgatccagccattgatatatatatataatcgatcgagcacgagcactagtctgttctctgttgacaagttgcaaggcaacaaccataataacaataacaatgataataatgttttaagaaaaagccatcactccaggattctaggtcgagggtcagtacatcatgtagcaagacatcagatgcgcaaatactagctagtagtaacatcaatctggatgcaaacacgcagcagcaccaacattatttgtccttgcagcaagtaggtcgagctatagctagtcccatgcaaatggatcattgatatcgttaatacactcacactgacaagtgagaaacactacgctgaaaaccctgcacattgccatgttgcccctgcctatactgctagtgcgcgcgccacctgtttttcgatccccagctactagcgctgatcgagacgacggccaatgatcatatgcaagtaaaaatttgcaagcaaaagcgcatgtagtgcaaaaccatgggcgggctagccgctacacggtgggctgcactgtgccctaactacttggaactctgtccattttcaaaagatcgttggcaacttggtactaggaatgctgctaggatcactgtgctcattgcgtccgattattgctttcgttgccatcaacagaggccaaacactgtcgactacagtctgaatgtcgacacccccctgatcatggattcaaagctagctagctacatgatgcacgcatactccttgtcagcattaatcctagtcgtctctgcttgtctgcatatctctccttgtcagcattaatcctagtcgtcccctgcttgtctgcatatttcaatatccatgcttgcaaatgcaatggttcatcagatcgagatactactactccagctagttaaatttccaatttctttgcactggtagtagtaaaaatgaattcggagctttcagctaacgtactgtctgattaataactcgatcgtgataaaacattttgatggcgtgaccagtgaattaaagcagccgatctggacttctggggactgtttttatatgagactaagctattggaagctgtcgtcaccgtgttcagagatgcacaacatcatgtttctgcaaataatagtgctcctcttccttacagtggcccaggcctgaatttgtccaaagctcaacctctgcagctagctaccgctgcattactgcgcaccataaagttgcacttgtacgaccatccaatcagcttctctcaagtttcctgtgctgtgctcatatggttttatatctagaaaccgttcctgaacatttctgtcacattgcttgtctgtttcgctgagaatcaataaagaagctcactggctgctcttgctcggcccagctccaacagggatctcgactcatggatgccaaaaatatccaagaacaacatcattgatgtctcttaggccctgttaacagatcccaccccaaaatttttcaccctgtcacatcgaacgtttaaacacctgcataaagtattaaatataggctaaaaaaataactaattgcacagattgcgactaatttgtgaaacgaatcttttaagcctaactgctacatgatttgtcaatgtgatgttacagtaaatatttgctaatgacggattaattaggcttaataaattcgtctcgcggtttactgacggattctgtaattagtttttttattactgtccgaacaccccatgcgacaccctatataatatccgatgtgacacaccaaaactttacacccctgatctaaacacccccttactccagattgagatggctgcatgccggttattttactgttgtaagtggacaattctactatccgtataaaaacctgtttactataaaaaaaacctgtttactagttcatttttctacatgatattttaaatttttaaaaacaaaataaactagaagtaaaataagcggacaaaataatcctacttttgcccgctccacttgcattcctatcggttattagggtacgtcttgattaacaattcagtttagcgtgtacttgtacaaaacaattcagtaaaataagtcttgattaacaacttacgcaagtgtgcatcgtatatatgatttagaagctgaaatatttattccattatcttaaaaaagttatcctaaggcctggtttagttctctatttttttttccaaaaacatcacatcgaatctttggacacatgtatgaagcattaaatatggattaaaaaaactaattgcacagttaggggggaaattgcgagatgaatcttttgagcctaattagtccataattagccataagtgctacagtaacctacatgtgctaatgacggattaattaggctcaaaagattcgtctcgcggtttccaggcgagttatgaaattagttttttcattcgtgtccaaaaatctcttccgacatctggtcaaacatccgatgtgacacctaaaaattttcttttcgcgaagtaaataggccctagaagccttgcaatattgcaagatgattgtgtactagtacatcgtatctgatagagtgaataaatgcgcatcagggtcgctgcttcaaaggagaacctacaatgttggtgtagcagtagcactcaatcctagcgcattaaccagcgacctactcacgggatgcagaatatgctcttatgcattttattgcatgcctatacatgttgctatcacgctaaaaataattacttaagaatctttagctctccagatacatatacatttggtatcacaacctttatcacaagtttaatggaaagctagctgaggattatggatatgcaggaatgatgcccttttttataatagaatgattgattctcctttgcaggttatctcattggttctgtttctaggctatccttcaaaagtcgggtttgcagaattttattgccgtggcatgccagcaattggaaagggtggctagggagtttttttttacccaagaacataagtgacgatctagtctatggattgatagctcttaatcattcctgtcatttgcttacttttttcaaatccagtgtgtgtttagctgtgtgcatcttagttatataaaggccaagagtgtttaatttcattacgattgtatcgtgatataattgattgagtttaataaatcttccattattaaaaaaagtactagtttcaaacggtgaaactaataagcacctggtgtagaattcagaaatgaactgatagacagaaatttgtttgggttcataggtttacgcaccaagtacactgttctttctgaaataaaaggactgaaatgatcgagtgcccggcccgtttgtggtatacggtggtgatgtactattttgccaaaacaagtatacagtaccacgaaattatggaagggcagcagcagcagcccgggagcctcggatgctgtaccatgtatagctggcattggaatcagccgtcatcgtggtcctttggattctttggacggtgcagattggatttgattggtcgagtatcctgttgacactggtcaatgcagagcacgccagttccaattgccaaaaggtgggcttcccacttgtcatgccccccccggtccatccaaaactgtgaaggttaattgcagatttttgcaaaaaaaaggaaaacattaattctaattctatgatgcatgtaaaattgcataagcaggagaaatttaagaaaaacatacgagttacttcgttagtacccaggggcggatccaggataagaaacgagctagcgtcaccacgcactactactttatggatcatatatagtatttacatatggatagtaaaaactgtaatttacatggcatgtttgaagatgcccttacacatttgtttccacactgcaaactatatatgctctgcaaatatatccaggtcccctacggttgtgcctcctccactgctgataccgagttgcaagcgggctggagtacgtaccaacttgtagtagttgccccagcctcccaaggctgccactatatatcaacaaatgcaaacagttatgctctataattggatcttgccatatcaactgtcccatatacgatccaacgtccttttcatcctatgtcatcactgcaccccacaaatggtccatatcccattttccacacataggaaatctggctgaaaaacttggaaacttccaaaataacaaatttatatatatgcgcacataaaaagaatattttgattaatgaagagatgcgaaactgatgagaatatattggttgtttaaataagattgttattgaatatatattaaaatagtagtatgcatgttaggatgaaagggtaaatatatggtgtaaaccaatatatacgtggaaaccatgcaagctacatgatggaagttctccatacgagaatgtttttttgatttttttcaggacttctatgcaaaagttcctaaaactttttgtcatagtttccactgcatattttttcatgcggaaaacatgctagtttcagaaatcaaatggaaatttcgatcaccgacagatgccaaattattacttcaaaagcatcatatcaatcaattactagtaccatataagaacctcagctgaaggggactcactatatattttttatctttatgcaatttagtattatctcagttgcacgtgtaccatgtagataccagatgagatgtgctacctaattaacttttttttttggaaaaacaacatatatgtgtataaattgtgcctgcaatgtgaccacttaatacatcagaaatgggcccaattaaaggctcttgtacgtagggggatgaacctaattagtaaggctcatgtccattcgtccaggtcactctccgtcctctgcttccacttggccaattgtttcagcaagatttcaagtgcacccgatgctgaatcgttattggttattgcaggccgtacccccttgattttaatggcaatacacaactgctatctactgtcacaaaacacatggtatcggaggcgataaggttttcaaatattaatgcagctttgacaactaaattttgtcataacatacttataaaactcgacaaaacatactataatgtacactatttttggggcgaacacagatactattttcatacatccaatcttacaatattaaaatattaagattgatgtttcacctctagaatttttagtgctctttgtgagtaatttttttttgctctttaattattgaacgggtatttgtaataagtggatgtaacttctttgaagcaaagtatagtccattatctcaaaagaaccacacactcacacaccaccaaatgcatcctctaacacacggcaaaggacagtggtaaatctctgccccttactaaacttctattgaaatcacaaccacatgtatgcttatattggttttgagagtcccttgggtcaataggactaaatggatcaaaacttctggtcaattatattattcggagtttctagatgtaaacaggaaaaaatataacttgtattagtaagaactatgctcaacatcaaaaaccatttgaaccaaacgatagaatgcgggctatagactaagaaaagtaaaacacccactagctcaaactaccacatgcatagattgagtcaagagaagtaataacggtacagagagaagccaaattttttcaccaaagttcggatccgacgatcctaaatattgagggactcataagagctaggtcgcattcgactggtctaaatgtgccaaacgaccacgaagataaagctcggttttgactcaatttaccactttcccttgtggagggggagtagatcattcacaatttttctcgggctctccacatgggttggaagtgcgcatgataagactaaacctaggggtgggcattcgttatgaccgaaaattttggtatcggtcttcggtctttcggtcatttcggtctttgaaaagtgaagatcgaatttcaacacaaaaatgtcaggaccgacaaattcggtctcggtctcggtctcggtcctgaccgaaatagaataacattttcatatacgcaaagaaataatggaaattttcaacacaaaaatcacaaaaaaaattcgtaagcatgtatgagtaaagactcttattaggttgcatgcctataagaagtagggatgtgaaaattagagtttaatcctattgaaattagtggattataggttgcatttaggcatattttgttaatttggtcttttcggtctattcgtttacccgaggaaactaaccgaattgatcgaacaaaattcggtctttcactatctaggaccaaatttcttggtctcggtctcggttttttcggttcggtctttttctgcccacccctacctaaaccacctagagccctagaaaggaaggcctccaagagtaactagtatgaacactagcttggcttcgaactcaagtgctcaagaatgaagctctcaaatgcattcaaatgcccaaattttatccaatctcacaaggatctctcttaatgcaaggtggagagtgagtactgggagtgtgtttcaaagaatgagccaaccaacctatcaaaggaggggaataaatatcccaactggccaactagctgttactcacaacaatttaatccatgaacttccaccctcctaggcctagaacttgtggccttttttgaaatatcagacaaaaactctttgccagaacttctggctacatcagctgctatacataacacttcaaatggatacccaacccctttgaacttccgaccaaccctgtcaaccccgaaagtgtaagtgttgtgaattttatatctcatcaaatatttcttgagcacttgagacaacgcatactacaccatatgcatgagagcctcttaatagtgggacattcctagactcaaaataaagagaaaaccgacgcttcggtgtcttgagtccattttccactagtcgtttcttttgtagggttcattgttgtttcaatcaacatctccgttgaagttgatccctatacatgtccttaataaacacgttagtgtactaaccgctttgtcatcaatattccaaaacccacttaggaggcctagatgcactttcagatttgaattgtggtgggtgaagtcatgcacctagaactccaccatcatacaaccaatgcttccaagaaattttgaaattttatttaggcaaaatttattacgggccactgaaaaagtgtggtctttgctagtggataccaaaataacgtgaaatttgcccaaagacactccaaaagtacgataatttgctgtaggacaccaaaaacattaaaatacaacatacatccaattgatgagagagaaaccatataaaatatcagttttgcccccatcttcttcttccttctcacagtcttcttcaagcaacatgcatcaacggtgaagctgctgtggcagctagagggcatccaaatccggttgaccgtgcatgctcaccccgtcatgaagtcactgccaccaggcgctgaaacccgatagacgatgcatgtgcgtgctgccgtgaactcgccactattgcaccctgccacctcgcagcctcaccacgaggtcaccatcgccccctgctgcgttgaggtcgcaggctgcgcacgccccgccacgaggtcagcgccgctgtgccgccccaccacgtagtcctcaccgttgtgctgccatcactcgcacacgtgccccatgtttctcgtgacgttgcagcccccccccactctgtagtcataagcgttgcaccgctcgccgatccgccgcaaggtcatcgccaccacgcggtatagttgcatcgctgcttctcatgccctccctccctctgcgggttgcgcatgagtggaatggatggaggaataagatatgggcaaaaaagtcattttatataaattctcaccaatctagtgaaaataatattttaatggcattagtgtcctataacaaattaccacacttttagagtgtgctcgagcaaattcatgttcttacggtgtctactagcaaagaccgcactttgtgaatgttctgtagtaaatttggccttttttttaaggcatgacctaaacaacatatatccaaatgtttgttacccgagggaatatatttactatagtgaaatgaattaacatcttgtaattaaaaacaattattaaaataggagagagatatatgtaaattatgatcaaaccttctctccatttgaacatgacagaaaagagaaaaacacttctatgttctcactttcttattagggctctatcaaatgcaagattttaacagggtttatgcaggaatttagattaaataatcctttaaaaatcctccgttacaaagaagaccttagggttctatgcatctcaaagtacatttaaggggaagttgtagaatcatgctttcaaagtgcaaacaattaccactaaaatatcttactaaaaagggtcatccctcgtctcctcccccttctcatgttgcggtcgcctccctgatgaaaagaaaaaaaaaccaactaagctcatagactatttttaattgtatggacttagtaatacatttggcccatccctaattgcacagccgattcaacgtccatgtttgttgtaattagttattatagaaaactatatgaagcacggtatattaggatgacatatgtggtttaaaataattgatcaagattattttttggactgtctaattttttttagaaaaaggccagtggcccggcttatattgaaagcccagtgcgggagtgtgctaggcaaagcccagcccggcttatgttgatgcaaaaaacacatcaaatttggtcgttaacagagtaccattacctacctgccactttgacccaagtttcatccactttcttgcacgaagcaccccaacccagaattgagaagctctatcaggggagcattggaacatcccaccattgtgtaggtatttcttcctcaatagctcaacacacaaactcttatcaggggattcaatcttaaacaactatttagctagtaaagcagtgttcagtattctagtttcagtaagccccagtcccccaaactctttagggaaagctagatcagaccacttcaccatgtggtatttcatgccttgtttatttcctagccaatagtatctaccactaattaagtcaaagttatgatgtaatcattcataaagttgatagaaacccatagcatatgagggatagaggataaccatgcattgatgtgtacaactctacctgcatgtgaaagagtattatcagatcaaacacctaatttcttctccattttttgagctaagaaggacggtatgcaaattaaaacaatcgaaaatcatgcacaccttttttgctttcgtcatcatgtatctaaaatctctattagagcaagtttaatagtatagccaactacttgcttcaaatcatatatagtcgatttaatagctaattcatacaatagttacatataacatatagtacacaattaatacctagattcacttatcataaacacatgtatcttggagcccatgctgtagctggctataaatctgtagtctactgctcttctctcttctcttttattttcttaaaatatgtttatagctggcttatagtctactattgctcctgctcttatattcttagagctgatcagcttgagcaggagagcaacatgaagggtacagtgcataaatatgaatccacgaaaagtataggaagaaaacttcagtgccatgagggaccccatatggggccatgctatacagctgaaatgtgcatgcctttaaacattcacagtaatcaacctcttagaatatattccaccaaaaactattatctcctcgacggttgccatgattgtacggacatgcatgtatatatagtgaaacagttcaccctgtcttttcttcagatataatattagtactcatcagtcgtcaattaaatttgaccaatcaaccaatcgtactaattaaattatattaattgcttgatcgccatgtttaaagcagcgtgcctgtacgtgcatgatcgacctacatataatatttcctatgttttaatttagtgctttagtttaattacactcttttggggatcttaattaatttcgagaaaaacaaagcacactttggcagaaattaaaaatatatatacctggactggatgaaattaagaggactcgaatgtgaaaataaaacaagtttgcgtggcctgtccttagaacagaatacatgatcagaaaacatgcacaaccacgcgggaaggaacaggaggcccagatggatgcgtacaggaaaaagtacatactagtaagtgtgcatctttcttttgcctgaaagcgacaattaaattgtttcaccaaaaaaaaccaattaaaattatcagtaaaaatactaaaatagctaagaatatatgtatgctcatggaccatttctgtggaaaaagcatgctggcttgcacgaatcaaatttaattaaatatggtacacatcaaaactaaataatagcatcgaccaaaatagtcgattactaacagagattctcgtagccacacatgcctaaacagtaggcacaaacgaacacttgcctgaaaagatcacgcaaaaaatatagcataaaatgacagtctcaacagtgtaaagtttgcaagaatgtgcaattagaagctaacataaacacaaaactagctatcatacatacgagtgaagggctggaagcagctaagctgaaagctcaacacaacatatactaccaatctagctacaaggccactccaagtcgcatatatactagtatctataagctaggctgttctctctttccattcgtcaagaactaccacgacgtcgacatcataatcgtcagagagctcgagaaattttttagtatctttgatccagatcgatcatggagcaagaagctgccatggtcgtcttctcctgcaactccggctccggtgggtcgtcgtcgacgaccgattcaaagcaagaggaggaggaggaggaggagttggccgcaatggaggaagacgagttgatccacgtcgtccaggcggcggagctgcggctgccgtcgtcgacgacggcgacgcggccgtcgtcgcggtacaagggggtggtgccgcagccgaacgggcggtggggggcgcagatctacgagcggcacgcgcgggtgtggctcgggacgttccccgacgaggaggcggcggcgcgcgcctacgacgtggcggcgctccgcttccgggggcgcgacgccgtcaccaaccgcgccccggcggcggagggcgcgtccgccggcgagctcgcgttcctggccgcgcactccaaggcggaggtcgtggacatgctgcggaagcacacctacgacgacgagctccagcagggcctccgccgcggctcgcgcgcgcagccgacgccgcggtgggcgcgcgagccgctgttcgagaaggccgtgacgccgagcgacgtcggcaagctcaaccgcctcgtggtgcccaagcagcaggccgagaggcatttcccgttcccgctccgccgccacagctccgacgccgccggcaagggcgtgctcctcaacttcgaggacggcgacggcaaggtgtggcgattccggtactcgtactggaacagcagccagagttacgtgctcaccaaggggtggagccgattcgtgagggagaagggcctccgaccaggcgacaccgtggccttctcccggtcggcggcggcgtgggggacggagaagcacctcctcatcgactgcaagaagatggagaggaacaacctggcaaccgtcgacgacgatgcccgtgtcgtcgtcaagctgttcggcgttgacatcgtcggagacaagacgaggtaacacgcaagcgcagctagctgcatcgtatcgatcatatatatcaccccggcgccttcttcttcttcttcttcttcttcttcttcttcttcttcttcttcttcttcttcttcttcttcttcttcttcacttgttcttcgttttcttcctcttcgatcttctcattcatcttctgttgctgccctagctacaatgatcgatcgatggatgatccatatcatcgttgatccttcgcttcacatcaggttcatcattcctagctacatcgatatatgtacctataatttgatgatgagatgaacttcttcaaaattcaaattaatctctgaagaaaccaacggagaattaggatcagagtgtgctagctacatgtgagctagagattagagaaatttaagagtgtgtgttatatgtaaatatatcgatcattgccagatcgatcgaggcgaaactatagaattttgccttggggtttaattagccttaatttgtacccaaaaattgaaacaaatccgtcccacgcattgcattgggatgtgtaatccgggtttccatatgcatggttatgggaatgtgccatgtgtctgctattgctatatatagttattagtctagctacatttccaaatcacatgttaaatttgttgttctcataatggattcctctgttggagatgactgttcctacaatattatattcgaacttttatgatctcttactgtatgcttgcttcttctgcctacatttaacttactgtacttgtttagctagggttacagtaaaactccctcttcttaatttccttctaattacaaactcgattcttcaaacatatatattcagttcagactcatccaaaccgcctctctctataattcacacattgcatgccagttacttcctctgcttagttaattacaaaggagcacgtatgcacatatcccaagattcagtacgttagttttgactagcaaatagactcacatttagtgatatatgcatgcacaaagtagtggtaccaccactactgtaaatgtacttccaaatatatactcactatatcctataacaacggtatataaaaaatgagtaccactaaggaggaatttggttatcagataatagaaggaattttgagtgtgttgagattcagaccttgtagctgaaaccacataccctttaccacgacagcatctcaattaacggcagtatattgcaagtaggaatttatggttagagttcaatacaactaaaatatatatcgccttaagatcgagaagttatatatgatatggacagtagtgcagtgggtgtgcactttcagaatcgaaatgaagcctatgcgtgtttaaatatataaagagatattacttttcaggtattgagaactgatcagctctattgcttgcatgctagctagttctttatctcccaaatttaattaaccagtttgctcctacaggtaaaataaccatacattatatttctttccgagttagtttgtttttcggcttaattattttgcttagcccatcgaaccaaacacatcctatgggggtgtttagatccagtagtgtaaagttttggactgtcacattgaatattatatagaatgttgcatggggtgtttgggcactaataaaaaaactaattacagaatccgtaaccgtgagacgaatttattgagcataattaatccatcattaacaaatatatattgtagtaccatattgtcaaatcatgtaacaattaggcacaaaagattcgtctcgcaaattagtcgcaatttgtgcaattagttttttaagcctatatttaatactttatgcatgtgttcaaatgttcgatgtgacagggtgaaaaattttggggtgggatctaaacagggcctaagtatagtttgcacaatttaatttgttatatatagttgtatttggtatatagatggaatatattcctgagccggcaatggaggacgaggtactcacgtgtggtacggtcgccggatgcatcagaggcttgggagagaaaatgtttagaattttctggatttttcaaagaaaaaactataccaatgcagcatgcttcctgctattaatttccatgaatttaattggaagcatagatcaatcatacaaaggttgcaggagtatctacaaattatcacaagttttttgagtgaaaagtttttagatataactaatagtataactgtgaatgaaccgagctcgagcgagcccgtttgcccaggctcgagctcgacataagcttgagccgggcctattgcaccttcgagcttttagacaagttcggttcgagctcggccataagtaagataatatatattttaatgataatctcttgataagtataattattttctagttaatcacactaataaaagagtagaaaatgattaaaataaatatattgtgctaacacatgctaatttattgtgtaaattgatattaatatatatatttatctattggtttataaatcaataaggtgaacaaacaatataaactatatataattaagctcggctcggtaaagctcgcgagcttttgctcaggctcgagttcggctcgtttggagcttaggccgagcttgaacagagcctaggacaagctaagctcgagctgctcgcgagcctcgatcttttttgatagccctaactataactgtgttgtaaccacactgtaactattatataacttatataaaacttgtattcaactatagttaatttggttgcttagtacctgtattttacgcgtgatatgtgtgaaaatttctttctagcaatttttttcttgtatatataaatctcgagatgatccgatggccacaaatctaaaaattttgaggataaaaaacttgcagaaattttctagcaatttcgtattgttaattagacgtggatccaacatgcatgcaaggtccatgatatatgagtagctagtctcacttatcatcttcatctacagtatataaactccataacacaaagccagccagcaaggaactgtctatgtgcagtgatcataaagtgaagctaattaaggtagtgaactaccttaatatcataccatacgttttgtgtactcctcaacgtacacaatccaaggattacctcatccttggtacgtacaattttatgagatctattattgtctcagctgtgactatgcaactatgctgtgagggccacaaattctttcccacacattttgatctaatggaaggttgccattttaattatttgggagttaattaacttgactaaataaagttattgtacatcttattcaaaatgtggagccgcagtttggacgcgtccatatttgatcatattacaaattaatttgttatatatatgcatgtcacaagcaatactatgccacaaatacatatatgtatacgcgtgtgtttgtttcgattggaaccacaattaagtgagttattctgagcatgcactactttgtacgcatcaccttcagaatgctgcaacaatttaattacttttatagctacattatatatatatacttaatctactgtacgtcccagttaattgctctgcgctgatatatctttgtacatctgatagtctcgtaatatactcaatctgtcttctagcattcatcatccggaggaggcaggtgtttagactgctttctccttagctcaatggactttgaggcccatataataatctaagtatctaatgtatttaggcctggcccaacctaatccaattcagcgtaaaaaaaaaaactaatccaattacagtgcattgtaattttgctgactgcatatgcagccggtcttgcctgtatgcttgcaattgatgcacactagcagaaatgcagaatgcaggggaaggacaagaaagtttcatgatgtaaatggtgtgtatcaaatgctaatcatgatcggtaattagcagacaggtgagctgcacatcacttcaattatgggcaccaattttgggacgaaggtgtagtactaatctgaactatatgaagccatgcatttaattttgttgtggacttgtacgtggtacagtcgatctagtgatgatacagtgtttaagggattttaactcttcatgagatgtcactgtgcagatgtcatgctttatttttttagtgaaatttgctataagacacttaaaatttgtgtaatttgcttgtaaatatcgtaaaaatatgtcacgactgaaagacacttaaaaaacaataattttgttacgggacactttcagttcaatttgatagagaaattcttcaaaaagacgagaatgcccctcgggtcaaaagcttttaagccgagtttgaagtgaagatggcatatgatatttgctagtgatttacttctggtgatgacaaatttagagttgcataatttctaaatgtttactctaacaccatgtttaaagcatgtgttcatagggacattcttgtctttcttaagaatttgtttctccgattgagctgaaagtatcctccagcaaattaccacctttttaggatgtctttcagctatgacacgtgtttttgatgtctattagcaaatttcacaagttttggatgtcctgtagcaaaattacctattttttaaacttggagaaattatatatgttcatgcctcatgttgaactcaaacgataacttcatccctagttttcttactttatgtttcctcttatttttaaatctaaatcttgtgtttgcccatattccatctgaaggagtacttaacaatgttaaaaacatcgatgtatggtcttgcaaatttaccacaatttttatgaggactttgtaatttaatttcccccttttgacatcaagccttttgacatgcattttcacaaatctagttaaaaaaagagcaagcacaaacttttcatgaattttaccaatgtatttaacatgagttttcacaccgtcaagtcctcctaattgaatgggaacaatcacaagcatcacttcaaaaaagataccaaaataaaaacaaatcaaaactagaaatgaacagaggggtaagaatggaattgccccttaattttccttgttgcatattcatggctacagtacatttagccagagatgcatgattatttcttttggattttaatcatggtcacttatgttgcatgagttgcgaggtaaatacatctattgaggcactactaggaaaacgattttcgcagacgaggtgcgtctatcttcctaggcagataacattgttgccatcatccgtccgcctgcaaaatagggaggcgggggatcaagatggccgtccgcttgcaaagatcaatcttcccatgcctttgcctacaggggggcgaccgtccgcctgggaagacaaattttggtctcctgcaaaaatggttttcctagctagtagtgaggtgagaagggcaaccactatatttaccatcttgctaactagtgccccacatgttgttacgatatataattaaattcaaaatagtataaaaataataatgaaatttgtatatactggttaaaaatggtgtaggcattggacatcagctctcctagctgatcgagttgtaaccagtgtatatgtaagtcgtgggtgttttcttttcttcttctttgtggggaagggggggggggtttatcaactacaggtagtgaagtttatctgatggttcatatatacacgtaagacatgttcaagtgtgcattggtttaacaaagagactaaataataggggtatctgtgaaagctcacacctgtatgaactgctcaattggagaaacgaggtaggatagtgtcactactactaaagagaatataatgtggaatgagagaattgctccttgagtgtgtgttttgagagtgaataattggtctccttttatagctgcttatgacggtggttaaggtcggtaactcccacaaccgtcattgggaagcaaccaggagctgccacttggtttggccgacccctgggccccacctctctccaccgcctttcaccagagattgacatgtgggtcgctaaggcagtgcacgacggtttggccccactctaagttggtttgagctgacttgtgggcccatcaattcatttgctctcatgtgattcgccagaggtgtgtttctttgaatgccggctcatttctccttcaccttagtgtataattcatgcacccatagtaattctccaagacaagtggaactaaatttacttgtaactaatatacgtgtaagaaatgatagttctctctttatttattgaggtaattgacgtgtcaaaattggtacttaacgaccgtcaacagtcatgcaactcagtcacccaaaaaaaccgaccacccctccaactctcgttactctcatgtaatcctgttggccacgtcctcctttcttggccataattgaagaggcgatacaaaacgacaaggcaaagatgtccccactgtcgttcctctctatgcctccctcaaagatgtccccacctccacccgtccccaccctcgtctgaggagatggtcacccttcccaccactattcccctccccatccctgtccttgtgtgctagcacctatcgccgagggaggccaccgcgtctgcctcgagcagtcgccattggccagagatggaggccgcatcaacctccattcatccccataggggtggacaaaaataccccgaaggctgcaaactgaacaaaactgagctaaattgaaccgaagtgtcgattctttggggcataggtttacccttcgattaatgtattgtgtttgatcaatctatggtcttttctacggtttttaattctcatgaaccggacaactcgaggaaactggaaagtccgaaccacaggtccaccaaacgttgtatagcgacaaacctggcaatgtgcaagctttaaggctcaacacccaaagcccacatatctaacaataatacatctcctagagtactccagtactgttcatcgttgtttcgtaatcgtgcgaagccgtggccggatttctaccctaccgccgcaaccgtttcacgggtccgtgccgctcgccgcccccagctcctttggacgactaccctgtgcaactgcgcatacaattaccacatagctcggtcatggtctactagttgcccaaacctctccaagttccaagactcctgctatgtgaggtcagaaaaactccttgtctcttgatctgccattgtatgtgtcatcaagtgatttctttgagtatcttgtgctttggaattcttgccaacgtgttcccacgatttgttcggtaaaaccgaacaacagaaccaaagttactcagtttactcggttcggctttctattttttctataaacacttcggttgtcatagctagaaaaccgaacttttattaaaccgatgaaacggaacactcagccctaagtcccctagagcttctttcacactacgaggagcttgcctccaccttctctaatcctcagcaagtctagaccagcgcccttcatcttcgacaagtcgtcatccacagatgctatctcccgtctttgcctcccatcctccactagaccatgctccgggccctttctcaacaacatgcggttacttcggttatgaccgaagaccggaccgaaattttgggtgcctgaattgtcgatcgcaaaatctacagtgccaagttcaggcatcatttttagaagaccgaagtttttttttacccgaattacgtagaccaaaatctcggtcagcaacaaatgcccacccctgagtatgccgatcgggatacgtggcacccgttggacctctttcttaggtcagcaggtgtcaccaatagtcccgattgagcggccgaagtcactccttggattaggcttggccagccaacccactcatagggcggttggtccaccacctcacttgggcttgtcttggtgaaattgggttaatggccaaggcattggacgtggtcggccggcctagtttaacttggtggctgacccttccaaggggtccaaaggccctccggctaggcttgtcttggtgaaattaggttaatggccaaggcattggacgtggtcggctggcctagtttaacttggtggctgacccttccaaggggtccaaaggccctccggctaaggtggtgaccagcctgattgctggcccttgttctaggtcggtcgaccaccctcggctctataggatgacggctctataggatgacttgtttttctggtcgtcgt

SEQ ID NO: 80046 - DNA, 20822 bp, Oryza sativa
gccctcccagagggcggtaggagactatttccgttaattttcaaaatggaaaattatttttgtaaaacttttaataaaaaaaattataaataaaaaaaattcgtcagtgctctcagtaaccttgggcctgaaatgacaggcccaagtatgcaatcgcacaagaatcaggcccaatgcatttcctatccttgtccttgttggcagcttagaacttcagatatctccactgcggcactgccgaactgtcagtctttgacaggcaataattcaagatatcttattaggttagtggtacattagtaataacgatcaaattaagttatatctaagccaaaactaacgagtaaatgccaaaacacacggaatgaaaccgacattctgaatgagacaattagctgcaaaatattcaacagtacggagccaaaacttcatttatatattatgtctgatatttgcacgaatcttgagtacagtgaacaaataagatcccaaagaaatggatggtgcaacagatcagcttgctgtggatgccgaattgccgatgatgctggctctgatgtagtatatgagcaatctcacttttggagatgcttcaaaacctggtggtcaaaacctacatgctccttccttccgtcccatttaaagtgtgttgtgggattttttgtctaacatttaaccgtccgtgttatttaaatttttttatgattaatattctattattattagatgataaaacatgaatagtattttatgcgtgacttatttttaaaaactctttcataattttttttaaaaagatggacagtcaaacgttggacacaagaactaacagctacggttagaataaaacggagggagtataatggtggccttttcttcctctactccctagtaattgttcatcttttgtcttatagctaagcaaacttttcttttttttgaaagagggtaggcaaaaactcttgcttatgagcatcattattgatcatgcaactccaattgcggaaaggtgcgcaactttgagcagcaaaaattcctcgtgtaaaacatgtattccctgtccaggatcaatgttcagaatctcatattagctatgcatgcatctgagtttattactaagaaaaaataatttgacttttatattacgctttgttaatcaggagcttaataaactatgtatattttgtatgctgctccatatatataattaaggagaaccaaacatttcaacaggttgtggtcatttgttgaacgtaaaaggcaaatgtctaaacctattagtcgtacttagtgtacaccaaatcaaaattttcagtgatataaaaatgttgtaactaacttcaagtattaattgcaatgatacacatataaatcttttgcatattcccgaaaaaagtggtataaataattatgtcaaaccataacacgttaagataaatgtcataagcatattagcatttcaaacacataatctgatcatatatatagctagtatgcatgtggagtgcttgaggtgaaactttgccattatatagtatgtgatcacatattatcgtgcatatatacataaattctgtgctttaatcattagctctctagatatgcactttaagtatattttactgttttctagagtaaaagttcaattagaaatacttacaatccaccagatgctagatctatatcacaaattaattgatcgtatatattccaagaaaaccaaaataatcatatcatcactttattattgctccaatctgaactacaattaataacatgaaaaaaaggaaattaacctagctagacagtgctaacactagaaggattcttgtacagccaggatgatcaactggagctagctgatgaaaatacacaatataattaatatagatgcaaatacaaccatatatataacagttcttggattcggtgattaatttgcatcaatgacggcgccagctgctacctagtgatctgcaagctaagactggatcaggagagtcaaagggcatgtgaggtttgtacaattgacaagcagctagcaagcatcgatccggtatttctgttagctatctactaactaactaactagtatacataattaatgtgtgatgtttgttattcccatgcataatataggtcatgtgatgtgcatgcactgtggtcttaagccaagatctagcttagctagctagcagctctgcctagctagctagttgctcatggcttaataactaatcttaaattatattagtgtctacctgcatctcatgatcagctagtgagactcgtcctttcaaccattagtttattttcgatgcatctgaagccattattgttcttttttacagtgtaaggaattctcaagaagattactggtttttattcttgtgacagacaaactttgctaattaacaggatatctactagaatctgatactacaaaaaaacagcttacgaattaccattcatctctagcccattgatagttctactccatattaattcatcagataattaagtacacaaaccaggcatctccactgcctgaacggcatgtaatcgcatccttaagctgttatacatagtgtgttcgctatgtaattagcaaccaaagcaaagaaattctcgaataaagagcatgcataccctttttcagggaaataacatgcgtacttagaagtaagaacaatcaagaaaaattaactgcataccttacctagtagtattatagctatatgatctataatcatcgaagataggaagatcacctcacagacgactgcagctaagaacgcaagacgtctgaacccaacaatgaagaacatgcaccatgaatatcaagaactcaagacggagatcgaagttttaatggctagaggaagcctccaaaaggatcgcatgatccgtcaagctgcttgtagacgacgaccgccatggaagcgagcgagagcgatgaaggatcaatgcgatccctttggatgcttccccaagacattgctgctacaccggctggcccttctctctttctctctctgaattctgaataagtctgaaggtctctgcagaggcatggaggagagaaggtgttgtgcaagaaagctccagtgatgaggcccttatatataggtacgcaaccttgctttgcccataagtttattcacatttgctttagttttcctcccaaaatggaccaatattttatcctcttccaatttaagtttgcccattcctccatgatcacactgtaaaccataattaatagtttggttcttgaactgtaaattaacttgttaaaaagtactacatgccaaacattaaggggacgttatttatatatattatatcatatagtcataattaaaagtgagatctataattactgtgttttgttgtactagatggtacgttcggttttgtaatgatcaagaaagttgttagtagtggacatcaaaatcaaatatatgaatctctagagggcgcatatgcgagataacattgttaataagtacatgtttatggtttgtttatgccgtaatcaattatggttgcatcattagatgaagcgtaaactggggtggttctccccaagatgcctttaactttcccctaattttagttctttctagctagctagtttgcaaaatgggctttgcaagaagcaatgcatatggatgatttgattatatacatgaaagcaaattaattaagaaagttggatgactgtatcagcacctgccagatcttttggtgattagggacaccattttttttagctagattaagagatgcatgtggccctgggaacaactaattgcagccattcaatcattaaattcagccattacaactgattccccctacccttctgcttatgtgcccctaaactgctttttctagctgctattctttcatcagttgagaccccttgaagcatcttttgcctcttatcttaatgacaagtgcttactagccttttgcacagtagctagccttggttaatatattgaaagaaagggtcctagattgcaagtagaatggcaaatgtcctgcagatctgagtactaatcctgccttatatgttaattgtgtctggtacattcgccgtttgtcatgttacagaggttgttacagtgtagtaacatgctagaacaataatgtcacttttgtcctcctgctgttgctttcccagttttgctacagtgctgtaacatgcatatcatccaggatgaacaaaatctagcagaaatagcagttgtaggccaacattcagacagttctcagaatgttgttgtaacatctacaccattatgttctgctctttgtaattaggaattgttgaatcctacaaaaatggatactgtaaaggttgcccaatttggacaagcaagtaggagtagacatttgagcatggtagattggcactagtggatttgcttccttctctacaagatcagcatgggtacattcactaggaataaataaataaataaataagtgaaaaaaagccataaactcctcctatgcatatactgcctttacagatgtcttcaggaagatgtacccatcatgcatgcagggaagctcttagtattatcaattgtcagaagataatgaatgccataagataatgaacaacactctttttggatatataatcaggaactgcatgatgaatgaaatgcaggtactacatgttacacctctcccaaagttaagaaggttagaaaaaagatttacaagatgatgtgtcatatgtacagtgataccttggcatctaacactgctgatttgtttgtctgtcttgatttggctctttgtttgtgccgaaagaggagatgtgaatatatgatctgccatgtgcattcatatgattcctcctgacaaagtccaaacattcttttgtgtgtgatcaccagatgcaatcttatctctgaaagcaaagctcaccatcagctccttgtagggcattgctcattgctcacatgtgctcaatccaaccagagtttctcaattcctacactctccattcacaacagaaaccaataatcaatttttgctgcagtgctagctagctgcctcaacagcatgaaggccatgcactcacatgtaaagatccacacaaaatgggcatatgttctactactcacatgcaaaggcatacatgcccatgttgctatttcgtcgctcatgatgtgtgaaatgtgagctccgatgtatcggagtcggaggtgcgaaaaagtatcgcaggccgacggttcttcgacgcaacaattattgtagaaattcagggaattcaggactagtagactgatgtgaatgcgctggaactgaaagtctgaagagctgttcaacaatgtattccacactaacattgttgatctcaggataagcatatttgaataatgctatttcagtcaaaagaacatgtgactgcaattatatattcagtaatacttggtgtcctaaacctaccaacattcagaagactggatggaaaaacttgatgaatactactgtactgcacatcatctgcactaaagaaaaataaagaaagaaaagaaacactttggccactagtttctgaaatcctaaccaaagtactgtattaatttgatctctgattggtatatcaaactgtcacaaactgaagctagttactatactaacatataaaatgagtatcttcatgatgattgaaattgcgatcgaggaggatcctgttggcaatctgaaaaacaaagatttgcctcacctaaaaggacggccgttttcagatgttatttttttctgcaagattggccgtctcacctcacatgcatgagctgcaccagaaagaacacaaaatacgtcgctgccgtctctcgttcagcacatggattgcagcacgcatgagctacgaacctcgtgagcatttctcccctttcttcccccaatgattgaagagtacacgccacagcaagatcgccgcccaaaatttggttcagagatttttctttttttctttttcttggtttctttctaattactttcttccagcttgctcaactttatggtcattaaccaaacaaagatgccctcaattagtagcactaactgcaacctgatctgatctgatgacggtttagatagcggcccaatcatttgcgccgatgattagctagccacagccggtactgtattatgaaatcaaccaatttgctgttgagttggttaatcatcatacaatgtgatgattacatatatataatcacactagctagctagacattatggatcagccggccaagcttagactaatttcatgagaaattcaagtggagcaactggccatgtaacacttggaagcatgatcgagcatgccagttggactagcattcttttattttttttttaggaaatcaaatttgtattcttttcagtctgaaattagttagccgttttttaggaacaaaatgtaaggaattcaactccaatgttactgggcctacatgactaaggcccaactacttcatggcccagactttatttcccagatttcaagctgggcttttacataggcccattcccttgcctgttgcgcagcaggtcgaatcgctgcattttcagttcaaaacaaagctaatttgaattcgatttggtttactgcacaaaataggaattgaattgaatttgatatctgcaagtctagtatgtcatatattcttttttattttttgtcaggtcggtcaaaagttggctgacctaatttcattaagataaggagaagattaaactgtcgagttgggcgtgggcaagataagccacccctgcttgctctaagtagtcaacaaatctaggataaatagctggcaattgatcatgccattctgaagcttctgcagttctgctccatgccgagcggattgatgcagatcagtcatggcatcgataacattttaatgtttggatttgtgtgttacctttgattgatgtgatactctcctgccaatattttttgaaaatggaaccactgatgatcatgggaatttcataagtagatatgaatgtaaaaagttccaaggaataaattatatatagcttaccgtataattcccgatgcctttcatgcttatgatatagtcttcatgggacagtttttgggcacgcatatacactgtccaatcgtgagtggaaatgcttgtgtgattgagtgatgaattcagtccatcctcttctccattttcattatttttcttttttttcgaagtattttcattatttttcgtttccaaagggaaatggaaagcaatatataggccgttgatttcgctacgagtaataacaaacagtacagatgaaactaatgctacgcgcaggcacacctactagatttattttttttatatagtaatccattacctaagaagaaaatctacacgagttttgatttaatacccaattatcaaaacccattgtttcaaaacacatcttgcattttcaaatgaaatgtaaatactacacatgactgccaactaaacaacaacaataaagttaaacataattgctagagaacttctacaagttttttttttttttgccttcaaaacttttagatctatgaacctcatatcacctcgaaatttatgcatgaaggaaaaagaaaatttcgcacttgtcacacgtaagattctagtgcgagccaaccaacctatagttgaatacaagttttatataagttataccggtaattgcactgcagttatagtgtagctatagtgtagttataatgtaattaaatttcaattatgttatagttatatctgaaagtttttcaaatttgcggcagatttttaatactcccaagttaaattaaactatctcggctgtaacaatgcttcattcaggcaaacgaaaatgttcagatcaagagagaatacttgtgcgtgcacgtttcgaaccacacatagtttaacacttgcatgctcaggatttctgcagcgaaagaacagaggaactgcactgtgggactctgaatagccgttctttttttttttttacggatcaaatttcattaaggttcagtgaatgcccttttgtcagacaagtatggaacctcgtttgctcatggctaaacttggcaggaggaaatgctcaacccccaggcggaacatccaacgaaatcgatcgtcacggttcaaaagagcaaaagctgaaaacaagaggagctctcctcacaacatggtggaatatttggttggaaaggaataataggattttcacaagttctgttagatcagagatggacgtagcttattttgtcaagcaggaaattgaccttcgtagctcggcttttaagcccccttgatctgtaatttttaattttattttgctcgctctggtctgtattgtacggtttttctttctctaatcaaattccggcagatctcctgccgttgatttcctcaaaaaaataaattcattaaggtttagagaaaatagttacatgagtataatctcaatattaaactgccagagttatgagtggctgaacaccctcaaggaagaaaccgagacaaagaaaaaagaacaaagactacatctcctcacgagattgcaaaatgcccgcagtcttccaaatagagatttctacctggacatcattgacgagcttctccgccaccttcaactctgtgtccaaacactctcctccgtttcgctctttccaaacgaaccagcacactgactccgaatagccgttcctctcgtcatcttaaattaggagcacgaccatgatgctgcacggatgatctaagatgctgtacaacttttcacgattagtcgaagctgaaatttccccaagcctctcatgcttattgctttcatgcatccacacacgttaacagtagtaaatgtttaaacgtgctaaaagctgcttcttcttcttggcaagctatgtgcagagaaaatacacaccgtttttgttcagttggttaatagatcctactgtataactgtcttgctacgcttcgggggaattgttcaaacccaggagcgattttgagaaattccacttgttctaaactggttgtacatattatatgtgcacatggtagctagcatgcatctcgtgtatcttgagtagagaagaagagatgccaaacaagtgtaggtgcacctccatttacatggggcttgtttagtagagcttcaattgttaaatttagctataggagttggatatggagtgaagttgtggagcagcctaaatctagctccacctctctagttcattgtgtgagaacgtgatctagtcagctccgctctcattttgggtggagctaaaattgtttggctaggtttcagctccaggagagatggaggtgtaagtggaacaatgccaaacatgccaaatgccaatattattagtgaaatccatgcagctctgaatatataaatgtagctatacctatacgaaagggcatgtagcctagtggttacagttacctgagtagtaccctaaggttctgagttcaaattttctatggagcgaatttcagattgggttgtttgcgtggctaagttccctatttcaatggccgtatatatccggttggatgtagaggcagggtaaaaaatacccttctctaaaaaaataattaaaaaaaagctatagctctaagtagatgtgtaattaagatgagctagcatcaagagagtagctaaattgattaggttgttgttcttggcagcttatggattgtgaattatcgggggcaagtttccaaaattttcttttaaaaaaaaacttatttatcagtatttttgaaaccagctttttcaactttgtaaattttaatttgttcatttgtgccccttaagaattgtcagaaaattcagttttagccattatatccattagcagggtttacagaatgattaaccgacgaaaaaaagttcagttttttttttctgaaagccggacttcccgggccggatcgataatacaaaacaattaaattacaggatactaattaaattacaggatggataatctctcctagtttctttgagcccgcgataattcgatcttacttagcgattatgacccgcagcggagtagctcgatcgttggctgaagatacactcgtttctcccctatcattagactagagcgacgattaggattatcagacctccaaattcttttctgataattttcgaacgaattccctttttttactagagaaagatattttttacctcgtctttttatccaattagatgtattcagccttttaaataaagaacttatcctctaaaacaacacaatctaaaatttgctcatatgaagattgatatatgcagtcttttaaattaggaacttagccccttaattaacccaatctgaaattcgctactatgaagatttgaactctgcaaccactattgtatgccctttcattgggtgtagatcctctggagttggttccgaatccaccggatggatttcaggtgatccaagccattgtttaatttcaatggaccagattaagcaagttacttgcttttctccctatctctacgattgcacacatcatcctagttaattactattttccgggaatataacacaaagttagaagcagaataatacaagtagttagatacttatatttcctagagaatgtagattgtaatattaccgccaatagattgaatatatcattaggagatcaacaccaaaaagaaaacatggcacatacatgatgcattcactatgccatttaattatgcatatatagctcatcgtcactaggatagcaaatcaaaacaccatgattaatcattctgagccgcgtgaagaaaaaatttagtcactgtggctgtgtttagatctaaagtttggatccaaacttcagtccttttccatcacatcaacctgtcatacacacacaacttttcagtcacatcatctccaatttcaaccaaaatccaaactttacgctgaactaaacacaacctatcttgtttctatgcgatgtcatatcaagatacagagaggggcttcagttctcgtgcatgggattaggcaaaaagaaagtgacgtggctaccgtctatacctcctataaagaaacaaatggtccagatttgtagaaatccacccggtggatttggagaactaactccaggagccgggatctgtacccgtccagatcattgtcatgattcagaagcagttcctctgcttccagcgggagtgaccttttacaatctggcacgcgtgttccggattttagtccagtcgttgacgtctcgacagagatgaaatttcctgacgcttctcatgcttaattatgttcatgtatccatgcaaacataggcttatatagctatagcttgcttttctctccccttaataattacctctgatataactattttgctatgtcgttatggagaatcgttcaaataatcacagaagaaaagctatatattttgctactatgttttaagctagcatatatgcatctgggatccgattcaggtgcagtagctagtatgactgcatgataaacagtcacactagcatcgcacaatttaaaatggacatcccagatatatctgagcactgtagcgatttactgtggaagggtactgttctgattttactgtgccgaatcctttttggtcgttagattttgacatggagggctcggattgcgtgcagtagttaccgtgcagtcctagtagctactgcatcagatctcaatcccaattatgcacctggtatgttgagcgcacagaccaggagagagaggcaaaacaagctagtgtgtctgtatatatataggcaaggagcatgcacccacttattatacatccctgtaaacatatgggagtagtacatatttgctacttcctccgtttcaggttataagacttttctagcattgcctatatttatagagatgttaatcaatctagacacacatatatgcatgattaattaacatctatatgaatatgagtaatgctagaaaatcttataacctgaaacagaggcagtagctgtaaacattacataattaatgagcattatggactagccaattaatcgagagcgtattttcactgtatacatcctttctggatgtaaaggccagtttaacccattacaaaaataattgagagcgtactacttatctatactttcgtcccattaagtgtaccttacacattccaatcaatacctttgacaaaaactcgacaaattaattagtcctgtagaactaatttatttttttttcaaatcactgcaaaacccacccaactggttaagcatttccctcgccaaaaaatgtagttagaaatttctttttagaaacaaaataataggaattcaactccaatattgttaataggcctacatgaccaaagcccaactacttgcggtgcccaaactttcctgaaatcaaagctgggcttttccttaggcccattccacccttgtctgttgctccggtggaatcgctgcattttcgattcaaaacgaaagtggatttgaattcattttgccaggtcagccgaaaatcgaccaaccgaattgcattaagaagataaaaaatcgagctagttacagaacgatattatactgtcgcaaaggtataagccccccccacccacccccgtcgcaaaaaaagaaagaaagaaaatccagaaaaacaggaaccaggagaaactcccacgtggtactctctatgcttaaacacttcagcttccctccaaatcagcatttcatctctaatggatctgtaaacttgcgctgttgcgcaatctttgtgatcaaagattctcgagttgcgctctttccataacatccaacataccaacatggcacctgtcgccaccattccgtgaagtgttcccctccatcctccggaaaggaaaaggagaccccgagccaactccttaacattctctacacactgtttgtgaattgacagccactaacaagtgttgacagcttgggttgtttcagatggagtgaattttagattgggttgtttgcggggctaagttctctatttcaatggccgtatatatccggttggatgtagagaccgggtaaaaaataccattctcttaaaaaaaaaaagtgttgacagctcccctccacattgttgcacaaagcgcaagtgtcactgtgcggcgcccaccctcttttctgaaggttgtcagcagctaaaatctcgcaaaagaggagttgaatccatagattcttgccccttgctgggtacggagtcaccacatcgcacggtaaatgaattgatcttcaacacgcatgatctgagatgctgtacggcttggatcgatctgacgaagctgaaatttccctaagcctctcatgcttattgtattcatgcatgcacacaagctttagcttagttatatattggggccttattaatcaccaaaatagtagaacatatttaaacgttctagcttcttcttcttggctagcttagctatttgcagagaaagcacacaccgttttttttggttcagttggccaatagactctctcgtactgtaactgtcttgctcgcttctgaaaaattgctaaaacccagaaaggatttggagaaactccccatgctctaaacttgagttgtgatgtatcttgagctgagaaatagaggtcgaccaaactagtgaagctgtatatataagcatacaatgatatatacaagggtatacaatgcagtccggccatgtagggattgcactaataaatttaaagcatacagtacatttaatcatttattagaggagatcgaatagacacggtgccgcatctgtccagcagccaggacaatttttagatgcgtgcatcaaagagatcaggctactattacagaaatggagctcctagctagccaattaaccgagaaacacaatgaacaaacagagggtatgaggagttatgtgattgtatcgtaacagtagcaatatctgtgatctctaaattcatgatgtctccaagtcccatgttgtagtatatgggcgaatatatatgcaatggacaccacaatgcatgcataaatttcctatccatcgctatgatctgttctagcttggttgccaatatgtttatctcatatatatccacacatgtagaaacgtggggagattggctctggttggcacactatcggtctgagatatatactactagtatcccgggtttaatctttccgtttggatgtttctatcggagggtaccgatatactgaaatttccaaaaatttgaataaattttagtcaaatttgaacaaaatttcgccaaattcacaaaaaattgaaaaaaaaactaaaattttttgccaaaataatcaggggagggtccgatatgaccgtgaattttaaaccctgctagtatcatgcactgggttgatgcacagtgttgatattcattgggtagctatgttactcagcaaggtacaatcagttgatccatgcatgagcagtggttaattaagattcataattggatttttttaaggaatacctccttaaatatgagacattattgtgaaagggtaattccctgtgttctaaattggttgtatatgtatgtgaatggtgtatagtagcattcatctagtgtgtatcttgagcaaagaagaaagagaggtcaaacatgtgtaggttctaataaaaaaaaagtgtagctgattggtggtgtccatgcaaacatgcttccatgcacctctctgtattacaccatgcacatactctgaacggtttggcagagctgaattactgcggccatccttcttaaatttatactactgtttccaaaaaaaaatactatctatctattatatactaaaagtttatgaaacatcctaaaaacgctcctaagtcgatacatggcacccctaaaaacgctcccaagctgccaagtggcgctctaataaattagataaacatctaatcattgattttcacttagcttggtggacccatcagttttgaccattagattaaattctcatctctccaccctaatatacgatggttgcatgctttggtcccaccaaaataattagttaagagtaaacaaacgcggagaatcagttatttctctcccgaaaaaatcaccgcagtattaattcttggaaagaaaaccgacgttgtagatttaatgcaggagcctgggtgtgtgcttccctcatccaaaaaattataccatcgaaaactttttaagtgaatatcacctttgcgtcaaaaaagtgaatatcactaactgctctaaactatttacagagttaggttcagattcatgaatattgccctcaatagttagtttctgaatttttgatgtttctgtttgattaccagggcctgatgaaattttcacagatgctaaatctcactacattaaattctcatctctcctccgtaatatatgacggtttcatgctttggtcccaccaaaataattaattaggagtaaacaaatgcagagaatcagttctttctctcccgaaaaaaaaatcaacaaataaattttcagatgcaaagccataggaaaagaaagcaatgcgcctctagcttactttttcgaccaatatcaacgacatccatctacattttttcaggaacgagcagcaacaactaaggttgaaacaatcctaatcgtatcaaacaggtgagtgatgcaagcagcaacttccatctttttattgtttgatctcttaacatagccttccacttctctatttttttaagcatataatttcgcttttttacctacaattttatactactcctcggtgatgttcgtattctgatctgttgctactagcttctacaactaagcgatatatcaaagctcttgcctcttggacaatatattcactaattaacatcgggtatttgggtgctgtcagtttatttttgagcacttagtcaagacgtcttgatgctgcgtgctttgccaccataaatttgttaattgattttttagataatcattttggaaaggtaatgcatgccgcttttttaggagaaacatattacaaacacatgagtttatatacacacgcgtacacttatccatagaaaacatattcgagagactgagccaatgatatatcttcaaattagtgaagtcatcataaacgcctcgctattgataggaacgttgcctactaaaaaataattagccataaatatgagacccatgtcaagtctagatgttaaacctaggtgggtaagttccaccataggtaactaaccagccacactcactaattgcagataatgtggagcccctcttccctctccttaactccttttttccatacattatttgagataaatgtagtatataaataatagataaactattgtaatttttaaattatatatacaatttttttattcgaccacaattatattctgtagaattaaatcagttcatatcgatttgaccaattgcgttatatctcacagacaaaaaaaacacgaaaacatatgttatagtgtcatatatcacattataatcataaataactaaaaatagctctaatatgtttgaaaataaagtttactacattatgttatttaccattaacttaatatatgatctatattgactatactttaatctgtaaaataaaattatattttaggtcatatttttattcttggtctgtaatccaaacggacatgaaaattattaaaaaaagataacagtatggagtatatatcactatatattctttatcggttataataatatgtaccattaaattagatttacaatataacaagaaacatgtcgtatctttgcgctttacatgtcatttgagaattataacaaaacgtgaaaaaacaatttaatgatatgggtaatatcatcacataaatatgcttactatgtagggtgcactctatttggcccaaatcagttcacaaatatgcgcgactgaattagatttacaatatcaacaagtagcaagtcacatccggggccttgcatggcaatcaagaattatgacaaatcatgacaaaaaataacaatatggattatatgatcatataaatatacttatcatgtggattccaatctattcggactatacggggataatctaaaatgtcaattcaatttaccaaatcatgtataagttgtacgttttgtagactacaccctaaatattaagtaaaataacggatggagtacacgtcgtgttttctcccctttgatttctattaaatacgtatggtgtgtgggtattttgtatatactaagtttggttaattagggaacataaacaatactaaagttatatatgagaattcatgcattaaaaatacacttcataacaagaacttacttaacaaaaatgtactttagtctatggtgcttaaatatttataaattctctaaacatactaattatttctgctcttatttcaaactaaattcattttctctacataatataagagatcatatgagaaaaaaaagaggagggagaagaagtaaatagaagtctgccattgaacagatagaataaagacatctataacatacaagaaaatttgttgattaaggtttataaactccaaatgtaagatatgctaatttctaaaaaacacacacacatggtacacataatagttccatatgaagcaacactattgttgtgaaacaatagtttctcataaattaaaaaccacatggtttaaataaatttgatttagaatttatatgttgaaaggtaattagaagaaaattaaaagcgacattcacaacaatctcaaataaattattgataaaaaacatgttcagaatagagtaaaaaaatattttaagaaatactcatccacacataagtattcataattaacattaaataaggtgtcccgcgcatatgcgcgggctacctttctagttgttgtaaaaactttattaataaacatttatctgaatactttttaaatcattttccaaaacttactattatttcattaatttggttgtgccctttaataattttgtcacaaactcaattttagtctccgcttaaaaaaaacacaacctagaaaatgtatacagttagggggcggaccttggtttgagccaggccccacaccagcacaccggataatcggatattgggccaaagagaaattaaaattacatgggtgaaactgcatgtatctacacgagctttgatgcccagatcagaggcctgcgcattcccttgtatgctgatgaattctaggatatcggcaagggaaaacattattgttttcttaatttttagtcttaaaatgaataggtcctgagatctcccgcagacatgcactgatgttccaagttcccgtctagcattgcccagttggcccaatctgaaattccccgatgactctcacgcttaattaaataaatatatatacatgcacgcatggtcacaggctattagcttagcttgctctttattagtacaatatatatgtttcgttactctttctagcttgcataatctggggtttctcttgagcagacaagaagagatcgtcgttaaagtagtgtagctgcgtatatatagacaaggagaacagtagtcgactagctgccctggggtctgatcgagttctcaattcaattattatattgtattactccatccgttacatcgtatcatattataagtcgtttgatttttttctagtcacatttgtttaagcttaaccaggttcatagaaaaattagcaacatataaaacaccgaacttgttttattaaatctaacattgaataccttttgataatgtgtttgttttgcgttaaaaataataatatatttttctacgaacttgatcaaacctaaaaaaatttgattaggaaaatagtcaaacggcttatcgcatgaaacggatggagtaatttttttttatatataggaattattattgtagtactaaatacacacatgtatgttgtaaatagttaattagtgtgagtgaaacatgtcagatgaattcagttcatcctcttctctgcttttgtttcacattttgtatctttcactgaaaagtaaatacgttttgccctggaattaatgtgcatactcattcgttccatagcagttacacagtaaaaacaaaacaagcaaatttgaattctagttccaagccaaatttatcatcttaattgatccacagaagtccctgaatgacatattgcgcaatcagacgatcggatgttgagagtctgtcctgattgttgggtttagtctcaccttggtaattgatgatgggggagcacgacttaaaaggtgggggcagtcctcacccatcagactagtcttttgagttgtataggttcaggagttaaagttgtgactctggttggacctgtggtgaagcaggcccaacgtgacttgagtggtccacggtttgtgggccgggctgcgcacttctaacactcatgaggtagccgtttctcatctcgccgtaagagtgatctaaatttatctagcacgaatgatccagggtgtgtttcagcaataaagctgaaattccctgatgcttctcatgcttaattacattaattcatccatgcacgtaaacacaggcttatatagctagctctctctcgtttataattacctctcatatagctattttcctatgttatggagaaatcgttcaaataatcgtagaaggaagaaagctgtttttctagtatgttctaagctagcatgcatctagtgtatgttgatcgcacagacaagatgtgaggcagaactcaagtgtatgtgtctgtatatataagcaaggagagcatgccgtcccactcattattagccctgtggatcgcactaaacatacaggagtagtactctgtcaagaaaaaaaatcgtagctataaatttggacacgtatatgtccagcttcatgattagaattaggtttttaatgtaatggaggtggttatttgctacttcctccgtttcatattataagactttctagcattgttcacatttatatatatgttaatgttatacgagcattattggattagccaattaattgagagcgtaccttgtctatacttccatcctatctagtgtactggccttgcacattccaaccaatactatagaactcgacaaattaataatatctctacacaaaaagaactcgacaaattaattcgtccgggttaataaaggggagatgagaatttgtcccatcacattattttttattttgatttatttttatctttattttttttgttattttaataaatttatggctgtgttttttacgacagaagatggagatgtaacctatttctattacccacataattagttagtcctgtagaactacttcaatttttgcaatcgctacaaaactcaattggttgagcgtttcccttgcaggaaaaatagtcaggcattttttaagaaacaaaatagtaggaattcaagtcgtacaggcgctggtatgtttgagtggaaaatgtgagatgaattcagttcatcgtcttctctatttctgttctattgttaaattccaaaggaaacaagtggaaagcaatgggtcgttgattcacgagtattaacaatacagatgcaaattacttctaaacgagttaatggcatattcttttttttttgcggggaagttaattgtacattcagcgagcttaaatactgacatcgatttaatggacaaaatttcaaaatccgcacaattgtaatacatttttaatttttcgaaagatctataaacactatacttg

SEQ ID NO: 80047 - DNA, 5351 bp, Oryza sativa
attttgaagcagtgccgcactgtcttgcaggacaaaatttgaggcgtgcataaaagagaccgggctaccgttacagaaatggaactcctagctagccaaccgagaaacacaaagaatctaaacaaagcggaattgttgggggatcggctttgccctcctccgctctagaaaacgggcctccctttctctgaagaaggctctaaattcgaaggaagcttagaaggggcctccagaaacgatggaggccagctgggtggcctcttcctcgaggaggctctgtcggaggaggccctcagctgagtattcatggtgagaagatgggttattaagggcacatttaatgcccacaactatctgccgctctctcgtaggaagcccgcagctaagcattcatggcgagaagatgggccattaagggcacattcaatgcccacaactatctgccgatacactcgtggtgggagcaggtagggtggatgtcaaggcgcctcgatcatgtagcatgcctcagcatcgagctgttcatcccaggattcacggtttaattgaggcaaccattttttttggccctcataggattttacctttttgccccttgggctaagaccacttgtcagcctcttagtacgtagtaggcggaggcctggggtacccttgtaacttttcatacgatccatgggactatacaattgtaattcatttcccaaagggagcaggagcaaaagtaatccagaaaacacacgatccactattgattcatgttggattattctatttcaacattgacatcatctatggggatcggacaatattatttttatgaacacgaagtcgaccgctcgagagagaatggctccgaaaagataggctactagtgccgcaacacagcaccctaggagggcagcctgtcacctagcccggttgaggcacccggtgctcgctacctttggtgaagtcgctccacaacgacgacagcgcaaccggcggtagtgaaacaaacgtggggcagggctcggccctgccctgcgagcaggatgaggggccagtcccaccacccatccctgctgacttggctgcagccatccagtctcagctggatgatattgcagtcaaaagccatcgggtcgacacatgtgccgaaggactcgtcacctctaaattcctgatgtctccaagtcccaaatatccattgctatggcatgaagctctgaaggtgaagtgtgttttcctacctatggccatcttatcttcttggttgatggagtggccctggttgtcactctgcctgccaaatatatagtgtacccattattgatgaataatgttgatatttactgcgtaccaaactcttagtcagcaaaggtacaacaaattgatccatcatcatgagcagtagttggttaatcatgattcagaatgaataaatgtcacatttaggttctgatatgggttatcacgagcctatgctttccaaatttttaaacggtgtcatttctttttttaaaaaaaaaaagctttctatatataaatttgatagaattctcttttaagataacattttaaatttgtaatagtcgttaatttattcattcgtagtatcaaatattagcacaaaactagttaatccatcatccatttagcactgtttgaactgggccttaaccatggagtctagaacgatcggactgtcaagcatgcatgttacagttacactgttcagtaaacagtgagaacgctgatgtagctgagagtgaaaaattaatgagggatgagttcatcctcttctctcttctaaattctgttttcaaatgacaaagggaaagcaatggttaatctgttgccaattctctacgtaataatataattcagatacatcctgacagcggttttatttaggggccaaagttttattcagcgcaaagcgaggatgcaggtacaagtatataaacggctaaataaatttcttaaatttgccagatgaaatggcaaattaatactccaagtgacagatcgctgttaaacaaacaatgcacattgaagtcggtcgcggagagttcgttctaaaaacgtaacttggtaaggtggtggttcacccaaagcagcgtgttagcaaacatagaacagctaggggcctaagggttaatcctatgtttgtctccaaaattacgtataaattatcttaaatcatcatgtaatattttagaagcaaaatcaataatctgttagttgagtcccagattagctctaatctttagcagattctggctctgtcactggttaaaagtacagaggatcttgctaacaccattgttccagtaacttttgagtataacagtaaagtcccgcactgatgctcctcattcttgtctagatttgcccagtcggcccaaactgaaatttcccgatgtctctcatgcttaattacataatagttacatgtatgtttttgttactctttcaagctcgagccgcatgcatctggggtttctcttgagcagagaagaagagatcatgaaagtagtgtagctgtgtatatatagacaagaagaacactagttgatcactagcaagggtggatccagcgtgggtgttggagggactcaagtccccctatcccgctggatcaccattgatagaaggagagagaaaggggggaagaagagggagaagaggaagagtagggggactaaacaaagaagaaggaaatgaattcaccctttaatattgttctggatccatgcccatgattacctgttattgggtttaagttctcaatccatattattattgtagttatggccgtaaagaattaataggagtaagtgtcaatggtacaagactagttaataaagggcatgtgaccatgcatgtgtgcttaactttgggatagtggtacgaaaaagacatgtttttttcttttacgtttgtaaattcttaatcttgaatctaccgattaaccgagaaccatccaacatatatgcctgtacgtacgttcaacttttaaagagaacaagctgaaaatgtataattttacaagctacaaattaatcaagtttattagttcagtgcactatttcacaactttgtgtaaaattttgaggcctccttttgaatggagtattttagagaaatttaatttaatagtattaaaataattgcaacagaaatcctataattttctaatgtttcaaaggagcccttataccagggaacactaaagttcaagtgtcctaataataatccaacatagaattcctactctcctaataaccatacaagaagaaacaaattaactaattacccctcgaaattcctgactattccgaacttatttttatcgataggcatttctatcattctcctcgttttctctcccatattaatgaagggcatagtagactttcatcctcttgcttaatttgtctttaactaactaaaacaacagtcttttagggatggtgcggagtatgagttttgttccttcataattttctcatctttgagtggcttatgctagaacgggggcatctcctgccgatccaagagtgagtgagagagatgcatatttccatgattacaagagatcgagaagcaatccggtataggagcaagttggcacatagctatatatgcagttgtcatccaagccttctccccatctgaaatgtgatacttgcacatagtactgtagcatagagctggagtaaagaaaaagaaacaaaaattaggagcttatacaacagaaaacaaatctaggaaaaggttacttgcgtgagaaaaaggaattaatgtgtgacctctaaatttccgatgcctctaagtcccatatcgtatgtacacaaaatggacgagcatccaggcagagaacgacacattatattgtgttttgctctagctactagcttaattattggtatcttatattcttatttgttgacgatggaagagaggcgaaattaagcatcatctcatctgcagatatacacataggtagtggctcttgatggcacactgcctgacttagtgactttttccaccatgtgcaataattatgattctgaattactccctccgtacttgtaaaggaagtcgtttaggatagcgacacggtctccaaaacacaactttaacttcttgtttctataaaaatatttatttaaaagtgatatatgtatatttttatgaaagtatttttcaagacaaatctattcatataacttttaccttttcaaactcaataacttgagagttatttatgatttatattcttaaggtttgacttaaacattgtcctaaacaacttcctttacaagtatggagggagtacttccccgttgcaacaattaaacccggcttcatttctgagaataaagaccagatttgatagtagctacggagtagtaataacgacatgtaattgatgcatcaaccgattcacacggtacattaaccagtagaattttgtaaattgaaggcacagatcctcaatcactacttaaacaagaattcaccagattaactaagccagttgaactaattcaattttgccaatgcctgctaaaccgcttctgtaattttttcttatgttttaacaagacacattggctacaacattgtgtagtaattcgcattcagggccgcacatgctcgcggttacatatggagtatcaaaattcacttggcttaattactaactctgataactgtgcataaggcactgagatcggctaatcagatggcattgagatcctgagccgtcggtactaggtacctcgcagttctgggagtgaaaacgattgtgattcagtagaaagaagttcatgtccagcaggggtaagttcagacgcctaaaattgaaaactcctgatgtctctcatgcttgactctgcataaatatgaagtagcatcgatctgatcaggtacttgtcgatacatatattcttcaagagaacagagctaagagatgagagcactatattcttcggaagaaatcagatcgagctatatatatagtccctactggtactcccaattcaattaattatcacgatatatatatgcacatttatgcgattacctaatcgtacatgcagtgataatggtccttacattttaatctggtcgcatcgatttgaagatatacggacagaaacatttcctggaccaaacaaagatgtcctcaattagtagcactaatggcaacctgatctgatctgactaacttcatgaaaaagagtaaagagtaacgtgaactctatgcattttgccctagcttcttaataacttgcactccctccgttttttaatagatgacgccgttgattttttctcacatgtttgaccattcgtca

SEQ ID NO: 80048 - DNA, 6534 bp, Oryza sativa
ttgaataagacgaatggtcaaacatgtgagaaaaagtcaacggcgtcatctattaaaaaatggaggtagtaataagctaagattatcttctcttggaacgtaacgttgcaggtaactatagagagaagtagaaactagctggtcaattgctagctagcttaacatgtcaggtgcgatgccgaccaattgtcagcaaatattccggaacaagtctcagaaaagtgcacatatttgggatcgactgctcaactcactgatcccaaatgacgagtctcttccagctatatagacgatttatgtgttgttcctctacatctgaatcatatgcactggaaccagcgctgtgagaggcacggaagcagaacagtttgctcaaggattttaccgtggctcatcagatatgcagccactgaacattcatattccccttgtctctcatacctaacagtttatagcttctttgcacaggccgatcgatgtagtttaaacagccacaataatatgaatttgtctgaaactctgtagtctgtacacataaacatatggagtactatatctttatgatggcacaacgcttgctagcttgaagactaagctggtggcaaacgtcaagcctatatatttgcgactgatttgtattgattgtgcagggttattttgtaaaacattttctagtttaattattttttaattggaaatctatattcatgtacatgcacaatggattattccagcctatatatacataaagttggtgtgtaatcaaggaaagtgcattgattatttttgctagaaatttcatttgtgtgtagtaccattttttgtctatataaagccagcatgactcagactcatgactctagcctactctactgccagcgcttgctatcgtccgggtagtcttggtcttagccattttttgtgttttctttcatgtacttagagccaccagatttgttttattggaggtagatgatataattggcttgggaggcattggtaacatgagaagtattgggtagatagagagaagcctggcatcaattttattaggaaggaaatatgaacatactctctagtattgggaacataggatcaagccagcacaacaaatctgtccatgaattgctgaccatgcagtaggtaacatggaagaactatctactgcgaacaggcgaacggcgatgggtacatcttcgtcaacgatcttcagccagggaagtaaatatcacgctgaagggttaatttgatccatgtcactctaaatttgccgatttgaaaaaatgtcactattatttgtgatatcggctgagtgccattgggtacgagtccgggtcaggtaacggctaggttggcctgtggaatctttcacaactgaagatgcccgctcctgatcaagttacaagagacagagcagcgacgaccgaactattgtcataccggagggaacaaaaacggaattttgtaaaattgaaaccatgtcattgccgtcacatttttttttatcttcttccttcttctcttttcttcttctccccgtcagcaaactctttgatgcggcggcgcacaggcggcatgggcggcagtgtcgatgcccagatcgggacggactagggcagtgcacatcgagcatggtcgtcgtccggtccttaggtggatcgaggcagtgcagtatgacgacgggctcctacattcttcggaggcggtggggctggcaaggtctataacgacgcagatcaaaggctgacggggccagcaagctccatgctccgcccgctgtcttcagggccggctctacaattttgagggccctagggcaaacttgacaacatgatccttaacgctctctcccctatagagagacgtgttatatgtatattcacattttttgggttgttcagattaatgtcattttgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggggtcgggttgcgcttgccccggccccgagggccgaggcaccccgaccccttaaggaagtctgcgccacatatatgggataagtgagcacagctgtgctcacctaacagcatttattgcagtctggtcaagcgtgtcacgctgcatgcaacgcagtacagcgcgttcctttatccggtctgtgaccagtcacagaccggtcagatcacgggttaggtggcggctggcggtctgacgcacgccttgccccatcccgtcaagacgaaagcctctaggcactcgtctcaagccggagctagggtgttatctcttagagatggcacgttagccctggtcagatttataccaggcttcatcctaaccattacaggcaaggtgttacacgaagaagggcaaacatgcacgttgttaagctgacgcgtggtggacaagaatgaccggtctggcactggtcgcgtcatcgacagacagccacggtcccgcgtcatctctgtcttcgggggaggtgggggtaggtgtgggctgtcccatcagaagggctcccggacagcaaccgtgctgatctccgcccattcaagagaaaaagaacagtccagtttggaaagagaagggtgcatgtggtatccccttgaagtataaaaggaggaccttgcccatagagagggggttggttgattctttcccagattatgagcttagaacgggggagaagtcagctcacacttgtagctcattcatacgcagatccaccaaaacacaggagtagggtattacgcttctcagcggcccgaacctgtatagatcgtcggtgtctcgtgttttctggctggcatacgatatttccacatacagagagagtgagagcttgagatttcaccctaagcccccggccgaactggcaaaggggggcctgcgcggtctcccggtgaggagccacgagctccgtcatctggcgcgccaggtagggggctcagcgtgtgttttctgagctctcatactcttccgtgtgcgccaagtttcccttgttctgcctaatggccgagcaagcgaaggcgcacgacctctctccgagtgtgagcggcgacgacggggagccaaacccacgccgtcgagctcgtactcccccacctccacaccaaagtcctaagcagggggaggcgctcgagagggttgataaatccgcagcatcaccggtcgcgggtgatgcaggagaacggcgagatggggagcgacgcctcctcgtctacggcgacggcagcacgcctcagggcgcgcttcaggctgctggcgcgctcctacgtcacccgcccgtcgtccatgaccctgagtctccagctcagcgatggctggacaacgtggccaacttggtcatgacggcccagcagcgcctgggtgctggtggacggtccgccaccaccaagacctccggcgccgccaccaccggttccgtgtcatcaaggcggagggcgcggcgagcggcggcggctgcacgtcattcggctgccactccctcgtcgacaccttcgactcgggaggatcagcatggggagccggatgcccgcctcaacatcgagcgccggcgtaatagccgacgtactccccgtgcaacggagggcgcctcctcgtccagagtgtcacctcgacatggacgtgaggaccagccctccgtgcccccggctggtggtatcggctgtagagcctttgtggcgagtcttcggaatgtccgttggcccccaaggttccggcccaccatcaccgagaagtatgatgggagcgtcaaccccaccgagtttctccaggtctatacgaccgggatcgaggccgctgggggagacgacagggtcatggcgaatttctttcccatggccctgaagggacaggcgcggggttggctaatgaacttgccacccgcgtcggtccactcctgggaggatttgtgccaacagttcaccatgaactttcaaggcacatatccgcgcccaggtgaagaagcggacttacacgcggtacagcgaagggatgatgagtcacttcgctcgtatattcagcggttctgtcaagtccgcaacaccataccatgcatccctgcacacgcggtgatctacgcgttcagggggggtgtgcggcacaaccgcatgctcgaaaagattgcctccaaagagccccagactaccgcggagctttttcagcttgcggatcgagtggctcgtaaggaggaggcatggacctggaacccctccggtcccggagtggcagcttcggccgcccccggatccgctgctcagacagggcggcgggacaggaggaggaagaagaggtcggcccattccgacgacgagggtcatgtcctcgccgtcgagggcgtttcgctggccacccgaaaggggaggtctgcgagcgacagaaagaaggccggcgctccttgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaaactctcaccaatgtgggagggtccgtatcgagtgatcggcgtcccccggccgggctccgttcggctggccacgggcgacggcacagagctgcctaacccgtggaacatcaaacaccttcgtcgcttctacccctagtgggggtcgggtgtcaggtttcgggctcgggccaaccccgcacccccccgggcgtgcagggttggccgggggcttatcttttttctcttccgtatttcaacaaaagcattttcgatttcctaaaggctgtgtctgtgcttttgtttcctttttgaagaatcttgacttgaaataggtcactcgtgctcaaccttgccctcgggggctcggttcggtcagctaaaatcgccaaacggggcccagaaccgagccgtgccccggggcgtggtgaactccgagggggaatcggcaaaaacccacaatcgggtcacccataaccctcggtcaccacgttcccggcctggccagtctcgacatgtggatctccccaggcactagccccgacccgagccatttgaggactaggacctgggcacgagcccttgatcaagccaagacacagaaggaccgcggcacagaccatcctcgtctcatacacacaacaaatagaattgacatagaaatttcctctttatttggttgcagattaaattagtctatacaagaagggggcccgaaggcctcggaagaagaaagaaaaagctattcaagattggcgggggcctgggggctcactccgacgcgcccgggtcaccagccttgtcgtcgttatcgtccgcaccaccgtcgccgccctcctcgtcggagtcgagggcgaacgcgagccgaggggccgtaccctcgaagctgtgaacgatgtggtcggcggcgtcccggacctgcgcgcgtgcgccgtcctcggttccgaaagggaactcttccagcgctgcccacggggagaagtcagggtccgagaggcccccaagccgaacggcggcccaaggcccccgacggccagagttggccctccgcctgcttgtccgacggtgtcaggcgcccccgaccctcaggatagcctcggggccactgcgggaaggccgcgcctgtcgccctcttaccccgaggatatcggcgcagaagccgagggcgccccgcgctgcctctcggatgaagagcgccctggagatgcggcccctagcgaagaggatcggccccgccgaaaggtgcagcggcccgtctactttgttagtgaggccctccgggacgccaaaacccgataccctcgggcccagaagatgctatacgctattctgatggctccgagaaaagcaccatcaccatatctccaggcgaagcaaatcggctcgcccagattcgtgcgctgctcaggtaatgtggcagtcttgaagagaccgcccattatggacagccaagtcaccattaccaatgtgcatggattgagaccgttgggtattttgcccaactacggagaccggtcccacctgtcaccaggctttaggggtggcgtcacacctgaccgcttcccttgggaagggaaattgctctggcataacgccgggggctactgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggggtcgggttgcgcttgccccggccccgagggccgaggcaccccgaccccttaaggaagtctgcgccacatatatgggataagtgagcacagctgtgctcacctaacagcatttattgcagtctggtcagcgtgtcacgctgcatgcaacgcagtacagcgcgttcctttatccggtctgt

SEQ ID NO: 80049 - DNA, 11100 bp, Oryza sativa
cattatcccctctaaaccccttgaatttaatgggagaattaccatggacgattgtttttatcgtgcctcgggctccctgacaaggggcccaggacagctgggtcttgcttccctcgccacgtgctccaaactaggcttggtggacccaagccaagtcatagcacatccatcatcgtttttctcatttcttgatggtgaagtatgaaaccacctaccggtgctagcatctaactgtacatgtgtgtggccgtttagagctagcataaggtgaattactacctacctggagatttcctcccaaatggccccgttgagggtcgcttcctgcaacaccgtgtccatctcgggtcggatcgtgagcagctccagtgtatcctgccgaagccacctgttgtcagccgacgagccattctcgtcacccttcacgctggccagcctatcgtggttgagggagctcccgtggctccaccgagctgctcacctgcctgctcctgcttctgccttgttcttacagccagcgatggcgtctggggtttgagggggaggggggagggaagggggccaagcaaacggtgaaaaggcgagacagagcaacgtcaatggcatcttagagttcaaaagcgagggctgggacggtggattgggagattaggggagcgatggaggttcgaggcaacgacggcggcatcgtcaagggttaagagggggagaggacgagagtgatgctgcggggattggcaagggtggcgattgagggatggaagtatgctaggtgggaggtagaggcgatctgagacattggatctaacgtagatgggccgttggatttgacgaatgaggtgcgcaggagtgtagttagtgaactatatggtagatacctgtcgaaacaaattttcggcaatatgaaaagggggtagcgcacgagacctaaaagtggatggatgcggagacaaaggatttagacaggttcaggccctctcgatgagaggtaataccctactcctgtttggggatttgaatccaccgggtgtatattgatctgacgatcagtttgtgtcatgccccctagagggcctcctgtccaccttatataggatggggggcaggattacaagatagaaaccttaaccaatacggtatcggtttcctaaatctattttacaatattatcaaatcaggactttaggccgcttcataatataaaaggaaacgtaatacccaagtcatgatcggttaaatattccatagatataagctatcccctatgactagtcggataaccatgccgtgtgggtatggggtacccataatctccacagtagcccctgagaccttcacagtcggaaagataatcttctctcgaactagattactccaaagccgtgtgcttcaatcatcctcgccatgatctcccgagtacttttaccaaatatgaagactgtggagggctgaaaaataaagtcaggtgcatcgagtagatgtacctaatagatgcaccaactgagtggttttgataatcgtagtcaaacaagtaacttaatattaatatatagcatatgcggtatgaatccctgaataacatgatccgagtgatataccgacttatgatgcgtgcaacctaaagctgactacattattgaatacacatagcaaaacagctataaagaagcttgtatgttgtgaataaataactttccaaagtattgggcatacaccatgcgcacactgctttaacagatgtgcttgagtccctaaaagacacatggtttcactacacctgaaaatatatggcatatgtggtataaaatccgagtaaataaactcataaggatttatcaatcgtctgaaaaatgaccaaaatatataatcagcctaagccataatattggtcaataaaaatacacacttacgtggcaaaaagcaatgatgttgtatccaatcaattgcttgataaacccaaacagcgccatgactatataaaaaagtcagcggggcagctatataaagctttactgtttgacaccttttaagatgcattgtaccaactcctaaaaagttgagtaactgcggtataaaaggattttaaggtattggacactagatcacgcgcacttttgcctaagcaaaaagatgcctaagtccctaaaagaacgtgacatgccacacctgaaaatatgggctgcagacatattaggcctaggccaaaaaatatgccttcgacaccctttaaaggatgacgcatgtaacatgctcccgagtaataaatcttttcgggtgatatagaccaagtgtagctcatatgaataacttctgatctcagtgattatcctttatgggatactccaaaatagatataacaattgaattccgactggcgcaagtattcggttgataacccttacggggaataataaatagtccagtctttaagcataaaaaatagacccatgatcatcaaattcatgttgcatgtatccggaacaagtccaaattgaaggtatgacacttgtgtttgaggtagtaagcccctgagcatatagcgtgtccttttgttgtagtcacaattgtccattgatggtagctgacgcagttggcatagagacaagacgaccaatatagagagaatattgcccaccagaggtggcaaaaatattggtggtagtgaagatagtgataccaatcaaaagtgatgaagttgcacaaccgtgaaggcaaagaaaccagtcggcagcagtcaggtcagccagcaatgaagatgaaggcgcccagcgataaagttgtgtagccatggcagcgaaataatcagtcggtgacagacgatgcagttggtgaagaagatgaagatgcccattagtggcgacataataagccatccataaaggcgaggataccggtcggtggtgacgaaagcaagccgacggtgaagatgtagacacgcatcaaaggcgatgacgaaatccaccaatcatgaagatgaagaaaatagtcggcggcgacaaacgcaaccgatagtaatgatgataagcagcaatcatagatgatcaaatataatgacgaagttgcccatcaatagcagtagagtgggctatgttgaagaggctatgttgaatagggatattgatgaagatgacgatgtcgatgatccagtcaatagcagtgtagcaaccgatgataatgacgaagacgctcatcagcgtttgcatagtaggtcaaccgtgaaggcgaaataacaagtcggcaatgacggaagcaattggagacgaagacatagtcatccattagcaacagcagagatgtcagggccgatgaattagaggtgctggtgatgaagtcaatgacaataatccatcaaactgttgagaagatatcgaagctcgagtagtttccttggcgcgagagtgtgtataacgaagattgatgcaaagctccttgatttataaagatggcagtagaatttggtgttatagctgttgcagattcttcacttggaggaaagtagatgctcttgcccaactcatcaaaactgaacttattggttgataactccaaactcccgaacatgtagattaaatttcaaaattgatactggaaatatttggagtagattgtgacggcgtgaagaagccaaaattgccggtgtaataattggagtcgctgaaattaaatgacggttctgaagcgtagacgaagataataactccccgaattgactcgttgattgattgattgcttaatcttgacataaagcttgtcgaattttgatagtcttgtatttgtgtagcccccgactctttggttagttgagaaacaactgaacatagagtcgagaactgtagcttcttgtagtcgaatagtcattgcttgagtaaagatgcatgttgaagatgtccgagtagaaatattgaagattggaacaccacttgttgtaataatataacacggcatcatatttggtgacgcatgccgagatgtcgaagctcctgtagacgtcgtggttggtgaagtaggaaagcggtagtgaagacatataattgtgaagataaaagcaccagccggcggcggcataaccagtcggcgacggaagacgatgatgtccatcagtagtggtagctgtataaaccagacgtagaggcgagggcattagtcaacagcagacgagacgaccgacgataaagacgataaagccaatcaacactagcagaatcatgcagccatgaaagtgaataaaccagtcggcagcagacgtaggcagcttgtgttgaagatgctgacgcctattagcggtgacggcgatgtagccagccgtgaagaagatagcatcagttggcgtcataacaggctagccgtgcaggcggtgacaccagtcggcggcggatgaggcggccggtcagtgaagcggccggtcggtgaagacgtagacgcccaacaacggtggcataataggccagccgtgcaggcggaaacaccagtcggcggcggacgaggcggccggtcggtgaagatgtagacgcccaacaacggcggcataataggccaaccgtgcaggcggaaacaccagtcggtggcggacgaggcggccggtcggtgaagacatagaagcccaacaacggcggcataataggccagccgtgcaggcggaaacaccagtcaacggcggacgaggcggccggtcggtgaagacttagacgcccaacaacggcggcataaagcccagccgtgcaggtagaaacaccagtcagcggcggacgaggcggccggtcggtgaagacgtagacgcccaacaacggtgttgtgaccaaccaaccgtatagacgaagacaccagtcggcggcggcgacggcaagccagtggtgatgttctgactgatccattcctggggcgtaagagataagcttaaagccatgaatcccttttatgcatatctggatctggatcctgcagaacgaacatataggatgagtagtatctgatgtaaatataatacttcgagaaaaattcaagtattttaaaatatttataaatatgtatttcttctcttgtcaattttgatttcccctagcagatgactcattatgtttaaacactctgcccgactagtcatagccatcaagcaccgggagtcggcctaagcacttcccaaacatgcatatgagtgacatgagttcgtcattaatggaacaaagtttcatgggtcggagtttactactcgggtacttttgcaattattaagagcagaaaataaattatcttatctctatgcttttgatttattccgaataatacttagcaccttacgttattcggtccatccaacaagcccccaggtgctaggaatcggcccaaaggcaactatccattggcaaaccaaacggaaagcataggaagatggaactccataactcgataggcacttttgtattcagaatatgtcgcaagcaatcaagataaatattatgaaaattgtttaaaaaatatgatataacatctatagccccccgactcactagtcaacggcgaaccagttgatgtagtgaggcaaaggaaaaggcaaaatatcatataaagaataaaataaatgatgacttagctttgtcatattccccttgattatggcagaggtggccaatgtgggaacaaagtcgtccatcaataataatgaagacacccgtcggcggcgacgaaggcgatcgacggtgaaagtgtggacgcccatgaacggtggtgtggccgaccagccgtataggcgaggacaccagtcggcagcgacggaggcaggccggcggtgaagtcgtagaagcccaacaacagcggcataataggccagccgtgcaggcagaaacgctagtcggcggcggcgaaggccagccggtcggtgaagatgtggacgcccatgaacggtggtgtgaccaaccaaccgtataggcgaggacaccagtcggcggcgacggaggcaagccgccggtgaagtcgtagacgcccaacaacggcggcataataggccaaccgtgcaggcggaaacaccagtcggcggtggcaaaggccagccagtcagtgatgaagtacaagcgatgatacatgcaaagacaagaaattgcacatcaacctgtggttagatatttgtaaaaaaaaaataactgatataataatcaatagatccaaacacatggcttgattggcacttgatagagaggcctgcataaccataagcacaaaagcgcatgcacgattgcatgtggttcattggctcctcgttctgtccggcagctgccgtccctgtacaggacttgtataaccatcgacttgttcagcgagtagttcgacgtacaactgcatggtcaaaggactcggccgaatcgacgacaggaaatatatacagataatagattgatctgtaaaaaaataaataaatcaaagattaattttaataatctatgaattggaacagctaacccgatatctgaacaatttaataggggtgtgatctgcccggtcgacaatgacggatatggccgtcagtgggtatggtcgacaatccaatccagtcatcggtgttagatccattgatgagcgcgtgaggccgcaattggtggagatcatgacaccatgcgaacgtgcgacggccgtatagagtaacgtgacgtccaaaatgcatggatcaagacatgcagccggcgagttgcgcagcgacttgtgtcctgtactccgcttcagcctcgatatgatcatcaccgtgatagcatgatggcagtatgacatcaccacgcactcagcagtacatgcatgaaatcaaggagagaaaacaacgtagagtaacatgtgattagggatcaatctaaataaaattaaagtggaaagccaaaccaggtaatagttgcatagatcgatatatgtgatgatgccaaatattatggccacgagctagccggttgatcttgatctcaagcttctttatcgttccaccggtctgcatgcacactcatgattggttgccctggcaagcagtcggcggcttcacggcgtgcagcacgcacacacatcttgtgagcgagaatccagggaccagtgcatccatgcatgccaagatgatcatcagcgctgaacgtgcaaacgcccggcgacgttgctaattggatcgacattgatcttttttctttctgaagttgatttccatcgcactcgttgataggaaactcggcgtcacccctacctggcgcgccaactgtcgaaacaaattttcggcaatatgaaaagagggtagcatacgagacctaaaagtggatggatgcggagacaaaggatttagacaggttcaggccctttcgatgagaggtaataccctactcctgtttggggatttgaattcgccgggtgtatattgatctgacgatcagtttgtgtcatgccccctagagggcctcctgcccaccttatataggatggggggcaggattacaagatagaaaccttaaccaatacggtatcggtttcctaaatctattttacaatattattaaatcaggattttaggccgctccataatataaaaggaaacgtaaaacccaagtcatgatcggttacatattccatagatataagctatcccctatgactagtcggataaccatgccgtgttggtatggggtcattgtgttgttgataagcaggattcacaacatgaaggacctgtacattcaaagggtggaaatcttgtaccttcatatttttattgtgctcagatgtggagcttctgtagcaaggactgggatggccagccccagtgatatggccaaagtgatgacggccaacccaactgaaagtaacctgctgcaaaaacccaagtcagcagcacgtttttaggaggtgttgaggtgatgtcatatttttgaaacttaaagtagtgcgatctctaggaaatacaacacaactacaagatcctctttggccgaccaagagtcaatttctctaatttgaaatatatgccatcaagtcttacaatactgataattagtgggcagaattatccattagttagcaatatggtgcccaagtccaacaagatagttcccttgtcatatttcttctacgtgtactgaactgtggatttttcatgttcaataaagaataaactctgatgaacaatttcaatgtactgaaagtatcagacgtccatactcagtagagatttaggatatgtagtagatatcgtttatataggtgacagtaactgcattgtaccattagttagtcatattttttcgacatacactgatcttcagattctgctgttacactcaataaacactaatcactaatgaataatttcaatattatgcagcatcatagatatatatatatatatatatatatatatatatatatatatatatatatatatatatatatatatatatatatatatatatatatatacttcagttgaggcatcagacatgtaaatattgttcatgtagaagacaataacaatgttgtgcagctaccttactactctgatttcttcgggcatctccaatttaacaaaaacagaggcttgtgcaaaactagaaagatgtgaattactaaaagatgatgggcaattttcttttttggccaatggaatatgtcaaaagcatgtttatcccatagtaaaggtctgacgttggtacttatctctacatcataagggctaacattctgttactaactatagctctaaaagaatatcgcaaagagaaggatatccctaattctggcataagctaaaccattaaaaaccataaaagtctgattccttaaatttgcccaaaaaaaacaatagttgtttcagctccagacatgcaaagacgtgaaaagattgtctatagaataacatacaagattaacatcttttgagttaaaagatgatattaatgatccatgaccacattagaaatttctgtggagggcaacaatttgtaggtggaatccaagctcaaaggaaataatttcagaagagttagcaacaaaaaaaaaaagctatgttagctactatttggaaattaggttcatggaaagttcagtggttattcattagtcacaaatgactatatgtacctcagatgtcaggatcacgagagataagtggggcaaactgtttagaccaaaatatgcaccttcgttaattaagtcctcataataatggcacagaatgtcactgaattcttgaccgccttgcaaaatgtttgccacgctgtggaataatattatattttccagctcctctccaatggtctctgttggccaacaaaaaggttctgaactccttttcaagttttggatcagaagcaaagccattttccttcatttcatcataatactctaaagctctttgcatgcatccgtgtttgatcaaaccttgcacaactgacatatagtgtgaataagaaggtctgatgtcatatcttttcatttcattccagagcttcaaagcatgtccaggttcattcaattgaaaaaatctatcaataagcatgagaaatgtatcactcttaggaccacagccatcatccttcatttttttcaagaacttcagggtttcatcaatgttttcttgtctcagaaatgtatggtatgtcaaaatggttggaacaattcccttcagcatcatgtcctccaacaccatccgtgcttcatcaagcttgcgactttcgcaaagcggaactatcatactgttgtaagttttgacgtttggttggaggccttcatcgataattctagtgaatatattctgtacatccttcatgcaattctcttttgtcaggacatagataagagaattataaacagcaatactaggagtccaacccctctttttcatctcatcgtaaaccctcagggtatcaaaaaggtttccaacttttgcaaaacaactgaccatgagggtataagatgtgccatcaggagtaatgcagtaatttgacatttctctccaaattctctttgcttcagctatatcagtgattacattgcaccaaccatctagaataatattgaaaccttctgcagtaagtgggaagaatttctttctcacgagaagcaattcctcagcatcctctatgtttttatttttgcaaagagcacgaagaagggagtaaaatacagtttgatctgcttccgttttaaacttctccattgcatcaaatgtcttgattgctttgttcacttcattggcagctgcatacctgaaatagccatgtccttacagtgagatgaccgtcgaccattatgcaacaaataaaaacaactcaactaaaaaaaaacaaaaaaagaagtgctactacaatatggactgctgcaaagcaggcattatgatgtccccctcacagcaagacgacaaatggacccgtatatatttttcatccaatgcataagttcaacaagattaaaggagccaaatcccagaattaccactagttaaaacactaacaacacaggaaatggtaacttacggacttgcaacagctttatattcccaaacactaatccattcaataaatcgatccaaccatgaatatttgttgaccatcatagacaatagcacagttataacataatattcaagtggatcctggatccatagaagctgcttgtttgcaacagttttacttcctaatatgattgtgcaagctgataactgcttgttcaccaaatcaatatgatgtacaagtcccttgagggaggcgcacattcagtggcagtaccaatcagtaaggcggaccaaatcattcaaaatgcaggcatacatcaccataaacaagtagcaaacacataattctgacaagccaatcaacaacagttgaatactgcccaagcaatcaaatacttatgccatagcagtagcactatcacaaagctgtttcttatctcaacatggaaagctatatactcctctgtacagaaaaatggagacagattacgaagaggagagaacccacctctccatcacgatgaccatggcgcggctggtgagcaccccgcggcgcagcatgcggcgcacgaccgcccacgcgaggtcgaaccgccgcgccttccccgcggcccatatggtcaggtgccacgcctcgg

SEQ ID NO: 80050 - DNA, 12005 bp, Oryza sativa
gtgaaggttaccacataatgaatcttccatttgttatgaaggttacaacaaataaatctctcatttgttgtggatgttacaacacaatgaatctctcatttgttgtggaggttacaacacaatgaatctctcatttgttgtggaggttacaacacaatgaatttcatttgttaatggtgactttattctcatctgttacaaaacgaaagagcagcaggcaggctcggctcggtcggccgcctcgcctcgctacgcccacggccgaggccgactcggcatgcgcgcatgcgtgtggcagtccaaccatcacctcaaccggtcaacagggaatctctaatatcaccctatttaagttgaggttcttccacctaaattttcaaggcagtattattctctctaacattacttgtgggctcttgagattttagttgaattaaattgggacatatgagacaagaaagttcgcttcatttgatggcttttaacatgatttcacactttttcctatggttcgtccagatgagtacaggcctagcagtgacttccatgcatactcttttcatgtcatcctaccataccctctgatttggtcccgttagtggatacaagcctaggcgagattctcgctctcaggttcggtcctctacgagcggatacaaatcacggatacaaacataaattttgcataattcaccataaattaaacaagcacttgcttcggtcatgcttcatggcttcgagccatgctagtagtgatacaggcatagtgataaacaaaattaattgagcatactaattaattagcacgcacatttgctagttttgacatatgttcagccatatttctctaacaagaattaaaataaaatggcgtttattttctttccgtggtcagagataggaaatagatgtgcgcatgcatatattttctccttccatctattcatctacaaaatgttggataaatcacgaactacgccgagtcatgacggccggccataaaattaaccaacactcgcttcggttacacttcacggcttcgagccatgctagtagtaatacaagtggagtgaaaattataatctcaaaatcatctgcatacatatatttgcttaaaatagtgtatatatacttgttgcaccatatataaagtgcagtataaaaaataatctgatatacgcacatgcatgcatccatatactctggccgtgcattttccttccaattgcaaattaaccatgtacgcacgacaagtggcgacatcgtgatagtcgaccataaatcaaacaaatacccacttcggttacgcttgatggtataaggccatgctagtagtaatacaggtgtgccgcaccaaaatcccgtggcatgttgataataatggcgctaaaataaatactcgtttggttacgccccgcgagtgctcaggaaaattcatcaatttatatatgcgtgctacatataggaaaaaataaagtcacaatgccaaaaaaggaagctatgtataaatttgctaccatacacgcagtgatattaaaaaccaacaaattagtgggcatctaaaatacttggacgcccaaaatgaaataaacatataaatggaaatctacagaagattctacagctgcgacatctggagctttaggatagattttcctttttatccttttagcgctcatgtaattttattttctttcatgttggaattcctaatcaggggttttctctacggagatgtaattaacagaatttctatctaaatgtatgaattctggaagtaatggactcgcaatttctgatttttatttatttattgcatttaaattaaattgtctctaacgatttgcggataacggacctactataacgaccgtcccagttttcccatcgtcaattttctatatggatcatctatgtgatcctaatccatgcaagatttgggactaactatttgattgctcctgaactgatcttcagaaaatactctactgttaggtgttagattcagaaatgctgtcttttccggtttgttgaaattagttccaatttgaagaaatcatgtttgacttttagtgattgaattaatttagtggcagagaaattagaacaatagcctagttaactactttttctcaggaagtatttaggcccttcatcagtgtatttgcagaccttgctgaaacattcaggccatacctcctggaaggagaaaatgttgctgcgcagccttgctgccctcagatgttctttatacactgatgaagaacaaaaaaacatagagagcaaaaaaaaaagataaaattttgatagaattataacgttaaaactgttagatttttttcgacggataaaatataatgaatttgaggttaagattttacacgtaagtataatactattgaaagtacatgcattattttttctagattttttggtgatatttattagttggtatgtacggtgtatacaagtgagaacttgtgtggataggatatgtttccaacttgtttatgcccacatgttaatggaatagctcttcatcaatctatttatgtggacatatgttgtcttaaaatatgtattaaagtgactatatataatggtgaatgttcttaattattttttctagacaatataatatttttgcattttgtcttaaatatatttttttatatgatcgcttaattggatcgattctaagaaaatcaattttactgtcatcaaatttaatgatttattaactaaaatattatgtcatcgtagcgtagcacgggcatattactagtaggagtgtagttggtgaattatagggtaggtttgtagatgtctctctaagactgtgtttagatccaggagtgaaaagttttagcgtgtcacatcggatatacggacactaatttgaagtattaaatgtagactaataacaacacaaattatagattccacctataaactgcgacacgaatttattaagcatcattaatccattattagcaaatgtttactcagggccgtgccatcaaatttgtaggccctgtacaaggctctaagtgaggcctaaatcaagtaccaaatatagctaaaataatgtatatactgcagagcaaatgcgatatatcaacaacagtacatttttgaactcttgttttataatcagaaactgtcaaactgaaaatggagaatgttcgttgctgttgctagcttgctgcctagtgccttgcttgttggttgcttgctaagttgctatatgctagatgaatgaaaatatgaaattagatgagccggctagcggcctggcgctcagaagagacgagacgtcgagactcgagacgaactgaataagtcacagatacgaaaaagaaatacaatacaaaaagccgtgaggcctcggggctcggagtcgagaatacgaagcgccacgcatgtgaagtcgccacgcggagatatgcgcgtactcgaacggggttctggcgctctggcctcacacgaatacatgggccttctctggttgggctgattttttgaggccctggaaatttggagaccctgtacggtcacacaggtcgcacgcccttctgcatggccctgtgtttatgtgtttattgtagcacaacattgtcaaattatggactaattaggtttaaaaaattcgtctcgcaatttatacgcaaactgtgtaattaattatttgtttatctatatttaatactctatgcatatattcaaacgtttgatgtggtaggataaaaaaatttaccagggaactaaacaggccctaactctccctaccatacttgatactagtaccaaaagtcaatgtgcagtacaaccattatctgtaaaaatctagagaaagtgtagactctccctacatgtatgcagtgtagtagtactaggagagtactagctaggatgggtagatttcttcggcttctaccatagggtgtgttcgctattcatggatcccaatcggatccttccacacggaaaacggagtagttcattagcgcgtgattaattttgtattagctttttttaaaaatagattaatttgattttttaagcaacttttgtatcgaaactttttgaaaaaaaacacgccgtttagcagtttaaaaagtatgcacgcgaaaaacgagagagaggttaggaaaaggggcatccgaacactccaatagagtgtcttcgatactcacgtttgggaacggtactctctaccacggaaaacggattagtttattagcacgggattaattaagtattagctattttattaaaaaaggaacaatatgatttttaaacaacttttatatagaaatatttttaaaaaagcaccgtttagcagtttgaaaaacgtgcgtgcgaaaaacgagaaggaggggttgggaacccggaaaaaccaatgcatgtgtaagtgcctgatgatgtatccattcatcaaacaagcaagctactagtagggcctctcacagtgcaagctatgtcgcccgtacccctagcccaaaaggttggtccaaaaacacccacctcatagtgcaagcacccatatatgtatggtttaattggatgaaggcactagtaaaggtaccaagcccacagtgggtgtgaccctagacgtgttaccacacatttatttctctcaattaccctcgcctgctactcacgcgagtattcttctcctctcctcggcgcgaccgcctcctcctctctcccgcatcgccgcgcctcctcctctcctgccacgccaccgtgcctcctcgcctcccacgccacggcgcggtccacggcgccgcctcgtcgcaagaaaccacgcgcgcaccggcgagtctttcccctccctctctgtcccacgctctgcttctcctccctcacacgcgccgaggaggaagcgggcacgggagaagggcggaagcaggcggcgtccccggtgacggcggtccggagtagggcggacttcgccggcggtggtgttaacgaccaaatttgataagatatgaaccaggttcgacattggaatcgaagcagattcggcaaagagatggattcgaagaacagagtgtgcatcggttgtgaagacatcggttggggtatgcatcggctgagatggatcggttagaggatggctgatgcaaccaatagagctgatatagctgatttcgatggagatagcttcgaggctgtttctggaatcaatcgatgtgcttaacaaggattgccacaatggagataaagctctcagataggcaattgtatctattaattaggatatcttatgtaatttctttagagatatgtttgggcaaaagtctgccgcaaagacttatagtgtcttagagtttgttagagatagtagtcgtgtccggcaatgacatattttgtatctcgggtataaatatgacccgaacccatgtaatcaaacaacacatgttcaataacactttcggcgcatcgccacccttttactttcgttctattttgacgagttcttgctttcgggttgagctgcatcgattcaatcttcaactagaggtaaacttgtcatgacggtttgcgttctcaggattagtgcttccatctttataacactctaatcttgtttatgtaattttttgagttatcatatatactttataatctctattagtttcgctatataacttgtcatcggctagtttttactgttagagagtagccgatagagttagatctcattattaatctagattataccgtatatctaccatctcttataggttttcatcatcttgtttagatcttacagttatctttatgcttaatgctgcatcggttgagtttgatctattaagtttatctataattgtgatatctagcctgttttatgatcatcaatagagatagtatcagagtttcagccgatcttacctgatttagttattcttatctcatatgcttgtttgttatgctaaatctgccctttatattaagatcttgttgcattgaagttatattaggtttattatttaatatatcttgcttgtctcaaatcttgatatagagtggtatcggagtattagccgatacatggtagatctatctgatcggctatgctataaacttctatataatctttgctttaatatatatttcgacttaagtaatttatactgtcttggcatgatgaccgatctatcccaatcacttagttcaagtatataccgaagtaaagattatatgttgttaatatctacagccgattgagtagatttagttttatcatttttattcattattgccgatcgagtcaaacatgacatcggctcgaagataaatgatatgtcattggcaactagccgatcggctatcatttatggatttaaccacggtttttcttattcttgttgattgcatgatcaaatcaactggcacgctcatgaacctaaaggcgagattttggacctgcaaaggagttaagcagatcttccaggccagtgtgtgtttttcacatcaacagacgactggcgcactggcgcggcggcgggaggcgtccccggtggcggcggctggcgcggtgtggcggcgagcagccggagcgtggggctgcagttccggcgccgccacaaccggatccagcggttcagcgttcgatctggccggggtcggcaagagtggacggctcaacgccgacgggcggctggcagcaggagcggacggcttctccacctcgccgatttcccccttccttttctctaccaaattactcaagaaatattgttggtttggtccgcatctgtggtggtttccttccttttctctaccaaattactcgagaaattttgttggtttggtccgcacctgtggtggtttgggagggaatttgttgtgcgtttggggggatttcagttcgtcgatgattccgttggagggtgatttggggttttctgtaggtggattcggcgcgagggcataaggcagtgaagaaacgctgcccacagcgcgcgtgcctcgcttttccctgtccgctcgcgccctcgccgcaacaaagtttcgcatagctcaggtaggggacgagaaacctagctaagggacgggccccgtcgccacgtcgacctgaatccgagctggcgcgacgaggtcccggtccagctcaccgcactgtgagaggcctaaagagctgtctactcttgagctgtccactcttgcatcacacttgctcctcctccagtacatcctctgcttcagaacgtgctcaacaaatatttaagcaccaacatcctctagtttggaagctgtgttcggaagccttggttgagaacccaacttctatgcatggaaaacggagcattccattagcacatgattaattaagtactattagctaatttttttaaaaaaaaaatggaacaatatgatttttttaagcaactttcgtatagaaacttttttaaaaaacacaccgtttagcggtttgaaaaacctgcataccgaaaacgagagagattaatgaaccctgagttcctctcaacactcaaggctgttgttggcccgatctttcggtgagttgtgataactacgatttgggagaaacgttgacgatccgactacaaccgtacgagacgttgtgttgcgccttagcgatcgatacacctctccgtgggttgctgatcttgccggtgcagataaaccctattcctgcaagcaaatcgaagaaacaagcaagaacaagataaaagcaatctgatattgcaaataggaatttaatacaaatgataagttggggttccaaagaacaagcagacggatggtctagccgacacgcgcgctgcaagcaagtagcaatggctaaactttaatctatcaaaaacccaagaaaccctgaaggggtacctaactatttatagaggtgggaggatgaccaagagggtccaagggtcatgctccaccagattggggcgcaccccacatgggccccacatgggccagggtcccaaacaaagttacaagcccattggcccaatacaggagacgcagcaccttgcttttgtgattgcggccaaacgagatagatttccgagatgaggctggatccgttggaaggaggacttcgagagctttccatcaagtactcacgggcccaaaacggagcacgtatgtagatttggcggccgtttgaagtcagcaatgtaacacgtggccgaatcagattgcagcacatggaggacttgatcgtgctccacctggctggggcgcaccccacatgggccccacctgggccggggtcccagacgaagttacaagcccataggcccattataggtgacgcagcaccttgttgcttcaattgcggctcaataagatggaattttgcaatgaggctggatccattggaaagaggactccaagagctttccatcaagtactcacgggccgaaaacggaggtcgtatgcagattcggcagccgtttgaagtcagcagtgtaataggtggccgaatcggattccagcacttggaggacttgatcttgatatcttcttgttgattcatgatgtgagcaatggtcgtatccatagtagccatggtcacatcatcctccccttcttcacagaaaaccgtcctcggtttttccatatggtgctcttcgcgcagtccactgaaaacaacctgtttcttgcaatcaaaacaagacaaactcgagacaatatgattagcagtaacatgtctctctagcttgcatattttatccggaactacaagatgttctaaatctgaacaaatgtaaactctatacaccaaaaatattcctctatcattatattcgccaaagatatgaaaaatagcattagttggacatggcaaatcagatttagcaaataatttctccttcaaattatcgagctcacaaaaatcatcaaactgaacatagcccaaagtatttaaagaagatagcaattcgcgttcctctacttcattagcaatgtgaacaacatgcttagaatcagcacacaaagaaatagtagaactaacatgttcattcactagttgtggcatggatataagtgaaacattatcacacaactcttctttatcacaaggaacagcaagtaaatcaacttgtgacaaaggcaactcagtaattgattccactaatggttgctctactatagcatgaaaagtggacaagtgtagctcaccttgagaatactcaccttcatttctctcagcaccatttaatttaccttgcgaactttcttcagataatgtagctgcatcagccttctcctcattcgcgagtgatggaaatgacatctcaaacatatcgttcttctcattttggagacttttctgaacttcctgcaaaacatcagtgataggaggcacaagcatatcttgttgctccattggattctccaaaattttgcgctcaacaatacaagcaagcatgaacaattggcctatatgattatatgtcacattaacaagcccagcctgaatattgaaattaagccctctgaaaaatctagtcattgtgttctcattagattcttgtaaaccactataagtgatacaaattttaaaatcatgaaagtactccctaacagttttgtcaccttgttttagatgttcccatttctcaaggagagcacgtctatagtatgaaaacacaaatctttttctcatcagtattttgcattcatcccaagtttcaagcttattccccacagtatgccaccaaaaagatgcagaaccggtacacttattactagcagccttaatcatttgagcattagaaaaatcatactcatcaaattgtttttctactgctagctcccaattaatgtatgcagcggaatcatactttccatcatagactggtaacttacatgcaacttgtgcaaaattatagtcatgtacctcatatgcatcacgtgaagaagtcgtcatatctcgtcgaaggtgtagatgttgacgttgagcatgaccatcttgtttccccttgcgcaatcctgccatggttagcagcaaacaagaaacatacacaagaatatacacgctcctatcaactactaggtactggcagctcaaatctcacacacacactcaagcttttaaccaagctcttacaagatcttaccaatgcaagtggaatggtgatgtacaccgactcaaccaagcaccccaatagaggttggatatatcgatgcctcggcaaacacttgccgtacggttgcaatcaaatctgtggagctctgggtaggcttaaatatgtagcaaaggaatagcaaatgctcaaatcagagaacgcaaagttgaataattgttcaaagtcaagtaccgtgctggtcctaggctagaacgtactagagacgcgagcctagacacaaacggtaccacaaaatagcaccagaaacaactcaagcacactctgatgtatgaagttcagctcaaacaaaacaatattttctcttttctttctttcttctttcttcttttctttttttttccttttcttttctgattttttttggtgcggctttttttttcttttttttttcacctttctgccttttttttctcactttttttcttattttttttaacaaaaactgactcaaggaccttaatgtaagattacagggactcaaacataaatataaaatttatagggactcaaatgtaaaagtctaaacccaaaattaaaattatacaaaaaatggaatgctgaatttatgccggttccgtttttccaaacagatctcaaaaccgacaccaaacaaaaattcgccaaggtgtttgacacaactcggaacggtggaagagagggagggagtcggactcggccaaaggggcgagtgggactcggccaggaggtggagtggatggcagccgaatttggtgtatgggataaaaaggaaactgatttttaaccaatccaatctactatatctttccaaaacaaacttgactacttccaaaatcagatatggtaattcaccttcctcctctcgtgcacgacacaggcacggccaaaacaaacacacacaaggatcggcaaactctagatgcaactcaagaactccaaaactaaccgatagaaacttctgaaaactacaaaaatagaaccgtggcagcgagccgattccgttttcgtaggtcccgacaacaacagagacacggtggcagcgacgactgtggtacaaaacgtgaccagaactcgagactctaaacgaactagacgctaagaccagcaacacgacgtgacgatgcaacacaaaattcaacaaagcaaaaactgaaaagaacaatgcaatggcacaatatggctaggtaaatgatacgaatttttttgtatggctattttctggttataggaagataaaaactcaccgagcaacgaaagctctgataccacctgatgaaccctgagttcctctcaacactcaaggctattgttggcccgatctttcggtgagttgtgataactacgatttgggagaaacgttgacgatccgactacaaccgtacgagacgttgtgttgcgccttagcgatcgatacacctctccgtgggttgctgatcttgccggtgcagataaaccctattcctgcaagcaaatcgaagaaacaagcaagaacaagataaaagcaatctgatattgcaaataggaatttaatacaaatgataagttggggttccaaagaacaagcagacggacggtctagccgacacgcgcgctgcaagcaagtagcaatggctaaactttaatctatcaaaaacccaagaaaccctgaaggggtacctaactatttatagaggtgggaggatgaccaagagggtccaagggtcatgctccaccagattggggcgcaccccacatgggccccacatgggccagggtcccaaacaaagttacaagcccattggcccaatacaggagacgcagcaccttgcttttgtgattgcggccaaacgagatagattttcgagatgaggctggatccgttggaaggaggacttcgagagcttt

SEQ ID NO: 80051 - DNA, 9567 bp, Oryza sativa
caaagcaatttacataaaaatgtactatattatactccctcaatctacttttgatagacatatttccaaatctgaaaaatttagttttgatagacatatttcaatccaaccacctatcctcttattgactttctcggatttaatgcgtgactctctattcttctacacatgattgtctattcttctacacatgattggctacatgggcattgagaaacgtaaatattaatgaatcgcgtgtttacaaggaataactagtagaatatttaaatggataataaatagaattacttattcttaggtcattgtgaagatgaaatatgactatagtaatgaatccatatatggattatcaatcctattagtatattattcataaaaaagttatattgtcatcaaataagacatgtaatggaaaaacatgaacgatcgagatacacgttactccctccattccaaattgatctacatataggtttttttaaggttattcctaaatgatctatatatatttatgtttattcattaagtctattcgttatttgtgcattggagtaaatggacattgatgcatgcatccatgcacataagggggtgtttgggagagaggggccaccccctaagtatatataacccacatgcaatatcttgatttgttattgactaggaaatagtggggatggtgcatacattgagtttgttgctcgagtaaatatagtatgagagagttattatttttttttgttttggtgcacctataaaataatcaatttggaatggagggagtatacaatattattatttgatctctatagcttttgtaaaatgtctaagggtatggtcttcattacacggtctatattaatttaacggaacatttagtggtacgctattagtccaagcggctagtcggagcagtaggagaaggtaagctagaatctagaaacaaatattcaatatcgatcaaaattaaaacaacccaaaatcgaggtagacgaaaaaagacatgatgatcgaacctgcaggagcgccgccgccgccgccggcgtcggcggccgtgcattcccagatctcctcagcaacgggaagatgtgctccatgatctcccggcggacctccgactcgagctcccattcctccgcctcctcccgcaggatccgctccattatcttctgcttcttcgcctgccgcagctcgtcgcgaccagccgccgacggtgaagacgactgccccagcgacacggccgaatcacccccgttgtagtctcccgtgcccccgccgtctgcgccacgatgcccatcgtctgatcaagaaaggaaacgataccaaaaaaaaagacgcagatagcgagatcgatcgatcgatcgagaataattaattaagtaaccttcgttggccgggagcacacgggcggatccagagctcgccgtgggcggcggcggcgggggaggggaggaccggctgcggtcgtcgccgtcgcggtaccggaactccatggcggtgcgggtgcgggtgcgggtgcgggttctaccggggttttgcgggatgcgaagcgcgtgagcgctcggggtgcgtacttatcgtacgaggaggagtagggggatcgaaacggctcgcacgcggacgatctgatcccgttcaattccatcttactttttgggccttccctaatttcttttggaaaaaaaagtacaccgaagtttcccaactcatgtctgatgtgaccatagctactatggatacgaccattgctcacatcatgaatcaacaagaagatatcaagatcaagtcctccaagtgctggaatccgattcggccacctactacactgctgacttcaaacggctgccgaatctgcatacgacctccgttttcggcccgtgagtacttgatggaaagctcttggagtcctctttccaatggatccagcctcattgcaaaattccatcttattgagccgcaattgaagcaacaaggtgctgcgtcacctataatgggcctatgggcttgtaacttcgtctgggaccccggcccaggtggggcccatgtggggtgcgccccagccaggtggagcacgatcaagtcctccatgtgctgcaatctgattcggccacgtgttacattgctgacttcaaacggccgccaaatctacatacgtgctccgttttgggcccgtgagtacttgatggaaagctctcgaagtcctccttccaacggatccagcctcatctcggaaatctatctcgtttggccgcaatcacaaaagcaaggtgctgcgtctcctgtattgggccaatgggcttgtaactttgtttgggaccctggcccatgtggggcccatgtggggtgcgccccaatctggtggagcatgacccttggaccctcttggtcatcctcccacctctataaatagttaggtaccccttcagggtttcttgggtttttgatagattaaagtttagccattgctacttgcttgcagcgcgcgtgtcggctagaccgtccgtctgcttgttctttggaaccccaacttatcatttgtattaaattcctatttgcaatatcagattgcttttatcttgttcttgcttgtttcttcgatttgcttgcaggaatagggtttatctgcaccggcaagatcagcaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgttgagaggaactcagggttcattaatctctctcgttttcggtatgcaggtttttcaaaccgctaaacggtgtgttttttaaaaaagtttctatacgaaagttgcttaaaaaaatcatattgttccattttttttttaaaaaaattagctaatagtacttaattaatcatgtgctaatggaatgctccgttttccatgcatagaagttgggttctcaaccaaggcttccgaacacagcttccaaactagaggatgttggtgcttaaatatttgttgagcacgttctgaagcagaggatgtactggaggaggagcaagtgtgatgcaagagtggacagctcaagagtagacagctctttaggcctctcacagtgcggtgagctggaccgggacctcgtcgcgccagctcggattcaggtcgacgtggcgacggggcccgtcccttagctaggtttctcgtcccctacctgagctatgcgaaactttgttgcggcgagggcgcgagcggacagggaaaagcgaggcacgcgcgctgtgggcagcgtttcttcactgccttatgccctcgcgccgaatccacctacagaaaaccccaaatcaccctccaacggaatcatcgacgaactgaaatccccccaaacgcacaacaaattccctcccaaaccaccacaggtgcggaccaaaccaacaaaatttctcgagtaatttggtagagaaaaggaaggaaaccaccacagatgcggaccaaaccaacaatatttcttgagtaatttggtagagaaaaggaagggggaaatcggcgaggtggagaagccgtccgctcctgctgccagccgcccgtcggcgttgagccgtccactcttgccgaccccggccagatcgaacgctgaaccgctggatccggttgtggcggcgccggaactgcagccccacgctccggctgctcgccgccacaccgcgccagccgccgccaccggggacgcctcccgccgccgcgccagtgcgccagtcgtctgttgatgtgaaaaacacacactggcctggaagatctgcttaactcctttgcaggtccaaaatctcgcctttaggttcatgagcgtgccagttgatttgatcatgcaatcaacaagaataagaaaaaccgtggttaaatccataaatgatagccgatcggctagttgccaatgacatatcatttatcttcgagccgatgtcatgtttgactcgatcggcaataatgaataaaaatgataaaactaaatctactcaatcggctgtagatattaacaacatataatctttacttcggtatatacttgaactaagtgattgggatagatcggtcatcatgccaagacagtataaattacttaagtcgaaatatatattaaagcaaagattatatagaagtttatagcatagccgatcagatagatctaccatgtatcggctaatactccgataccactctatatcaagatttgagacaagcaagatatattaaataataaacctaatataacttcaatgcaacaagatcttaatataaagggcagatttagcataacaaacaagcatatgagataagaataactaaatcaggtaagatcggctgaaactctgatactatctctattgatgatcataaaacaggctagatatcacaattatagataaacttaatagatcaaactcaaccgatgcagcattaagcataaagataactgtaagatctaaacaagatgatgaaaacctataagagatggtagatatacggtataatctagattaataatgagatctaactctatcggctactctctaacagtaaaaactagccgatgacaagttatatagcgaaactaatagagattataaagtatatatgataactcaaaaaattacataaacaagattagagtgttataaagatggaagcactaatcctgagaacgcaaaccgtcatgacaagtttacctctagttgaagattgaatcgatgcagctcaacccgaaagcaagaactcgtcaaaatagaacgaaagtaaaagggtggcgatgcgccgaaagtgttattgaacatgtgttgtttgattacatgggttcgggtcatatttatacccgagatacaaaatatgtcattgccggacacgactactatctctaacaaactctaagacactataagtctttgcggcagacttttgcccaaacatatctctaaagaaattacataagatatcctaattaatagatacaattgcctatctgagagctttatctccattgtggcaatccttgttaagcacatcgattgattccagaaacagcctcgaagctatctccatcgaaatcagctatatcagctctattggttgcatcagccatcctctaaccgatccatctcagccgatgcataccccaaccgatgtcttcacaaccgatgcacactctgttcttcgaatccatctctttgccgaatctgcttcgattccaatgtcgaacctggttcatatcttatcaaatttggtcgttaacaccaccgccggcgaagtccgccctactccggaccgccgtcaccggggacgccgcctgcttccgcccttctcccgtgcccgcttcctcctcggcgcgtgtgagggaggagaagcagagcgtgggacagagagggaggggaaagactcgccggtgcgcgcgtggtttcttgcgacgaggcggcgccgtggaccgcgccgtggcgtgggaggcgaggaggcacggtggcgtggcaggagaggaggaggcgcggcgatgcgggagagaggaggaggcggtcgcgccgaggagaggagaagaatactcgcgtgagtagcaggcgagggtaattgagagaaataaatgtgtggtaacacgtctagggtcacacccactgtgggcttggtacctttactagtgccttcatccaattaaaccatacatatatgggtgcttgcactatgaggtgggtgtttttggaccaaccttttgggctaggggtacgggcgacatagcttgcactgtgagaggccctactagtagcttgcttgtttgatgaatggatacatcatcaggcacttacacatgcattggtttttccgggttcccaacccctccttctcgtttttcgcacgcacgtttttcaaactgctaaacggtgcttttttaaaaatatttctatataaaagttgtttaaaaatcatattgttccttttttaataaaatagctaatacttaattaatcccgtgctaataaactaatccgttttccgtggtagagagtaccgttcccaaacgtgagtatcgaagacactctattggagtgttcggatgccccttttcctaacctctctctcgtttttcgcgtgcatactttttaaactgctaaacggcgtgttttttttcaaaaagtttcgatacaaaagttgcttaaaaaatcaaattaatctatttttaaaaaaagctaatacaaaattaatcacgcgctaatgaactactccgttttccgtgtggaaggatccgattgggatccatgaatagcgaacacaccctatggtagaagccgaagaaatctacccatcctagctagtactctcctagtactactacactgcatacatgtagggagagtctacactttctctagatttttacagataatggttgtactgcacattgacttttggtactagtatcaagtatggtagggagagttagggcctgtttagttccctggtaaatttttttatcctaccacatcaaacgtttgaatatatgcatagagtattaaatatagataaacaaataattaattacacagtttgcgtataaattgcgagacgaattttttaaacctaattagtccataatttgacaatgttgtgctacaataaacacataaacacagggccatgcagaagggcgtgcgacctgtgtgaccgtacagggtctccaaatttccagggcctcaaaaaatcagcccaaccagagaaggcccatgtattcgtgtgaggccagagcgccagaaccccgttcgagtacgcgcatatctccgcgtggcgacttcacatgcgtggcgcttcgtattctcgactccgagccccgaggcctcacggctttttgtattgtatttctttttcgtatctgtgacttattcagttcgtctcgagtctcgacgtctcgtctcttctgagcgccaggccgctagccggctcatctaatttcatattttcattcatctagcatatagcaacttagcaagcaaccaacaagcaaggcactaggcagcaagctagcaacagcaacgaacattctccattttcagtttgacagtttctgattataaaacaagagttcaaaaatgtactgttgttgatatatcgcatttgctctgcagtatatacattattttagctatatttggtacttgatttaggcctcacttagagccttgtacagggcctacaaatttgatggcacggccctgagtaaacatttgctaataatggattaatgatgcttaataaattcgtgtcgcagtttataggtggaatctataatttgtgttgttattagtctacatttaatacttcaaattagtgtccgtatatccgatgtgacacgctaaaacttttcactcctggatctaaacacagtcttagagagacatctacaaacctaccctataattcaccaactacactcctactagtaatatgcccgtgctacgctacgatgacataatattttagttaataaatcattaaatttgatgacagtaaaattgattttcttagaatcgatccaattaagcgatcatataaaaaaatatatttaagacaaaatgcaaaaatattatattgtctagaaaaaataattaagaacattcaccattatatatagtcactttaatacatattttaagacaacatatgtccacataaatagattgatgaagagctattccattaacatgtgggcataaacaagttggaaacatatcctatccacacaagttctcacttgtatacaccgtacataccaactaataaatatcaccaaaaaatctagaaaaaataatgcatgtactttcaatagtattatacttacgtgtaaaatcttaacctcaaattcattatattttatccgtcgaaaaaaatctaacagttttaacgttataattctatcaaaattttatcttttttttttgctctctatgtttttttgttcttcatcagtgtataaagaacatctgagggcagcaaggctgcgcagcaacattttctccttccaggaggtatggcctgaatgtttcagcaaggtctgcaaatacactgatgaagggcctaaatacttcctgagaaaaagtagttaactaggctattgttctaatttctctgccactaaattaattcaatcactaaaagtcaaacatgatttcttcaaattggaactaatttcaacaaaccggaaaagacagcatttctgaatctaacacctaacagtagagtattttctgaagatcagttcaggagcaatcaaatagttagtcccaaatcttgcatggattaggatcacatagatgatccatatagaaaattgacgatgggaaaactgggacggtcgttatagtaggtccgttatccgcaaatcgttagagacaatttaatttaaatgcaataaataaataaaaatcagaaattgcgagtccattacttccagaattcatacatttagatagaaattctgttaattacatctccgtagagaaaacccctgattaggaattccaacatgaaagaaaataaaattacatgagcgctaaaaggataaaaaggaaaatctatcctaaagctccagatgtcgcagctgtagaatcttctgtagatttccatttatatgtttatttcattttgggcgtccaagtattttagatgcccactaatttgttggtttttaatatcactgcgtgtatggtagcaaatttatacatagcttccttttttggcattgtgactttattttttcctatatgtagcacgcatatataaattgatgaattttcctgagcactcgcggggcgtaaccaaacgagtatttattttagcgccattattatcaacatgccacgggattttggtgcggcacacctgtattactactagcatggccttataccatcaagcgtaaccgaagtgggtatttgtttgatttatggtcgactatcacgatgtcgccacttgtcgtgcgtacatggttaatttgcaattggaaggaaaatgcacggccagagtatatggatgcatgcatgtgcgtatatcagattattttttatactgcactttatatatggtgcaacaagtatatatacactattttaagcaaatatatgtatgcagatgattttgagattataattttcactccacttgtattactactagcatggctcgaagccgtgaagcgtaaccgaagcgagtgttggttaattttatggccggccgtcatgactcggcgtagttcgtgatttatccaacattttgtagataaacagatggaatgagaaaatatatgcatgcgtacatctatttcctatctctaaccatggaaagaaaataaacaccattttattttaattcttgttagagaaatatggctgaacatatgtcaaaactagcatatgtgcatgctaattagtatgctcaattaattttgtttatcactatgcctgtatcactactagcacggctcgaagccatgaagcatgaccgaagcaa

SEQ ID NO: 80052 - DNA, 7191 bp, Oryza sativa
cggtagggtgtttaagagagttttcactaaaatctactcagctcttatcactttcttaatctaatttgtgttttcttgactgtcacgtgcttgaagaaaaatatcatataatccatccgtttcataatgtaagactttctagcattgtccacattcatatagattttaatgaatctagacatatatgtctagattcattaaaatctatatgaatgtgggcaatattagaaagtgttacattctaaaacggaggaagtagtaatttcttatatcccactctaagtttacaagtttacaacgatacttttaatttgcaagtcattgttatcttcatcttccacctccaaaacaccactattgattgaattagtgttcattggtgaagttgttgtcatttggtgattgggttgcagaaggagtcgtataagaaatcttttaaaaaatactagaatgctaacttgaggtgatcataatcctgattgcatctcatgattttttagaaaaatatatatctaggcgaattcttacaagcgaattcttacaataaatttcactttaaaccgtataaccgttgttgcaacgggcatattttccagtaaaattaaaaaaaattcgccctactaatatcgttgttattgttatgggccgaaatccatgggctggcaaatatactcgtggagaagatcgcccaaaaataacctaaaccgagcacttgaagcgcaaaacggcaaaacccaaaactcccctgccccatcaccgccgtctgcccgtcttcatccacccaaccatggccgccgccgccgccgccgattccacttcggcggtgccacccgccgtggtgtccgccgccgaggacaccctcgcggccgccgagtccgtcggggaccacctcgccgagatggtcgcggcggcgggcgaggaccccgacgccatcgccgagctcccgccgctgcgccgcgcgcgcgcgtttctcgccatggcgaaggccgccgcctccctcttcgcaggcaggcagctctcgcggtgacccccttcccgttatgactgcgtgacccgcatcgcttctgaccaattgtttttattactattattattattgttgcagtgcggcttaggtgttcgggagttgatccggatgaacaccctatcaagaaggagtttgtaagctctctctctctatatatatatatatacacctgcctagaatcctatctacttctacattgttctcacattctatagtagtagaaattcggtttcagatttgccaataagaacaaaagtttgggtgtatccttatataggtttctaatttatgttaacaatttctaattgggaatctttgtaccatgccatactattgtaaagaggagtcatggacttattttataccctgtttttagacaaaggcaaaccaccctgctttcatcccaagcaaataacgaggttcggcacagtagcatcagagaaaaggaaaaggaaatagctggttttaccagtgccctataaatcatagtaataactagtaagttcaatcttacaactaccattatcaaagcatatcacacagttaagtcacccctacagctgtctttaaagtggtggactgaaagctcatttagccagctcgtttgctcggctcacagcagccctgattatactcgtttatattccacaataaatcagtcgatgttaatttttgaaagtagactctcaaggagggattgattggactaggatggcgcaatctttattctttaaaggtgatatctcctgattatgctctggaggccgcgaaaccaaccagccataaatatatctcactcgaaagaaaccatgtagttttgcatgccttttcgatcttgtttgtactgcatgtatgctcgctccccttgcatccttccggttcccacatgcaaaatcacatacaaaaactgtttgcaccatagctcagtggaaagatgtcgtgacggtggataccctcctgtggcatgtgcacaagaattgaaagaaatactcaaataatcagtaggataatttgggatgtatcagtctgatcgttatctcatttctaaatttgctacaatgataataaatcaaaataagtaaaacacggtgcaaaactaagaaaagtaaagttgatccaatatactccctgatctttgaactcttgtagccattattgccctttgccctttgattacttccatattattttgcctttcttgatgtagcaattacctccagttttgcgtattggaatttagaaagaatgtgtacgataagttcctgcctgaggaaaaggctgctttcaatttccatgatcccttgccttatagattgtaaaagaaacagctgcaaaagaaaatagtgtaagatgataaacagattcacccccatttttcattcacatatataaggtgctagaggtttggcatggccgtgaatcccaagcaactagtgagcatattacataaaacttacacaatagaacactaaaatagcaggcacaagagcccccaagtacagttaaccacccaatgcaccatttaatgcataatcggggtggctacctggcgcctagcacctagggccaagttttgaacacttcattcacttatacaaaagatgtcaaatagaagttgacatcctgtcccactcgagagcctctatagtaatccagacaaaggtagctaagagacaggatgacaaaatattaataccatcctccatacctgaatacagcatgcactttcctggccacaaaaggaacaaacttacttccatgggatattgctttaacaaatcccttcattcttgtgtttctcacacaccaaaccaatttttttttcagtatagccatctaggaattaattttactgatctgtccagggtgtagtgagccacatcctgttcctgatcaagctgatcaggggataacaagatgcaaaagctaacactataatatactggattttcactttgtgcacttcttcccaaacttgtgtgcctcccataggatcagtgctgaataagtttttcccttgctggtattgtgtacttccttttatcctatctaatatctgaagcaacttaactgagctaccttctataatcccatatcctgatattcatacttagtaggcacaaattgatgatcctgatatttaagactaccactctacaatcctttggcagcttgaacattaaatcatccatgctctatgctcatttcacgaattgttatccagtttttcacctgattttggctagagcttgtaggtttgtaattccactcgtttatcctaacttctaatatggttttataactttggtgttcctggggcagtaatgcagttaaagattgaagtcttggatagggaagatttgagtttattcttagttagaaattttgcatggaacaatctaaaatggaaaatccaatcaatatgttttttcaattccaatgctgatactgtcagatgtttagttccacttctgcttcatttatttcaggagaggttaagcttgtgggaggaaaagttaaatcgatttgaggactgggacaagggtacttgacaactcattaactattggtggaaatatcatatctatgcacacgtataccaaattactgcttgtgttctgaattgcagcaccattgcgcccaaccactacagtgaatacacaggcagcagcaaggttcattggtcactcattgccccatttgacaactggtacataattgtttattgaaaagttttacgaacggtttggttttttatggtgtagtgttgaggtttcatttgctatttcagatcagaagaggagcatgcaggcaatcagtagaggagaaggagggagttactctgggaacaagagaaaaccacaaccaccgcggccaaataagaagtctgttcgtgctgccacggaagaattccttgcaaaagcagctctggagcttagtgggcataatgatagcaaggtgaagggccctattaggctcctctctgatgaagatgaggactaagattgtgtattgttggttttatccagaggtattccttgctgcttccttgcattcatgatttctatatcattgcaatcaaggtctgaactggcttggataagggtccagagccctatagggcactagccctctagtagctctagcagggtctccactaagagaagctctgaggcttagggctaactttagagatttgattgattgattaataatagagtacatactaccacaccaaaggaaataatgtctaaaattgtagaaaccaacccaatctctatctctaatttactatcagagctcatttatttcctaactagataatcgcctacctttaattgatgtttttcctaatctgttatgcctaacctgctgcatgggcctggcccatgtctataacatattgctccatagtgacaatatgatgtaatcacgatacttgcaacacttaaatgcccattgtttgttggctgaaccccattgaactagccaaaaccagcagtcaagccgcggtcagactggcagatgtgagtccttttagccttttaatttggggtgcatttttagactttgtaatactagctccactttatcgctgattaggtgcttttgcctgaattttttttcctccaaatgaagttgattttggacttgagatttggtggtaatgtagttcatgcctctctagtaaatttttcatgaatttagagaacttttaggtcccgttttcatgtattttcacttatttgatggttttcaccagatatttccccgtataaccaatgggcccagttctgacttaatccattttgttattgaagggcatgtttaaaccgaatgttatcttcttgctttaataactgatcaggatttcttatgcacaactgctcaaagctaccaccaaactagttagcctcaagaatacccatatagcaccctagattagcattgagctgagtccttaaactattcctcaacacctaaaattaaaaatgttgctactaaatttgagtagaaatctccccgaaataaagcaattaatgggatagcaaatcttgataaccccatagctggtcacattacaatactataacagtaacaataaggtgccggtaataatagaaaatagaaccatgttctgcacaaaccgcaaagtacccacatgctaccaataactgaattccagctgaactgagctaaaacattaaaaatataattatgataaccaaacatgataactaaacttaatattcatggaacactgtgtgtatggtactaaccaagggcatacatacagtagtagcataatgttgcccctttgtttggcagaaattatcaaactcttctgtatttccagacttcttttaatcagggtccgcacatttcacaggtccccaaccaaataagtccatatccttccttggttcctgctactttcttgcatttatttctgctacatttcttggttttgcttctaactctaccttgaaactccacagaggatctttttcccatgtttggtgctgctcatctagtgcatatttcctccgagcctacaacccaccttttgtgtctcaagtctacattgtattgctttcaaacctctcctgcaacttcagtgctccaagagtggaatccttcattccttcctcaagatttctttccttcttttatttagatttttcctggcccttcatcttagttacttgtgcttacatctttacctgcacaagctagccattggaattagatgcaatcatcaaattaaatattgggcacaacaaaaaatgccagaacctataagtttataaactgtattcactgctagccatgcaattactccagacatacacgtcaactattctcacaatctcaatgcaaacacttctctatacattccactctactgtgtgatttcagtccctcacttctacttgataaagacgacagcatgatgcaggtagaggtttgagacaacagctcaacgtgctagggtaataatccttttatgacaggatcattgatctaactaaactgagcggatacatttcagtggctgtaactggggtgaaaaaaatgatactataactatgccactcaagatactagtactgtagaaagtttctgttaagcataatgctagagaagggcaacttgaagcaactcacatttttgttatttgacattttagacttgtcattgtcaaggctagcttgagattagtttttttttttaacacttccgataaattgtggctatccttttaaatgcctcaattgtttgtttcacttccatgcagatgaaatactagctgcctacttcaaagaatggataaagtgcggtataacttactctgcaatcaagaaaattttgcttagttgtgctgtggtgtacataccaaggcagaatgaagtagacaagctagatgtaaactgtaatagttattatctttgccttgagagcaatattgtagtcctgtctgaatgtcattttcagaaggaaattttgactgtttttagttaaagcactgaccctcgaatggcagttgagtccattgctgaagatttgatctagtggtgtttgagactgtttaacatcgccgtagcgtgaatgttgccaaagtagtctgcttgtccagttcctgtgagtgcttgtatgatgtattatatttttctttagtgaacagccttttacgtgtcacaacttttttttttgtgtgtttggcttgagcactgtcatgatcagaagacagcgtcatccgcccttggtacaggtttttttttttctcttcggtaacctattttctagggaattatttttattctttaaaccttttaaattttaaaaataaacatttccaaaacttattttcaaaatctaaatcttttggtcacgccagctgaactgtcatagcaaaacaatattgtcatataggtcttattgatgtgacagcattacttggccatgttgatctcgctagtgtgacaacgttatttggcacaccattctcgctgatgtagtatggtgtgtaaaggctcagattttgaaaataagttttgaaagggtttatttttaaataaaaaattaaaatggttaaaaaataaaaaatcttttctaggtaaggctagcgtgggattttttttattttcctggatccaataaat

SEQ ID NO: 80053 - DNA, 19104 bp, Oryza sativa
caagcactttgaacataaggcggaccatcgtacgaagcctaaacatcgcagcgggaaaatagtgtttgctatggttaaagatcttaaagtagtgtttggaaaggggcctggaagcagcctatagagagcaaagatggtcacgcggcgatgtggaaaaagaactctatattttgggagtttccctattgggaattcttggacgtccgccacgcaattgacgtgacgcatctcactaagaacctttgcgtaaaccttcttggcttcctaggtgtatatggaaagtcgaaagatacactggaagcacgtaatgttctgaagcatatggaacaacgcggcgaccttcacccggaaccaaaggagaaaggaagccattacttgagtccagccagctacactcttagcaaggcatagaaggaaagtatgtttgaatgcttagagagtataaaggtatcgtctagatactccacgaatatcaagcgaataataagcacgaaggagaagaagttcacaaacctaaagtctcatgactgtcacgtgttgatgacacaactgctaccagttgtaataaggggtatccttctagacaatgtccgggcaacaataacaaaactatgtgcattcatgaatgcaatttcgcagaaggtcatcgatccggatatattagaagcccttcagaatgatgtggtgcaattccaccttcattttttaatataatgacgcatctgctttgtcaccttgtcaaagagatcagtattctcgggcctatgtacctacagaacatgttttctttcgagaggtacatgggtgttttgaagaagtatgttcgtagccgtgctcgtccagaggcaagcttcgctaaggggtatggaacagaggaggtcatcgaattttgcgtagaatttattgaagaccttcgtccaattggggtacctgaatcgcgccatgaagggagactacggggaaagggaactctcggaaggaaagcaataatgacggtagacaacaatttattccgtaaagcctatttcacagttctgcaacaatcttcattggtagctccttacatcgaggagcacttggctctagttcgggccagaaacatcggtcagtccgatgcatggattacacggcatcacattgatactttccccgcgttgctacgacaacatctcatgggtaacgagacgatcaaccaacaactggtcttcctggcaaggggaccatctgggtcgatcgcgacattccagggatatgagatcaatgggtacacattctacacgagagcccaagacatgaagagcacgaaccaaaacagcgctgttcgtatcgatgccatgggacacgatggaacaactggcatgtattacggtgccattgaggacatatgggagcttgagtatggtcctctcaaggtccctctgttccggtgccaatgggttaggttgactggtggaggcgtaatgattgatgacagtgggatgacaacggttgaccttaacaaggttggatactcggacgaaccttttgtccttgccaatgatgtaacgcaagtcttttacgtgaaggacatgtcaagcaaaggaaagaagggcagagggcctgacgagccgaagcgtcacgtggttctctcaggcaaaagaaaaatcgtcggagttgaggacaagactgacgaggattacgatcagtttgatgggcaaccccctttcacggtgacgattgaccctagcatcctcctatcaaatgaagacaccccttactcacgtagcgatcacaaggaggaaacaatagtgaggagaaagtacgtgcggtcaaccgtcaccgccgatgtattgccgtaattattgtgtacacgatgtaaactattttggatgtattgattatccatataaatcaatttttgtatggcatatgttaactacgtacgattattagaggttttaacaattttaaatcatgtaattgctagttatatgcgataattagaatttttaaaagtcttaaatcatgcaggtggcatttacatatgatacttagagtttttaacaattttaaatcatgtatatgctagttatgtgccataattagaatttttaaaagttttaagtcatgcatgtggcatttacatatgttacttagagtttttaacagttttaaatcatgcatatgctagttatatgcgataattaggatttttaaaagttttaaatcatgcttgtggcatttacatatgttaattagaatttttaacaattaatttaatatcattcatatgctaattatatatgattattcaaatttttattaattttaaatcatgcatgtcgtatgtatttacatatgttaattagagtttttaacaattaatttaatatcattcatatgctaattatataagattattagaatttttattaattttaaatgatgcatgtcgtatgtatatacatatgttaattacaatttttaacaatttaatatcattcatatgctaagtatatatgattattagaatttttattaattttaaatcatatatttgcttattacgttttatcgacttaatttactacagacaacaataatttttcgaagtaattgtcattaatttttcgactttaaataattttaatgcattattttctattttagaaacacatatgtaatggaaattaatattcagtccgcttatcagtagtcccggttcctaaccttaaccgagtttaaaaagaatttggaaatagcaggaaaatatctttagtcccgattgatgagaacaacccggagtaaagatatctttattcccggttgttgagaacaaccgggactcttatctttagtcccggttgttctcaacaaccgggagtaaagatatttttatctttactcccggttgttctcatcaaccgggactaaagatctaggggtatatatattcccgatacgcgccctcatcttctccaccaacacttagaagttttttccccgatcgatctctctcggcttctccttcgccgccactgcctagggcatccccgcaccgacgccgccgtcgtatctcgccgtcgtctcgtgcgcgtcgtcgtcgccacctccgtcgccgcctccccctctctctctctctcttcgatctcgatctctctctctctcccgaaaccgccgccggccgcctcgttgccgacgccaccgcctacgtcgtcatggccgaacacgactccgccgcgccgacgatgccgaccccgaccttgatgcggctggcaccggcgacgctgtcgccctcgcagtgccgacgaagccgcgccacaacgccgcggcggcacgacacgctgggacgccacgacgccgccgcggcatggcaccgccgcgccgccacgccgccgccgcgcaacgccgccgccacgccgcgcgcgtcgccgtcgccgcgcaacgccgccgccgcgccacgcgccacgccgatgccgtgccgccacgccgccgccgctccactgccgccacgtgaacgaacgaacgtgaacaagaacgtgaacgtgaacgaacgaacgtgaacgtgaacgtgaacgagaacgtgaacgagaacgtgaatgaacgaacgaacgtgaacgaacgaacgtgaacgttaatgaacgtgaacttaacgttgtatttgaacgtacgtaaacaaacgaacgtgcgtgaacgaaaagtgaacttaacaagaacgcgaacattacttaacgtacgttaacgtggacgcacgtgaacgaacgaacgtaggtgaatgatatacgtgaacttaacaagaacgcgaacgtgaacgatcgtgaacgaaacgtgaacttaacgagaatgcgaacgtgaaatacaatatatgttacttcgcgtttatcctaatacatctttttgtatgttgcagaaaagacgttgtcgtcgtcgtccctcaagccggagtggtagctagccctcgaaggaattcgcgcaggcaagtgatgtaaatatatgattgttagatttttaatgcaattaagactattagatttaatatacgacacttagacttagcattataattagagttttaatacaatattatttgagttttaatataagattattagatttgtaattagacttagcatataagattatgtagggttctaatatatgactatttgagttttagtataagattatttgagttttaatataagattattatatttgtaattagacttagtatataattattgactagttagggtcctaatatacgtcacttaggcttggcatagttgactattacagttttaatacaatatttgagttttcgtataagattattatagttttaatataagattattagatttgtaattagacttagcatatacgacagttagacttagcatatatgacttagcatatatgattgttagcatataagattgttaaagcaaaaatgtctcatgacttagcaactatttcttgtatgaacagatggctgaccacgatgaggaatagatattgtacgatacaatcgcggagggaagcagctagtactggaacgaagaagaggggaacgaggatccaaaccagtacttgaacgaggaagggaacatggagagggatgcggaggggaaccaggaggggcacatggagagggatgtggaggggaaccaggaggaggaggctagtggaagtcaaccctccgctggatagaagaggacacgtgggcaacgaggtgccgtgaagaagcttgagggttggcacatcataacggaagtggacgaagacgaccgacctagtgtcccggcggaagcagccaagaactacgtacgtcacagcagttgggttatgcgggataacatgcctgtcagtacggtgtactggcgcagaacaaggacacgcagagatcatgagagctttgtcccagattcggagaaagagatgctatggaccacaatgctcgagacattcacccttcccatgggtacagaggacaaagtgaaaaggtggactctaaagaaaatgacagaacagtttcagagcttcaagggagatctataccagaaatacatcctgaaggggcagacaccgaacttcgacacattcccaaagctaagggatcactgggacgagttcgttgcatataagataggtcaacaagggcaggcgatcatggaaagaaacaaagaaaataccaccaagaagaagtaccatcaccacttggggtcaggcggctatagcgtcgcgatgccgaagtgggaggagatgaaggcaagcttgcttgagaggggtatcgaaccggctaccgctaattggccagatcgatcgaagttttggtactatgctcacggtggaacactcaacccagttgatggctccttggtcttcagcgatcagatacgcgaggctgcgcatcgactaacggacgcagtggaagcctcttctcagggcatgttccgacccgacagagagaaggacgagctgtcactcgccctgcagactccagagcatccaggacgaacacgagggaaaggggtgattccttggaagattgggttcaaggaggacatccacacgtacaggagtcagatgaggagcaagagagataccgaggcgaagattgcagatcttgagtacagggtatcgagctacgagctcagcatgcaagaggaggtggcaagtaaggttgatgaacgcatggccgcacatcggtcccatgatccccagccgaccattcctcctgcaatgatgagcccttcaggaaatcgtagcagctgcgcctcaacagggcaggtaggatcacaaagcatggacgccatgcaaacccaggacgaaaccacctgccccgttgatgacatcactcagcggacaccatgtgagctgcatattccctttaagaacttatcaataaaggtaggctcataatttatatatttttgatttgtccattccgcaagttgctgcttatatatgttgattactaataaataacctctcaccacgtgaaggtggcgtcgggcatggccatcccaacagacccttcaggtacttaccactgcaggccgattctagcaggatactccaaggtcgaagttgagttggtcgaaggtgcgtacgaggacctcgagttggattaccctagaggagacggcgagacgcatctacgagacacaagccacgccattatactatggcgcaagcggtacatcatcctccctaggcgacaagcggcgtctcgtgcaccatctcctccggctctgccatctcctcctcaggctcttgcaccgtctcctcctcatgctcctgcaccgtctccacctcaggctcctgcaccgactcctcctcaggttcctgcaccgactcctccttaagctcctacaccaactcctccgcatgctcctcgtccggcaccttccaagtcaagggccccccaagctccaccgcctgcccccacaagggcaacgaagaaggcgaaagttgacaccgccaagaacaaggacccggggtacgattgtacgcaagaggagcttgacgcttatgtggcattagaagtcaggagacaattgaagcctcgaagtccagaaaagaagattcctatagacccgagtgtcatgaacttcttcagggatatgtctgcacctgccaaggaggccataaagctatcggactatgagcgaacactcaagaaagcatcttctagaaagtccaaaccagtccctcagcttggagagcaaccaaatcaggagatcgagccgttggtgaccggtgaagattttggaatacaagaatttattaatgacactaggctaactacggatcaatttctacgaggcgcaccaatcgaaaaggcggaagtgaaatacatgtacgaactcggtaaattgcttatcaagcctgagcagctgcagtctctacccacacaaatgtacaagttccatcaactgtacatggagatgagcgccaccggtagagagatgatcggagcaaggatcagggacacggacttcacatatatttttgaataagatgaacggtcaaacatgtttaaaaaagtcaacgacgtcacatatttagggacgaagggagtatttcggtatgggccacgtgatctcatcggcaacaagagccatcatcaagtcaacagcatcaaatatttagggacggagggagtatttcggtatgggccacgtgatctcgtcagcagcgagagccatcatctcattgttgcgcccccaatcctttttcctcttctcatcgtttaattaactggtggtaagagctataatgggtttgccttatgtatacacaaatgaatagagagcctagctaacaacaaaatgttaataggtaaaaatcgaatgctaaaaaatagatatgtaacttcagtgaatgtctacttactatgataaacacaccttaaaaaatagggaacaatcgcaaaaagtttactttagtcgtggaagttatacaactaatttaaggcttcagttgtaaaaactgcataacaaatttaggattataatcattgtttgttatacgataaatttataaagcttctgttgtaaaaattgtatgataaatttaggattataatcattattaatggcatatattctaataagtgcgaacatgttatagtttatttataataactagcaatgatgcccgtgcgttgcaacgggtaaaggtaattttaatcatgtatactggtgggaaaaaaaataaaggaatcataataataataataatattaatgaaataaaattgcagtgacctttggtcaaaaagataaaaatatataattaattttccattaattccattagctaaaaataatataatacgaagtaggaaagttattctcaaattttagcaattttcaaaaagcttaaatagagcaaactaattatataaatgaaaacaaatttaatcacctaaataaaacaattagacctgtaattgaaaatctgttgtcagttcagttaaacatgagcctgcgggtgtgtatggtatatatctctcactcgtatgtcgtggtctttttttttgacatagaaaaaatgcccatgggttgcgacgggtaattaaaattataacaaatataaaaatattatatgattaaggtttagttttacatgatatgaggtctttaagaaaatatatttataatgaaataaaaaagttcagctgaagtgacctaaagtgaacttgttccatacggagcgtacacatggtcaatgaggcggcccaatagtgtgggcggcctaggaatagaatcggggaggaacaacttaagcgacctaaagtgaacttattccgtgtgggcggcctaggaatggcgttcggcctgacgtgggagaagccagagctgtctgatctgatagacggtcatcccgacctatataaaagttcaacagcccaaaccctaaccctaaaatcatttcccctcccccctctctctcaaaacaatgtggcggcggcccgacataccgacatccctgcgacggcggtggcggttcagcagcgacggcgacaccctccccttccggcgtcagcgttttcttagtgttcttgaatctgatattgtattcttgcagtagtgttttctttagaatttaagtccaaatttgatgcggtctctcattttttttctttcttttctttttttattttttgccatcggaaagggattaaagcgggatcaatcgcacgtgcgatagcatttctataacccataagccatacaaatttttttaattaggtatatgtagatattgaatcggactttcctttttttttcatttttttgcccttttttggttactacggatgtcagaaacatctttaattttttttaccacgtcacgtataatcagattcgatttttttcgccgatttctttttcacgctttttttcacggatggacaacggaaacactttttaatttttaagtagtagagatagagatagacatacacatagagatagagaaagagaaacggaaaacttttttcgcaacttttttttttggaatcggacagaaaaaaattttacgcttgttttttaccgcgtcgatggaatcggattcgatttgtttttttaccacgccgtgtcacatataataggattcgattttctttggaatcggacatatacttttttctttttggcccatttctttaccgcgtcgacggagtcggattcgtttattttttttccttttttcatccttatttaccgtgtagaactagtcagattagtttcttttttttcctttatttcgcccctaatcggacttattttttttctttttttttccggtttttttcccttctttcgcccgttttgatcggactttgtttttttttcacacggtttttttcgtccgcggattttttttgtttcgtccttttttttatcggacatagttttttcacccggtttttttcgcacggtttttttctcccacggttttttgacggacgatggaagcacctcttattttttaagtatatatataataataaatagagatagagatagagatagagatagagaattgttacttcatttttaaaataccgtacacttcgtcctggtgtgatgatctgtcgtagctaaattttagtgctgggtctgccagtgaagatctggaatgccaaaatcaaatattacccgacagatttgtcgaactgaaaaatagggcatgaaatctttatggcaacttgaaaattttgatcgatgaccaaacttacgtggcaacctaaaaaaatgtatgatcgatgtatgctttcattgtttctttttcattacatggaaatcttacaaaaatgtatgatcgatgtatggtttaatgaattcttttttttattgttggtatgattttaattcgatcatccacatattttggttgtttgattcagattataaaatattatcgtagtgttagtacgggcatgccactagtactacttaagtatcaaacatcagtgcccctccacggtagggcattttttttctaaaataactcaaaattattggactgttagtccaatctaccctatatttgaaccaacaccgactggggtatttcctcgcaaaaaaagaaacaccaactggtgtattaattaatcaatttttgttagggccaaacgtttctgctgggcttcatctggatatatacgtgtattttttggggattaattcgtacacgatctactgctgttgtatcaggtgacccgtatctaggggtgaaaacggtacggaaacggacggaaacaatctttatcgttttcgtttccatatttttttcggaattggaattggaatcggaaaccccggaaacgaaaacggaaacgaatattatcgaaaccgaaaacggagtgaaaacgaaccggtgcggatacggtaacgaaaatttattggaataaaaaacccctcaaactgagcttcaaacttttgtcaagtccaattctaagtctcaacaaacaacaattcatcatacaacccaattatatgaaatcgtcttaacagcaaaatatattcttctataccttcatataatttgcataacaaatattttaaaaaaattacagcaaaacagaacagcaatatattcttctataccttcatataatttgcataacacccttgtataagatatatagtatacactattattcagtgctatactgctaatctgctatgagctatcactccatcatcagtacatagttcatcaattgtttcggtcatcacagaacagcaacacacatcaatccatcagtacagtacttggatcaatcacaaaacagctacttacatttgatgattccatcataaatctgcagcacaaaagaaatcaaatcaatggtttatgatcgtcggctcgtcgctgggctgctggctgctgccgctgggctgttggctattgccgctgggctgctgctgctgctgcgactgcgaggcgaggcgtcgtcggctccttggtgtggctgtggcgtcgtcgtcagtagtggtagtggcggtgaaacggcgggacggcgccgcggccgcgaaacggcactgcgaaacggcgggacagcgtcgcgagatggcggcggtacgagacggcgaagacggtgggggcgaggtcgcgaggagccgaggacggtggaccagcggtggcgcgggcgccgggcggtgggcgctagcggtgggtggagcgcgatgctccaccgccggcttgcggtctcgcaaagtcgcgatgccgtgtggctgtctctctcctgtagggttagccgctatttggatagatgccgcgatttgggttgggcttaaaacttggggacgagttatagactattgattctatgggtctttttaacttcggaaattccgataatttttccggaatttttccgattcgattccgtttccgagaaaatatttccgttttcaattccgtttccgagacattccgaaaaaattccgaccggctgattccgtttccgaaaacaggcccagaatccggaaagtttccgtaccgttttcacccctacccgtatcggatatttaacagatcaatcactgttatatccagattaattccacgacgacccaccatacatacgtgccgcgcgccgccggccggcgcgcatgggcaaactaagacgcgtcggcggcgagggaaacgacctaatcagcgagctcaacgatgacgtcctcgactccctacccaccatggccgacgtcgtgcgcgcgggcgcggcgtcgcggcggtggcgccacctctcgacgcgcgttccttccctgcgcttcggcttcaccgaggacggcgtcgacgcgaagccgaagcggcgcgagaaattcgaccggttcgtcgccttcgtgaaccacgtcctcgacgcgcgcgccgccagcgccggcatcgagcagctggcgatctccatccaactgtatgaccgcggcgccgcgcatgccgtcgccgcgtggattcggtacgccatgcggcagcggcacgcggtgaaatctctcgctctggatcttcacctgccggaggatcccaggttcgcggacgataacaccatagatctggacgatctttcgatggtttccaggagactggagaccatgacgctgtcgttagcctatgtaagtctccggctccccgctgctgccaccgccaccgccgtggtgttcgactctcttgtggacctttcgttcaaggggatacggctcgtcggcgccggagccggagccgatagcagccgcctactcagccggctcgtgttgtccgcggctccggaagctacggctggtgagcgtagtcgggctgagatcgagcgctgtggctcgacgccgacgttcgctgcaacagttccctaggaaccgggcgtttggtgtgcttgagctcaacacgccgaatcttcgctccctcaagatgtgctgttacgcccctggaacattgagaatctcggcgccgaggctggaggagttgagatcctccaacaacgtgatagacatgaggtggcaatgcgtagagcaactcgacgttggtgacctgtcgtgcgtgcggggactcagggagatcgacctgagctctcgtgggcaccccgtccgcgacgccggcattaacgatggccccattcatctcctgcggcgttgtactgccatcgaaagtcttggtgttcgccttgtttctccagataaggtgtactccctccgtcctaaaataaaccgattcctaggacggagtggttgtcccccaaaaaatcgattcttacccagaaaacgagacacatttaatatcttgcgtggtcatgggtggtccagaaggagccagaccatcgcagcttttcctttctctctgttcagacggtaacctttcctctcccaatctccctcttttcgcttctctctccctctgcctctgtcatcctcccactcaatctctcactccagctccaccctctttccgctcctatctgcagggacagcggcaaaagccgcggcgacggatgcggcggcgacgacgcgcggcgacggatgcggcagcgacggcgtgcggcggcacatggatgcagcggcgacgacggcggtgatggatggatgcggcggtgacggcggcggcggcggcgatggatggatgcgcgacggatggatgcggcggcggcggcggatgtaggatcccgattttatttttttttcctctctattcctagttcttctttgtttttcttcttgctattttttttcctctattcctggttcttctttgttcttgctattgttcttatatgtgaattcaaaccatttctttttcttagattagagagatgttccttccttgcggcaatgcatttcgttttttcttctcctctgagtactactccttcttctctaaagtactagtagtaaattaatgtgactgcagagattgggattgttgatggatgtagttaatgagggtacttcggtaatttcacatgaatcctaaactagccttggggatccaggaatcgattttatttgagacagagtgagtatatatgtgcacactccttggtttttattcccatatgttaataactagctaggttgcctgtgcaattacgcggctagcatccaaacaaaatcatatattttttaagtttgattttacttaaaatttattaaatagctatctcattgtcttaagactttgaaagaccaaaccttatcatccagtgtttctaattatatagttttttaaagtcacatcagttgctaccccttatgtcatcttctactttatttgcttggtcgatctaccactatttctattcattctccttggaacctttaaaaattagatattatagtttttagagtttattgtaacgttgggtttcatttttataatttctagacgtctcgtcaaacgttgccattatactcctctatggcatgtccactgtctcttctctttaatgtcattgagattttaaaaatctaacataattatcgtttgggttcatttttactttcacaagtcctgccaaactcgctcgctgcctcccttctttattgtcattgagattttaaaatcgaacataattatcatttttattactttttagaagtttcgaacctttaaaaattggaccttgtagtttttagagtttattgtcttgttgagtttcattttttttataatttttagaagccttgtcaaacgatgccattatgctcctttacggcccgtccaccgcctactctttattgtcatcgtgattctaaaaatcaaacataactatcgttggaattcattttttattttctagaagtccagtcaaccatcggtggctctgcaactatactcctatacaccccgcccggtgcttctcctttttattgtcattgagagtttaaaaatcgaatatgattatcaatgcggtttattttttttactttctataagtcccagtaaccgtcttgctcatttgcttcacagcttgcttgtcgtccctccttttaattgtcgttaggattatatttggtgttttattaacagtttttatatgtcatatcaaccgccaccactctactcctttataggcatgttacttaatttatctcgtcatatgttttagatggtcttttctttcaatagtctttatttttatcacaaattttagttatttataaattgtattcttaattgaaatcttatttttctttttctaatttcataatttatttttcttcaaattttaattaatattgtattgtgttcttttaatatttttactttttatttttaatttcagttgtttcaaaattttattcctacttgaactccctattaagttttttaattttggatattatattattttttatgaatagtaattcatctcatattgggttcttatatggattcttctttcaatattgcttatttttaattccgaatttctgctaattttaaattctattcctacttgaactcttcttttattttttttcgctaattttggattttattttttattcctaattttaattaatctcgtattgggttcttatatggactcttcttttaatatttcatatttttaatttcgtatttcagctattttaaaattgtatttctacttggactatccttttcttttctaattttagattttattttatttttatttcgaattttgattaatctcatattgggttcttatatggaaacgtctttcaatattgcttatttttaatttcgaattttagctatttttaaattatatttctaatttgactctcctttttttttctaattttggattttattttgaatttcgattaatctcattcaatattgcttatttttaattccgaatttcagctatttttggattgtatttctattttaactctcatttttttttctttttctctgattaatgtgagaatttctagcccccacagcgaacgtggtgcctcctttcaaagctattttaacaatataaacatagatgcgagttatatccctcctatatgtatattatgagtacctttacgggggagtattttaactaacaatattgtcactagtagtagtcgtaatcttaagggttgatttatgagtagtacaactatatatctatagaaaaaaaatattttttactatgaatagttaacttgttgtggtagtataaataggaatgatcaattggattagaaaagactgtgaatggtataaaggggtacttatattataatgaccattgtaaaaaggggtacttatatattataatatatatccaagctataaactgtacatgcatatttttctatataggccgtgtttagttcgtgtaccaaaatttttttaaagtacacggacacacatttgatgtattaaacgtagactaataacaaaacaaattacagattccgtctgtaaactgcgagacgaatttattaagcctaattaattcatcattagcaaatgcttactataacatcacattatcaaatcatggcataattaggctcaaaagattcgtctcgcaatttacatgcaaactgtgcaattggtttttctctttttcccatttaatgccccatgcatctgtccaaacatgatgtgatgtttttggccaaaattttttggaatctaaacaaggccatatatatctttttcgaatgacattgattatcctctgtgcaggaatacgtagttatctgggatgcagaggcagaggaattgatagatgaagaggaagagaaagaagaggttgatgacatgatgaaagatgtaccacatttgcccggagtcacatctttgacaataagggattctaccctaaacgaacgtgctcttatgactggcgtaacatgtctccttgcacgatgtaactctctcagatactttcagctcaacatgaccagcccgattatggtgagttcctcttgcattctcgcattgatcgttgcgtccatttcgctcgcttagctttcttttcaggtttttaagtactgtgatgtgttaactgacaacaaaataatattagaagttatagaagttatggtatcacaacctcttagacgacagtagaaaaaaaaactttactgcatgactactctctctctgcttccataatttaacgttttggcattgtctccgaaaacatatctttgattttctattgtaacacatctataaaaagtaagtaaatatttatcttttaaaagtactttttataagactaatctgtacatcgtggtatggtgtctttaaactaaatgttctaaaagttactattaacagtcaaaatattatttcctctatcttaaaatatagttttatactgtttatgttcatgtccaatatttgatcgttcgttttatttgaagtttttttatgattagtatttttattgttattagatgataaaacatgaatattactttatgtctgactaattttttttcatatatttttcaaataagacggacgatcaaacgttgaacacgaatacctacggctacacctattttgagacggaggtagtaattgtttaataccttgtctaaacttcaagaatcatgaaacggacactataaccagagtagtacaattatttagtttcttgtctccagacatgctaagatttgctgctcctttatttaattgcatttgcacaggattccaccattgctgctggtaatcaagctagcatcatctcgcttccacatctcacggaagttgagataagtggcttccgaggacggaagtgcgaagcccgcttgatggaacggctgcatgcaagcgccactgctctcaacaagatcacattacgtttcgactggctgtttacagtagaaagtagcagagaggaacgcataaattcgctgcccctaatccctttcggtgaggttggcaagtaggcggcggcttctggtgattttgagacgttcatgtggcgcccctgcgtgaacaagacagaattctgtggtgagaggaagcaaatgtgagactaaagggagtaataaaccatggaagcgtggctagaaaatatttattggggcaggagaaattatgtcatgacatagtagtacttgaactaattaagtaccttttattgaaaaatatgaacattatcttatatatgatattcctatagcaatattataggattattataccatgaaattcatatatttgtataattttctgaggtagttctaggtttctttgattttttttccagttctccaagtacattcatatactttcaaccaaaacatgcgtatatatgaagatatacagttttgttttggatgaactccggttagaatgctctctgctaaaatcgaaagtgagatgctttgtttgaaatcggtattgatctcttggattttctatgagctttcctaagagagaatttgttttaactgtggctagaccatgatgtggaccagagtcttggaggtgtgactttgatcacaattttatattataaaaagattattaaatctaacaagttcatagattacaaaagtacttttcatacaaatctatgagacacaaatctacactttcgccaaagcgattttcgcacaacggcgaagagggaacccccctataaagatttggctaggggcgagttgaggtcatgttcgtttcgcgtggggtgtaaaaaaaaggaatacaataaggacacaagaagtatacaggttcaggctgctcagaagtgtaccctactcctgtgtttggtactatgtggatacgagagtgcacaatacaaacttgctcactgaactaggcactagtggagaaaggggctttaatcccggttgggaacccccctatagtcccggttatgcaaccgggactacgaatccgggactaaagatgcctatctttaatcccgtgtgaaataaccgggactaaaaatccatctttaataaccggggctaaagagggtgggagcagtcccggttgatttttttttctcaaatcgatctgctctctaaatatccccgatcatattcccaaatcatcctcaaataaaagtagcatcacagatctggaaagaaatacatcacatattggaaagaaatgcatcacagatcacaatacatcacatcacaaaatctccaacaaaaaatacatcacagatcctaaaagaaatacatcacatctctcagatcagatccaacatcacatacatcacacagatcaaatccaatgaatcacaaattaaaaaaaaaatcggcagcagagaggaaggcgccaccggcctcccgaccaccgtcctcgcggcctccacgccagctcggccggccggctgccgcgccagcccgcgcggcgcccgctcgcccgcccgaccaccgcacccgcccgcctgcccgcccggccgcctcgcccgctcgccgcacccagacggccggccgccgccgctcccgccgggtgccgctgctcctgcccggccgccgctcagagaggggaaggggaggaacgggaggggaaaggggagaggaaggggatgaagggggagaggaagggatggaggagtaatgagaggggaggagatcgagaggagtgcgcgcggataatatctgagttggtggcgcgcggtcggggtactctttactcccgg

SEQ ID NO: 80054 - DNA, 35260 bp, Oryza sativa
actctccttcctctcttcctctctttctatcttcactctctctgtgtcacggtgacggggagtgcgagcggcgcgtgggggcggactggcggtgtgcggcggcgcgagcggcagagacggcggtggaatggcggcgagcggcgcgcgggggcggacgggcggtgggcggtggcgtgagcggcgcgcgggggcggactggcagcgagcggcggcgcgagcgaggcacgggggcggactggcggtgatcggcggcgcgagcggcgcgcgggggcggactggcggcgagcggcagcgcgagcggcgcgcggggtcggactagcttctcccctccgccgcctcctctcctagcctcccttccgccgccgccgccgcctccacgctgccatctgccgtcgagagccccggttctccacccacgcggcgacgatggcgggcgttctgcgcggccacaacgacatggtcatggcaatcgcggcgccgatcgacatctcgcccctcatcgtctcctcctcccgcgacaagtcgctgctggtgtgggacatcaccaacctgtccagctgctcgtgcccgccgccgcagctcgcgccgtcgcccaccgcccgtccgccccctcgcgccgctcgccgccggccaccgccgtccaccgccgctcgcgccgccgctcgcagccagtccgcccccgcgcgccgctcgtcgctagcccaccaccgtcctccgccgctcgcgccgttacccaccgccagtccgcccccacgcgccgctcgccgccagcccaccgccgtccaccgccgctggcgccgccgctcgcagccagttcgcccccgcgcgccgctcaccgccagcccaccgccgtcctccgccgctcgcgccgccgcccaccgccagtccggccccgcgcgccgctcgccgccagcccaccgccagtccgcccccacgcgccgctcgcgctccccgtcaccgtgcagagagagagagtgaagatagagagagagaggaagagaggaaggagaggtatgacaggtgggtcccacaattttttagaaagaaaatgctgaccagattgccacgcgtacaccacgtaggacaaaaccgctctgaattagattgagagggtaattcgtccggtattgaaagttcagggtgagcaatgactggttttcgggtttagggggtaattcggctgaccgcaattgttcagggggtaattcgtactatttccaaaatttaaatacgatcttgtattgtttatggagtgatttatcatatattaatatatcttttttttaaactgtttggataacatataacgagagaattttcttttcgagagtttaaaatagtttcgtgatgattccttgatcgtctcatgttaagatgactaatgtgatcgtttagttccggtgatataggctgtgtttagatcaggggtgtaaagttttggcgtgtcacatcggatatacggacatatatttaaagtattaaacataaactaataataaaacaaattacataatctgcctgtaaattgtgagacaaatttattaagcctaattaatccgtcattagcaaatgtttaatgtagcaccatattgttagataatggagcaattaggcttaaaatattcgtctctcaatttacacggcaatctatataattagttatcttttccatttatatttaatactccatgcatgtgtccaacattcgatgtgacagggtgaaaaattttgctagagatctaaggcccaaactttttcttcaaacttccaactttttcatcacatcaaaactttcatacacacacaaacttccaacttttccatcacatcgttctaatttcaaccaaacttttaattttggtacgaactaagcacaccctaaacagagccatactgtttgtcttgttgggatggatttctggccatctgcgatagtctggacgtgtggcggcgcactaggccatttggttggggataatgccggtggaagtaaattacttgtttctaattgtgagatgtctgtcaatcgaaagtgctcgttttaaattgtgtttgtggatattgttccatgattcactattatgtgctactaaggccctgtttagttaccacgcaaaatttttttatcatgtcacatcgaatgtttagacacatgtataaagtattaaatatagaaaaaaatagttacacagattgcatgtaaattacaagaagaatcttttaagcctaattgcacaatgatttaacaatgtggtgttacagttaacatttgctaatgacggattaattaggcttaataaatttgtctcgcagtttacaggcggaatctctattttgttttgttattagactacgtttaatacttcaaatgtgtatccgtatatctgatgtgacacttttaccctggatctaaacacagcctacatgagtcgataaaatctgcacattctccattcatcgtcgaataattcattgatggcgatgtcttaagataatcgtcaaatgattatgccgtccaatacggtttctcagtactaaaataaatcaatccaaaattattctaattgtatatcacatcttacctttgattaatttattataggaatgaggctcactgacttataggccccacagaccctcaaacccatataatagcgagcagtactgcagagaggatcaggattgaaactagaattgcatctaccactgattccagcaacacgagaggaacagcatgatagtaggtgacatgagtcttcaattgcaataatctcttgcccgaaatcatggcgacaagatgagacaaacttgtagaagcagccataaatcataatgccaccacatgcgaacccatcagcagagaaccagtattcctggggttagaatcctgctgaactacactacctaaacatcagttttaaccagcaccacagttgtactgctgcatcttactgtaatactaattcttaatgaaagaccaggaaaaagaacacatatggctgccagaactagcatggcattgcatcacagtagccaattagccactaccagaaatataaaacatcactatggagtgaacatatatgctgacattactatagtaatattcacacatggatataatctacaatggtgatgggttccatgacttccattctattccctagtgtctacataaaacaagattgagctcaagaatgaattacagctctacaagaatataaacatatgcagctgcagcacctactacaaggcatcagacagcatttgtattaattattcatttgctcaaatactattagccctagagtagttgttgagatggcattcacgctaacaaaacagacaagtgattgattatacacgactacgatctcaacaagtgccaggagcattacacccatccaccgattcctcttaaggattcttttacaactcgaggaacagggatgaacgaaattcagttcctcttcccaactatctcaacactgttattattaacctatactctgagagctaactgatcctgccatgatatcttcctcttcccagctcgggaggaggcggcgttccggacatcccagaatgccgccattttcgcatcactaggaccggcggcaaaatcaccctccattgggtacctcatgaccctgccaaccctaacaggttcctggtaaccatgaagctcctccatctcttctgaactctggaaagagcaaattcaaccacattcagatgataatttcttcagataacggaacttaaccgagttcgccccaaatattaccggctcgcaggcctcgttgaggtcaatcaccggagatgctcttggagcagcattcagcctccggtgcgccgatgggcctttgctagagcttccgatagcccgaaccgtgtggtactcttcaccatgagaccaaccaggttgccgcaatgtgggcggcaatgccggattctttactctatagacaaacgtctgggatggattttcggacatggatttgtaccttttccgcaaaaacctacagcgcggcacaattatgcgcaggataatgagacaatatcaacatgtttgcattgtcgtagagcataatcatccaggcatgtaaatcacactggagaagatgatgagttcaggcccttacttgacttcagccaaaagcctctgtttcttgagcttctccatctgtaatctcttcttctttgcttcagtttcctgggtaacccaacacagctaatcatcagcaaacatcataatagaagtaactgagatggacactaaacaccatcaaacttgcaagaaccacatttgtggaaatcctcctagattaagagagttgcgatccttggaagaaagtttaactacgaaccagaatgaactgatacacttattagctgacttggaacatatcaaaacatgctaattcattcaatattaggagaagaaggataataaatttcagaaccccacagatctaacccaaaatattgtcacaagtaaaaaaaaatccagatccacaaaatacaccaagaaaacccctcgaataatcagaaaaccaagaacaccgaaaataaaatcgatcaagaaacaaagccgccaagatccaatcggaatcacaaaatccccaaataccgagaggaaaatcaaacatcacaaaacccccttccggagagaaaccgatcgaaaaatcgcaaaacccccaaaaatcaagatcagatcggcgaagccaaccacgacggcatgactccaagaaacgccatgaatccacccacccacccacccacctcgaggagctccttgtagtcctggagaagattcttgtacttggccctcgccctgtacgcctcttccccgccaccaacgccgccgccacggctgtgccccggcgccctcggcagcagcggcgacggcggcgccctcgccgccggctgagccaacaccaccttagccttcttcatgtccgcctcacctcacccgcgaagaaaccaacaaacgccccgcaagagcaggagaccaagaaagccagggagagagagaggtagaaggagataggaacaagcaagggaggaggaagaagaagacaatatagaaataaaggaggaggggaaggtggacgtggggagggaagtttcttgcggccgctgcttcttggtgctctcgctgctggctggctgcagctgcggcgccgtggtgaggtgtgaaggagacccatggatgtggtgccaaaaaaacccgaaaaggcccatgcatggtcatggatggtgctagagtagacggactggacggcaagatagagagagagagcaagggaacaccaaccaaaccaaaccaaacaatctctcatgtgtttctctctctagacttgtagtagtagcggtggtagcggagagggagggagggtgggtggtggtaatggcgtggcgcatgtggtaatcaggtaatggagtggtagtggggcgcttgcttgctgctgctgctgctgctgtctgcagcgttggcttcgtcgtcggtccagctccgtctccaagaccaaggagaggagaagagagagggggggcattcttggaatccgttggggttgagaggtcagaggtgtccaccatgagtgaatgctgctgcagctaccccctctctctgtgtacacagatgtcatggtccatagggaaaaaaaagcgagatgacgatacgggacatggacatggacatggatgtgtgtgtgtgtacgtctctctctcctggcgtccatggctgggtggctccatggatccattcttttgattctttcgtttcgctttcttgctgtcctcttgagagagaggccgaacgctcccgggtcttgtgcgagtgggtggtggcagcagcccagcatactacaagcgttgcagtggttgggaggaggatgatatgatggcgtttgcagtttgcacgcatttgatgctttgatagtgtgggcggaggaggaggaggagatgatggatggcgcagaccgtagaggcggatgggccagtgcgtgcggttggtgtacaacggcgtgtgtgcgtcttgcagaggctctgcggcgttgctgtttgcttgctgatgttgttgtggctgtggctgcgagtgaaatggcgagattgccatcccattcccaaacaaacaacaaacctacctgggtttctctccctgccgttgacacggtcgcctccgctcgtttttaagatgggggatttgggaagagaggagaattcttgtgtgagatgaagatggcgatgaaacgatgataggtggggtgggtgactgggacgtgtagagataagatgctgtggactttgtggtcctgtggtttgctcgttgcatctgtctgcccggtgctttcgtatgcataatataaagtactgtatcatattaggtaaattttactgtatgatattaggtaaatcgtgatttcatagttttagctctagaacatggtaaaaatcgatctttggaaaaagacacatccaacatgtgattatttgctgttgtatcccgtccacattaaaatattaattttcagttcactaagagagataaacatcgtgaaaggtcaaagtacctctagccccatttgtcatcttcttcctctttctcatttccctctttctcatttcccctttctgggagccgatatcgaggtggattcaaggtggcttggaggaggcgaggtggagcgacatggacgagtcggggtgaagaagatcgacacgtcgagtggtgagctggtggggtggtcgatggggtctgtgtggaagccgaggatgagccggttgatggcgcggttgcaagagagggcgctggccggaattggaactgaagaggatgacggagaaggcggtattatcctcgatccggagaagcggtggcaaggagtgctaggcagagctagggtgccatgcggtgatggaggcggaagaagacgacgccgtgctgccaagactgatttagagctggcgaagcctagcctgaatggtttgcatcaaaaggacggcgtacccgaaggcggcccttgcaaacgcggcgaagaggggcccgtcagaggcatgcagtgcacagaccaaagttagcagcggtggttgttattgatgcgcccacaacgcgaggtagtgtgtcgatgacgcgggagaggcttcgcccacggatctgccaccccacctcctccaggcgggaaatttaactatttgccactcttgtgatatggcaattaactatttgccacaccctgtcaatgacatgtgggccctcatgtgtttatgacatctgggcctagtgacaaatcgttaagcaacattcgtaagagtggcaaatagttaaaagcccccctctaggccaccacctcgatgctgactcctctgttccgtcaacactggggtgggggggaagaagaatggaagagaaacgatagcgatttggtcactccgtgtaaatagttgtgccccctatcaccttgtcagaatgaatacattattttaatcgacgtagttgtaggatcgagatgtcgactagaagggggtgaatagacgatattaaaaataagagaaaattggaaccatgccattataattttgcaaaatcgagatatgccatcctgacccacatgccattgactcatgtgggtcctacatgtcattgagataccgatgacatatctcaaactttgcaaaattataatggcatggttccaaattaccctaaaaataaatagcgcctaattaaaactaacctgagttgctaggcttggtgaagggtaagactaactaagcaactaggttatgttttacaatcctaaggtgatagggtctcaagtacgtcattatgaatgtaaattgcacacaggtaaatacaataaataaatgagacaagagagaagaaaattttcacccgaggttcggaaactcgctggttttctaattcccgttgagacgagcctaactttaccgcttaaaaccatagagccacaacaattctactacttaaaagatctgtagtggtgatggtgaagctaatgtagactcatgatccaacttaaaaacgtagacacgtgaccgtgaaaaaaaaaaaacgaacgcttcacagcgacgcgcaacagaagcgatccgaaatcagcgcaacagaagcccccaatccatcttcgcgcatccccacatcgccgcgcccgctccactcttccacccccggcgccgctgacccctccccagctcccgcctcccggtctccctcgacccatccccgccgcttgaagccctcccgtcgcgcctcacggtctccatcacgccggctcgccctcgacagatccccggaagccctcccgtcgccagttcgtcgcacacacctaccttgccgatctgctcctcgccgccactgtcggcgcccgcatccacgacgccgccgtcatcccttggtagtttgatgtcttctccttctcctcaagatggatccaaatgtgccaaatgcgtttattagcaaagcgaacaaactggggatggcgccacgacctgcttgtgctggagacagaggacccctcgtcctcctcctcctcctcctcctcgccgtgcctccctgacccgccgccgcttccaccctcaagcgccaccgcacgtcgcacgagaccccacttcctcccgctccccccgctgccgcgcctcgctgacctgtcgcctttaaaccttgcgccggttccaccttctccgaggtcgctgcctccctagagggccggccagaggtcgccgtggagtccttgaaagaggaggaggaggaggaggagagacggtgccatatgcgttgcatcacacgcgggcgccgtcgctacctcgagcaccgtatgtgcgattgcagccgcctccgctcgccatgagaacaatagcgtgtcttggtgctaccatgccgagtgatctaggagtactcccttttttctgtcagtttttctttttccctgtttgcttgatttgtggtcaggcctttttcctcgtgctgtttgaaatttcatggtgaattatattcctaaattatatctactttactttctaggtggaatttctccaggttttagttgagtgcttgggactaaacagtactgtagcaagcattatcggcctattttgttcgcagagtgaagaccatggatgcagcatgcatgcagagttgcagactgaagacaggccatcattcttcagtctaccacgagatagcggcgcaaatgcttgattcacttgtgagaatcacttctttcaacttccaacctgattttagagcaacagtgcctcaccaattgaaatcaaccgatcaacatatatgtcactggttctcccatctattagatatagttctgaatttttaaacaaaatgactatttgtgtgctgtgagtacaacaaaaatgagctcaagaaaagctatctctatcaacattagcgaaaaaaaagcacacttaaagcctttacaaaaaaaaaatatatgaagtctttacaagtgtaaacatttctgaaattgcctggtgagcgattaaaatgtttttcttgtggtgccttcagagagtttgatatgtttctatatatttttacatgtgtgccattttctgctgccccgaacattgatctgagagtaatcaaattccttgaatagtttaacttctaaatgttcaaaaataaagggagcgccatggaagtcaaattagtgaaaatcttaggtatcctgcagtgtgtatgggggcactgtgcaatatgatgttgcatgcagtatactatcattcttttaaaagtatcttctcggaataatttcttatttccaaatattctcagatacactttcaataatgtagatatgagatattatgtgcgaatggccaccccaagataatatacttcaggatatgcaaaatcagttggagaatgcaaattcggttgttctctttcatccctcatatatgcatatgtttcttaaataatttacaaaattactgttcagtagtggagtaaataaatatgaatgacggtacctgtcattatgcacatgttctctaaacacatttcatgaatgacaaggtaatttttggtaatattgtttggcagcgagtatttgggtacaatgtactaaagttaatcaatatgtgtggcatatgcattgtttttcattgttaaggttcgaacaactgaaggcaagtaagatgaaagaccttgtttgaaaagggaaagctgaactggaagagcatagaagatgcgctcatctaattagccaggaaggttatgcagctgagtttagcattgaagttattgaagtgcaggtaagatattctcctatcttactgacttccattgttcttgaaaattgtcattccaaacatgttcatgttttggccaagatggccgaatgatccactttggttctgaatattttgtttgtcgtttttgcaatggcagggacgtatgcgttttgcaggctgagcacatgaagaatcccagttaatgtctctttaacttccatccataaggagactcgtgcactttcctgacaccctagcacaagttattacgctgtgcagacttttggctatacattaagcaagatgcagcaagtattttggattgatgatctgtaagatttgagttcagctcatgctcgttgatagcacatgacacatcggttgaataactgtgttcatttaactctggacctacatatacataatttcctcttactttgattccttggctcaaaaggctcacagaagcctatattttgcaattaagcaacaagaagcagggcttgatttgcattccgattcaggtaaggtaacagctgacttcgagtttttttttaattggtgcattatccatgaaacccttttccagtttccagtattcttttgttaaattttctgataacttaataggaaagacattaattaactatgcatcacctgctctatatataatataactataggacattgaatattttatttcattgcactaaaatataatcaatgttggcctatttttatgaatatattattctggcatgtcactacaagatctaagtaatactgatattttgatccatgggtgctttataagatctaagaaattaattatacttgatctcagggtctgaagaaattaaaccttaacaacattgtgaaatatagtgagactgaatcttggagataaattactgaagaactgaactattattatgagtataatttactttctgatcttttaacaaataaggatattgtttattagtggttctagatttggttaccttgcgtccttgccttttattcatcagtgcaattagggccaagcttttgcgtggccttgtcagagagatgaaaaagtacatatgcagtgcatcacttataattggttgtgcaacctcctcatccgcatgctaagtacaatgagttgaagatgatgtgctgcaagtacgccctttccaccatctgattatgtacacatttttatatatttcggtacatccgattatatacacatcaatataaattgtttttacgcattcttatatatttccgtgccacctactatgtaaatgagcaaaaaaaataatttgtttcttacatatattatttacaattatttttctccacttctataggattgacatattgttttccaaaggaaacataatagatcgggcagtttctgtgagctggatcagtacgggcatatgtgctaactgcctcctatgcagttgtgctttgcacaacgaagtgagtgtggttcatctttagagccatgttcaaagagagtttgggtgttgatcaattgtgagaaaatcatgtgtagaaatgccttgggatgatgtctaaaatagggcattgtattcatttcccgtgaattgctgcacaaatattttttgatgtactttatggtgcaacatgcatctattgacactttctactttaaacatattaaaaatatttgatgtattgtttcgtgctatagtttttttcctgttgcaacgcacgggcacctaactagtattttaataaatccctacttattataaaaattgaagatatttttgtcggtattttggtacatcaactgtgtttgagtcgtttttaagtccgtccgtttttgggaagacatatctgtgtttgagttgcattttagtcttgtttgcttttgaaaatacaaaaggagttgtataagaaatcttaataaaaaaactcacattacttgagatgaaatacaaactcataattgcagcccacgattttctttaaaaaaaatattcatacgaattcccaaaatgaattttaccctaactaaaccgtataagaatgataaaattaaaatagtatttacccgttacaacgcactggtattttttctagtctctactattataaaaattaacaatgtttttgccggtattctggtacgtcatccgtgtttgagtcggtttttaagtttgttcgcttttggaaatactgatccgtgtttgagatggattttaagttcgttcgcttttgaaaatacagatctatgcttaagttggattttaagttcgtttgcttttggaaataaaaaggggtcgtataagaatctttttaaaaaacacgcatgctaacttgagatgagtgtcgaactcttaattgcagctcatgattttctaaaaaaaatatccaaacgaattctcacagtaaatttcaccttagctaaaccgtataacaataataagatttaaatagcattcacccgttgcaacgcacggacatcttttctagtctctactgttataaaaattgaaaatgtttttgccggtggcttggtaagtcatcgtgttcgaatcggcctcgcatataatcactgccaatttaactattttatgtgtccaacatgtacgagctttaaacattagattttccataagaaaatttgcatgttcggatcgtgcctttggccgattgcgttttgtcctgtgcattgtcacaaaccaaccgcctccgcgaggttgtcatcttgccgatacggtctgttgggcaacacggtttgggacctgctgttgcgcacctatatcaacaccaaccagcagcagtcaggtgtgttgccgtgcgccgaggcaagcagcacgacgtaccattgttgattattctctacacgcacacactgtatcgagaagaattcctaccgtgttcatcagaaactcaattcaatacggtctgctgtgtatacgtgttccaaaaaaattaaaaaaaaagttcaggagcgatatcaaagccgagatctattactacccacatattgaatatccacgcgtgcagcaagacgatcagcaacaacagccgatcgatgacggttgccaagagaaatacaaaaacctaatcagagaaatattcaatcaagctactgcgcacatatatctttatctttactattatatctctatctctactattataaaaattaaaaatgtttttgtcagtacgtcatccgcgtatgagtcggttcttaaatccgtttgattttagaaatacaaatccgtatttgagtcagtttttaaattcgttcgcttttaaaaatacagaagaaatcgtacaagaaatctctttaaaaactcacatactactaacttgagacgttcggacacctaattgcagctcatgattttctaacaaaatatatatccaagcgaatttaacacagtgaatttcatcttaactcgatataataataagattaaaataatcttcacccattgcaacacacgtgtattttttctagtaaaattaaaaattttaaaaattctcatctggagcgttgctgggctcgcgcggcccacatacggcgcagatcgatcggggctgtggggcctgcgcgggagagagcgcatctagcgcgcgaggctataaaacacgccggattctgatctcaccgcccggcaagcacgaacacgatgacatcggatcgggtcggtttctctcttgctgtcttctcgatcgatcgatggctcccacggcggcggcggggctggcagcgcgcgacgcgtccggccacctctccccgctcaccatctcccgcaggtgaaacttcaattatactcctatatatatctagatagggttctctagatagtagtgtaatgttgcgaggggctagctagcgctgttccgttcgtacacgtgatgccgttcgtgagcggcgccggcgccggaccgagtagggaataccgttcgtgagcacggcagcggcggcggcgttggcgtgcgtggagatggatgattctgttgaaacctctattcccatcgatattcatgatagttcatgattctgttcaggcttgtttcgttcgattttgccgacatgtcgtagtacatggtactacctccatctagatttgggcacatagaattaaatggtggaaggttattattgattaagaagtgcaggtacatggggaaattaaatggtgaagggttataattggttgataaaggattgttggtggagaaattgtattttgggataaattttaaaggctatgttatattttgcgacggaaacaaaaatatccaatccaggttctgaccttgggattaatttcttggcatcacacaaattaatttataggaaataaacttatttcagcaacaacttaattatattttagtactgtttgtcctagaaaataatcagaataatatatgatatagatagatagatactagtagataggtaggtaggtagtcgtactgctgtttagggtgcatgcatagtaggatgatactatcacgtacgtcccttcatgcgacggtttaatttgtcgatctagtggcagtccaacctattacacaccaaaatcgatcaacatgtggttttgcactgttcttttgtgaggtacatgcaccgggaggcttatgttgacacataatccaaaccgcattgtttgtgattacgtgatcagatcgatcacctcgtagtcttggtctcttggatctgtcattttctgtagtacgtactgtttggacttttagaggtacgatgtgttgagtacaactgtatatgcacagtaattggccattgtctctctgttcatatctagtgcactggtagcgttgcacctaggactttaccgtgtgatgggttgtatttcttcgactattgtcacaatctgtataattcctagccatatacgatttgccttttatgccagagtttagattgagtacgtttttaggcctcgttttaaagatgataataatttgagagcataaataataatattgatattgaaaagctgaaaaatgatttaagaacatacaaagaaaataatgatgaacaaagttttacaaaagacgcgccgtctagtagttggtgcctgtgcgtagagtttttctttaatcaacaatataaatagcgtttgtgctaattacttgaaaatctgtaggagcactggagatgatgatgtggtgataaagattctttactgtgggatctgccactccgacctgcacagcatcaagaacgagtggaagaacgccacctacccacttgttcctgggtaattattaattaagcaagctagctttacaaacaggttttgtacgttgttacatactccctctattccaaattgatctacatattttataggtacacaaaaaccaagaaaaattaataactctctcatactatatttactctaacaacaaactcgatgcatgtaccatcaccactattttctaactaatagcaaattaagatattgcatgtgtgttataaatacttgtgtgcatccatgtgcatggatgcacgcatcaatgcccatttactccaatgcataaataacgaatagacttaatgaataaatacaaatatgcagataatttaggaataaccttaaaaaaaaactatatgtagatcaatttggaatggagggagtacgatgcattattctgaattaattctgatcaaacaaacatgcactcgatggcgcaggcacgagatcgccggcgtggtgacggaggccggcaagaacgtgaccaagttcaagggcggcgacaaggtgggcgtcgggtgcatggtgaactcgtgccactcctgcgacagctgcaaccaggggttggagaaccactgcccaggcgtgatcttcacctacaactccgtcgacaaggacggcaccgtcacctacggcggctactcgagcatggtggtggtgcacgagcgcttcgtggtcaggttcccggaggccatgccgctggacaagggcgcgccgctgctctgcgccggcatcaccgtgtacagccccatgaagtaccacggcctgaacgtccccagcaagcacgtcggcgtgcttggcctcggcgggctcggccacgtcgcggtgaagttcgccaaggcgttcgggatgacggtgacggtgatcagctcgtcgccggggaagaggcaggaggcgctggagcggctcggcgccgacgcgttcgtcgtctccaagaatgccgacgagatgaatgccgcgacgggcaccatggacggcatcatcaacacggtgtctgccaacattccgatcgcgccgctgctgggtctgctgaagcccaacgggaagatgatcctcgtcggcctgccggagaagcccatggagatccctcccttcgctctggttgcttgtaagtgcttaatttgatccggatccattacagctagctactagctagctagctgctctgtgttgtgatccattacattctgtctgtggcatgcatgttgcagcgaacaagacgctggccgggagctgcatcggcggcatggcggacacgtaggagatgatcgacctggcagcgaagcacggcgtgacggcggagatcgaggtgatcggcgccgactacgtgaacacggccatggagcgcctcgccaaggccgacgtcaggtaccgcttcgtcatcgacatcggcaacaccctcaaggacgccatcgagtgatgcgtccggtccggtcactgcttaatttatctctctgtccattctggaaccggccagactgtctaatcgaacgtttgattagaaaatgaacatttaaaataactttcgacagaaaacggaacagaaatctgtcggatttttttccaccacaggatacgtacccaaagaaaagattaggcctcaaaggattttgtttgcacactacgacatggttaatcgatgaaactaattcagactttatttcccgtaattttgcaaacaaacagtatggttaaacactaaattagcatcaatcaagcatttctttacctattacatgaagcacggtacaaagtttagacattgcataattaaactataactacactataatttcctctctctttttttaaagaaatacggcaggggaggcccccactgttaataaattttattaataaaaagagaggtataaaaatattacaacatagcaatccaattgatagctgcatctttgtctctctcaataagacgaaacagcagaaggaggagatcacccttaaatagctgcctccaaagaggagattttttagtaaaaaatggaaccattcctttgcttccagatgtttcaagccccatatagaaacttctccatgaaacacttgccttggtaactattctttgtatgcagggtagtgtcccgagagatacccagcatagcctagtagaattgagcaaaaggccattggaagaacaaatgcaacagatcttccagaatatgagcagaacaaagaacacaattaagatcgcaattgggtggcgcacaatgtttgtgatctaggtattcagtctattcatcagcagcaaccaaccaaagactttaactttagaagtagttttgcacttccataaccaaaggaaatgagagggtggttgtaaagctctgaagttaagggcataaaatttctgagaagaatatttcagattacccaaaatgtaaacccaaacatcattatcctgagaaagattgacactctccaaaagagttaacaagggttgcaactcctgaaaagcttgcgcaaaaagaggcagatgaaaattttcctccaaatcaaaaatttctgactgatatctttgcattagcaacataagagaataatctttacatatggaaagacaaaggaggtttatcactcaaacatcttcccaaaaatagcaagcgacaccatcacccaccatacatctagcaatgcccatggaaagatccatcagtttgcaaacatctttccaccaaaagtaacctttgagattgctcactccattcccataataagggttccaaattaaattaacccaaggtagatttttttctattatagaacttgtccaggtatttcaagagaagtgcctgattctgtatagaaaggtttataacccccaagccacccttattttttggtatgcaaaccttgcccgatacagccaaagattttcggttacagttcacatcagaacccctctatatgtaataccttcttgccctatcaatactagtaatatgcatgtgctaaacgctacagtgcaattatattcatctttaataaaaccttagaatggattcggatgtcacgaatagaaaaatatatagagtataagaaaatatattttccgcatgtcacaaattctaatgttctcttaggtcaattccattcattttttctttttgtgttatgtacttaaaaaaatattgattttttctatttgtcacacaaggcacacgcctgttgcagcccattgatgataacatgagggtgtgaatataaacccaaataacagtttgaataatttcacaatgtacaacaatataacaattgttggtcatctcattaacgtcttctttcaagatctatatggaatgactactaaaattaatcgatggcaaaagtgcatatttagagagacacaagtgttaacatattatcagcatggtgcaaactgactcatgtagaacacgatggtgtgaagaagataatcatgcaatattccacctgaggtgatggcgtgctgtacaaaacaagaggatgtcgatgagtaacatttcgatcagcaatttactatcttctagaatatgtttttgaattaattttgatcatgcgagcctacctttgctcaccagttaagaacgtttttatacacgatattcctagtgctcttccctgtggggtcgacttctttttttgactttgccaaaattcttgttgtttgccttgacacacctcctgacagtacgcatttatccttgttgtttgcgcatttatccttgttgtttgccttgcccttgacacacctcttgacaatgcacatttatccttgttgtttgccttgacacgggggttcctaaggggggcacttgcgccggctgcttaactcgtgcagccgtgcgccctcccccacgcccgcgcgtgattagcgcatcccgctaattaccatcattaacattaattaccctaattagtattattattttagtacgcgaaaaattgggataattacggagagttcaacgtaggtttgaaaacctttaagtaaagatttgaaacattcaaatcaagattttttgaaatttttaagtcggatttgaaaaatttcaagtcaagatttaaaaactttcaactcggatttaaaaacattcaactcggatttgaaaactttcaactcggatttgaaaactttcagttcagacttgaaaactttcaacttggattcgaaaactttcatatcaaaattaaaaaaattcaagtcaagatttgaaaagttaactcatgtttgaaaacttttaactcaaatttaaaaactctcacctcgaaattcaaaatatttgatttaaatttaaaaactttcatttcaaaattcaaaacattcaactttaatttaagaaactttcaaatcaaattcaaaactctcaaactgatattgaaggtgaaagattcagtttataaaagtcgcaacaaaaatcacgcgcgcgtgtagagaaaaaaaggatagatttcccaaaaaaaaacaaaaactagcgcctattttcccaaaaaaaggagaaaaaaagagaaagaaacacgtgccacggccgttggcagcgtttgcgacacacgggccgtgtgggtcggaagtgcgtgccacacctcttgatacacctcatatgataattgccagaatcaaatgaggaaacatcagaatcaaatggctgaagataaaaaaatattcttccaccttcatcccgtcaccacttaacagaattttttggaagtgcagcaactttcgaaaaaaatccccttgcttctggcaacaattctatttctaaatccatgcacagtaaagctaaaaaataaattgataaatgcgcttcagtgatgtataacacatctaatgaatcttttgttttcatataattaattgaaaaaagagggggtaaaggatgaaatgttaattttgctctctgaatcattcaattgagcccacataaatccatacactcaagcgcatttattatcaaggtactatactttagatgtcaagattaaccaaatttctccatattaaccaagactatgccaaattcacaaaagcaaatgctgtggaaataaacccgcacccaacaattatccatctacatatgtagaagtgaaaatcacttgcatttttctgaatagtttgtcatctatgataatttttcatgacaaacacaaatttcatcatttcagagatgagattcataactgttagtggccatgagaaatcagtaaagataaaattaacacgaaatgatgctgaacatctgatattggagttaaagtgactgtagcatacatattgaagcccccaattacactaaacatctaatattttttttttttcataaattcactactccctctgtcccagaatataagaagttttaaagtgtgacacggttattaagaaggtaggtagaagtgaatgggagagggttgtgattggatgagtagtggaggtaggtgggaaaagtgaatggcagagggttgtgattggttaggaagagaatgttggtagagaagttgttatattttgggacaaattatgaggactaaaagttgttgtattttgggacggagggagtaataaacagaaaaaatgttcctttaggtaatacatcagttcacattactaatgcaagacattttacatatccaggtgtcatgaataaatatgtgtaaaccaaatcttatattttaataaaggaaaaaaattaccactgcacaaagcagaagttggatgttaactaaaagtttttttttcataaattcaataataatctgaaaaaaatgttcctttcaatacatcagttcacattattaatgcaagacattttccatatccaggtgtcatgaataaatatgtgtaaaccaaatcttacattttaataagggaaaaaattaccattgcacaaagcataagttggatgtcaactaaaagtacaagaagctatgtcaatttggatgatgatgtattcaatgagaaatcactctcataattttatcggtttgaccaaatccatataacaaatagataaattgcattgtactttatcgccgcaacaatataatacttaaaggtagtatacgcacactactaattttttcagcttaaaaatgcaatgaaaaatataatccaaggtaagtacttgtataaagatccagtatatgaatagctcgaactgaacaaaactacaacctaaactgcccttatcgaatcaccattgaatatctcatataggctatagctacttccgaagagtatatatatactgaacccaatgtattcctagtgcttaattgaaaaaaaaaaactatattcgtagtgtccttgttgacaatgatttcctgggcatcaaagtccagccaagcaatacacagatagggtgaatactctattgcatgacgcaaacaggtaggcaccacagaaaacaacagagggatatatttattcaaagctaaaatccctgtgatgctgaactatttataacagcgacatgatgagaaaaaaacagggatccacaaatcgacacatatttcaggggacgaacaaataggcatggtctaagatccacaaatcgacacatatttcaggggacaaacaaataggcatggtctagtttattactgaattagctagaaaaaactcctaaatggctgtgcatttggaaaatgtcatatatagctacattgctgaacatttggcaaatgtcaaaataaataaatcaaagaccagattgtaaatttagaattgttttaccaaattctggattaaatgccatctgaattccaaaataagaaaaaagaacttcagaatcaaaatcccaacaccacacataaaccaacaccattctgatctttgactccattctgatttaaaccaacaccacacattcctagtgccgaacagccccactacagaaatacaataagaagcagcagatgcacatgattaagtacacacaattcaaacatgtgtgagcatattctggttctgtttttgtcagtgattttacgaatttggatttttcttcagaatcaaggcacaacatttatacgcaaacatgcatatgaatatgctagaacagtattactatttatagtaattatgtcattcctgatcaaagcagtacagggttagtataagcaaaaatcaaaacacctgtccagtcagcaaatagttagtctatgtaaagtctagcaaaagggatcaaatatagaacaattcagagcctagcaaaagtattcaggaaatatctagttgtaacacatggatggagtttgactgcaaattaaggccagttcatgcaccaataaaccattccatgcatgaattacatcatccactattcagatacttgaagaaatacagatacttgaagaaatagggttatttgaaaagacagtgaacaatagaatcagttggaatccatctccccgtctagattgaagtagtaaatatagatatccagggatcatacctgagtggggcagcctaaccgtagaagactgtgtcgatgcagattgagcactggagcaccgtcgccgacgtggaagagataggagcgcggcataggggaggggacctaccgtcgaccggttgtgggctctgaggaagaggggcgtcgagaccttccccagctttcggctgtgggcggtggttccccggcgatagggcaacgcggttgaggaaaatgcgttgaactatgggcggtggcagaacagcttgaggggagcgacgggagaaatttgggcctgtttggttgctaccaagaatatgcttggtctgagactagtctgactcattttattccttgtttggttgccaccctgagagccattctccctagcctggcctgaaggaaccggacaagtgattagcctgagttaggtgaccaaaatcggtcacctgagctccaggtgcacgcgtgcaacagaaatcaaggataacctatcgtagagatgtcccctgtgcgcacgaggcccacacccccacacctcacagtctgcaattctgcatgcagttggagattaatttgatgcatgcttggatttggaggtctcttttctcgcgttctcctaattgtttcccctcaacaggtgtgatgagggtgttaggccccgatcttccgataggtattgataaacagtcgatttggacggagtcgcgacacaactcgatccggcttctgaacgaacacgctactgagccccgcaatcgcagcaccacgtctcctctggttatcaaccgtgccgaaacccggttgacctcgccgagaaggctaatctctgcatgcgaatcgaagaacacaagcaagaacaagatagatttcaaccaatttgcatatgaatgattaagtacacgaatttggggttccacaaaccgatctagcagcgaaactgttcttgacagaataatctgaataaactgttttcgatcagcggctaggtccatttgaagttgatgctgtcaggaggcccgaatctgaatccaaaacgtgtacaacttgttctcttgtcttctatgggccaaaagtgacgtggtgagatgaaagaagacttggagaaggtcttggtttggtccccaatcaacttattcaatcatccatgcattccttacactcgatctcttttctttagcaacgtttgttcaaatatataacaagtaaatctaatatagaacatatgcacctttggttgattaatacataaagtagccatggttatatccgagctagttgtgttctcatcatcctccccttcttgattggaaatcgtcctcgatttcaccttgtcatggagcgtattaaacttatctttatctatcacatccggtgaggaacatttcttgatggtcatatgattggatcctaaaatctttgtagtcgaaaaaccactacactccccttcttgcaaaccaacctgtaacttatttaaacaactagaggaactagatagataattacatgtgcgcatgcggtcctctagacaatacatttcatcatgaaaaggaggtatagtcaaattcgaacaaatatatactcgatgcacattatattctcctttactatcataattgccaatgacatgaaaaatcacatcagaagtacatggcaattcaaatctagcaaataatttcttctctaaatagttgagtggacaaaaatcatcaaaatgaatatatccccaagtatttaaagaacatagcaatttaagctcttcattctcccaagcaatgtgaataacatgtttaaactcaacactaggtggctctactatagaactaacatgttcattcactagttgtggcatggatataagtgaagcatcgcacaactcttctttatcacaagagacatcaagcaatttgttttgtgacaaaggtatttcaacaattgtttccactatgagttgctctaacttagcagaagtagtggacatagttggcacatcataactatgcataccttgagcagttgtagcaccattactttttttctcatcttcagaaattgtaggcacttggtcaattaaacattcctcaagcatgcgtggagctatgtataggtttttttccctcttcgtctttcttctcttcctcattaccttcgttgttcttagatcctgcaaaatattagtatccaaagcaataggcacaacattacgttcgttttgtaataactcagacttagttgaaggcatcacaatagtatctttcctggtatctctgaaaatctcattgattctatttttcttcctttcaatactatctttgaaaatttcctcgattccaatcttcattctttcaagattatcttcgaaaatttcagtaaaactcatgggtaccaatttcattttccgaccattatgtctaaatgtgtatgtattagcaacaaaattatgcgatccattattagcgtatacccatggttgaccaaacaacaaagaacatgcttgcatagggacaagatcaaaattggcagtatcatggtaatttccaatcgaaaagtttattctcacaattctatttaccttgaacttaccacaagagttgaaccatttgatgtaatatggatgaggatgcggttgtgtaggcaactcaagtttctcaaccaaatctgaactcatcaagttattgcaactctcactatcgattatagtgcgacatgctctatccttaaccacaaactttgtttcaaataattcgtggtactgccattgctctgctttctccatttgagaacttagcacttgttgcaccaaagtactgtcatcacgtgcatctgtggaaggtgatgtagcagctacggtttgtctcccatccaactttatctcatgtccataagagatgtaacctaccattgttagtagaaaagagagaacaacataacaatattgttcctattaactatagaacatggattgtagtggagactagcaaatggaagcgtcttaccaagctcttacaagtgccttaccagcaatgctaaggacggtacaaccggtggctggttcgtgacaccttgaaggacatgatgtggcgattgcaaggatcaaagcagtgctgactagaagaatatatgtggagcttgggaggcacaatatatagtagaaaaggaacgcaattatgctaataagaaaatgcaaagttgaataatagttcaaagtactagtcaatgtgctggcctagtctagactcaactctagctcaagcaagcacccgaccacactaaggactagaagcagctcaaaccacaactctgcactctagatacagctcaaaagaatcactaaattttctcttctttttttttgctgcagctttttttaagcacctttctgccttttttttcttttttttaggtgcggcgttttctttcttttttttctttgcacctttctgccttttctttctttctttagtttttcttactatattttttttaacaagaactgaccactgacctcgaacagggactcaaatgtaaatatgaatattacatggactcaaacacaaagtgcaaaattaaaattagatcaccccaaaaatggaatgctcacatcacgtaggttccgtttttataaaaatatctcaaatctacaaccaccaaaatacctaacaatctgataatcgaggaagcggcatggaagaaacttgccgtgaggtggaggtggttgtcaaccgtgagggggaggtggaagttgcggatgtggggtggggggttcagcctcagcctccacaggataagagtggccccactatttctttttatctctaacagaactaacccacagcaaccaatctcgtgctttttttttatttctttctcacggcacacataagctcgggaacacacgacaagaaccctagcaagaaagtaactctctaaccgctcgataaaaatttctccacatcataaaaacggaaaccagatgatgattagattcgatttttcgaggtcccagcaacaaccgacgagatgaaaaactggaaccaaaactgacgtacaactcacaccgacttgagtgatgaaccctagacctaagtgatgaacagatgcaatactcaaaactaaaaattaaatctaaaaactaaaccagcactcgacacgacgatgcaatctagaattcaacaaagcaaaatctaatagaacaatgcaacggctcaaatttgtctaggtaaagaataaatatttttgtgtggcaattttctagttatgggaagataaattacctaatggcaaccgtgctttgataccaactgatgagggatgttaggtcccgatcttccgataggtattgacaaacaatcgatttgcgtggagtcgcgacacaactcgatccggcttctgaacgaacacgctaccgagccccgcaatcgcagcaccacatctcctctggttatcaaccgtgccgaaacccagttgacctcgccgagaaggctaatacctgcatgcgaatcgaagaacacaagcaagaacaagatagattgcaactaatttgcatatgtatgattaagcacacaaatttggggttccacaaaccgatctatcggcgaaactgttcttgacaaaataatctaagcaaaacccaaatctaaacgatgatggctactgaattaatatgattagggacgtcctagggttgccctagggcacacaccccgttgggctaagcccacgacacaattacaaggcccaaaacccgagtcagattcggactggatgagatacgtggcttgttttgcagattcctggcagctcggtaggaattttgatgtgggaccaaaaccatctgaaagtagactccataagctttccaacaagtactcatgggtcccaaaattccttctagatcagcggctagtccgttgaaagttgatgctatcaggaggcccgaatctaaatccaaaacgtgtacaacttgatctcttgtcttctatgggccaaaagtgacgtggtgagatgaaagaagacttggagaaggtcttggtttggtctccaatcaacttcttcaatcatccatgcattccttacgctcgatctcttttctttcgcccaagcaagtacctctgcaaacgaaaacacacaaaactcattgtgtagcaacgtttgttcaaatatataacaagtaaatctaatatagaacatatgcacctttggttgattaatacataaagtagccatggttatatccgagctagttgtgttctcatcaaggtgtgtgatagatttgtcatttgtaatagaaagctagatagctagcagatagatttttggtgggcgatgcagtcttgccaatattttgtatcttattccgattatcacttaacttagcaataatcatgtacagcctaatcatatttttacttctcaggcagcagttgcaaaccaaacaagcgaagcatccagctgcctgactaggcaaaaatctgaactcatcggatgcctttcaggcatgaaaaaaatcttaggcatgaaaaaatctcaggcatggtgctcaggacaccaaccaaacagacccaaagtcacggaggaggagatcgtgcaaggggatggagaagagatcccatcgtgatccatgattgggtggggcttgcgctacgggggagagagacagagagagagagagagagaggggggagggggagcgacatgaggcgttggatcttagggagaagatcctgaccaatgaggaatgagtaatgaagtctgtaacactgtgttggtgaactatagggtaaattatctattactatcttgggcagctgcaaagtgcacatgtagtactccctccgtttcacaatgtaagccattctagcatttcccacattcatattgatgttcatgaatttgtctagatttatgaacatcaatatgaatgtgggaaatgctagaatgacttacattgtgaaacggaggaagtaggtaggcagtgaagaaaatactgaattcagcaaggtaagcctatctccataagataaaaaggttgaattagcagatagttttctatcaattctaacagaggcaaaccaagatatgtgaaaggaagtgagccaacttgacaacaaaaactcctgccaatatttgtgctttttcctcatctatattaattggtatgaggcatgatttatgataattcactttgagaactgtcctctgtgcaaaaaattacagtaaagctttcaaagtgaataattcctttccactggctttgacatacaaaagatttcaaagtgaataattcctttccactggctttgacatacaaaagagtattatcagcatattgcacaattggaaaatctagatcattctcattagggataggttttgacaacaagccaagagtataggccttgttaataataacctgaagcaattctgcaccaagcacaaaaagcaaaggagatagtggatcaccttgcctgacggttgttaacgattagtttcgcccgtcaatattactaaaataaaggaaaactagttatgcttgcaatgcatattatgttagaatgagaaatattccactagtactaggattctaatggagaagaaccgacagcaaaatagacgattggttaatcagacgctgtcgagaagtagacttatggatggatgggccaagaacactaaattgacacgaccaaaacagccccaaaatttacaagtctacagaaaggagcaagcgaggaggccacctgctgaaaatgggctaggaaggcccagcccatggttcggccgaaccatgggttgggccgaaccctcccgggcgccattggatgcgaggtttcttctggatggcttggatcactccccaatgatggttggagggcatttccgaccattccaaccaccacaaccgtcattgggaggctatgtaaagccctctcatcctccactccatcacacactcaagcaagaagttctcatactctctcaagtttagtttagtgtcacaagttcaatttagaatagaatcttcatagaatcttcagttctcgacactcgtgcgggcttggaaccaactggggatgcacccggatggacccaagccccacgccacagcatcggaggttcaacctcgcagagtgccagtgagaaccggtgacaggtgcctcatcacgtacatacaatgggggaatatgaacgcccgttcctccagctcaagtggtatgcctccattctccaactagtggcgctcaatttcctctcgggacctgggtgaaatcacgaggaggttggatacccttgacatacggacgagagagatccatcacaacctcgaggaacacatagcccagatgcaagaatggcagcaaaatgctgatgctcagttcaccaacatcaacaatctgatgcagcaacaacacgctgttctccaagcgtacttctgcttccaggggttcaatccttaccaaggaccctgagcgaaaggcaagcttgggggagacgtctttccctccattgaagtaatttgtatcacattgcatatttccctttacaattgcatgtttgaatttccgcattgcatcttatagattgaaaacaacataaaaatttgcaaaatagaaaataccaaaaatataggatatattttattatgctaggtaagacaacttagttctcttgttgaaatgatgaatagttgttttgttttatatctctcatatatgggttcatggttaagtactctctcaaaaattgaataagagtatccaacaattattcgggaacctgatggaagtaagctgcactttgctaatccgagtttaggttgttacgagatatgagatagtgataagagttgctatgatcctgttctaagtttgacttgaattccagatattttattttccaaaatgataaatttgaaagttcctcatttgatataaattcctaccagaggcaaaaatactcatattgattaagtcatatacattgttggttacttgtaattccattgaactttatcaaatccatgtgacttgtctagatacttttcatgctctatgatcaagatcatacacccacatatatgcacatgctatacttctacactggaagctagcatccactcactccacttatatccacccgaggatcatcaaaataaattctccatgcttatatgtgctttcttctcctagaaaagaaaatattttttgaaaaaaaataaaaaagggagggaaaggcatggttatgaaaatgataaacatatgctctctcaaaaatattgagcatgagatgaaaaaaaaatgtagccatgccctctcatgtttattaaaggaggattttggataagaaagtaagcccccttcgtaagggttaggcaaggtaggagccggtccacgaagtggactacccaagccttgatcactagggtagttcttccttcactccgaaggtgatgaactccaaaccactcacaaaccggcaccgggatttctccacaatctccttggagagatcaccgggcaacatatccacaagccgtctagggggcgactacctccaagagtaacaagtaacatcccggctcggagatgatccggtgtcacattaactctacaatgaagtaatgaacttgtcttacctcaatcaactctcaaacacaccaaatggataaacacaagctcaagatagtgtgagagtagatgcaagggatgtatgtaaataaagcaagtgccaaaagaatccccttgctgctgatgggggagtatttatacccccatctacaaaaactagccattggggtcgaaatccccaacctctgttgcctgctggtcaaaccgcccatcagtgtaatagctagaaagttagccactactgtgcatttaatgcgcaggcacaactagcacggtctgactgccataggtcggcctgttagaccgcctgaggcttggttagacctccaggggctcaatcagaccggcctcgactctggcggctctggatcgttaagccaagggcatccaactggctcagagggggcccggtcataccagccaacacatgccgatcagaccggcttgggtctagcggtcagacaatgcaaatgatctaatatggcattttaataaactctttgtttaggtcataacccctcttgatagtatgtcaaaactataaataagtctagacaaaatttgatcgtccaacacctcgatcaaataaaataaaaccattagatttaccatcttcgtcgctctgcgtcatcaattttaatcatcggtgatcatcttgttaacggtgaaatttgataagccccgaagtcatcatcggcttagagtcagtatcgtttttagagtcctagaatcggccgatgggaattatcaagtcgccaatagtcggattgttgctatatttggttagggaaattaattcattaaaggaagcttattcagaagtgaccgagttcaaggaggatgcggcatgacagtttatctattaattaggaagagtatgttagtttccttttatgtttaggaaagtgtgtttaatgttcgataaggactttatattttccttttatctttagaaaatttctttcttgtccaagaagtactcgtatctatccatgggtataaatatgtacacacggggttattgtaaactatctcaacgatcaatacaactactctcagcacatcgccacccgaggttttttatttatcatccgatcgaacatggcacctaacgtggggctgcatcggctttcaatctctggcgaagtggttgttggcaactttttaatctgacaatcaagccgttgactgattttcagagtggtggatatcttagctaatctaatctggtaaagcgatttagccaatactggcataaaccctaaaacgaatattagccgatacaagtaaactgagataccaaactagattaactaagatatatgtgtcgacgtttgatgtcgcgattccagtatttgcatagtatggggattgttggtactaggatatatgcgagattgaggtaaaagagatggaggcgaggatttttatgcaaggttcgggcccctgaattgtcagataataaccctacatcctgttggccgaagccggtgttgctctttattcatctggatcacacaagtacaatatttgggatagcctatctaactattgtcgacttggcggtctgaagttctgactcgtagtcgacaacagggtagccttcctcctcgaatccgcatccggcgagatcagagacagcgctattgttgacggttgttatcgatcagtttcgaccatcaatattactaaaacaggagagaactagtgatgcttgcaatgcataaatatgttagaacaataatattccactagtattaggtctactaacctttttgcagagaatgacaataaagtgaaggagaatcgacatcaacaccaacaataaatcaatcggacaatgtcgaggaccagacttatgtatgaatgggccaagaactcagaatcgacatgatgaattgggcccaaaattcacaagtctgcggagtggagcaatagaggaggccaccagccaaaattgggctggattgggccagccccaggttcggccgaaccaatcctagcgccattggatccaggttttggcatggacgtccaggattgcatcccaataacggttggagggcacttcggacaattccccttccataaccgtcatacctaccttctatataaggagctcactctcttcacttcaacacacacctcaagcaagagctctctcattcctctcaagttttgtttagtagtatctagctggtggaatagaattagaataggaatcaggagtccggaagtcttcagaagagttcgggtatggctagtagctttcctttcctcttatgtaagctttgtacttttattagaatactcttttatatacatttatggtattgaaatactttccgagtatatgagtaccaactttacattatgttcttgttatactgaatatacggctagcttatctgggagatgctttggtgcgggtatagtgtttgcatatgcaattaatctatgtcatgacgatgatattagagtagtatctggtagtttaggcgtggtatctagattatgggatatcattatttggggttatatattgcggatgagaggtgggccgctgatggtgacagctcagtacgggtattcctccgcgcctatatataatcctaagttaatttcctggggagggtattcctccgtatttagccccggttggatggtcatgacgggctgtcgtaaggaactcggcagtcaggggtggcttctcgaagtaccaggagggcatcagatagagggtattagctagtatattagttaactagaatgtatgtatactatgtatattagaagtataggaatagattattctctttctcttttctttccacctagcttagattatttattatgaggatgagtagaaatgcttgtgtgtcactctacccttggattatcataacccctgcttagaatatgattatcacaagtaatatataaattattagttgagttttctctacatgatcttcccacgggataaaataaatacgatacccttggaatactctcgggtgaaatgctacaatggtatatccgtgtgcttgcggatgaactctgtaaccataatataccagaagtatttctgcgccattgctgggaattatatttctagtaatgtcgttaagaaataccaacagctatatctctcctaacggtatccataggcaccataggggactagccatgcctatctctgaagtcgatatccggcgtcttgtcttggcgtatgttggcttgtatgttgatcttgtgtcttgatctattgttccgtgtcctctctcctcccagagggccttgtatttatacctataggtgtccccttgtccaagtagaactagggaaaccaatatggatacaatccgagtggtccttatcatttccatgtagaactctggttgtctttccttatccggaactcctcctatatccgaaggttgtttccgtacaggacatgatatgtggtgaatcctgccgagatttagtcgactacttattaggtatgtgatatccataaccctgacaatatgatagatatgtaggaaaatttatcaaccaaaccagagcgatcgaagaggtcgaagcgatgcagttttcaacaacactaatgtagccgatacaattaccagggcccgcggaacgtaggacttaccccttcgct

SEQ ID NO: 80055 - DNA, 19583 bp, Oryza sativa
  unsure (1)..(19583): unsure at all n locations
agaaggagccaatagggaaaagaaaccacccgcccgctgcccgctactgagtttatgatttacgtcaaccaaccttttcatccgatcaataggaaaagagaacggggtcctaccgccgttcttttaaaaagagtttcgacggcgcgaacaatatctccgacccccccaaccgtttgtggaaagaaaggcgtgcaccgccgccttggtcgctcgtaaggggagaaggggcggggggaggggggaaatgaatcctagggttagggttagggtttgggtgtatttatttaggttaggattaatctggaccgtccattcaatcggacggctccagctgctcccacgtcgggccgccggcctattgggccaccgaatggaggacgtaaaatggacttcaatggagatgaaaacaggccagacacatagaataaaagggagggaatataacattttctatattcggcccaatcatagaaaggaggattttgattttttttccaattaaataattgttaaatgcttttttattattaaaaattagcaattaagctctgataattacaataaaattccaaagagtgtaactaatcatggaaaatttaataaaattaaatttaaccatgttattttatttttcacacttgctttacttgtaaattgatttttatacacctacctatttaaaaataccaaatattttaattaattacataatgtaaagttttcttaactttttctcaatttttttttctgtacacttcctgttgcaacgtacgggcacctttgcttattttaattaattacataatgtaaatttttcttaacttttttctcaattttttttgttctgtacacttcccgttgcaacgcacgggcacctttgctagtatatatatatatatatatgctctaattgggcactttttaggaacgttaacatccctccattgtttgattgaatgtattatcatgaccgtagatcctcttgagggtccatgttaaataaatcatgccacactttacgcccaagaaagatcatgccattgaaaatgatatggactcttatttaataaatcagaaattagtaattaataataaatatggtggcaaaaatatcaagcttagactgtcagtttagtattttattaatctatttttaaaattcgaaattaataattagctagttgtaactgacgtggactctcttttaacataagcaactacactttcaaaggaaaccaacacgttaaatataatattagagctttaatatttatagtgtcaatattcattaagaaggggtgaaacgatgatatgttcgcacgttatccgtaggacctctcaaagaaagaaattgaaggatatatgaaacgtttgaccattcgtcctagttaaatttttcgtgcaaatataaaaatatttatatcatgcttaaaaatatttgatgataaatcaagtcatattaattatataaatttttttaataagataaatggtcaaacgtttagtaaaaaagttaacggtgttatacattaaaatacggagggagtattaggtagagttgtcgtttttgctacggtatgtttcaggtgttagggcaccaacgttgcaccaacattattttcaataggtcccataatcagggtagttagtaagtttgtgccaaatccattatgtgttatggatagggtggtaaacaaggcgaggcactattgaaaataaaatcctctaacttcagtctctctagtgagtagaaacactacaaataatatgctttatttgcttgttgctagtaatagcacaaagatccgctttttgttattacctcttcccacgatgcttattacctaatagcaacggtgtatttattgcttgttaccgggttttctattacgggtgtgtttagttatttggttgtaaagtttttgatgtatacggatacacatttgaagtattaaacgtagactaataataaaacaaattacagattacgcctgtaaactacgagacgaatttattaagcctaattaatccgtcattagtaaatatttattgtagtatcacattgttaaattatagtgtaattaggctcaaaaaattcatctcgtaatttacatgcaaactatataattggttttttttccacatttaatgctctatgcatgtgtccaaacatttgatgtaatttttggccaaaatttttttaatctaaacaatgcctacattgtaattgcccatagataggccctgcacaaaaaccgagttatttcaccctgttagctgaaatgcagtgatcctgccacttggtcttgatgaaacaaacaagaacaatagtgaatgaacccagaagatcgagaatcattagaagacaaaaataaaaggaccacccatcatttctacgacccagcagatttgtcggattttacatcatcttgcaagttgcagttggaccactaaccgactaacacaagcagtgttttctgcacgatctgcaccgatttccccttccctgagccagccagtcactgatagatgactcccactctcctattgcttcacacgttagtgtttataatggttattagtaatgatagaggatgtaaaccttatttcgtgcgaattctcgaacgagctctacgcattcacggagcaccaccgccacctcatccgtgacaagtgttactctggtgactggaagcagcaattgagcgtcagataagtagatgtgcctgctgtaagagagaaacattagtaacattgaaccacaaattccttgatcaatagttttctgatcatatctgaagctctccgtagaagcttaagcatatgcaacagaattgagctttgtaacaatcagcaacaacacaatgaagagggattcgatgaaaagctacggtagatttgcgagtgaacaattcgcagacttaactgctggtttcagtttcttccaaaagaaaagaaactgcagtttctgctaggtacctagttcttcatctcatagccaaacatgcattaatcttaccaaatatacaaccaaagattttgagaactgaacatgttgccaaatgaaaaaacgcaatatatcaaaagtcatgtgcagtatttcataactaatccactatgaacttcagataaccagcgcattattgcctaatcgaccttactcaaaagctctaattagatcattatatcttgccaccaaaacatagtagtactaattactgatatgttattacgatatatagttttaccatcaacaagctattagtacgaaaaacctatatgcacatgggatacctgtcaagaagtgcatatccactaaatctaaaacttaacgtataaagatgccacatcatcatccactaacaattattatatttaaacatcgtgtaaacatgttattttatctataattttataatttattaaattttatagctttttaaatgcaaacatgttaagtcatcatcttatataattcacataatatttcaatatgtcatttttcatcttttttataatatcttataaatctttatagttcatcctaactcctaacttagttaaaatatgctcctctctctctcctcttattaagttacatcacttcaattgttttgttcttagatgattatctatggtttaaattatctccctcttttattctcttattaagtcatatcattgatccttagttaaaatatgctcccctctctctctctcctcttattaagttacatcacttcaattgttttgttcttaattctcttattaagtcatatcattgatccttagttaaaatatgctcccctctctctctctcctcttattaagttacatcacttcaattgttttgttcttagatgattatctatggtttaaattatctccctcttttattctcttattaagtcatatcactgatccttagttaaaatatgctcctctctctctctcctcttattaagttacatcacttcaattgttttgttcttagatgattatctatggtttaaattatctccctcttttattctcttattaagtcatattactgatcaattgttttagcccttcgatatttaatctacggtccaaactatcttctttcttttctttctctcgtaaagtcatatcagcttacttttacatttgaatcatcattatacatactatttaaatttaaattattataaaccacattaactttcttaagattatattatctagtattctagctatatatcttacacattatttttacttagtaaactcccgtagtaacacgcaggatttcacctagttcaatatatgccaccagaggccacgctaccaagttactactagatgtcactagagctaattatccatttcacaactactagctagtaatactaattaagtatgacttaattacaattagagatgattaattattactactgctacagcattgccaacttcttaacattgatagggtagactttgtccggcgagttggagccgtacgccttgcgtgccagcctggcattcaccacgtctgtcgggtggagcccatcgaagaaggcgtacttggtcctgtcactgcagatggccccccccttctgacacagcacgcctcccctcgacacctcacagcaagctcgactcgttttcctgatgcctgagcaattataaaaaccatcaaagcaaattaggcacttaatacagctagctttgttgcttgcacgagtgatgaggaatgtttggattgatggacaaaaacacatgaataataatattgtaggaaaaagaaatatatagaaatatatgaataattaaaaaaacaacactgaaaaattaatatggacgtggttttggaacatgaattttagacttgcttaaaataaaaaaggtgtaatagattctttcaaggaattttttccctagatttgaggacattttttcccttgatttgcactagaataacaatagaatagataatgttaggaaagttttttcaagggattcttgatccattcctgcattccaaacagctatatagctaaaaagactataattttaaattccttttgtttttctttaaaattcccctaccaaatagaccctggaaatatcacgagaaaatagtagtggtaggaaaggaaaaggggagggtgcatcatttcactcataactaatttcttttgagtttcagaaatatatgatcgcttaattattaccatattttgccgggtgctgtattatatcgctaatgatcttgtaggaattgacgtagacgaagctcgcggcgggcatgtgtgacctcacgccaccattgtgatttttaacgatagatcttagcccagagttgaagaggagcgccgcatggttcatcggctcaatgcaagcatcactggtagcgttgaggaaggtcctcaccacaggggtgcaacccaggggttggatggagaatagcacaaacttccttgcccctagatcatacaatctctgaaaaaagtaaaaataagagtcataatttaaataaaacatgtacaaaagatatttattgtatctgttgattattatgtgtaatctcgaagaatataaaagggatgatatggagaaaagaaagactacagtaccaatcaatgtactatccatccaactactatgtactcttgcaatattattatgtcatgtacccttcacattcattacttctcagtctgagttcaaggtccacatatatatagctgcctgtacattttctccccagttccttctctttatttcacatgtaccaggaactataccaccatatccagtagttataattaattaacatgccatatctgtggctttaatagcaaatccatatgttatgggtacacaaagatatactcctacttaattaaggtgtgcattaaattaaggtggtactacctgcaggtggtttgagagcttggtgaggagtgagcttgtgaactctgacaagggggcccttgtgggcccactaccagcgttgaagtagttgagcaagtagtcattgccacctgtcccaatgataaacaggctcttgggcaggtaacactggtcaaagaaatcctggcccttcatcttgtgtccggtggtggtggtggctgtggttgctccctgcaggtgggcccgcaggtcagggagtgtcactgcctcaaagttggtgatctgctgctttaggctcaagacctctccctaataagattagttacagacacaaattagcaattaagctggctaattttacatcttaattcttttgaaacacaagaaccatacactttatttcattaagaaaaaaaagtacaacagagcaatttataaaaatgaaacctataaaaaacccatcgcaagcaatgcgtataaataaaactcctaaccatccatccaagggaagcaatctattttgatgcttagtttataagttgatttgaggtttctttatggcattatgtttctagttgtggctttcaaacttttaagaatagatttataggggatgtttggattggttccaatttgttttggtagtttcaaatagtgttttgttggtatttggattaagaccaaattttttacctagctagtaatatatcgccctacaaaatttgaccgcgtcaaaatttatctagattttaacactaccagtattttagtagggttttaaaccaaatcagcccataataattttaccaaaaatatgtcttgaaccttttttttcacaacttcagccttagctcaaccgaatagagcctcaccctcaaataaacgcaagcatcattacaaggaatgaagaagtatactccatccatcctaaaacatacgacgccgttaactttttacatattgtttggccatctatttattcaaaaattcaatataaatttgtaaaaatagaagttagattatagttttttataataaaacaagtaacaataaaacaaacaatatttatatttttaaaaaaaacaaaatgattgatcaaacattataaaaaagtcagcgtcatcgtatatttttagaacgaagggaattactatatagggacaattgctcatcaagtaacgcagaccttgttcttgccggtgaggtcgaggatgccggagccgccggaggcgaagttgacgccgtggagggcggcgcggccgcgggtggcggggtcggcgaaaggcgggaggaggccgccggcggggaggcgaaggagctccccgagggcgtcgatgacgttgcggccgttggagaagcggccggtggcgcccagcgggaagtcgacgccgtagggcgcgtagtcggcgcgcacggcgccggagccgttcaggtggttgttgttgccgttgtccaccagcgagctcccgaacacgaacaccgccctcaccgccgccgcccttgccgttgctccgccgccgccatggacgacgaagctcgcagcagcagcaggtttgcattggtggcaatggagatgcagcagcaggaggaagaggaagaggtagaggtagagagttgctccgacgagcttggccatggccggcaagctgatgagctagataatgtggctgcacaagatcgatagcatctgctacttgtatagcagaaggagagaattgaatgctactagccggtaggtttgggcactgcatgcacgtcgtggtttagtaattacagtttgggggagagagagaagttactgcgtgctggtttttagtatagcagcaatttatgcgggtgcaaggtgcaatactgcaatgcatgtacagtgtccttcccgcgaaggaaggatctggtgcacacaacggcacatgccatttgcccaactgtaatttggccttgttgagttcgcgaaaataaatattttgggtgtcacatcaaacgtttgatcggatgtctgaaggggttttcggatacaaatgaaaaaactaattccataactcatatgaaaacctcgagataaatttattaagcctaattaattcattattagcacatataggttactgtagcatttatggctaatcatggactaattaggctcaaaagattcgtcttataattttcatgcaaacggtgcaatcagttttttattgtatctatatttaatgctccatgcatgtgtccaaatattcgatgtgacgttttttacggggaaaaaaatttaagagctaaactaggccttcttctatcccctcctcccacttataactcgcaacagctggtctatatgcaaaaagtaaccaccgaaaacagtattttatcttaaatcatatttatagtagcttatttctagttatatacatatctgatgtgctacgagctaggtcttttttttaaaaaaaaaatcacattgatatgttctagggcacatctatattgtataaacaacatgtgctcaaggacggagaacaaggaaatgttcaagacaggcagtaattgcttatacactttgtatcttatttttttctataatttttcatagatatctaacacaaatcaagaagacaaatttagggctctggacttaagccctagttgttctgtcttatctcggccattgtgcattttgaccattgaatatatcaaatccatgcgtaagatctttggtggtgttcgattctaacgatcgagtcaagtttgcaaaacaagaaaaccatttgtgtataattaattaagttaaaatatataaaatttcaaaaataaatttatttaatattttatagtgacttttatataaaaagttttcgtacgaaactcactgttttacgttttacatgtttagaaaacatgttaatagaaatcaaggtagaaacaatatcttaatcataatcttaaggaaaatatgaatacatgaatgtagaactcaaatatttggagatatgtttcagattagggatggcaacagggcggggtgggttgggctggaatgcccctgcccccgacccccgacttcaccctcctcccccgtccccggcctcgaccgttgatgcagggccaaatcaacccccgtccccgacccctccggggccccgcaacccgaccgggcccccgcattggatagcatctccatccaatcagaaaaaaaatacaagacattcatcaaattagcaaaaacaaaaattgcacatagtggacacaccatcaaaaatagaatgaatcgtcggcatcgtgaatcgctggctgccgccgcgcctgtcccctcgctgggcgccgcgcccttgccgcaacctcgccggccgttgcgctcctgccgcaacctcgccggccaccgcgccttgccgcacgaccgggcctatgcgccaccccgtgcgtcgtttgcactgccggagggagaggtggaggtggactcgggagggagaggtaaaggggacgggatgggaggccagaggggagaggagaggaggggagggaagagggcgaccgacgaccggcgagattcagaggtgcgccatgcgccttgcatcgcgccgccgtcgtgcgccctgcgcaacgccgccgccgtgcgtgatgtggacgggagggagatggggatgggggagactagggagaggataaggttagggtttagtaattttatttatatatctcctttttttttgggttgggctgttttggatcttttatgggctatattttgagagttcatatacacttcccggggccccgcgagtgaaatgtctcccctgtcccctccccgctcaaatgcgggtctccggccccgactcccctgcgggtccaaaatcgcacccgcccccgcccccgtaggggcgggtccccgcagggggaaattgctatccctatttcagatcagttatcaacttgaacttggcactgcggctgatatcgtgtttctggcttttctgtttgtgtatgggcaactggccatcgcgcatttgcactgctactgtactgagctgaccgtgcatgcatatgcgctagatcgatcagtatcatgagtgggttaaattaattagggttactggcagctagctgctgctgggccaacgttacaatcagttccataaaagaaaaaaactcaactcaatctgttctataaaaaaaattctaaagattaatcgtctaaatataatttagacatagagggagcagctggtagctcgatcggtgacagatggtttaattcgcacattgaatgagaaagtacttgacccagaaggaagacgaaggaatagaaacgctttgtccgcaggtgttctcccttcattgaagtgtttgtctatgtgaagttccccttctcctggtcataagttttcagtgcacacatgatacagtgcaatgatgctctgggcgcgtctcatatggtttgagaacatctgacgttactgttcaccccgtgactgacatatgggcccgccactctcaggcccacatttcagccatcaagttagagggaagttacgtcagaggatctcaatccgtcttatatacatatagtagcatttattttactgatactgatagaagagaataaagataaataaatatgaatagtctctttgtgggtctcattgtggaaaattctaattgttgtattctgatgttttctgatctattagatggaccctctcatagagtatatataggagtacagagacttggagtataatacaagtaagagtagatttatctctaggattctatctctagtactctatcttatctataggatatatcttatctctatatttgtatttgactcttatccctaaccgacatatccatacttctaacactcagagtagtagctagatcgagctcacagtaagctataagctcataaaatcaacacatataatatgttaactatctctttctctcactttaaatatatttatcttcgagtatatgtagagctagctattatataaaggccaacaccttttattttttttatatctctcttacataagcttatatctgccttatagtccaatattatccttgctcttagatcatctctatgtttgacttatcatccattgctaaaatttatattttaaaaccaaattttagagttaactttgaggggtttttttattgtaaattactttcagcattgaattttaagccatgaataatacatatataaaaattttacctacaaattattttaaagtcaacaccaatagttacaagatccgcaagcccgtccagacgaagaggggcaagaaaggtgggaagaaggcagccgataaggtacagttcgaagttcttgcgaagaacctcatcatgagactcggacatttgcatgatgtcgatcatcttgtcatactccttgtatgatgcatgcctatacgagtgctctgcatggcactacggtggaaggtggagagtgtcttcttgatcttctctgtgtccatgacaactttgccacagagggagaggttggtacaaatccggtgcagtgtggagttgtagccggcaacgctcttgaagtctgtgaacctcaggcgagcccactcctgctctgcttggggcaagatggtatacttcagcttcttgaatcgcttcttgagtgaggtccaaagagcgagtaggctctttaatggctcaatcccatttcctcattcttgagcatggcgcatagatgttgtcataggaagtgcaaggcctcatcgttctcgtcagggataagcgcacgatcttgcagtgtgcccatccagatcgtctggcaaagcttcttggccctgaggacactctggacattggatgcctaggttaggtagttttggctgtgcggggctagataagcgaactccttgttcgtgattcctgatattctgttgcaaagtgataaaaaattcaaaagtaactgctagtaacatgcttgcaaatacgaatacaaatattttattattttttccaatacttctatgtaggaaatgcgaattattcaattaaataaatacaataaagaaatgctagagttcatacaaaatatatacaaaagaagcataaagtgaatatattcatataaatactgaaaataaaatttttaatatcaagtaacagtaattaatgcctcaagtatgaaaagacaagttcaaattctaaattcgtaagacacaatatgctcaaaaacgaaatataagcgaaatttgcaaaaaccaagggccgttttctaagtttccatgcggtggacggttagaaatggaagtttccgaaattctagtattgcgcaaggaaactccatgctgagagttgtgggtgtgattttcaaaaaaaaaaaaaataataataaaagggccttttgcaaaattgccaatttcattcctttctctcttgctctttcctttccccattgacctcctcagcgtggcgctgcggcgaggcgaggcgcggcgctggcacggtgccaaaaacctcaatcggctagtgccgatgactccaagtccgcaatggtggttttcgtcggaagtcacataaaaggaacaaggaggatacaacaaggaatttatttttgaaacccagtatacaagatgcaaagtggattttcgaggttttgaaatttaatgtacaagatgtaatgacttaataagactcggcccatgccggtccagcccgaagcccaccgtgctcctccttacaaaagtctattttgcctccctcatctcttttgggccatctcttatatggctatagtaagtctattttgcatcccttatgtccccttgtatggctagaataaaactattttggcgctctcataaaataaaaagtaaaccgaaggtccctcaacttgtcatcgagttacaaaattgtccttgaaccataaaaccggatatgacgcatccctcaacttataaaaccagtgcatactagatccctcgggggttttgactccgattttatcctatgtggcagctgacttagcgtgggaccacgtaggccccacgcgtcagcctcttcttctctcccctctccccctctcttcctctctccccacgggcagcggctggcaggcgcaggtggcgtggggagcagctgcacgggcggaagccggcggggaacaattgggcggcggtgcacgagctcctccgacttgctgaaagagcggaaggccaacgcggcgacgaggggtgcctgcgtgacttcctggagagggcgaacaaggacggcggcacaacgatggagtacagggagcgcggcgtgttcaacgcgagcgagatggtggtggagatacagagcgtggaggctatggggaacaaggacctgttcgtggttgggagatcaccagcatgcattccgccgtgctgctcatggtcaccgctgttaaatatgtgatccgaattttgggcccacaatatattcggattagtttcctagtaggagtcctattaggtgtctttcttttataccctatatatactcttgtaagccgtacgggaaggggtgacgttcctattgtgattcccctacgtttgtaatcatctcctctatagtgatcattgccggtcggcgcccgtggttttttcccgcaagggttttccacgtaaaaatttgtgtctccgttgtgcatctattttcataacaagtggtatcagagcattggagatcgttctactattcccggccaccggcgattgtttctcgatcgaagaaatcgatcttatcggcggtggcggcggctcccgtcgtctcgtcgattcccagtccgactcagtgtttcttgtcctcgtgcagaggagaaaagccgcgcaagcaatcgaagcagaggagtactactgcagcgcacgcgcaccgaggaaaagtataggagtatcagccgagaggtctgtctagtacaggcggatttttcctataggcgaatttgctatacgcaccaagcttgtgtacccaggagatctacatacttcgctacgtgcacacgagaagtgtaccaggtttcgtgtttttgctaggtttaatttctttctagcaaattcaggattaattcccatggcgagtttgaagtatgatctaccgctcttggaccgagacacaagattctcactttggcaagtgaagatgcgagccgttcttgcacagcaagacctcgatgatgcgctttctggatttgacaagaggacacaggattggtccaacgatgagaagaaaagggatcgtaaggctatgtcatatattcatcttcatctatctaataatattttgcaggaggtgcttaaggaggagacagccgctgggctgtggttgaagctggaacagatatgcatgactaaggatctgaccagtaagatgcacctgaagcaaaagttatttttgcactagttgcaagatgatgggtctgtcatggaccatctctccgctttcaaggaaattgttgctgaccttgagtctatggaggtaaagtatgatgaagatgatttaggccttattttattgtgttcattgcctagctcatatgcaaacttcagggatactattctttatagccgtgatactctaactttgaaagaagtttatgatgctttgcatgccacagaaaagatgaagaagatggtaccctctgaaggtttaaattcacaagcagaaggcttggttgttcggggcaggcaataggagaagaacacaaacaacaaatcaagagataaaagttcaagtagctaccgtgggagatcaaagtccagaggcagatataagtcatgcaaacactgcaagaaaaatggacatgatatctctgagtgttggaagctacaggataaagacaagagaaccaaaaaatatgtaacaaaaggtaagaaagaagaggaaggtaaagctgcagttgttactgatgagaagtctgatgcagaattgcttgctgcttatgttggttatgcacaaactagtgaccagtggattcttgatactgcatgcacctatcacatgtgcccgaatagggattcacatgtgcccgaatagggattggtttgccacctatgaagctgtgcaaggtggtattgttttgatgggtgatgatacaccatacgaggttgcaggtattggaacagtttagatcaagatgtttgatggctgtatagaacattgtcagatgtgcggcatattccaaatttgaagagaagtctcatctctttatgtactcttgatcgcaaagggtacaaatattccggtggagacggaattttgaaggtaactaaaggctctcttgttgtgatgaaagctgatattaaatctgccaacctataccatctgcgaggtacaactatattaggtaatgttgcagcagtttctgattcattatctaattccgatgctactaatctttggcatatgcgtcttgggcatttgagtgaaattgatttggcagaattgagcaaacgaggattgctagatggacaaagcatcgggaagctcaaattttgtgagcattgcatctttggcaagcataagagggtgaagttcaacacatctacacatactactgaaggtattcttgattatgtgcatcctgatttatgggggcctgctcgtaagacatcttttggaggtgctcgttacatgatgactatcattgatgattattcgtgaaaagtttggccttatttcttgaagcacaaatatcaagtttttgatgtgtttaaagagtggaaaactatggttgaaagacaaactgaaaggaaggtgaaaatccttcgtactgacaatgggatggagttctgttctaagatatttaaatcatattgcaagtctgaaggcattgtgcgtcactacaccgttcctcacacacctcaacaaaatggcgtagcagagcgtatgaataggacaattatatcaaaagcccgttgtatgttgtctaatgtagatttgcctaaacagttttgggcggaagccgtttccactgcttgttatcttatcaatcgatcacctagttatgccattgataagaagactccaattgaggtatggtctggttccccagcaaattattcagacttaagagtatttggttgtactgcttatgctcatgttgataatggtaaattggagcctagagctattaagtgcatttttcttggttattcgtctggtgtgaaaggctataagttatgctgtcctgaaaccaaaaaggttgtgattagtagaaatgttgtcttccatgaatcagttatgttacatgacaaaccttctactaatgttcctgttaagagtcaggagaaagcaagtgtgcaggtggagcacttgatcagttcagggcatgcaccagaaaaagaagatgttgctattaaccaagatgcacctgttattgaagattcagattcttctactgttcagcagtctacaaaacgttctattacaaaagataagcccaaaagaaatattaaacctccttgaagatatattgaagaagcgaacatagttgcttatgctttgagtgtggcagaagaaattgaaggtaatgccgaaccttctacatattctgaggctattgtttctgatgattgcaatagatggataactgctatgcatgatgagatggagtcacttgaaaagaatcatacttgggaattggtgaagttgccaaaggagaagaaacctatccgttgcaagtggatcttcaaaagaaaggaaggtatgtctccaagtgatgaggcaaggtacaaaacaaggttagttgctaaaggttatagccagattccaggtattgatttcaatgatgtcttttcccctgttgtgaagcatagttcaattcgcactttactcagtattgttgcaatgcatgattatgaactagagcaaatggatgttaagactgcatttttacatggggagttagaagaggacatttatatggagcaacctgaaggttttgttgttcctggaaaagagaacctagtctgtaggttgaagaaatttctttatgggttgaagcagtcacctagacagtggtataagagatttgactctttcatgctttctcagaagtttagaagatccaattatgatagctgtgtttatctcaaagttgttgatggttcagctatatatttgcttctttatgtcgatgatatgttgattgctgcaaaagacaaatcagaaatagcaaagttgaaggcacaattgagtagtgaatttgagatgaaggatttgggtgcagcgaagaaaattctcggtatggaaattactagagaaagacattctggctagttatatcttagtcagaaaggttatattgaaaaaattcttcatcgtttcaatatgtatgatgcaaaaccagtgagtactcctttaactgcacatttcagattatcttcagatttatgtccttagtcagattatgatattgagtacatgtctagagttccttattcaagtgcagttggttcacttatgtatgccatggtatgttcccgtcctgacttatcacatgcattgagtgttgtcagtagatacatggctaatcctggcaaagagcattggaaagctgttcaatggattttcagatacctacgtggtacatctagtgcttgtttgcagtttgggagatctagagatggacttgttggttatgtggattcagattttgctggagatttggataggagaagatcgcttacaggttatgttttcactattagaggatgtgctgttagttggaaggcaagtttgcaagcaactgttgccttatctactactgaagcagagtatatggctatttttgaagcttgtaaagaagctattttgcttagaggtttgtacactgagctttgtggagttacgtcttgcattaatatattttgtgatagtcaaagtgcaatatgccttacaaaggatcagatgttccatgagagaacaaagcacattgatgtgagatatcactttattcgaggtgtgattgctgaaggtgatgtcaaggtatgcaagataagtactcatgataacccagctgatatgatgacaaagccagttcccgctactaagtttgagctttgctcaagcttggttggtgttacagtatagtcctagagactatttggcgcgcggtgattttacctacatgaggtattttttggtgattgatgtttttatgctacaaaaggaaattcgtctcaaggtagagattgttaaatatgtgatccgaattttgggcccacaatatattcggattagtttcctagtaggaatcctattaggtgtctttcttttatcccctatatatactcttgtaagccgtacgggaagaggtgacgttcccattgtgattcccctacgtttgtaatcatctcctctatagtgatcattgccggtcggcgctcgtggttttttcccgcaagggtttttcacgtaaaaatttgtgtctccgttgtgcatctattttcataacagtcgccatggcctttgcggtcttgaaggtcgccgctgttgtcggtgtccatcgggctgctgctcaacaccaagtgtatcatcgagctcgtcatcctcaacattgcaaggaacaaaggggtaatccattagttaattacttaatcgatcgccatgcgatgcatgtcgtgattaattaaggctaggtagctgcttgtgttgtgtagatcatgagtgaccagtcgttcacggtgctcggtgctggtgttcgtgccggctctgaatcgctgatcacggcgatggtgagccctttcctcgccatggtggtgaagccgccgcggcgcctcgtgttctacaagcggcgcacggtggcgtgggctcacccggaaccagaatcggagctccgcatcctggcatgcgtccacgtgccacgtgatgtgcccgcgctactgacgctcctcgacgtggtgacgccgtccagccggtcacccgtcggcgtccacgccctccacctcatcgagttcgtcggccgctcctcctcatcaacgcatccgtgtcgtcgtcgtcctcctatgacctacgacgcctccgtccacgggctcagccacatgaagatgcagttcaagcacatctcccacgccttcgtggcgtacgaggagcaggcggtgggcgtgtcgatgcgcaccatggccgccgtcttgcgcccgtgcagctcctccccccgccgcctgcgcccggctcctccccacgccttccgcgcccgccggcggcagcccgtgcagttgctccccactgccgcccgtggagattggagaagagaggagagaggaagagaggtggagaggggagagaaagaagaggctgacgcgtggggcccacgtgggttccacgctgagtcagctgccacataggataaaaccagagtcaaaaccgccgagggacctaatttacatggttttgtaaattgagggatacgtcgtatctggttttacggtttaaggatgattttgtaactccatgacaagttgagggaccttcggtgtactttttcctatattttacttccctgacccagccggcccatcgtgccgagacagaggcacagatacggcccaaaggtcaggcccagggcccagggcctttcggccgacaagagcactaccaccgatccgacgtgtccgcccctatcaccgaccacgcgcgtacacactacatgatganctncttgcagtcgagcgcgagtcacgaaatccaacgcg

SEQ ID NO: 80056 - DNA, 31390 bp, Oryza sativa
cctcctcctcctccaccacccccaccccctcccccgccgcagccgccgccgcggggcagaatgcgaccaccgccgcgaaggcaacgacgaggacgaggaggagacggaggaggcggaggggccccgcgcggcgacgcggcagcatcgccggagaggaggggagggggagagaggggtttagattgtggaggcgggtgtggcggtgcggtgtgcgtgtgagtgcgcgtgtcgggggggaggaaggagaaggagagggagagggaagaagaaagcgagagagaaaaagcgaaacacacgcgcacgccaacggggagaggcgagacagaagcgtgtgagatgcttacgtgcagttgcagcgggattggatttgcggcaatatgtagggggggtgtgtgtgtctgtattgagatctgttgctaatgggattggcgacctaacaatttcgtttcatttcttcaccaatttttcttttcttttttgtggggagggttttgagggcccattttgttgggtgtcatggtagtacactcccttcgtctgacaaaatatcaacatagcactggatatgacacattctaatataacgaatttggatactaaaatgcgttacattctgtattaggctggtatttttagatggagagagtatgccggtaagatttacaaacgtgatataggggttcatttgttcagtgacaattgttttcagttgaaacaattcaatttttgaagagaacatcagagtaaaacagtgtataaaaaaacataggtattcaccttagggcattctcaatttctcattattgagcaacagttttttagaaataaaacattgaacaacagttagattttttcttttgcaaaactaatcgctccattccaaaatatagctatgaatttagatagtaccatatagtagttactttaactatgaatctagataattgtatatattcatagctacattttgggataagggggtatgcttttagtttgtcataaaaaagttacaacatattcactttgttacaaaattcttcattagcattgaagaaatttattaccattccacttttaacacttgttcagattcatcgttctaggatatgttacatcttatcttaagttgattctttttgatacagggaaactagtttcaatagatagtttcctcttaccaaactaagcaagcgaaatgacttttatccagaattggttcaacccgtaaacaagtttagaatgtggcatgcttgttgcgcttgttgccccaacttaagccataatatattgccttcatttggctgctcaagcttaaaaggcatgtcatagcaacataatacaactcgtcttactggtgctcttgtcatatccattttgagtcatttgttgctttttttttataattggttggttattcgttgatgagcccaacgagattactttcatcaaattatcacaatgtcatgcactcctcattcatcacttccagacgagaagctggaggaaaggagggaggatcatgttgagaatggcaagaagcaatggattcaaattaacattagttgcagcttggagtgtcaactatagtatgagagagatgtggtgacaagaacaacaatgagatgaccaaggggctgagtgagtatttgactttgatcgaaaatgcataggaggagcaagaaccatgcatgaagggtgttatcctaacatagccatagtaaaataacatgtgactagtgcatatcaaggtacgagacggaatagaagataactatagtcaatgaaactaacgagtcgatctttattgggcttgaaaaagaggtgtggtcaaaccgaataatcttgtaaatggctaggctcggaaattagcattacactcaagtcaagacgaatgaaattactcacagagttgagagctgtcatcaatgtattgtgattgtgaaaaacattcacggttagccaaaaaagaaattccactattattcaaagtaaaatcgatatatctcgatggtggtgattttttccttttgtagatcatatcctccgcccattctatgcactgttggaagtttgtacggaaatatcgtttaatttgcttcttacgttaactagctgtatgcaaatgcaatgtacttgaatgcatttttagtactgctggtcattcaacgtaccagctgctataggatcattgtgtgatgcaatgctacaccaccgtacaaaatgacttgtacgacaccatgatggaagactttttctaaatgtatcatctatatactcctttttagagaaggccccacctcctctgccctagtacatttcttttatcagctgctccttaaagtttttcaagattaatactaacacttttatagattgcatttctattggtatctaaaatacgcatagcgtccttgcaaacatccgataaaatacgaattttttatctaaaatacacatagagtctataaagataccaaattttcatgtatatcactagactgtcataacaaaaccaacctagggttctataaccaatgtttctctaccgatgcatgggttttaattaccagcaccacacggtaagacaattaccataataaccatgcaaaaattcaacttcaatttattttttcttaaattagcttcaatttgtttttaaatcaacaatttcaaacccaagaaacgaatactgtcgaggagcgatcctctctagcgggaggtcgtgagacccccctttgtgagtttgaccgggggataaggcgcgatgatcaagagcgtatctccgcttagggtctagctgctagatcactagcgaatctgtgtggaagacgagggattatccagattcgggccgccgggaggcgtaataccctactcctgtgtgtggaattatggtggagtccttacaagagatcttgtgctccttggaaaccctagctgtgcttcctctggagctcaagctatcaagagtcgtccatttttttcggtgggcaaggttctcattttatagtttaagaggatactacatgcaccgttcatacctatccctccatgggggggctcacttggcctgagtcagatcaccatccgtgccttcaactggaagcaaagtggttgtccgccgccaggtgcggcccaacgccgtcctccgcctgacacgggggacatcccttccattccctcttaaatgtatggagactttggtggattcaccatgtacatggggcgcacttggcagtgtgccgatgggacggggcatatctacccccactccacctgacacagggtgggacgtgggggcactatcgcttgtcctatccgcctgcgatctgtcgcagaccggtcaaggtcgattgacatgcgtcaatcgggcggcaccgcacgtctgcccacaccacattaaatgtggtaagagatggttggggcgccgcgcatttaagacgctggatggcaccgcctgctccgtccactcactccgccacgtggtggccggtgagggcctcgaggcagtatgcctcacgggcccgaggggtgtgacgtggcgccccgaggccccctggccacctcataaccacctgacctccccccgagggggtggggaaaaggcaggccgcacggccacgtggctagatgggaaggtcattcccctctaccatgcgtacccccggacccatatcaccgacaaatacaataagaaagtactccctccggttctataattcttgacgttctataattctataagcgaaaacttcttgtgctattttttggtactgtttttttctgtgctatgaatcgaattttcttaaatttttttatcaagtaaacaggcccatatttttttccaaaataactgtatatctttccgtgccccatgtatggtctgcagcgacgttacggcgtgtacctcccaccggctggcctctgggtgcattgccttcacacacaccactatcgatatcccctgcaggagtccacttccactggcaggcagttgcacgagcactctaccaattcaataataatcatcaattcatcatccccatgcataatgactctagtacttcctctttattcgtaaaggaaatcatttaggacaatatttaagttaaatcttaaaaatataaatcatgaataactctcaagttattgagtttgaaaatgtaaaaattatatgaatagatttgtcttgaaaaatactttcataaaattatacatatatcacttttcaataaatatttttatagaaacaagaagttaaagttatgttttagagaccgtgtcgctgttctaaacgacttcctttacaagtatggagggagggagtactagagtatctacgcactataaaatcatcgcaacgatctccgaacccctattattggccgcataggtatatactccacaatctggtcacactagcactagcagtagctcagcttttttttttttaactccggtagctcagtttggtcatgtttgaaggagtttatgtctgactaaaattatttttttaaaaaaaaagtctttagctccttcaaacggtacaggtttttacctagaatataatttaagaatttatagttgcagaattcgaagaataaatttaaaaatcaaaaactgggaaatatttttatattcctattaagtgtctatttatctgcttctctgaattttgagctccgtagatataaccttattcggtccttctccaacggtactagttgggtgggagtggtggagagagggagacgaccaaacacaatccagcttttgggtggagggagatggcttgatgagatttggctgtagatgcagggaaaaggaggtagaccctttttgttggcactgtcggctctaatggaaaccttgaattatttaaggagatcatgtcctcatgtggcccctaactattagccttttcgtaaaaaagcatgcgtgaagagcgttacatagaaatagcagctgacagatgaaatcatacatcaaacccaaattttttatacctcgataaagaggacagattgttcctatttttttatactaagaatggaaaaaaaacacttgttcaagaggaatcagactcgaaaaccttacacctgctgttaaaggagatcaaacagacaaatggacaaatccacgtcaaccaagttagacctagtttcagtcatgcaaaattacacatctaaaaaggaccgtgttacgtaaatgtgtaattctagaggagggcaccagtttggaacacatgaatttcacgtgatatgatttactcctatcactaagcatgtgcttggttcaaggaataggatgtatcggcatagatcaaacacatttttcagtgtcattggtttaaggacacgcatgatgagaacggtccctaaaaagaatattctcataagacccaggtttaattgacgctatcccactaaaatcgacaaactaattaacccaacccacttagggtgtgttcgctactccagtttccccgcatgcacagtaaacacggaaaacggagtagtccattagcacatgattaattaagtatttgctaaaatttttttcaaaaatggattaatttgatttttttaagtaacttttgtatagaaacttttttttataaaaaacgcaccgtttagcagtttgaaaagcgtgcgcgcggaaaacagagggagatgggttgggaaaaaggagttacaaacacacccttggggcatatttggtaaagctccatctccagcttagcatcgttctatctctcatactagacggataaatagaaccgtctcataattaataaacatggataagtccatcctattctaccgcgtgtccaaaataattaaaacacatgcttttacgctttttctgatgtgcgcgatacaagttggccaatagcatcgtgtatatgctcctccagccttggtgggattggatttggagcgaggaggcgatatcagttgtctcgccaccactccagtccagtccagcaggttgtggttcggccgcggtccacttcgctcgcgatcgtggcctggccgtcgtcaaattcaaattcaaacccccaaaaaatataaccatatatcggacgaaaaaggggggattttgttcagacgtggtgtgtttcatctttcaacggatgattgcatcacaagggaaaatggaggactcgcacaaaaaaaaaagcacagatacacgtcctttttgattgggttgtggccaaccttcctctcgctttctctgcctcctgttgccgtgaaaactgaaaagctcactggtcagtttgatctcgcaccgtactagtactactttactttggacgtatagatgctgcttgcttctccctggtgcacggagacaacaagcaaggctgcaggacggatggagtactgtttactcggttgtctcgtccgtcctagccagtgaacgagcggcacgtccaagcgtagggtacaagtatacacgtacggtgacaaactttgcaaaaataattataccggattctcgacatattatagtctaattttcaagtaatacaataattaatataacttaaaatagctagaagtagtaatataatgattaatatgacttaaaatagctagaaatagagataagctattcggtatctgagaactgccgtcactatactcaaagtgctatacaaaagaaatagattttttcttaaacatcgaatctatgttatcaacgattattatgaacacgatttgagtagaaatttagagatatttacctttgtcctatgtttcatatatcatatatgtcttagctagacctatacttatgtggcattcttctctaataaggtgaccgctagaagaatcccctccacgtttgcacaagtcggaacctcggtaaaacccgtgtatctctgtagtggcatacacccaacttcaatcgaagcatgcattgtcccccctccccttcccttccattcaacccaacccaatcgtggaggggaaaaaagggccaaccgatgatgacgacctcgactatggacgctgtcgtagggcactcctgtcacttgagctcgatcagtggcaccaagcttgagccgccactgccaggaggaaaggggatgggaggaagcagagagacgagaggtggcaacgaggagggggcgaaggccggcactcgaggagatggagaagggaggaggcgaaaaggaaaccaatagagaggggaggaggcgacaagagaggcggaaatggagatcgatctgctggggagagaattagaggagagagagggcggtgagggagaaaaaaataaggtagggtgatagtgggtcagcctataattaacggtatgtatgtatttttgatgatgttgttatagcgtctaaattgtaaaagtttcagttaatttgtgttaataaaaaatatgagaagggttggcatacaagaaatcaagagccaaaatgataataataaaagaataatgagtactacattcgtcccaaattagtagtcgctttgacttttttcttgtaacgtttgaccattcgtcttatttaaaaaattagtgtaaatataaaaatggagaaatcatacttaaagcactttgataataaagcaaatcacaaacaaaataaataataatttcatattttttttaataagacgaaaaatcaaatattataaacaaaaactcaaaacgacaaatattttagaatggaggtagtagccatcatcgtaaagctatagcaacctcgtcctacatagtgtgatgtgacacaactatgaatattacactaggaatgcccctattggtgagtgtgtgctggtagggtggatcaagaaaaaaagacaatgttctatggtcaggggtggagcaaaaactctaataacacggtccatgcctccgcccatttctggatccggcccactacggttacatctactaccaataaagcatcatgcgaaatgatttacgagaagggaacagtttagggtcaattgaaagactgttctttcggcccattttcaacttgcaaaagatcatccacattccaaaaggaatgagttcacttcaggtccctcaaatttgtcgtcgaatctaatattcatttctaaaccgcaataccagatataacgcattcctcaactctcaaaaacaatgcaaataaaatcaaagacggtttggatggtggttttaactaacacgatgtttaaaatgagaaaaaaatggtgaaacccatatgttagtgacggtccaattaaaagtaaaaaaaaatacagtgggactcgcgtctccttctccccaatctccccatctccgcggcgagcaattgggggtcgctcgactccaaggcggcgtcctccaacctcaaggtatcacctcccagccgatggcacctccgatagatctgctagcctcgcctgcttcactctcaaatgattcttgtcttttgtgtttttcttagccataggaatgtccagttctagatgattggtaagtactttgggactctgcgctgtagtgatgtgtaattgatcgtgaagttgtgattactcgtttgctattacttgattcatatataaaaggaaattgacattttggttttcggtgttggtggccaccagattctcgatcattgatggcaccgcccccttcgggttgacgatgttatcacgaagtctcttgttggaggagtcgaaaccaccatccgaaaccatccaaaccatattgagatcttatttgcactggttttaggagttaaaagacgtgtcatatttgttattgtggttcaaggatgattttcagactctgcaataaattaagggacctaaagtgaacttattccatccaaaaagagctgtcaccttgccaatggaaaaagtacaccgaaggttcctcaacttgtcatcgagttacaaaatcgtcccccaaccacaaaaccagatatccagcgtcccttaacttattctacgtggtggctgagtcagcatgggacccacgtgtcagcgtgaccacttcaacctcctctctctctcttttccctcttctctcctttcctcgtatttctctcccttctctgactcagcaggcgggaggagaagggcgtcagcggccggcgatgggcgacgcggcggctggccgacgcgagggagctcgtgttgtcgttgctggagaacgcgacgggccgacacgagggagctcgtgctgtcgttgctggagaacgcgacgggcctggcgacgctgttcgacgcagcgaagcagcgcccctacgagacgggtcccgtggggaagttcgtgaaccgggtggaggtgaaggcggccctgggcgcgcgtggcgatatggagtgggaggagtgcagcgacgcggtaggcgcggcgatgcatggggacgtgatgaagagcgtgaagccgaaggtggaggcgctgctgcggggaacgcgcgtgctgctgtaccagggcatccgtgacctcagggacggcgtggtgtccacggaggcgtggatgcgggagctgaagtgggacggcctggccgtcttcctcgacgccgactgcgccgtgtggcgcatcggcgaggagctcgccgggtatgtgcagcgctccggcccgctctcccacgtcgtcgtctacggcgccgggcacctcttgccggcggacaacggccacgcggcgcaggagatggtcaaggattgggtgttgcaggcggggctattcggccgccacggcggcatgaagcgcgcaggctgactccgcactcccccggggggggggggggggcgcaacctgtggcctcatctctcgcggtgtcaaactctaatctgatttgagaatcgagcagagtaaatcgaggaatacaattcccgggaaatacaagcatttgagtttataatggttcttctggtgtggttgaattcatcgtggtaaacttccctggtttcattgggattatttcctccagaaggtagcttatccgggattgtttttgttcagtccaagatcagagggcaataccgaaggatcactttgtaccaaactaccaatgcagtattcagtaacaaggacttaaaagcaattcgcaaatctcagaaacacgaagctcctcatttcgaccagaaaaaggcccattttgctctcttgtactctggagcagggtttacgaaaacgaaaaaaaagccaaattcatcgcgcgggcggacggcggggggaggagcggtgcgcgggctcccccgccggccgccgcccactaggcagaggaacggtggccgggggaaaggagtggcgactggcggagtggagttgggcggcccgtccgtccctgccgccgccgccaacgcggcgctcaccatcacatgatgtcgggcgcccaagacccagcggcgggggccgccgccgccgctgctggagccatgcaggacagcttcttcctcggctcggccgccgccgccatgttctccggtgccgggtcgtcgtcgtcgggcgcgggaacatccgcgggagggggcggcggcggtgtgccccttctacgaccaccccaacccgccggcgccatgcccgtgccctctctgccaagcctggggctccctggctggcctcgatgaccgcctctccccatctggcgccggctgcatcgagaagagaggagaattgaagaaataaaagaaaagagaaaaaagacaagaaataagagaggatgatgatgtggcgttctgacatgcggggtctacatgggttccacgccaactcagctgccacatcagacaaaaccagggtgaaaagcaccaagggacctaaaataaatggttttgtaagttgaaggatgtcatatatctggtactatctggtactatggtactatgattagaggacgattttgtaactggacaacaagttaagggaccttcggtgtactttttccccttgccaagaaggcatcaaaacagctcaggccatctttaacttaggcccatttcctcacaccccaaaaggcccatccagataatggctcagatgctcagttcatctcatctttcctcgtacacacgaaaaatctgcacgcctctttgcaaatttcaacccttcttttcgaatgcaatttcatgttcagatcccacctacaagagctcatttacaaagaacaatcaccggcaacttttattccacgtgcatggctcccaacaaattctgctcttaacatacaaaatgtgtacacgtactactacatacttgtacagccaactgaactcctgcaattacatcatattacaggataatttcgaccaattttttttatgttctctccctcttcttcaccatctcaacttggccgggaaatactgcgagagaattcagagagaaaaagaagatcatttcttcaggttttaggacaaaaagaagtctgtttcaagcttcagtattcgctgcaaaatcgatcataccttttcgatgagtgacatgtagtagggcttcaccttctcaacgtctatcctctcattgctcttgctgtacaggtcgtatttgctgcagaagaaaaccattcatgttcagtacattttcatactatatacattaagatgcagggtgatcaatctggtggcttacttgaacacacgcagccatttgaggttctccttgtcctcatcgttcatcagatgcatgtaggctccatgcttgtgcagggctgaatcatggacaaagatagcaaaatttagctaaaacttacttaaaacttgtaattctgacaaaattgaaaaaaagaagactgtcgcgcgcacttacggtagaatgaatgatatctgatgatgaacaagcctgcagaaggaagagtggtcttgttctccttggcaacctgagatgaacaagaacaagaaacacatcaacatttcagagaaaactacaacctcagtactagaactgaagatttctctgctccatggtatgcaattggtgatgaatcgacacgatgaaccgtgtgttttaccaggtacatgtagtcgtcatggccccaggacatgagaacattgtcaaggccacagccctcggagtaggccccaaacttggtgttgagctttgggttcaggtagtcagggttctccttgaagtactgcacattttcagacaaaatattttcagtttcagtcttagaccactagctcactgcttgatccatctacgcttttgatttgtcttgaacagtttgctagatgattcattggttaccttgaagtggacgttgcattcgtcgaatgcgcagccgacggggaaggtgtcacctgaaaggtcaaagacattcagattcagagatggatggatgttcagctattgttcctagctgaatctgaagaagtttcagtgagatggcaataagctgtttgcttctgttgtttgtttcttaccgacgactgaccactgtgggagctccccaaagctgggatgcagcagcaccttgcccagatctgaaaaagaaaagagaacatgttacacgtcacaagtgtgccccactgtattgccatttcatttctttcttcctttagccgagtaattccaaagaggttgttacgaaccgtcactgatactgtatcactccatcatatctaattattcatctttatttatcgtatggcctacctgctagtgactggatgagtcctagatatatactattattactaccttagagcaagtttaatagtatagcccactactagctccaattcatctatagctaatctaatagccaattcattcaatagttgcttactatactattaatatatggtatcacctgtcatacacacattgcgtcttgaagtccgtgctgcagctggctacagatctgtagcccactactcttctctctcatcgtttatctcattaaaatatatttatagctggctaatagcctgctattgtacctgctcttacaccaacaaatcctacccggtgtatcgtgtgaggcctgcctatcagttcattgcggcgacgcggtggatgtgcaattacagtgacggtttttgtggcggttataaaatagtttaatttaccgtggatgaggccagtgaggtggagccagtcctcgtcggggaaatccttgcggatggcctcggcggtctggaggaggtgctcgatctgcggcatgtcgaggtccgggtcgctgtcgtcgatgaactcgttgagcagctcgatgcactcccagatccccatctccgtcttgtccaccctaccgtactcctcccgcatccgcctcacctgcaatgttacaatgcaccaaaataatggtaaatctcatatattaaagctcccgttcttttttacttgtcgtttaggatattatgagtgtatttttttaaaaaaagattattagatacagaatttgcacttacgaaatcatatgtctggttgatgtggttgacccggtagaactcctccaccgtctccttcctctcagactcggcctcataattcctggagatttaaaacatcaccatattattccggttaattccttttttttaagaaatatcttttactaccaccgttgaaaaagatttcaatttctagattatgaccataaggtttttatttttcgaacacaggtagtgttttatttgtccacgtgttggactttttaaagaaacatcaaattgaagtacagaattcctgaagaagcgaaaatgataacgtgcaaaaaaggaataggcaaaaggccatgttaatgcagccacagatgccacgtgggacattcactgtgcatagacacgcagaaacctttgaaatcgtacaagaaaagataagtctttattttattttatttgaccagtaagtagcttgccactttggtcagcaaaattgagtttacgtttaagtagtcaaattcatcttcttcttgtccagttttatctgaaaaaaaaacaaaacctgggtttggacgtttcaacaaaaactaaaccaaacggctaatcatggaaagacaacttgaagtaatgggacaaacatgtattgtggcttgagagagaggtatgtacgatttgaatgcacaaccacaagtttcaagaatggccacacatctctttcatttcgagttgtgcccatgttctagtttactaatttcgtacgaaaatatcatgtctgtcttgtcagcctgctcgcattgtcctaaaaataagccaatcattctaatataacaaatctaaatataacgttgtactaaaatatatcatatcttaatacgatgttggcttattttagagggagcaagtaataccaacctctgtttttgcaaaggagaaaaaagaagacattccatatgcaaaatatatgattatttgcacatgtccacttgaaaaaaaacttgctgcccactctgttttttgcaaagagaaacaataaccttcaccatatttaaaaaaatactacatgattaattaaattccctaatccactagaaatattttaaatattttttcttctgaggggataatatttttaaccatagttgacactctgttttgctctgtttttgcatgatgctctgtttttttcctatgcaggaatatgtagctgacctgaaggcgttgccgaaggcgttggagtccggcacgacgaagccgccgtcgagcacgagctccgccgcgttgtcgccgccgccgccgccggcgaccttccggtcggcgatagcatctgcaagcgaaccatgtcagaacttagaaccttaattagttccacgatccatccatccatccaggaacattgctgaaccttttcttcctcacggactggaatcaagaaatcaagagagagagagaaaaggatcatgagctcaccaaggtgaggctgctcaatggtgatggtcatctcgatctaatcactctttagacagatcgatggtagccacaggggtgctaattaactccggtcttagttcttaaacacccaccccaagcctctatgtatctcaacgccaagaacagaggtgcatgcaggtcgaggagcacggcaatggcgtattggcgttgctttctgctgctgcctgagctgaggaggaggaagaagaagggcgaggtggatttatagcccggggaagctggaggtggggccggggcgtcagcgagagagagactatgaacgggtttatcctaggcgagcgagcgagtgactcagccatggcgtggagctacggctgtggatgacagcgacacctcacgcccgcagcagtgggtgctccgtccatctgctcctactcttccatcgccgtattataagtcgttttaatctttcatagttataaatctatttaaatttaattaaatttataaaaagtagtaatatctactatgtcaaaccagttacattaaatataacattgaatatattttaataatatgcttttattaaaaatattgctattcttacagacttatccaagtctttaacttaaaaagtcaaaatataatatagaacggataaagcatctaagaatagctgaatgacagaatgatttacgataattatttaagagtagaacgaatgataaataattgaagagtagaacgaatgataaatattgtaaagtcaaaaatgaatttagaatagtttctaagagattcatatatagtttatttttttgaaaaaaagtttcgttttagtttcctttcttcttttaggtttctgttttgggggaggtttggctgtctagatatagaaatgaagttgttggaggataaaaagttgtttcttctctaccttttgcatttgtttaaggtagccactctctcccaaacaccccctaagactatgggtttcctcatttggaccgtcggtgttatcttgtattacctcagctggtgtgtatatacatatatgctctttttcgagatggtatacctaaaaggacaaagtatttgtaatacccctagttatcttataaaataatataaatagaagataatagtattcttttttagaaaatataacagcagtataatattctcagaaaattagagtctaaatccaagtcatatatcgagaaaaaaatagacaaatctaaaacataaatagtaatttagctattcaattttgtaataattttctcactttatatgttgattttagacttcaattttggtgagatgggggatggccaacatgcatactctacattctttttagtatagacaatgtctgaaaataatatatatatatatatatatatatatatatatatatatatatatatatgcacacacacacgaggagatgtccacatctaatttagagtaaagtgtacgggtggtccttaaacttgtagggatatgtcatctaggtccctaaactctcgaaatgaatatccaagtctcatttaaattttaactgataaatgggacccattgaaaatttttcatttttcttttttttcttctcttttttccctttcttctcctttctttgtgaagaatgagaagaaaacgaaagaaaaagaaaagaagaaaaaaaaagtaaaggacacgtctccatgtgttgaatatgacacaattctacaagtttaaggaccgccaatgcactttactctctaatttaatactaaatcattaggacatagataaagggagactaatttcacccgctgtaacagtgtaccacaccattctgatatttctcctcggaaattaatcaagtaatagcattaacatctcaaattggctgtcacaccctgaaaattcaaaatatataaattgttgtttaaatggaatttctagaatttattttaaaagtcttgaaaagaaaatctatgtttaattaataaattccaatataaaaagtggccagataaaatttcattaaatactttgcttaattctataattcctagatttttctgggatttatttgagctaaggaagtatttttaataaatggaattgcatttaagaaataatttaaattgaaaaagttttaaaaagtcttcttttggctttgggccgaaagtcggcccaaaacctctcttctctctctcctcggcccagccggcccagtccgctgccgcgcgcgcgcccgctgccgctgacaggtggggtccacctgtcaggttcgtcttccccgagccgccgccgctgccgaaaccctagttcgcgccgccgccgtttcccttccaaatccggccgcctctttccttctccggccgaattggttgaggggaaacaatctccgggatctcctctacctttttctctttggaatcatcggctaaatcgctttggaaagcgttggaatcaagttcgattcggatcgggttccctctttccaagccgcgagtttccttcgccgttgccgtcgccgtgggccttcgccgccgcctccgagcccctttaaaaggatccccgtgctcttctctttccgccgccaccctcgccttcgcctctcgtcgccggaagagctctagcgccgtgtgccctagctttgccgtcgccgccgccgctccagccgtgcgccgccgccgttccagccgtcgccgtcgctcgggaaggccgccgtcgtcatcgccaagtcgccgccgtcctcgtccgccccttcgcagccgtcggaacccgccggagcttcgtcgccgtcgacaacccgaaggtagccgccgctccttcctcgtcgccgtcgtcgtccgttgcctctccgccgtcgttttggtcgccggtgtgttcgccgtgccgtccgctacccgttggtgccctccgtgtgcgtcctcgcgtcgccgttcgccggcgagcatgcgccgcccgagccgtccccgcccgccgagccgccgccgccgtcggtgacgtcaccgctgacgtcatcaggatcctctcccgtgagccgccgtggacccgatcaatctcggccgtccgatttggatcggatcaatctcggccgtccgttcgtgtgaaccgccgcccgtgcgccggtccacccaaaccctagttgctgacgcaataatccccttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgcttctttttgcttagattccgtcgtttccggagagtccgttttcgcggaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtacattgattaccttattccttgataccttgggttattacaatttgactagttgagctttatttatattggttcaactagatattaggtataattgcttagccctgcttagaaacattagtacacttatgggataactaatgactcactattatttcatgatggcttattgatagttcacgatggtcaatcgtgattagttaattaattaatgtgccaactaaaacctggtaatggtgggttgtgagcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtgaattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcatagtaaaagatgctataactggtaataatttgattagctcctggtttggaatggtacattcctggtttggagatagaactgtgcagccggggtggttgttcagaatggttgggcctatacaacagggtatgttgtatagcgttggattaatattgcttaattattacttaactgttttatcaaattctcaaatgtttgctaaatgctgcttttgcaaatgcaaccctactatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttaatttccgctgcttagaactttattggttgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagcctctttgaccctaggttatgccaaatggttacccatagaagccctctgaaaaatattggaaaagtagaactgttctcctccctttctcttttaattaaaccaaactaatggcacatgcacttcataatttttttttaatggttctcattaaaaatttattccagtgttattagtactgtacatctattactgtactaatggctcatttaccagcaaaagttttacaatgttgtatttaatcttgctgcaataaaataaatttagtatgtcgattttataattttcttttatttcttttgaaaccagttattcaaaattacaaaatttgtgaccttgtctccaactatttcaaattatctcgcaaagcttggtttactttatttacttcccttctactttgatttctaaactttattcaaattaatccaaaaacttgtgctattaattggataaaggtcttaactctctcctttcacttgtctttagatgccgcgttacaagcctgagtacctgtttggtgttgagggttttgtccaggagttgcgtacgatgtcctttgtcattggatttgggactgcccttttttatgcccagattcgtcatgatcgtcatgaagaaaagtgccgagtcaaagtcaccttgaacagcaatagtgaagaggtcccctcagtgatgtttgaagctggaggaagaaactacatccatgcatgtcaggaagtggcaaggatcgccataggagagctccgtgatcgctacagtgatcggttggccgatactgagtatcgctaccatcctcgtcaaccacagggaagtgaccgtggcagttaccttgagactgaaggaattgagaatgatgctactacaaggcatttggttgagatgctgtgggctatggatgaaagtcgtgcggagactgtgttagcagctcaagatcgtgaagatcggaatcgtggtaagatttgcaagctagaagacaaggtggatcgcttggagaaggaattagccgcattgaagggagaagcaccgccgcagaaggccaggattcgtctcaccgcaaggaagagagctttgtttgtccctcgttatcaattggcgccaaagatccgcgtggtggagaaagaagttgccccagcaaatcctcccgtcatcatcataagtagtgatgaagaagaagaacccaagcgcaacaattccaagtttgagtgggtagctatcaaagatgaggaagatgagccgaacgagccttcaatcgacctcctatgctcggaagaactagagtgacttgttaagtcgttgtcttagatcgttgtgttagtttgcttgttttaagtttgtttgtgtgtgtgggtcttgcatgttatttacatcagtggtgggatgtaagtgcatgcgtttgtttgcttctgagtgttaggaagttggtgagtttagtggtgtgagagtcttcagtttgtaataatgaaactcagttaagatcaataaaagttaaggtaattctctgtcctaagtagtttcccccgttttctcttcttatcctgtcatgccagatggtgaacactcgcagcaatgggaatggtctcaacaacctcaacaacaacaaccctaacaacaacaatggagagaatcccactctggcccaagttcttgctcaacagacacagcttatgaacatgatgatgcagcaatttcagaatcagcaaaaccaagggataatcatgcacctccacagaacaagttagcagaatttcttcgtgtgaggccgcctgttttctctagtaccactaatcctgttgaagctagtgattggctgcatgccatagagaagaagttggatttacttcagtgtactgatcaggagaaggtctcatttgcatcacatcagttgcatggccctgcctctgaatggtgggatcacttccgccttaacaggactactgctgaacctatcacttggcttgaattcaccgctgctttccggaagacgcatataccatcgggagtagtgtctctcaagaagaagaagttcaggtcgcttactcagggatctcgctctgttacggagtatctgcacgagttcaatcgtcttgctcgttatgctccggaagatgtgcgcaatgatgaagagcgccaggagaagtttttgggaggacttaatgatgagctttcttacccactcatggttggagattatcctgatttccagaaattagtggataaggctattcgtcaggaggacaagtacaatcgcatggagcagaagaaacgtcggattgctcaattcaagacacaacagggaaataatcagaagccgcgtcttactttaggaccccagcccatgccacagggaggttcttcgtctgttgttcgtccgcaacgtcagttcttcaacaacaatgctggcaacaacatccgtaatcaagctccacgtcctgttgcagctccagcacagcaacaacctgccaagagggagcaaggcagcaagcccgtggtgtgtttcaactgtggagacccaggacattatgctgacaagtgtccgaagccccgtcgcgtgaaggttgtccctgcccagaataactctgctgtaccagcatccaaggctcgtgtaaatcatgtcgctgctgcagaagctcaagatgctccagatgtgattttgggtacgttccttgttaactcagttcctgcaacagtacttttcgattctggtgctacacattcattcttatctatgagttttgcgggaaatcatgggatggaagtagaagatcttagacgtcctttgatggttagtaccccaagtaatcaagcactttctttgcaacatagcccctcggtcagaatagaaattaagggagtaccatttctggccaatcttatcttgttagaatccaaagaccttgatgtcatcctagggatggactggttagccagacataaaggtgtgatagactgtgccaacagaaaagtaactctcaacagctatgatggtcgagttgtaactgttcatgcattgtcatctgagtctttaaggtcaagactgaaccagataactttggaaaagattcctatagtccgagagtatcctgatgtgttcccagaggatttacctggtatgccgcctaaaagggatatagagttcagaatagatttggtacctggaacaactccgatccataagagaccttatcgaatggcagccaatgagttggcagaagttaagaggcaagtagatgatttgctacagaaaggatacatcagaccgagttcatcaccatggggagctccggttatttttgtggaaaagaaagaccatactcagagaatgtgtgtggactatcgtgcactaaacgatgtgactattaagaataagtatccactacccaggattgatgatttgtttgatcagcttaaaggtgccactgttttctccaagatagatcttcgatcagggtatcatcagttgagaatcaaagaggaggatatacctaagacagcttttaccactaggtatgggttgttcgaatgtactgttatgtcttttggacttaccaatgcccctgctttcttcatgaatttgatgaataaggtgtttatggaatacctagacaagttcgtggtggtctttattgatgatattcttatctactctcgaaccaaagaagagcatgaagaacatcttcgccttgcattggaaaagctacgagaacatcaactgtatgctaagtttagcaagtgtgaattttggttgtccgaagtgaaattccttggtcacgtcatctcagccggaggagttgccgtcgatcctagtaacgtggaatccgtaaccaactggaaacaaccaaagacagtttcagagatccgcagttttctaggcctcgcaggatattatcggaggtttatagagaatttttccaagattgctaagcccatgacacgactgcttcagaaagatgtaaagtacaagtggtcggaagaatgtgagcggagttttcaagagttgaaaagtcgcttaatatcagctcctattttgattttgcctgatccaaagaagggtttccaagtgtattgcgatgcatccaaacttgggttaggttgtgttctgatgcaagatgggaaggtggttgcctatgcctctcgacagttacgtccgcatgagaagaactaccctactcatgatattgagttagctgcagtcgttcatgcattgaagatttggcgtcattatcttttcggtactcgtacagaagtgtacaccgatcacaagagtttaaagtatatctttactcagccggatctgaacatgagacaacggagatggttggaattaattaaggattatgacatgggaattcattatcatccgggaaaggctaatgttgtagcagacgctcttagcagaaaaggctattgcaatgctacagaaggacgacagttgccattggaattatgcaaggaatttgaaagattaaatttgggaattgtcggtagaggtttcgttgcagccttagaagcgaagcccactctaattgatcaagttagagaagcccaaattaatgatcctgatattcaagagatcaagaagaatatgagaagaggaaaagctattggtttcttggaggatgagcacggaactgtatggttgggtgagagaatctgtgtccccgacaacaaagatttaaaggatgcaattctgaaagaagctcatgatactttatactccattcaccctggtagtactaagatgtaccaggatcttaaggaaagattttggtgggcaagtatgaagcgtgaaatcgcagaatacgtagcagtatgtgatgtttgtcagcgagtcaaggcagaacatcagaaacccgccggtttgttgcaacctttgaagattcctgaatggaaatgggaagaaattggtatggattttattactggtttacccagaacgtcatcaggccatgactctatttgggtaatagtcgacagacttaccaaagtggctcattttattccggtaaagacaacctattccggaagtcgcttagcggaattgtatatggcaaggattgtgtgtttgcatggcgtccctaagaagatagtgtctgatcgaggcagtcagtttacttcaaatttttggaagaaacttcaggaagagatgggttctaagctgaactttagtactgcttatcatccgcagacagacggacaaaccgaaagggtgaatcaaattttggaagacatgttgagagcttgtgctttagatttcggtggaagttgggataagaatctaccctatgcagaattttcgtacaacaacagttatcaagctagtctacagatggctccttacgaagcactgtatggtcggaagtgccgcactccgcttttgtgggatcaaacgggagaacgtcaggttttcgggacagatatcctaagggaagcagaagaaaaggtaaagatcattcaggaaagattgcgagtggctcaatctcgtcataagagttatgccgacaatcgccgcagagatttgagttttgaagaaggagattatgtgtatcttcgtgtcacgcctctacgaggagttcatcgttttcagaccaaaggaaaattggcaccgcgttttgtgggaccttataagattgtcagtagaagaggagaggttgcttatcagttagagttacctcaatctttggcaggagtccataatgtgttccatgtgtcgcaattgaagaagtgtttaagggtacctaccgaagaagctaatcttgaatagatagaagtccaagaggatttgacctatgtggagaaaccgatccgtatcttggaaacaagtgagagaaggaccaggaatcgagttatctgattttgcaaagtccagtggagtaatcactcggaagaagaatcaacttgggaacgagaagatgaattgaagtcagctcatccgtatctgtttgtcagttcttccgaatctcgaggacgagattctgtttaaggggggtaggtttgtcacaccctgaaaattcaaaatatataaattgttgtttaaatggaatttctagaatttattttaaaagtcttgaaaagaaaatctatgtttaattaataaattccaatataaaaagtggccagataaaatttcattaaatactttgcttaattctataattcctagatttttctaggatttatttgagctaaggaagtatttttaataaatggaattgcatttaagaaataatttaaattgaaaaagttttaaaaagtcttcttttggctttgggccgaaagtcggcccaaaacctctcttctctctctcctcggcccagccggcccagtccgctgccgcgcgcgcgcccgctgccgctgacaggtggggtccacctgtcaggttcgtcttccccgagccgccgccgctgccgaaaccctagttcgcgccgccgccgtttcccttccaaatccggccgcctctttccttctccggccgaattggttgaggggaaacaatctccgggatctcctctacctttttctctttggaatcatcggctaaatcgctttggaaagcgttggaatcaagttcgattcggatcgggttccctctttccaagccgcgagtttccttcgccgttgccgtcgccgtgggccttcgccgccgcctccgagcccctttaaaaggatccccgtgctcttctctttccgccgccaccctcgccttcgcctctcgtcgccggaagagctctagcgccgtgtgccctagctttgccgtcgccgccgccgctccagccgtgcgccgccgccgttccagccgtcgccgtcgctcgggaaggccgccgtcgtcatcgccaagtcgccgccgtcctcgtccgccccttcgcagccgtcggaacccgccggagcttcgtcgccgtcgacaacccgaaggtagccgccgctccttcctcgtcgccgtcgtcgtccgttgcctctccgccgtcgttttggtcgccggtgtgttcgccgtgccgtccgctacccgttggtgccctccgtgtgcgtcctcgcgtcgccgttcgccggcgagcatgcgccgcccgagccgtccccgcccgccgagccgccgccgccgtcggtgacgtcaccgctgacgtcatcaggatcctctcccgtgagccgccgtggacccgatcaatctcggccgtccgatttggatcggatcaatctcggccgtccgttcgtgtgaaccgccgcccgtgcgccggtccacccaaaccctagttgctgacgcaataatccccttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgcttctttttgcttagattccgtcgtttccggagagtccgttttcgcggaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtacattgattaccttattccttgataccttgggttattacaatttgactagttgagctttatttatattggttcaactagatattaggtataattgcttagccctgcttagaaacattagtacacttatgggataactaatgactcactattatttcatgatggcttattgatagttcacgatggtcaatcgtgattagttaattaattaatgtgccaactaaaacctggtaatggtgggttgtgagcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtgaattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcatagtaaaagatgctataactggtaataatttgattagctcctggtttggaatggtacattcctggtttggagatagaactgtgcagccggggtggttgttcagaatggttgggcctatacaacagggtatgttgtatagcgttggattaatattgcttaattattacttaactgttttatcaaattctcaaatgtttgctaaatgctgcttttgcaaatgcaaccctactatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttaatttccgctgcttagaactttattggttgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagcctctttgaccctaggttatgccaaatggttacccatagaagccctctgaaaaatattggaaaagtagaactgttctcctccctttctcttttaattaaaccaaactaatggcacatgcacttcataatttttttttaatggttctcattaaaaatttattccagtgttattagtactgtacatctattactgtactaatggctcatttaccagcaaaagttttacaatgttgtatttaatcttgctgcaataaaataaatttagtatgtcgattttataattttcttttatttcttttgaaaccagttattcaaaattacaaaatttgtgaccttgtctccaactatttcaaattatctcgcaaagcttggtttactttatttacttcccttctactttgatttctaaactttattcaaattaatccaaaaacttgtgctattaattggataaaggtcttaactctctcctttcacttgtctttagatgccgcgttacaagcctgagtacctgtttggtgttgagggttttgtccaggagttgcgtacgatgtcctttgtcattggatttgggactgcccttttttatgcccagattcgtcatgatcgtcatgaagaaaagtgccgagtcaaagtcaccttgaacagcaatagtgaagaggtcccctcagtgatgtttgaagctggaggaagaaactacatccatgcatgtcaggaagtggcaaggatcgccataggagagctccgtgatcgctacagtgatcggttggccgatactgagtatcgctaccatcctcgtcaaccacagggaagtgaccgtggcagttaccttgagactgaaggaattgagaatgatgctactacaaggcatttggttgagatgctgtgggctatggatgaaagtcgtgcggagactgtgttagcagctcaagatcgtgaagatcggaatcgtggtaagatttgcaagctagaagacaaggtggatcgcttggagaaggaattagccgcattgaagggagaagcaccgccgcagaaggccaggattcgtctcaccgcaaggaagagagctttgtttgtccctcgttatcaattggcgccaaagatccgcgtggtggagaaagaagttgccccagcaaatcctcccgtcatcatcataagtagtgatgaagaagaagaacccaagcgcaacaattccaagtttgagtgggtagctatcaaagatgaggaagatgagccgaacgagccttcaatcgacctcctatgctcggaagaactagagtgacttgttaagtcgttgtcttagatcgttgtgttagtttgcttgttttaagtttgtttgtgtgtgtgggtcttgcatgttatttacatcagtggtgggatgtaagtgcatgcgtttgtttgcttctgagtgttaggaagttggtgagtttagtggtgtgagagtcttcagtttgtaataatgaaactcagttaagatcaataaaagttaaggtaattctctgtcctaagtagtttcccccgttttctcttcttatcctgtcatgccagatggtgaacactcgcagcaatgggaatggtctcaacaacctcaacaacaacaaccctaacaacaacaatggagagaatcccactctggcccaagttcttgctcaacagacacagcttatgaacatgatgatgcagcaatttcagaatcagcaaaaccaagggataatcatgcacctccacagaacaagttagcagaatttcttcgtgtgaggccgcctgttttctctagtaccactaatcctgttgaagctagtgattggctgcatgccatagagaagaagttggatttacttcagtgtactgatcaggagaaggtctcatttgcatcacatcagttgcatggccctgcctctgaatggtgggatcacttccgccttaacaggactactgctgaacctatcacttggcttgaattcaccgctgctttccggaagacgcatataccatcgggagtagtgtctctcaagaagaagaagttcaggtcgcttactcagggatctcgctctgttacggagtatctgcacgagttcaatcgtcttgctcgttatgctccggaagatgtgcgcaatgatgaagagcgccaggagaagtttttgggaggacttaatgatgagctttcttacccactcatggttggagattatcctgatttccagaaattagtggataaggctattcgtcaggaggacaagtacaatcgcatggagcagaagaaacgtcggattgctcaattcaagacacaacagggaaataatcagaagccgcgtcttactttaggaccccagcccatgccacagggaggttcttcgtctgttgttcgtccgcaacgtcagttcttcaacaacaatgctggcaacaacatccgtaatcaagctccacgtcctgttgcagctccagcacagcaacaacctgccaagagggagcaaggcagcaagcccgtggtgtgtttcaactgtggagacccaggacattatgctgacaagtgtccgaagccccgtcgcgtgaaggttgtccctgcccagaataactctgctgtaccagcatccaaggctcgtgtaaatcatgtcgctgctgcagaagctcaagatgctccagatgtgattttgggtacgttccttgttaactcagttcctgcaacagtacttttgatt

SEQ ID NO: 80057 - DNA, 9872 bp, Oryza sativa
tggtttggaatggtacattcctgtttggagatagaactgtgcagccggggtggttgttcagaatggttgggcctatacaccagggtatgttgtatagcgttggattaatattgcttaattattacttaactgttttatcaaattctcaaatgtttgctaaatgctgcttttgcaaatgcaaccctactatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttaatttccgctgcttagaactttattggttgagaggaactatctacctctgtaatgacattttattcacttattaattagagtaatatttgtactctattatcaatttgttattgtgtgcctcggctgattcctggacgagggttcacacacatgtaagcgtttggaattttggatagaaattccgggcgtgacattggcctccatctacaataaatatctttgaaatatagtaattgatagtttcttctgtcggtttagtttccttctttttttaaataaaaagaagaacttttaagcatcgataaatctccaaaactgctgccatgcctgctaacggcgacaattggcaacgccaggccgtgcagctgcagctacgccttctgcccaggggcgggcccagctataattcaagggtattcagatgtatacccaagaattttggacaaaaaataggtatatatactctatagttcatatatgtatgcaaaaagataaagaaaaagagttaaactacttatttgggccttgttttaccatttctgctgtattgggcctaaattctccactcccctctccctttgaactcggccagcccatttccaaacaaaattcccctcctcccaattcccaaaatccccaatttcaccctaaccctaattttgagacagccggtgcgcctggagggcttgcagcacgggcggcggcgcgcgttccggcgcgggcggcgggcgcggcgtgcggcggcgggcgcggcgtgcggcggcgggcgcggcgtgcagcagagtgcgcggcgtgcggtggcggcgtcgcagcgagccggagaccgcagtaccgcagggcaggcgccaggcgggcagcacgccatcagcaaggaagcaagccaggcagccagaggggcaggggcgggccgcgggcggacggccggcttggcgcaccggcggagggcggaggcgcgtagccgcggccgcgcggcggcgcaacgccggcagcggctgagcggcgcgtcggcgtgaggcgtcgccgggcgccgactccaaagtccagcgccgcgtgctgtgggcggttagttcgtggctgggtgccgaccgccgagccgccttcccctattccccagttcccttcccgccttcccccgccgacgaccgaggctgcgactgcgaagacgccgacgggcgacggccacgctgccaccacattgccagtatgccccagtgagtcagtgagtatgaagcacaaattttgaataattgcaatgaagattttaggattgggtaccgcaattgattgatttagtatacttgcttgggtgcttagttgcaattcattgctcaaatgctcaatttcagaatttaaacatgaagaagaggaagggtcctgctgttgatttgaagtcctttttggagaaatctgctgcaaagaaggcaaatcgaagccaaactcctggtgagggcaatttgaatccgattgatagtaatttaaatccttcttgcaatgagagtcagatgcaattagtcatttatcaaggtcatcatcatgagaatgagagtggtagtccagcaagtagtagcacaataccaattgatccagcgattagtgatatgccaggatcaaatgatgaatctcaatctagtgatgaagacaacgatggtggcttgtatgacatagagcatgatcctggactgaggactcctatctcaaggtatgatgtcaatgaccaagattcagttagaagggcatacattgcattggggccatgccgaccaaagatgaagaaagatgatttcccgcaacatagttgtggaggtatgcgccgcttcttaccaaaatggtttgatgagttcaagtggcttgagtatagtgtgaatcgggatgccgcatattgctttgtttgctatttgttcaaagaaagcaatcatggtggagatgcttttgtcaatggagggtttagaaattggaacatgaaaggtagattccataagcattgtggcgccgttaatagtgctcattgtgaagctgaagagaaatacattttgttcatgaaacctaaatcatcaattcatgagtcctttgcatcaaatagtgcgcaagttaaggccgagtatgaagctcgcttgttatggtcgcttaagtgcataagatatatattgcggcaggggttggcttttcgtggtcatgatgagtcaaggaattcagagaataaaggaaatttcagggaacttttgcaatggttggcagggaactttgaagaggttaataaggtggttctaggaaatgctcctatcaattgtcaaatgatagatcacgagattcagaaacaactcattcgctcatgtgctcatgaaacaactaaatttatcatagaggaacttggtgatgagtgttttgcaattcttgctgatgaatctagtgatgcctaccaacaagagcaattggctctttgcttgcggtttgttaataaagcaggacaaccggttgagcggtttcttggccttgtccatgttgaagataccacttccttgactcttaaagaggcaatcaagtccttgcttatgcaataccaattgccattgtccaaggtacgtggacaaggatatgatggtgctagtaacatgaagggtcatgttaatgggttgaagaaactaattatggaagattctccttctgcttattatgttcactgctttgcccatcagcttcaactaacccttgtagcggttgctaaggagaacactgattgtgcatggttttttgggcaacttgcatatttgttgaatgtctttggaatgtcatgtaaaaagattcgcatgcttcgcatagctcaagctgagtatatgattgaggcatttaaattgggtgaaattgaaactggccagggtttgaatcaagagatgggcttagcaaggccaggtgaggatcatgtttcatttaacatgttatatttggtactcaatcatgttatattttgtactcactactactttaaaatatggtggcaggtgatacacgttgggggtctcactacaaaactgtaatgcatgtgatgtctctatatccatcaatcaagaaagttctcttcagaattggcaaagagtgtacaggggttgaggctataggagctcaaactatgctagaagtatttcaatctttcgagtttgttttcttgctccacttgatgaatgacatatttggatacaccgctgacttttgccaagctttgcaaaagagggagcaagatgtagtgaatgcgatggatcttcttgcgttcacaaaggtagaactagatgttttgagagaagatgatggatggcgagaattccatgggaaggtcacttctttttgtgtgaagcacaaagttaaagttgttgacatggatgggaagtataagcctatacaaagatcaaggaagttctttaaagatgccattaattaccatcggtttcatgctgatatgtttttgggtgtcattgatagacaacttcaagagttgaataacaggtttgatgaggtaaacacagaactccttagatgtatggcatcattcaatccatccaaaggattttcagcttttaatgttgagagcttagttaagcttgctgagttttatcctcatgattttgatttcgaagaaatgaaccagctttcttttcaactcaaccgctatattagtgatgtgaccaaagatgagaaattcactaatttgaaaggtctagcagaactatccatgatgcttgtcaaaacagagagggttcgtcggtatgaacttgtttatagacttctcaaattggttctagttctccctgttgcaactgctggtgttgagagggtcttttcttcaatgaactacatcaaaaacaagttgagaaccaagatgggacagaaatacttgaatgattgtttggttacattcattgaaagggaattctttttgcaagctaaggacaaggacatcatcgattattttcaaaatatcaagcgtcgaaaagttaatctctaaattgtaagatttcttcccaatttatcattttctatcatttttatattccatatgttggcactttgatatgtttatcaattagtatttctatatgttaaacaatttcacgtgatgatcaattctatcaatgtgtgcacttatgctcaattttatgttatatacactatatattatataattattagtgtgtgatactatacaagccaattattaggtttttaggtgtatgaacaaaatttttttctttccccatttcgaatacacaagttcaaaatcctgggcccgccactgcttctgcccttatctgcttgatgaatactagttgaattgatcacaccaccatttaattccagcatgcgtggagacgctagctagctgctgatttcgcttctgctggatgtttttgatggttttgttgacgtgtggtgtggagttgtgcggtggacgaatcgctggggggatttcgtggtcaggtgttgcgatgcacctggcgcagcgtcagtctcatcatgcatgggatgttgatttggatgatgtctaaaaataccataattaagagtaggtaaattgtggcgagaaacataagtaagacttgaaaatagtttggtcataagtatgacatatggtgatgtttaaaactcatgtagatgaggatgaagataaagatcaagtgttttacgcaaaacgaggtggtactaacatattgtatgattaattgagtattagttattatgaacttgaaaaatatttttatctgacattttagagcaacttccatatagaaagttttcgcacgaaatgtatcatttagcagtttgaaaaacgtgccacgaatatctaaaattttcatacaactttagttggaaagaaaataacagggctctgctctaagattgagagtatgatatgtaggatctaaaactaagaaaatgtgacatgacacaaccgtgacaacgaaacaaacacacggctaaagcatgacgtggcaaaatgaggaaataaaccaaacaccccctcaatatgtcggttgcaatcagccgctttggctcaccggaaaaaacatactcaattagcttatcattacttaaatattaactattattacaaattacaaattatatttattaatgaactatattataatttaatattgccgcgccaagtaaaaattcatagcatggtaaggtttttgctgcgccagtccaattggtgccaaatgttgtgtgttattctgctatctcactggaatggtcaaaaaactttagaattggaaattataagttttaggtgtttatttttcatattaaaaagtaatccggttaaaaataataataaatccttatattgttcccctgctaggcacactcatcatttgagacatggacgggtatcccatttgcatccgtgaacttatctttcagcccatgtcattagcataagataccacaagtttgtaatgagatgataataccatgcatatatacagacacaatacggctgcaagttgggggtacttgagagctgttgtcaacctaattgttgatgaggaattatatctttaatttcttgccgactacatgagtgcatatatgatttgtgtatttttaccacatgaatgcgtgtttagttagtgtaaagttggcaaagtacaatatatataactagacaaaagctttgactgattgttgtgttatgcattgtacacatactaacgaattttgctgcgcaatatcggagctagattttaaaagaatttaatttgattataactcttggatacaacggtatttcgtatcacccgtcgatgacaggacttctgtggtgacttcgtaaatctaaaaatatattgatctaatttttgaaggtacttataaaagtaggatatgtgtgtaagttaatcagggtatatgtgcacattttatatgagcgtctgcctatataccgcgtttcggagaaaaaaaactacagtaggatttgatatgcacagatctttagctcctgtatttcatctatgcaattgtgatagtaaagccaacagacaagaatacaaaaggatgatgatattagaaatccaaatcttatgaatccaagttggcaactagctatacatattgggggccggggtacagctaataaaacagctgcgtttgctgatcacttcagcaagcctgtatttctttcagggatggatgcgcgtaggctttgtcgtgtgctaacagggtcagaattggattgtttatatatacatcgccttgagaaatatatggcgtgtgcagtgtgtattgactcaaggaaaaacaatcaaatatatgtggttcgttgtttgagatgataagtgttgatctttcgaatgaaaaatgtaagtcgctttattagtagctagtttagtttcgtttcagaaatggatactttgtattgaaagtatcaataatgcagaagatctacaggaatgtttattaacaggcaaatattcaccatctgattaggaaataactacctagatcaatcattgggttttactagtagcagagatcaagaataagggtgtgtttagttcacatcaaaattagaagtttgattgaaattggaacgatatgacagaaaagttagaagtttgtgtgtgtagaaaagttttgatgtgatgaaaaagttaaaagtttgaagaaaaaatatggaactagactcggcctaaagcagaaagaatatgacacacctaattaataaggggtgactgaagaataggatgattcctagctaaatatagttatattttgaaacaaatgaaataataggtggctggtgagaaagtagtactctagagggctcaagtgtgaaacccataatcaaaattactggaaattatatacatgctgtgatcccgggaacataagtgtatgtacgtcactaagaagttttatattttagataaatttttaatcccagatatattttagagggaggggagtaattttgaccacaaatataaacagctcagatgtatcaaaataatcaagtttatcttttaaaaagtattatgataagagtaaatttttgcgagatcctcgtccaaaagggaaggaaccaagatccatgattgtagccaatagacacatatatacccaagattcatatatatgttaatgccctcagagaatatacatttgttagacaattgttactatcacaattacaattattcacaactccaaatatctagctagctgctccactggaggcaggcatgcgctcaggacaattagccaaagtacaagcaaacaagcgatggtagtacaaaataagtgacaagttgaggatcagccagcaccagcagggtcccgcgagatggattcttcccaacaactccggtgaatgactggaccgtgacaaagatgagtgcaggacacgaacactgcacgtgttttattgtgatatgctgtcaggatctggggatctcagtttttttctagtagtaatgcactgatgcatgatgtggtagatcaccattatactgtactcgctccgttttatattataaattatttaacttttttctctagtcaaactttattatgtttgatcaagtttataaaaaaattaatttcattaaatttgacattggatattgaatatattttaataatatgtttgttttgtgtactatatttttttttataaatttgatcaatttttttttaaaaaattaactagaaaaaaagtcaaacgacttataatataaaacagatagtagtaacatgaatccgtttatctactactatctctatcctaaaatattcagatataagttaaaagttgttaaagatggaaggagtactagctggagtagcaaacttggtcaacaaagatgtttatgtgatgttgattattcttttgctccctctgattttctgcaacctgaacatcgtacatgtaatgtggtgtatgcatgtgctaggtgaggagtcaaggtgacaatatttttttgtttgtctggagcaagtaatttgtttgacaatgtagatgcatggatttcaagagagctatcatagttaatgctatcatcaactgagttcaggaaagggactagcaagtaaaaaaatgggatggagactaagtagttctttgatcgctctaaaactgctgttcagtccctttccttaacttgtgtgttaatatggagaattttagtcctttggttcgtggagagatattatgcgaaaatgagccagttgttaaaagtaaaaaaaaaaaaggaaacttataaaactcggagctataactgggatcacatatttccgtcaaatctatgtatgctgcgatcatgaactgtaatgtttaaataaaaagagaattctgggggacttgaacattccactaaagatcaaggtctttacgtggtttcttcacaagaaagtaattctaacgaaagataacctggctaaaagaatattggggggataaacattgttctttctactatgcgcaagagacaatccaacatcttttttttagtgtcatgtcgctcagtttgtttggagatgtgtgtttttttgcttttaatatccctccaccccgtaacgccaaaaacattttcggtaattagcttagaggggtatctaggtccattaagaagatgattataattggagctagtgttgtatgttagtcaatttggcgttgtcgtaatgataaagtttttaatgataaacaattatctaaccccatgcagattatcttcatgtctccacttctggtctatgatgctaccataggaggagcaggatactatgcacaatgatgctacactcttggaatcggtagccaaggatctcttattccactatgggtggcgtagtttcattagaaatgctagctatttttttttgtgtagtttaaagctagtcaataataaaggaggagttggggatttgtcccatcaccttatttctcattttgatttacttttatcttacctttttattattattaaacttatggctatgtgtcttatgacagaagccggagatgtaatccattttcattattaataaaaaagctagggtcatgttgaaaaactctactgagaaatcaatcccatcgcgacatgacaaaaggcaatttttaggtgcaacagtaaatgaagaaaaaaaaaagaaattttcacacaattatccatctatatctataactaatataaatattcgtatttttccggtcgtcacatctaattttcgtctgtttttcgtccatacacaatccgattcggttagcaatagctaaggaaaaaaattgcaaaaaaagaaaaagaatcggcggccgccgacgccaccgccgccgccggagggagaagagaggcggcggcggagggagcgccgatgccggacccgcccgcggtggccaccaccgccaacggatccaccctcggacgaagccgacgccgtcgtcgcggccgttgagaaggcgccgtcgccgtcgaggccaacggggagagggagtggggtccatccgcg

SEQ ID NO: 80058 - DNA, 2442 bp, Oryza sativa
cgccctctggccgggcggcaggcctgccgcccagccccgagccctcattcctccccctcaaatccaatgaaaaaaaaagaagaaaggggaggagaagagaagaaggggcgaagccctgccggattcagacgccgatttcaggtaatattcatagatcgtatatgtgactattgagttaaatagtgtgtattttttaaaactttgtttgaataaatgcattatatttttagggttttagttgtactaatctagaagtgcgtattgtagatatcggtaactacgtagatctactagtttggaatcaatacattaccgttgcattggcatacacaagaagatattacgttttagattgcttcagcatgaaagagtaatatgatctagttattttgttgacagatatgtcgaacaaacaaatattccaagtttaccatggaccaggaaacgtccgttacgggccaactggggtagatctgtcagattttattgtattagaaaggggaattgatagaccggctgagagaagtgtaccttctataaaaggatggttaatgaggggcttgaaagttgatccacagacaagtgacatatcaatcaatattatagtaagtcgggcaactgagggtttttattgggaactaatgccagttcaaaactctcgagtgtgaaaatggtatgtggaaaatgcattgcaacgcgggtggcctttagctatggttccgtttgttcacccgaaggatccaggtgtgcagatgaacatggatgatggcgagggaccaagtgctgaagtaaatgagacttctgtggaggaggtcaacgcacgagaggatgggggcgtagtagctccagtaggcattcaaccaggtggagtggccgacgagggggagactgtcggtgccattgtggatgaaatagacagggaggattctgacaacgagcgtgtagagaaaggtgattcgtcagatgatgagacggatattaatccagcagaatgggctagtgaggatttttctgagatggtcgtctctgaagaggatagtgtgagatgggagtacaaagaaaatgaggttattcagggagcgatttatagtagagcagaagatatgaaggaggcggtaaaacattttgcagtgtcaattcatagagagttttgggttgccaagtccaaccggtcgcaatatgaagttcggtgtgttaaggaaaaagatggttgtccctggagagtgcacgcgtataaggggaaatggaaggattattggacagtgtcagtcgttaccaagcatacatgttttctacctggtgtttagaaataccacaggaacattacatgtgcatttgttgcaactgagatgtatgcgcatgtcatcgataatctcacatatgaaccaaggtcaataatccgacacatcgaagagacatacaagtatactattagctatgccaaggcctggagggccaaacagaaaataatagagatgagatttggaacttacgaagcctcgtatgacaatttgccacgcctgcttggtgttatcgaggaaagaaaccctgggagctcttacgaagtgaagaaattcccctcaattgaacatcctggcaagagtgtgctgcaaagggcgttcttagctctacatgcatgcaaggtggcattcatgaactgtcgtcctgttctctgcattgatgggacattcttgacaggaaagtattggggccagatactaacagcaataggggtagatgggaacaatcaggtattgcccttggcatttgcttttgttgagagtgagaataccgacagctggtactgattcctgaaattagttaaaacaaaagttgttggtatgaggccaaatgtgtgcctgatacatgataggcacgctagcattctacgagcgatagaagagttgcagtttgggagtatggaacgaggataccctggtgtttgggaagatgtacagagtaggtggtgcatgcgtcatatgggagctaatttgttcaagcaattcaagaacaaggagcccatgaacatgttcaagaggctatgcaatcagaaccaggagaaaaaattcaatgagctttggaagagattagatgagttgacagccaaatgtagtgatcagcgtgcaacggctccatcgaccgccgttgctgaccctcctgaagctcttggacctctcccaatgaatagtccaacattggttagaagaactggattggagattcggaaattttctcagtggattcttgtaacgccccgattttcgttcgggattaaaaatcatttaatgatgcatttcctagaaattgaataaaaagttaagcaatttaatcaagtgaaataatgggagaattaaaattttcccttaaaaatcattggccgggaatattttgtaatattctttgtgccctaatgtactctccggaattttccgtgaattttcg

SEQ ID NO: 80059 - DNA, 4196 bp, Oryza sativa
cggctatagggagcacggtggggaggtgtctagggggcgcggggtgctcggggagaggggaaacgaatgaagggaggcacgtgagtcgtttatataggtcccggagggggagaacgtggccgggagaggcggatttgaagggggaagaggcgccggcgacgtgggcgagtggggtggtttggcgccggttttggagggggggaaaagtgggggaggagagtggaggaggtggggtgacgcggtcccgcggtcggggcgagcgcgcgggtggaggaggaggcggaatcggcggcgacgtggggaggccgtggcggcggtttcggctgagggagccggaggttagggatggccctgactggtggggcccacctgtcggtggctcggggggaaggagagaggaggagacggttgggggagaagatgacaggtggggcctcgggttgacggggaggcaaagcagacttgagggagagagagagccgagcgggctgagggagaaggccggcccgagagggagagaggggggggggaattgggccgaaaggggcccaaagagaggagggaggtttttatttgttttctttttattttaattggttaaatgatcttcgtgactttaaaactatttctcgagctccgaaaattcacggaaaattccggagagtacattagggcacaaagaatattacaaaatattcccggccaatgatttttaagggaaaattttaattctcccattatttcacttgattaaattgcttaactttttattcaatttctaggaaatgcatcattaaatgatttttaatcccgaacgaaaatcggggcgttacaaatctaccccccttacaggaatctcgtcccgagattctgggatggctagaaagaaagccggtgcagatgggcggtctgactgatctgcaccttgaactgccacattctgcttcgaactgattgattgactggttgatcaaacctgcacgattgaactggctggattcgacctttctgttcctttgctttgccaaaactggaccgactggttctgcttgaactgacccagtctaggactgcggatgctcctgaaacttacttagtttggactgaactgttgaggttagcaattttggtaacctgagaattcaccacgctggctataagaggatgaaaatggaatctggcatttataaatcatttaccctatgtccgcttcgactggtcccaattcaaataacaagtaattccaggaaaacctgcttgacctgtctttcgtctgaactgcaaccatcctcgatgctacttctctaagctgaactgttgacctggcctcaagggtgtacattagaattgaacctgttgacttgagattgggagactctgctagtggctcgcaacggactcctttaattactaaccaaattgctgcactgggttgaacattcaagtgaaatgccgacgaggtaaaccaaaactcatctctgagacctaccccccttacagtgggtagtcttactttcgcctgactgagaacttttgaactattgtccttgaaaaaaatgaccaacatttctcggatttacagatgccctgactttgaagactgaaacttcatcggtccatcaaattgaagcaatggcgatgcactttcatcccgacaagatttggaacttaagccttagttgatgataggaaattccacataaaagtgactctcatttagctcatggacacactgactcttgactgcaacacactactgctggagttctttccgctacacttgaccttgcatcgagctttgcatctcccgcatcaatacatccatcatctaatcttggacaccaaatgttgatcacgagcagggttcttctggcactgggataccttgtagctttcaactgaaccattgattggtgactttaattgatcttatctctgacactgaccatccgctgccaggacggaagagaggtggaagagaggggttgctaaagataaggtactaaaccacttgcctactgatatgttgtgagtagacttttattcttcaagttgcttaagcaaacaacctagtatggtcgcatccccaccaatgatgcaaaccatacccctacacacaagcaaacaacacacgatctagaaagctaacggaactactcttctgggaaagattgggtttaggtcatctccgagaaaactccacttgatcttcgcagaacgacgactctgaactgatcttctcactccttgcacgaagcttgaggctcgaattgacttgacttccgaacagacatgaagctgacagctggtcctctaggtttgacaactaaaagaattggagagattgggaggagaattttgaaaaaccgtttcacaaagaaatgccgaagggcgagaggagacaatttgcaagtagggttttcagaaaacttgtccttagggtttgaccatttggctcaacctacagtcaagttggctctgataccactttgtcacgcccagaaatttagcccaaatttccagactattttgtgtattaaatccctgtccaggaccagccagggtacacaaaacgacaagtaatatacagttccaaacgtaaataaagcgtaaaatacttacaaaagaggcacttagtcctcgcaccgaaacgaaaacagcagcagcggaaaaaggcgatcctagcggggcttcagctccactccacaggcaaaactcaactggggtctgagccttggtcctctaacttcgtcttcagctcagaagcactacacttctgaaaagggggaataatagcaagactgagtacaaccaccgtactcagcaagccacaccaacgatgcagacgtgcaaggggaacacaaggacggtttgtggctatttgcataaaggcggttgtaaaacattttattgagcaaaacagtaaaactgttgagtaattaaagtaacattaaatctccactgatcaacgctacaccacgttgaacaggcccaaccaacccacctaaactacagtgtattaggtcgatttattaagtgtgagactaatcacggtgaatctggtcgaccgcccataaccgtgggcacggctattcgaatagttttactctgatcagaggtgtacaactgtacccacaagacacagccccacgacacgttcccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcctgggtacgtcggctagagaaaagctacactacaagcccagccgttgcccacgctggcttgtgataagtacgataaattcttccagggcatcccgcgaaccggtccttaactgccatgggtgcgaccagcaaaaccatgcacccacagcccaccattcagtcgcattttagttggataattacgaccatgaagcatggccaggtgtctcgagcacgcagctcactctgatactaaaaaggtctaatactgcagttatcccatcaactgagctagtggtaattaagcatggctaagcatatagttctagctaggtcacataagtaacatgagctagtcgattcattacccaaggttgacaaagaacagatatcaagtaaacatggcacaagcgagcagataggtaaaaccctgaccccatgtaattagcaaaacatgcatatttgtttgcaaacagtaaaacatttgtaaattgggatcaacatgctcaaggggaatgtgtgacttgccttgcttcttcactttgatcttccgaactcttttcctcgcgaccgcggacttccgaaacgacggaaactacacgctggcacgcaaaacgagaaaaaactctaataaaaaccaaggaaacaggacataaaaactaaacaaacatgtagagctcaattttagatgaattttgcaagttgaatggctcaattcggagttcgaatgaattagatatggattttagaaattttgagccatttaaatgaatttctagaattaaaccgaattattgcgcaattaataattaatttctcaaaggaaatgacaagtgctgacgtcagcaaa

SEQ ID NO: 80060 - DNA, 5982 bp, Oryza sativa
agacttgttaacattgagtgaaacgcgtgaccataattaattgagatgtatagtgatcgataaattcgatggtaactgtacaacaaatttatttagttagaggatcaacatggtttttcagttgtgctttactcagattaattgtttaggtgcattaaacatcaaaaggtaaaataaacaatttcttttttatttgctctaagtagctcgggttcatggaaattgttggttcatatcatgctggcagcaacagctcggtaacaagaatactgatgccagctacctttggtagttgtagctagctctacctccagttgcacatctctgttttaattaactaaaagttggccttagctgtttcttgatagaatgacagtagaatatatgtgtatgcatgagcggtactctgcttggtcattgcatagtagttggaaaaactcgcatgttttgctgctctagaattagaggtggaatgttgaatgctcggaaaactacttttataggcagttacaatataattggtacccccatttttggaagtgtttagccaaccaaatgttacatagggcctatagaaatcgacagttttgtgctagtggattgcacaactgcatgttaacaaatctatttttttgtattttaagttcgactttcaagtctttaattattgtaggcgcaaaaagtatttcatattttaattgtcacaagttcgcaattttttcacacaaaatatgcatctagtatgtaggattcaaatccgggatctctcccttcacgtgtatcttacttattaccatcttacatatgaagcactttgttaattactatgaaatagacgttgatcttctaatttaaactctcttaaacttgtaacacatattaaaaccttaaagatttatgtagtgttcatttgaagtgcgattgaggtgaactaaagttatatatgatcccaacaattttttcattaaatttgtaaggtccatattttggtaatatcattgttcacttatgtcaagttcccactgtatgttttgatgtgttatgcaacttgacatttgtgaatgttcataataaaggaaatataaaaaaaaattgactaggccatatttgaggaaatattgtaaggatctcatagaactttggattaactcaattggacttaaggtgtattttctatgaattttaaaactttagacttcataaagatctgtttgtaaaatcatccttttttaaaaagtagattccgaatttgaaacgaatatttcggcacctaagtgttcttaaatgaaataactttgactagaaagttacaaaccttgtcgagcgctatattgttttatagaaattgtacccgtcaacgtatgtaacaaaaaattctaatgtagaccttaaagcttcttataatgaacttttgatcccattaactacctaaaatagaaaaacattaactacaacatctcaacaagaactacaattgtcacataacatttgtcattaggcgacatcataggaaagagttacaagtggtttcctaatagaactgcccttaaaaatcaattttattgattttttcttatgagatccgtatataaaaatgaccccacctttcaaattacgcgacccatttgtgttaatagacctattttcacatgcaatttttcataaggagctatctgtaaaaatagttttcttttgttatatgaccctgggcggcattagtcatcttcatagggacacggaaatggtttgtagtggttacgatgaaaaatgtgcatgtgcctattattgaaataaaaagactgccagcttttggccatctagacaatgcgtcagagacaaccatcccaatctatcccctccccatcccatctagaagtaaaagtataggtagggtcttccaaaaatacacaaaatattgaatctgcatgggaggggcagagggtagctaatgaaggggtgggagaggtgcagaggatcgatgggcacgcgtgtgacacattgcttagttaaacaacatgctacgtgttaggcaatagcacgttctctctctctctctctttctatctatctctgtatatttttccatagaaattactttaagtatatgaggttatatcacacggtcatgcatagcgtttagaagtttcaattgattcagatttacaggtataggggtagaatagttaaattttgatttatttttgggcttctgatttgatcatctgtacctttcaattttgaaaagcctgatctttaacatattataatattctgtgaaactttagaacttttaaatataatttgttgtgcggttttcttgatttctcttacaattggtggctcgagatgaaggatattaatttctgttgtttttgacctattaattaatcgtacctttgtatggcttcattcagcttcctgcattcctcgatggtggcatgatcatcatatgtgtcatccataaggacaatgaatacaattatcttggcaaggatcatccgtgtgagtgttaagttttcttcatagaatagcgcataggaccaaagatatgactccactgcacgatctctaacatgacttagctcgacatatccataaagatctttccaccacctgaaaattaaaatgatcgattgttttaggtgcttgttttgaagtatatttaagatatatatattagatcattagaagcaatgagtattaattgatttatgatagtaataatatgtacatagcatatcaggcataccgaaaacactaacaacatgaagagccatattgctagttatttcagtatatgtcactagttattggatgtttaaagccgcataaaagcctctagtgtattgctgctgcaaatgctgagacaaagattgataaaatattcggatattccttgaaggctagctgtccttcttttttatctgagagtggacaaattatatagtagtataaaccttaattttctattgttcaatacttgaaactacagataaagcgatacctaaactcggatacactaactacctcattaacatgacatatattgactacttctggacaaaacataaagttgtacatgtattttgtgattaattaacattaaattggttgcacaaacaaagcgtcaatttgtctaaaacgaggtacacattttatgtatttaccattcagtacatcgaaggaacacaacgtctctccagaattttgcacttatctatatctgtctatcctatatagtcagagctaaaatatccacatgtattgattaagttcatctgaaatacaacagcctttggattcctcctttactttgatcatagctacccacatgtcatgtgtattcagaattaaccacttagtataattgctttagagctcaagatgtattgagcaacatctcacctagaaagtaaaagccatcgaatccctctcatacttgtcataactattcatgaggtgaaattacacatcaacttctacgtagctcaaattatagtccttttaggtatgacgagtaaataatttccaataggtttttatcaagctttcctagaaaacaaatacttctaaattctccactgtaatgcacggcccattcactaataactaaatgttctctaaattatctttactaactgtagagcgaagatcgaaaaacatattttggtagttgtatcgtgcacatacacagatttgagattattacagtggtttgtttctgtcctaaagggcacaatcaattactttcatggtatatatttacttattatatatataaatatcaaataaatactctttttttagataaaggaaatgaataaacctggtatctacatccacaagacatgtacaaagacaaagcaaagaaagactcttactgagaaaaagctttgagctccttcaagtggacatgctgcagaaggttaaattccagctttgcaagatctaaaagaacaacaatacattcttcctcctgtccgtactccagcatgtaatgcaacatttcaactctcttgtaggttctcggtaatggtaagtgtagggcacggttgatttgattatctagaggggccttgagcctacttccatccctcattgattcgaggtggtgccttgcaaaagacatagcttcttcaagttctggctcatcatggacaaggaggtgagctgcattgtacaaacttaataatgcccttggttcatcagctattgtattgatgaacctcccatcctctcctttgaatttttcgaatacatctgcaaggcagctaaattaaatgtggatttttccttccaaaagatactagattcccttttcatacaattttttaatacatcggatattcttgactaatttttatgtatatatatactctaatttggatttatattgaaaaattgtttgacacaaaaaataattacgaaaatgaatgaatacctacaatacaatgacttaaaattttgtgatccaaagaaaaatacaaaaatttgtatatgcaagtcatcaccaatataagaaatactcgcactattgaaaattgggcctatctgtcatgcacacagtggataaattgttactccctccgtttcatattataagtcatttgacttttttcctagtcaaacttctttaagattgaccaaatttattgaaatgaagggtgtattttgtaataaacttgtttggcattattgtagtttgtaaaatacatagtaatggttgcagtgagatatttctgaccaagttgcaattttgtgaaaattactctgcaagttatctcctatagtatttattagtacctggagatacccaaatgccatgctccctaagtaagcgaaagtggagagcaacctcgtggaggctagagctagtgaattcactttctttgatgtcacttattacattgtttatctcatcttggaaaaggtgatctattccaagacgttgaactgcatctactaagtgcattttcttggctgtatcattgtgggtctcaaacagtatacggacgtcctgttttagtttatcagccttttccatcatccaatcctccgatctctgtttatttgcatgcaaaaatttgatttgttagaatcaaatgaaagaaatacaggaacaaatagttaggtgaaataaaatattccttttagataacttgttggtctgttgtggatttgaccaatttttttcttgccaaaatcagcattaaatcaaatgtaataaaaaaaatatgataaaactccattgatccgctaggaaaatgtgaactatgtcgcccctttatccttttaagttccaaatatgtgccgttctacaatgagtgcttgcaaactttttaaagaaaaaaaatttgctaatatacttattttttttaataacttacatttatatatctacatcagacgatttgcaaaaatatcgggacggaaacgcgggcctgtgatggtcccgcagctctaaaacgcgtgaccgctccaaaacgcattaccggctatactacaaaacgggtgcgcgggacctcgaaggtgccgggggctcaaaattagcgagcgaggcagccaatgatttttaacgatgtctaccactatcgacactgtgtagacctgtttgacacaattttgtaaggcagtaccgccagttcaatgtgcggaactggccataaacatgtctacacagtgatgtaaagtggcagacacgccccgaaacattgttaaacagtgccgactcagctaatgaatcgttggccagttcgctcccgcgttttgggaccatcgcggtcccgcgcgaccgttccgtgggacatcggtcctgtgttttagaactgcgggaccatcgcggtcccacgtttccgttcctcgaagcgggtatatttttgcaaatctcgtgcaggtatataaacgtaaattattgaaaaaatatgtatatttgtgtttttttcactttttcaaagtacataattagatatagaagtattaatt

SEQ ID NO: 80061 - DNA, 4635 bp, Oryza sativa
cggccaaaagatttttctatgttatgttaataataaataaagaagtatttattggtaaaacttgttaatattgttataaaaatgtattgaagttggttgtttccaatttcatatgttaagtgaggtattattttgtaccttattcgacgtatcagtactcggataattaatataggcctatcgcagtctcggtcgtagaaacattatatggacttaaacaaggagaattatgtaacatgaagaaatagtagtacaatttgaacatgatacaactatttccattgcggttacatagatgatattagattcgaactaggagggaggtagtgcaatagttgaacacaacgacgatgcagtaatgggacaaggaagcatgacagtagaaatttcaatatgccaagttgtccgataatagctaacccctacgtgaggatccctctcctctctcaaaccgcgctttagtaaccctgtattgctctggtagttcccctgcacaacatggctaggtggagttagaacccttctagtgtctatccattctctatattgacatctccttggtggttcctgagaggaaagaatagatgtcaagcgagcaaagttagtaaatgttgtgagaaaataaagattcatgtaatcaaaatattcttaccatgaaatcatcgtcaagaatatttagacaaacaaagaaccttcgacccaatgttgtaggctttatagaacgaagaacctgacaacgatcaccacacctgcatcttggacgggcttcccatggagggagtgctgtagttagcacccgccagtcgctctgttgttcacgacattgtcgttcataagccgcttttctctgtaagtattgctcagtactttcggatgcgaaataccagcgaccttcttgtaaacaagtggttaggtcgagaacgggattttctgtatcgacccactcgatgtatgcgcaagccgtagtgcgggtctgtcgaatagagtagtgttacgaagaataaagcgattgcccatacggaatgaataagcatatgcagataataaaatacctcacggtcatagttagggcacctaaaaaagtgccttcctcgaatatcaggattcctcgaagccattagttggcatcgatcaccgcataggcaaagaggacgctggcaccaaggtggtagtaggtatacacaaggatcgctacgccagttcggatcctcaacaccccggcgtctagccattgacgaaagccggtaggatttgtacccgtgcccgtgaccgccacagaacatcacccagccaaaaagccagagcaagtacgcctccaaacagcggctgtaggagtactcgtcagcctccgcctgtagctgctcgacctgcaagcgttcgataaaatgttaggcaccttaactgtggactaaatatgtagtacggttgtcatttcggtacaaaaacactcacggtgaactgaagcagccacctcttcgtaggtccggtgttgcggtggtgtgccaacggctcgagcgggagatgcggtgcgcgctgtactagtgcgaaacgtgccgtaagatcgtcctgccagtccacacccgtggtcactggcctaacagcgtctcccgcgagcggtagccccaacaagtacgatatgtcctgtagggtaggggctacctcaccgcacggcaagtgaaaagtgtgcgtctctggcctccatcggtcgaccaaagctgctaggagggaccggtccacagtccatcgtctggccgggtccacgtcgccggcggcagcctccaccagccgacacatcggtaggaggccggcctcacgcaacctgcaataacaaattaacatgtcattataataattattacagcgcaactaatttatagtaatacactgtttgtacctctcgacaaaggagtcgtgaaccgtaagtagctcaccgcacgtcggtgcccggaacgtcccaattctgagccccctgtaccgcagtaaggtaagaccgggtgtcggtgatctatcgccgggtccaacaactgaggtgtatcctgacgtgccatctctgaaaaatatagtgtttcgtgttagaacaattcaaaaagtagtaatgtaaaacaaaagataagttgtaaaattatgaaatagtaataaaatcatgagaataattatgtacaacaagagtacaggctatttaaatatagcaaacgttactaagggtacataacgatgacgtgcaatttaacatatatgtagagttcgataatataacataacataacatagcattacgtatcgaagtccgacattacatcagcatacctaaacacactaggtgccttagtctgacgttacatcacgagacctaaagacatgacatgccgaagtctgacattacatgacgaaacataaacacatcaataagttcgaaacaaattacaagcaaagccacatgccaacatagaacataagaactacaccacgtagccagatgtggcacgacgacgcctaggacgtggtcgagtgtaggtagtgtcttcacccgtagggcgagctccatctactgctgatcctgatagtcctgcctccgccgcatttggtttctccttgtctttaggacaatgcttgtaggtgtgcccacgttcatcgcatttgctgcaatgcttcaccctaccagcatccgactcatccatatcgttgcggatgcgacgagtcctcctccttctagccttgcctcggagcttcgatgggtcaggaatattgagtacttcatcgttagtctctgtgaactccccagctatgccgaacccataaatctcgctgctccatgtatgatatattgcttgcttactgaagtactgtgacacatatactgcatctggtatgccacactccgctgcggcagcaatgacatgggtgcatggcctgtggagcagcttcggctttgcacaagagcaatgacatgtgccgttggctttgagaacacactcctgcttcactctcttgcggtagatacccctgcctgccttatcttgacaaagtatctcaaacctttgttgttgagtaccttgcactagagctcgatgtttcatggcctttttacgcaactcctctagctttttctgcatgaaagttccaaacaaaatgctgttgttcggcatagagggaagaattgcctggaaccgatccctaaaatatctgcatgtcccatgtaaaatgaactccactatgccaactagtggcagtccacgaacaccgtgcatcacccagttgtaaacttctgccaaatttgttgtcattattccatatgatgcaccacctgtgtcatacgccttggcccatttctcttttggttcatgcagaattgtcacgcccagaaatttagcccaaatttccagactattttgtgtattaaatccctgtccaggaccagccagggtacacaaaacgacaagtaatatacagttccaaacgtaaataaagcgtaaaatacttacaaaagaggcacttagtcctcgcaccgaaacgaaaacagcagcagcggaaaaaggcgatcctagcggggcttcagctccactccacaggcaaaactcaactggggcctgagccttggtcctctaacttcgtcttcagctcagaagcactacacttctgaaaagggggaataatagcaagactgagtacaaccaccgtactcagcaagccacaccaacgatgcagacgtgcaaggggaacacaaggacggtttgtggctatttgcataaaggcggttgtaaaacattttattgagcaaaacagtaaaactgttgagtaattaaagtaacattaaatctccactgatcaacgctacaccacgttgaacaggcccaaccaacccacctaaactacagtgtattaggtcgatttattaagtgtgagactaatcacggtgaatctggtcgaccgcccataaccgtgggcacggctattcgaatagttttactctgatcagaggtgtacaactgtacccacaagacacagccccacgacacgttcccgtgcgccgacatgccaccacgacataccggaaagaggccgtgacaggacccttcgcataaccccctctaaccgatcgcaccacaccttagggttcgcccccgtccccagcagacaacgggcagcccccctttcgtgccgcggtgaatccggaagccgatcaaccggacaccccggccgacccaactccatcacgcccaccctcgcctgggtacgtcggctagagaaaagctacactacaagcccagccgttgcccacgctggcttgtgataagtacgataaattcttccagggcatcccgcgaaccggtccttaactgccatgggtgcgaccagcaaaaccatgcacccacagcccaccattcagtcgcattttagttggataattacgaccatgaagcatggccaggtgtctcgagcacgcagctcactctgatactaaaaaggtctaatactgcagttatcccatcaactgagctagtgggtaataagcatggctaagcatatagttctagctaggtcacataagtaacatgagctagtcgaatcattacccaagggtgacaaagaacagatatcaagtaaacatggcacaagcgagcagataggtaaacc

SEQ ID NO: 80062 - DNA, 4115 bp, Oryza sativa
tatctcttccgagtgtgggcccccccgggagaagaaatatctcctccggctcggcttgggaaggtaggtgacggcttcgagtatatatagtggggacaactaacctcaaacggtttagggtttgaacccgtttgaggttagtaaacctcacctctgacggccatccgattgcaactcgtcacaggtaactagtcacctgtgacgggccagaagtacaaaccgtcagaggtgaggattaactcacctttgacgggttccgttttcgacccatcacaggtgactagttacctgtgacgggtcgcagctgaatagctcaccgatgacggaatcttttaggacccgtcaaaggtgaccatcatcactgactaccacttatgcccgtcatagatatgtcgtcacaagtgtgaggatctggtgtcgtgtttgtggttgctaattatagcagaggaattggtgttgattatatttgttggatgtttgaactaatcatgttgcatgtatttgtactgtcaatttgtggcttgggagcaatgttgtccacactagtccaatatgcaaacatatgcaaatttttgtgctgctaagtgaaaaaggatggccaagtcctagtctaatgtaaaactatggtgaaaaaatctagtccattgtgcaatttactctatttttaatgataacgatatagaccatgtccagatttatatacaaaactgaacttattttaggacggagatagaattacataagcattatgtcagcacatagattgctgcattgttgatagctcagttctagatggggacaggattcacaaacagatccccaacaatctcctgaatatacctggaaaatgtatatgcatctttcttcttatcgtaaaagaatggcactgatacggccaagttcaaaagtcgttgcaccacagggaactgctggtgatgatcacaacgaacctgattcaaggttctccattcactttcaatcattgattcgatcttgtctaaggcaacttcgcttgtaaccttgttctcattcatatagcactctacagtgtttgcggcatctcctttgttctttcttccagactgcatgagtgtgaaaaaaaagtatgttacttcctctaatttacaatatatatttagcttttcttctcaaattttgtttcaatattatatgctgcaggaattagctagttatatacaaataacatttcaactctccactaagaatttagtaatgtaaagtgataaagtagctgaaccgcattcagcatccaattcctgcgtgcatatttaggttgtgttccataaactaggttggggacttctccaagtgtatgtaaaacaagggacttattaacacacaattaattaacgattagctattaaaaacttgaaaaaaataatttttaaagcaacttttatataggtttttttttagaaaagcaccactcaacaattcacgaaacatgagcatggaaaataagagagtataagttgggatctctagttccgaacacagccttacatatctaaacacaattaatcggggaagtacatggaattaatgctcttaattttttttttcaaaacagtacaattgaagtctataccttgaatgcagcaatgtcgttcatgaaacgcataatctttgcacaagctataacggcacttgatcgtactgttgtcaattcaaatgattccttcgttactgcatcaccctggccaactgcagcagtcacacagagtagtggaacagtactggacagggttgacaaagcaacccgctccttaaatgctggcttgtaattttgatgcaaccattcaaattcttgcaggtaatacgtggatagattttggaactgcacccatgcaaatcaaattagccaaaaaaaactagttagctacatcattataattattttaccgcactactaccatactcatcaaacaaagacatactccacccggttccaataattatcattttaggcaagttatacatagttaaaggttaacttcgtcgagttatttatgggtgagtggacagtgtctcccccctcctccacttgactatccttgtgcgctgccgtttgctttcgaggtcaaccaactgtaaggagagcatgtgccggccacccccttcccctcatcctcggcagtcaccacccaccggctacccgatcgagctagccagctagccatctttggaggtgagcgttgtttcaatgtatccacgctaatgtcaggttgatgcatctattttactttaaactaaccagtttgcttgtagccaaagccagtctattgtgaaatgcttagatgggatccttgtctgtaattttctttcgaatgctttttgtctactgtattaagtaaggtgcttgaatgctgagaggttgtgacttcatagtttcctattgtagaaaaaagccatggccttcccttggtttcttctaatattgttatgattaaaaaacaacatatttagatcgatgtatacacttaaagtctctagctagttcattattttgcgtgtatcttcagtccctgtccatcttgttaaggatatgtagttcgtgtgtcagtgaaggatatatattttgtgcaaagcccgctggaatacgattagattaagtataagctatgggttaattgtgcttcctgctagctagattgatatggcagataattccatttaagctattgggctaaataatatatgaatttcataaatagtatagaacattaaagcatgataatagcagccatatgattaatcagttatttatatccttggaattgttagactgacagttacttacatgtattcaatattatgctgtttgtagtatcctcatgaaccacaactttttaagcatatagcaggatcttattgatcagcttacaatattgtgtgtctcctataccttgatatatttttaccataatctgtagtattctcaaggcaagtaaagaggagaaaatagatagagataaaaatgcattgaaaagggataagatatctgcattcattgtctcatctagcttggaatattgctgccggaggacatgtagtaccataacttgtaacttatagtggtgaataaaagattcttgttgatgtgaattggcatgtacgtgtattggttatataacttacaggattgaagtttgcttaaaatttgatgctgaattgttgtgcatgcctatctgtagctttatcacttatgtatcagtaaaaaaaaaagagttcatttgcatattttgttgaaaaagttatgttcaataatccatatggatatgtggattgaattgttgggggggggggcgggaggttgtcttggagccattttattttatggtgccacatgatcttttttcctgacggcagcacgtcacaatttaggcgacaaaacccgatgccaatggaatttttctgtgttaaacacatagggaaacccataggaaaatctaatttctccgttgtgatttttctatcggcaattcttgtcggttccctcaaaaatacaatttctatggataaaccctatttttctgacaatttttgatccgtagggttggcacaagtctcgtagtgcatagaagtctacgtgtgtacagtatgaaatgagaagtttagtcctaccatgctaattttgggagggttacacaagtttacgtatctagttgtccaagttctagcaacacttactaaacattttacataaagtgaggatgaaaaagcacgtgtgttatcgtttaggcatggtttaacaaattcatgttgagcatacagctataagtattggtacctggattattacgattttctatcagtaatagatgttcaatatggtttcaaaattttaggtttggtggtgaaaagttagccctagattctatcccaaaattttctcattagtgatttaaacaaaagatttcagggatagaattttgggaactgttggtgatgctcttatattgaatatataataaatgtggatagtttattccaatagatgacaaatttcattggtgcacacgatcttttcttggtatatatcgataacatacagtaagaagaatccattaacgatcaatgcataatatgaagat

SEQ ID NO: 80063 - DNA, 20986 bp, Oryza sativa
tttgtcgtttgattaataattggattagctagaacattatatggttttagctaaaagtgcataggatgcttagccatgcttagagacattagctcatataaatgggataacttatgattcactatatttaatgatggcttaatgatagctcacgatggttaatcgtgattggttaattaactaatttgccaactaaaacttgataatggtgggttgtgagcgcatgattttgatggtcgtgctcatgacaattaaggaccggttcacgattttcagttgtgaaacattaaccgtgccaaccacaagccagcgtgggcaacggctttactttttgtatagtatggttcattctggagcaccagattgtgaagtggcggagataagcacacgggggtttctggggagtctatgccttgtttataagggagtgattatgatccaggaacggtgcactactttgaattgtgttatgcaaagggtattgtcacaatctctattcgggtacttgttaagtatcgcgacgcatggttgacatgatgttgaggttgtgtcttgtgagtacagtggtacacctctggccagagtaaaactattcgaatagccgtgcccgcagttatgggtgggtctaacaatgtctttcgtgattagtttcatgcctcttaccatattaaatgacgatgataataatttgtttagctcctggtttagaatggtatattcctggtttggaggtagaactgtgcagccgggtttggttgttcagaatggttgggcctatgcaacgggtatgttgtatagcgttggattaatattgtttaattaaatactttgcaattttattaaattctggagtatttattaaatgccatttatgcaaatgagactatattatgccattctttgttattccctgcatttgcatatttgctgcgtggcttgttgggtatgtcatatactcaccttttaattattcatcaaaggaagagttctacagtgatgctgaaggtgtgaaggattaggcgtagccctggtcaagctgcttgtgggatagagtcgtctgcgccgttcatcttatttttccactgcttggatttttattgtttgagaggaactatctacctctgtaatgactttatattcgcttattaattagagtaatgattgcactctattatcaatttgttattgtgtgcctcggctgattcctggacgagggtttacacacatgtaagcgtttggaattttggatagaaattccgggcgtgacaagttggtatcagagcctccttgaccctaggttatgccaaacggttacctatagaagccctctaaaaatattgaaaaagtagaactgttctcctctctttctcttttaattaaaccaagctaatggcatatgcagtttatagtccctttatttgttctcattcaaaatttactcattattttgtgttgttagtactgtacatctattactgtactaatggcccattttttatctttcttttcagcagaaattttacaacctttctttttatcatgttgcaacataatttagcatgttgattttataactctctcttttattttatttttgaaacctgttattcagaagtgcaaaaaaaaatttgtgatcccgttttatactgtttcaacttatcttgcaaagattggtttactttatttatttaccttttactttgattttctaactttattcaaattaatccaaaaacttgtgctattaattggataaatgtcttaactccctcctttcacttgtctttagatgccgcgcttcaagcctgagtacttgttcggtactgagggatttgtccaggaattgcgtacgatgtccttcgccataggatttgggactgcccctttgtatgcccagattcctcacgatcgtgatgaagagaagtgccgtgtcatggtcaccttgaacagtaatcgtgaagacatcccatcggtgatgttcgaggctggagagggaaactatcctcatgcttgtcaggagatggcaaggatcgctacagtgatcagttggccgacactgagtatcgctaccatcctcgccaaccccaaggaagtgaccgtggcagctatcttgaacctgcagggattgagaatgatgctaccacaaggcatttggttgagatgctgtgggccatggatgagtcccgcgctgaggtcgtattagctgctcaagatcgtgaagactggaatcgtggtaagatctgtaagttggaggacaaggtggatcgtttggagaaggaactagccgcattgaagagagaagcaccaccacaaaaggccagggttcgtcttaccacaaggaagagagctctatttgtccctcgctaccagttggtgcctaaggttcatgtggtggaagaagaagaagaagctgccccagtcccagcggatcctcccgtcgttaacgtgagtgatgatgatggagaagattcgaagcacacccattcaaaggtcgagtggggtgctacccaagaggatgaggacgagccttcaatcaactccgatgcccggaagacctagacgtcttgttgagtcgttgccttagttcattgtgttagttatcttgtttaagtttggttgtgtgtgtgggtttcacttgtgatttacatcattggtgggatgtaaatgcatgcgtttgtttgctttcaagtgttaggaagttggtgagttagtaccaagatgtaccaagatctcaaggaaaaattttggtgggcaagtatgaagcgtgagatagcagagtatgtagctgtgtgtgatgtttgtcagcgagtcaaggcagaacatcagaaacccgcaggtttgctgcagcctttaaagataccagaatggaagtgggagaaaatagggatggatttcatcactggtctacccagaatgtcatcgggtcatacctctatttgggtgatagtcgacagacttaccaaagtggctcattacatcccggtgaggaccacatattctggaagccgtttggcggaattgtatatggcaaggattgtgtgtttgcatggtgttcctaagaaaatagtatccgatcgaggtagccagtttacttcaaagtgttggaagaagctttaggaagagatgggttctaagttgaatttcagtaccgcttatcatccgcagacagacggacaaactgaaagggtaaatcagattttggaagacatgttgagagcttgtgctttagacttcggtggaagttgggataagaatctgccttacgcggaattctcgtacaacaacagttaccaagctagtcttcaaatggctccttatgaagcactatatggtcggaagtgccgcactccgctgtcgtgggatcagacgggagaacgtcaggtttttgggaccgatattctgagggaagcagaagagaaggtaaagatcattcaagaaagattgtgtatagcccagtctcgtcataagaattatgctgacaatcgccgcagggatttaagttttgaggaaggagatcatgtgtaccttcgtgtcacgcctcttcggggagttcatcgttttcacaccaaaggaaaattggcaccgcattttgtgggacctaataagattgtcagtagaagaggagaggtcgcctatcagttggagttacctcaatccttggcagatgttcataatgtgtttcatatgtcacagttgaaaaggtgtttaagggtacccactgaagaagccaatcttgagtagatagaaatccaagaggatctgacatatgttgagaaaccaatccgtatcctggagacagatgagagaagaaccaggaatcgagttatccgtttttgcaaggtccaatggagtaatcactcagaagaagaagctacttggaaacgagaagatgaattaaagtcagctcataagcatcttttcgccagctcttccgaatctcgagaacgagattctgtttaaggggggtaggtttgtcacactctaaaaatcctgaatttataaattgttgtttaaatggaattattagaaatgatttaaaaagcctagaagaaaagatctaattttaaataataaattccaatataaaagtgggctagataaaattttattaaatacttctatagttcctagatttttctggaatttatttgggccaaggaaatatttttaataaatggaattgcatttcatgaataatttaaaaaagaaaaaggttttaaaaatcttcttttggctttgggccgaaagtcggcccaattctctccctctctctcctcggcctgcttgcgcccggcccaaccagccagtcgagccgagccgccgctcgcgctcctctctcccgctgacaggtggggcccacctgtcagggccatcgtcttcctcgcgccgcccagccgcgccctagccgcgcaagccgccgccgcccccttccaaaattcgcccgcgtctttatatctcggatcaaatcaatagaggggaaatgatcctcgggatcccctcttccttttctcttttggaatcttcggctaatttcgtttggaaatcgttgaattcgagcttgattcgaattcgttttttcctcctaaccctagatcttccatcgccgttgccggcggccgtgggcctccatcgctgctcctagcccctatataaggacccccgggacctcctcttttcgtcgctacgctcgcctcagctcgccgccgcttgtagcaccgccttcgcgacaacccgtgcgccgctgtcgccgctgcgagtccagccatgcgccgccgccgctccggtcgtcgtcgtcgctcaggaaggctgccgtcaggttcgccaagtcgtcgccgtcctcatcccatcctccgtttccaccgaggaccgccggagcactgccgtcgtcgtcgacccgaacgcctccgccgcttcgacctcgtcgccgtcgccgtccgttgccgtccgccgttgtccaagctctcggtgacttcaacgcgtcgccctctacgcgtaggcgccctccgtttgcgccgccgcgccgtcgttcgccggtgagcgtgagttgccgagccgccgccggtgatgacgtcatcgccgtgtcatctgtagacccgtggtggattagatcgatctcggccgttcgttttgtctagattagatctcggccgttcgttccgtagaccgtccccgtgcacctggtccaccatgaacccgagcccgctgacgcaataaatcatttttccttttcaaaaataattctttattccgtcataattcaattaaaatctaaataattgatttaatccgatttaatctttaaaaactcataactaattcatcttagctcggatttagttggttcaagtctctaaatttttctaaaattgagatctacaggttaaaagtatccacatgtactgttcatgattgtttatgtgctgttttggtgattttgctcttttatgcttcgattccgacgttcctggagagtccgattttgcaggagaagactttgaagagttccaaggccaacaaggcaagtcacacatatcccaaacaatcctttgagcatgttgatcccgtttaaagctattgtttctattcaactactgcatttattttcgaatgtcattgggtgggaataacctattgcctttgttatactttgtcgtttgattaataattggattagctagaacattatatagttttagctaaaagtgcataggatgcttagccatgcttagagacattagctcatataaatgggataacttatgattcactattatttaatgatggcttaatgatagctcacgatggttaatcgtgattggttaattaattaatttgccaactaaaacttgataatggtgggttgtgagcgcatggttttgatggtcgtgctcatgacaattaaggaccggttcacgattttcggttgtgaaacattaaccgtgccaaccacaagccagcgtgggcaacggctttactttttatatagtatggttcattctggagcaccagactgtgaagtggcggagataagcacacgggggtttctggggagtctatgccttgtttataagggggtgattatgatccaggaatagtaaactgctttgaattgtgttatgcagagggtattgtcacaatctctattcgggtacttgttaagtatcgcgacgcatggttgacatgatgttgaggttgtgtcttgtgggtacagtggtacacctctgacctgtcacgtcctgataaattcatcccaaaataaaaatcattttataaaaggaataatagaattaattacaattcgaaaagaaattggcaaacactaaaatacgtataagaaaaattcgaatgtggcccagaaaatttttgttaaattctccttggtctaaaaggagctctcaaattttacttgaattttcagagcaccggaattatatattaagcaacaacaacaattaactaaaaagaaaaactaaaaataatcctcctccctcctttgggccgagtccagcccaaagtccttcaatcctccctctgttttccctgtttttcccgggccgccccttcctccttccctcccttaggcccagctccctcctcttctcctcctgggccgcctcggctttgcccggcccaagccgagccgcgcctcccacccgtgccgcgcatgtgcgcgcgcgtgcgcgccgttgccgcgcgttgactgcgcgcctctcgcatgggtcccgcctgccaggcgcgtccccgacctccagccgccggcctccttcctctctctctctcccgtgaaccctagcgttgttcctcctccaaatccaccccattcaagccggctttttccaaattaaatagggggaattaatctccattgattcctctttgatttcccccattttcccccttgaacggcgtcccaatcaccgggaacggacgcgccaacaccgaccgccttccattgccgccggccacaaattccgccgttcccacctctcccgtggccggctccctctcctctcctataaaatggaaccccctcgctccattctcttattttagccccctcccatgctctcccgtgtcctcaccacctctccccgccttctccttctctctctccggcgccggtcgacctccagccgcacctcccgccacgaccgtgcgccttccggctacgccgtcaccaccctcggccacgtagcctcctcctcacccccgggctgtcctccgtttagcgtggggagcaccagaggcgctttcccgccggcgtccagtggtgttgccgccactgcaccgtctccggccggctgctgttcgtcgccggtgcgccgatcgacgtcgccatctcctccgtcggcgtcgcagcgttgtcctctcctccggctgctcctctgtttcaccagaatgccgtcacccgtgccggcctatccatcctcctcattgtcgacgtcgcctccggcagcccctcccgccgtgcccgtgcattggccgacgtcgccgtctcctcctccagcgtcgcagcggcaaggtcgcccctggcctcgcctccccatcggcggaacaccgccggtgtccgtcgtcgtcttcaccgttcatcctcgccggctcatcgtctcgctgcgccgccaccgtcgtcggcatcgcagcggcgtgttccatgccgtccttgtctccgtgcagctgctgccggctgccctcgtcgcctcctcgccggttccggtcgtcgtcctcccgtcgttctcggtcgtcgttgcgtttgtccctccgtcaagccgtgctgatcgtcgcccgcgtttcgtcaaggttgctgcagccccatcgtcgttttcgtcctcggctccacgtcgtcaggcctcatgccggccgcgtctcgccttcgtccaaggatcactgccgaagtcgtcccctcgccattcgtctccgtcgttcccgtctgtctccgccgcgcccgttcttcgtcgtcgttcccatgccttgttgcgtggtagtaaggatctctcctctcgctgccctcgttctcatcctatcggtgtcgcccgtgcccgttgtgcggttgtcgaccccggtacccgtgtaccggtgtcggtagtcgttcgcttgtgcgtgtggtgaccgtgttagtgtgcccgcttggtagccgcgtggtttccacgtgtgcagcccgtctggtatctagtggagtccgtttgtcggccactcgcctcggttgacacacgggatctgcttctatcgacccgtggaccgtctctgtgtacccggtccaccgtggtcccttaggtggtccgcatgtcaacggcgcagctttcctgtcttttccaggctagcgcttacacatgttttatagttgtaaaacctaattataataatccacaaatctccatataacagcattaaacttcgaatgaccatgccttggtcatacgaactctgaatcgacccgttcaagtctcctaatgtttgttataacctaaagaaccatgtacttcctttttatgtattgttattgcttctttatagccttgtagctttgcttttgtgcttcgtgtagcttctatcgttccggaggttcccgaagcgtggtttgcgatcgtcgccgaaggttcggaaggccgttctctttgagcaaggcaagtcacatcatcattgagcatattgaatcctagtttataaaattattttgatttaaattaatgcattatcgctttatttcaattcccgcgttatcactgtattatttagccatgcctatttacctttgttatgaccttattattattgctattgttattattaccttgttcaccctaggataaacaaaaccccaactagtgggtactctattcatggttccactagtatgaatttaggtagattcttcgctgattaattatgcaacattaggtggttttataactttagactttgggaattctcatatcatttggacactatggaatggttggattatgatggaattggacatacacctctctttctctttcaaaacccctaaaacctattttccggtggggtttgggtgcatgccagttgtgggaagtagcacccggccaatataaggattaagctcaggcctctattgcaaagcactaccgtacttccacatgtctagtgggtaaggcttagtttgtggctcagtctggttataaacaaaggtacacggatggagatggacgaagtcggggcccgatggacatctctaggacaaatgaaggctacatgagctgcggcccggtagtcgagatgtcatggcacagggccggtgtcctgctgctaggggctcaaccttggttgcccgtctcgggaatcccggccgtagccagggttaggtcggtactcttgtttatggctaggatgggttgggaactatgtcacgtctttcgtccgtatgccgtggtggtatgtggcgcgttgttagacgtgaggaagacgtgtcttgtggataaagatttacacctctgatcagagtataatctattcgaatagccgcgccctcggttatgggcaagcctagcaatgtacccaagttagtggtttacttcttaaaatttgcttaacaactataatgtggaatggttggcctgggttggcttgggacaagctgggacctaggtcgggttgtcagttcggtctgaatcatcgtaggccttgggttaaggcaggttcgtgagggttcacggccttgattaataacagtgtagctctaggatcgtctttataaaatggctttgggcaactaagtgacttttaaatgctgtttactgcaaaacttaacccctatattattaccccttgtacccccttgcattaatcatgcatctcccggtgtggcttgctgagtactgtggttgtactcattcttgctctatcttccctccccttcagtacgagaagctttggagaagaagtcctaagtggactcctagcttataccccagttgagcgcctgtgaagatggagccgtaggcccgctagtccgctgctgtttatttttgattgtcaggccttaagtgtctttgtaataatgtaaatattatcgatataataaagatgtgccttttgtatcatgtttgagtggtgtacctcggcttttcctgggacggggattaatacactagcgtttgggaaaaggtaatttttccgggcgcgacatggccagagtaaaactattcgaatagtcgtgcccgcggttatgggcgggtctaataatgtttagtttcatacctctcaccatattaaatgatgatgataataatttgtttagctcctggtttggaatggtatattcctggtttggaggtagaactgtgtagccgggattggttgttcagaatggttgggcctatgcaacgggtatgttgtatagcgttggattaatactgtttaattaaatactttactattttattaaattctggagtatttattaaatgccatttatgcaaatgagactatattatgccattctttgttattccctgcacttgcatatttgctgcgtgacttgttgagtatgtcatatactcaccttgcaatcattcatcagacgaagagttctacagtgatgctgaaggtgtggaggattaggtgtagccctggtcaagctgcttgtgggatggagtcgtctgcgccgttcatcttatttttccgctgcatggatttttattgtttgagaggaactatctacctctgtaataactttatattcgcttattaattagagtaatgattgcactctattatcaatttgttattgtgtgccttggctgattcttgtacgagggtttacacacatgtaagcgtttggaattttggatagaaattccgcgcgtgacagtggcgaaaggttttagacaaatttaaggtgttgattatgatgaaaccttctcaccagtcgccatgctaaaatctattcggattgttttagcgattgctgcctatttcgatttttgatatggcaaatggatgtcaaaacaactttcattaatggaaatcttgatgaggatgtgtacatgacacaacccaagggatttgttgatccacaataagctaaaaaatatgcaagttgcagaaatccatttatgggttgaagcaagcatctcggagttggaatatttgttttaatgaagtagccaaggtgttgggctttgtcaaaaatgaagaagagccttgtgtatacaagaagattagtgggagcgcacaggtgtttctaatcctatatgtagatgacatattgttgattgggaatgatattcctatgcttggatccgttaagacatcgttggaaaatagtttttcaatgaaggactttggagaagtagcatatattctgggcataaggatctatagagatagatcaaggaggctaattggattaagccagagtacatacattgacaatgtgttgaagaggttcaacatgcaagattctaagaaaggtttcttaccgatgtcacatggcattaatcttggcaagaatcagtgtcctcaaacgactgattagcaaaacaagatgagtgtgaatccatatgcctcggcaattggatccatcatgtatgcctgttatctacacgtccagatgtttcatatgcaattagtgcaacaagccgataccaatcagatccaggtaagagtcactggattgctataaagaatatcctaaagtacttgagaagaactaaggatatgttcctagtctatggaggacaggaactgctcgttgtaaatggttacaccaacacaagcatccaaatcgataaagatgattttagaccgcagtctgaatttgtgttctgcctaaatggaggcgctgtgagctggaagagttccaagcaagatatagtcgctgactctacaacagaagttgaatacattaccgcttctgaagcagcaaaggaggctatttggataaagaaatttgtttctcaattgggtgtgatggccagtgctcccagccctgtgaacctctattgcaataatagtgatgccattgcgcaagcaaaggagcctagatcgcatcaaaattccaaatacattttacggcggtatcacctcattcgcgagatagtgggtagaggagatgtgaagatatgcaaaatacatatggatttaatgttgcagatccattgacaaagccactctctcagcctaagcatgaggcacacactagggcaatgggaatagagacatgcgtgattgactctagtgcaagtgggagactgttggtgatatgccctagaggcaatcatagagatgattgaatcacatactatgtttacatatttatccgacattattccttgaaatagataactcattattggttaatgaatatgtgattctttcatgagactctttatgttgtatgttactatttctaaaggatcccttatcaaatatcatatgtggaacaaatatgtttaaatgatcagtacatgtattaattgatgatcatgtctcatggatcatggtatggagataccaaattaataatgtggacacatattggggaacatgttgttggatagtcccaacatgagacagtgcaagagccatatgttgttggatatggcggtcggagggtattaccgacctttccaactgccataaccgtcattacctgcctatttaaggagctcactctcttcatttcttcacacacttcaagcatgagctttctcatttctctcacgtttagtttagtagtatgaagctagtggagtaggaatagaatagaaatcggagtctggaagtcttcggaagagttcgggtatgactctagtagctctcctttcctcttttgtaagatttgtactttgtttagaatattcgtctttatacattttttttgcattgaaatactttctgagtatacgaatgccaactttgctttatgttcatgttatactgattatactgctagcttatctgggagttgcataggtacgggtataatgtttgctattgcaattattctctgtcatgacgatgatattagagtagtatctggtagtttaggcgtagtgtctagattattgggtatcattatttggggttatatgctgcggatgagaggtgggtcgctgatggtgatagctcactacgggtattcctccgcgcgtgtatatagtcctaagttaatttcatgggaagggtactcctccgtatttagccccggttgtatggttacgacgggctgtcgtaaggaactcgacagttaggggtggcttctcgaagtactagaaaggcatcagaaagagggtattagctagttaatcgtataattagaatgtatgtataatttgtatacaagaagtataggaatagattcttttctattttctttccacttagcttagataatttagtatgagaatgagtagtgctatgcttgtgtgtcaacctatcctttggattatattaacccctgcttagactatgattattacaagtaacatataaattattagtacggttctttctactatgatcttcccacgagattaaacaaatacgatacccttggaatactcttgggtgaaatgctacaatggtatatacgtgtgcttgcggataaactctgtaaccataatatttctgcagtaatgtagtaagaaataccaacacacggcaataaagtaaaatttaagaaattgtgcaactctaaatttaccatcaccacaagtatatcactagcatacactgtatttgtttttgaccctatcggcattctcattttttttcaataatttctcttcaattgagctgaaagtgtcctccagtaaattactagttattcaagtatcttttagccatgacacgttttaacagtatctaatttcaaattacacaatgtttgagtgtcctgtagtaaattttgccatgacagaatcaacacatagcgaagagaacgaatattttttttttattccttgctagtatattgtactactattttgtgacatttcttgcttagtacagaccttttagtatttattattggaaaaagtatgaattaccccctccctccgaaccacaaaaccagacatattaaacctcaaactattgaaaccggacaaattaccatcctattagattcggagcggtttcaatcctacaaggcgttgacgtggaaatccaatcagcaaaaaaaaaaaacagggctcacaagtcatattaattcccatttaccggcactgttgggcgagcggcggcactacaagaggaacctccctttagcaatacatatatgtattgcaaaaagtgaaaataagcattgctagggtctgtatcaacgcatttaatatgcgttacctatgctgctgttgctagcaccaataacaacacatacacaatcgttggtaacatgtaagaataaacattgctagttagcaacaaagtaaatagttttcagccatacttgtatgcgttggcagtttcggtgatgaacaattatatataatccttgcaatggctataatcaagttgcaccaacacttataagtattgcaatataggcaactattcattccagcatgcctttgcacaattatcttgttgggttagaggcccataaactcaaatgatgtacacatgagaaaaactaagtcattcataaaactaatagtaattaaagagaattttttgtattacatggaaaatcatcctcataagtcatgacattaaattttgttcagaacatcatgcacaaatgtaatctaaactatagaaaaaaaaacatgcatctgaagttgccactatcattgccaccatcttccacattacagtcatcatcatattcacaagggatctttagatgacagttgtccaccttgtagtaaccatattgccccagatcatgatccatttatcttgtcaacctgtaacagaaaaaaaaacaaccattgatacagtattggaagaaagaagatcacatctaaagaatttgagaaatagcaccgtacaaaaattgctggccacgcaatatcaagtcgtacgacattgccaataattttgtagcctttgtatggcctgatcaattcttcatattttgccaatggaaaatgaacatgcaccatcaagtattcagttcctagctcaatacctgcaactttgcgtgttggatcacagcttacaattgaagcaacaaccacattcttatttcgatttttccagcttttcaagaatacattagttccaatctggtgcataaatatatgtccatcagcattatctctatataaagagcaattaagtatggaaaagaacatcatattaaaagttttacctccaatgaattggcatccataatgtccactatgttgcactgttgtttctgtacaaagttatttggatcaagattcaataatttaactataaagtacaaacatattataccaaatagaattctatagcttatctttatattaggtggctccagaagtgaaaatttaccttataagcattagaattattcttcccttgttgcatgtgatcattctggttcatgtttcctttattctgcacggaatatcaaaatattggcacaaactacaataatctagttatttttataatcaaacactgtcagttccaatcaataaaaaagtgaagactagccttcacacaaataatcttcctctgtttctcaaggtgattttggccataagtttgattgctgtgtaataagataagacataagattgtaatgaacagctacaataaacgttgacagttgcaaacaatattgagatcatataatgctatgtagtgagttcgacataacaaataggaagagaatgaccttatctacagtagattgcttggttggtagttgcaaaaccttgtcctgaacatggatatttgtttaagaatgtcctttttaacttttaattcattttttttctctctctctttcctattagaaatctccagtctgtgtagcttaagctacacaaagtaccattcctagctaccattccaagaaatttagacaaaattccagcttcatctcctactgcctgattgagatcattgcactgaaccacaatcctaagacctttcggaaggttccaaatatctttcagttttgtcttcccacgtgtttcaattgttccattttcatctgttcaatgttaaattgcaaagataaaagtgatgctcaacagtccaggataagaagaataatttcattatttcttaccatcaagatttagtatttacctcgaacattaattttaacatcatcatcagattcttcattgccttctccagcattcatactagcatcgtcatcagtatcttcattgacttctccaacatcgtcatcagtatcttcattaccctcttgaacatcactgcatattgtttctcttcagatggtgtggcaagctgtttaggggcattttcttctgcaatgtgttcctctgacaaatattcctcatggctttgaacaatgcaccgccttctactccttgccatatctgctgcaccaaaacaaaaatagcataaacctatgtattgcagtctgagtaccacttttctctactgctctagaagaataatttcagaattggctaaaactttaggcattttactctactgttgtccaaaaaagtaccactatggtttgtattgatgagaaaggtgctagcctacaggttattagatacctctgttagctaatgaacaattttcaaatagaggtgtcaacacattaaaaattgaacaataaatttactaattccaatttggatttatttgccagtcactaattcctttgtccattttaattggccaacaatttgaaacaagtaattgatagaaagaacaaaatttaatttgacgcaaggagataaaatgcatagatggacagtgaacgatcaaaagcaaaagtggtttattcggctagattgcaacatccaggacagaggaatataaaaagatcacacattggattgcttattggtctgttctagcctaataggctctgtcacctaggattgatcactgcatctgatccaaaacctgcatacagagaacatatatatcaaattagtaatgtagtatagtgctgaaatggaattaggcccgagtgtgatttggcaacacagctgagcagtgaaacgtgtaggaactaggaagggaggcggagatgcaggagcatggcggcagggccgtgggctgcgcgcgcggtgtagacgtaggcgctggggaggcaaaaccgcactagcggtgcagcgcacagccaccgggcatgaggcgtcgccgcgtggccctcagcggccgtgggggagctcgcctactcagggttgttggtcggcggggaggcgtaggtgcagaggatggcagccaacacagattgggagaggtgtggacacgcggagcggctggccagcaaatcaccatggtgccttaccttcagattggtgcctggcttaagcctgaggggaggagcagtgcacagagaagaagagaggggatagagtttcgttggagaagaaaacccacccacgagctctttgttggagaatggagagagaggagatagagtttttcacgggcagttagattttcttggagggataaaatggagggaataaatggcgcgacaacgaaagacgtgagaaaaaaaatattgagaccgaaaatactggagggagagcaaaataatttaagctcatttttttcgaaggaaagatttggaaaataacgtgagactgaaaaaaaaaaagagggaaagaacggagcgagagcaaacgttctgtcggagataaaaataatgttaaattctgactgagtagatttaagctcaatttttcggagggaatgatttggaataagactgaaaaaagagggaaagaatggagggagagcaaaataatttgcgcaaatacacaaaatgttaaattcacatcaagtaaatttaagctcgatttttttagggcagatttaacctccagttatctaatctagttcagctaatttatttttgtgcggatcaataagaactagttataaaacttcataaatgcactagtaaaaattattttctactaatacaaaccgcgtcgttgccgactcggtcctgagagaccggataaaatccaaaagtaacatattgttttcttaaaatagtagttagttaatttatcttagcacgaccgaaaaatcacgtgttttttcattgtagacccggtctagaaagactggatgaaatccagacgtaacatattgctgtcttaataaaaaagtagttagttaatttatcctagtacgaaaaaaaaccactttattttacattgttgactcggcccagaacatatttttgtcttaaaatagtagttattcaatttatcttagcacgaccgaaaaaacgtttttttttgtcaatctggtccggacagaccggatgaaatcaagacgtaacaattttttgtcctaaaataatcattatttaatttatcttagcacgaccgaaaaagcatgcgttttttcgtcatcgacctggtccggacatacctcatgaaaaacagacgtaatatacttttggtcttaaaaatatagttatttaaattatgttagcacgaccaaacaatcacctattttttcattgtcgacccggtccggacagaccggataaattccggatgtaacataattttttgtcttaaaattatagttatttaaattatgttagcactaccaaacaatcacctgttttttcattgtcaatccggtccggacattccgaataaattccggacgtaatatatttttttgtcttaaaattatagttatttaaattatgttagcgctaccgaaaaaacacttgtggtccagacaccgcggattaaatctagacgtaacatattttttgtcttaaaataatagttatttaaattatgttagcaccacaaaaaagccacgtgttatttcgttgtcgacccgattaggatagaccgcgtgaaatttggacgtaacatattttttttcttaatagttatttaaattatgttaggacgagcgaaaaaccacatattctaaaaatatatttttgaatggtttattttaaaatttagaaataaaaaagttcaagaaatttaaaaaaatctgagcagacagaatttaaaaagttttaggaatcgccactagagaagaaatgaaaaaaaatatgcatttgctagtatttgaactggagtcctcaattcagtagaaacagccaagtaccactaggctatgtccacttcacattggagaagtctgttttatttatttattcacgttaggtgccattgacaatgtaaatagttttctcgaggaatttgtataagatggaaatagaataacacaacacagatagatgcaaaaaatatagtcggccattccattttctcatcatataaacaatatgatatcttatatattgaaaaataagatctaaccaccaattctgtatataactaatgtacaacattattacacaaagcatatatgcaaataaaaaaaatgcatccatctggctcaatcacttggacaatccaatgaaatctacgaacgacacagtaaagctattgtggtgaagaagcctcgatcccagtaaatctccatccaaaattactgccataaaaataaagagctcgccaagtgaggatatcaacgatataaggaaatcagtgataatggacagatagacagagaacaaccttcataacctcacctttaattagttaccatgttatcgacagttgttccttctatatctcttcggacccatgtctgaccatcatgtgcattgtcaaatagctccccaagattattgacatgatatggttcacattccacatcattccattcttcgcccagttcaaatacatctctgggtttcatcttccttacaatagaccaccctggatttaaatggtcttcaatgtaaaacacttggtcgacttgatttgcaaatacaaagggctcatgctcaatcttttcaccggtatgaattttatttgagaaattcacaagtatgcagccaaacttatctgttttcactctttttcctttagttacatcgacccattcacatttaaacaacacaactgagaaatttccatagtagtctaactcaattatatcaagtatctttccgtaatacatgatatcaccaaggacagggttggtatcactcgcagacgtgtagctcgatgtttttgcagtcacaacaactccactattttgagtcaccctgtcataacgctttgatctgaacctgtacccacgggtattgaatgctctatgtcgttttgctacctcaattggtccacgtgccaaccatctaatatcctcatcaatgctatcaatacctctttgattctccaactgcaaagatctacaccacaccaaaagatacattagttttactcatatttgaaaagaaaaatctaaattttgatacttacatgatctctgaaccaattaggaaattgttcattttgcatgttgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggtcgggttgcgcttgccccggccccgagggccgaggcaccccgaccccttaagaaagtctgcgccacatatatgggataagtgagcacagctgtgctcacctaacagcatttattgcagtctggtcaaagcgtgtcacgctgcatgcaacgcagtacagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgttatctcttagagatggcacgttaggggatcctctagagtcg

SEQ ID NO: 80064 - DNA, 16473 bp, Oryza sativa
gccccaaatcctctctgctctacgcctgcatgagggtgggatgcatcgatcatgcatgacaattcatggtgcacgttgtcgtgacctcgccctcgtgggtcgtacgggggagaaagcaaacgttgatcaaatgggagattgtccggaacatgttgaaggatgatccaccttagatgacttgtgacaagttcttttttctttttacaaccaacatcggatggagcgatgattcattgaatagagtataaaaaaattacaagactagcattttgacaagtagtaattataaaacaaaaagaaaaaaacaccaccaacgaagaaccccagagaaggctagcactataaaccggccgctactaaggtgacatgctcccgctaggccaacaaaaaagctatagctcaaccgcccgaaaccaaacccaacagcctaacaccacactcaactctatctacgcctttggaattggaggagacagggttagagcaaaggatcaaagtgctcttccccgtaagtcaacatgactatcttacattagctaggataccgccgcaagaggacaatcatatctagagagagcacgtacaagctgtctgagagaagcttaatttgacaagggagcttcctagacgatgagcaccgccaacgccatttgtcgaggtctcaaggagaaccaagacaggtttttcacctgataaccccacgagagggagagagacggctccacagcgccccaagaggtaaaatggcactaaagctccatcgttgtgggcttggcaatgacaagctaagttttgaaccgaccgcatcccccgagtcgatccttagcttagctattgctccattgcccaccaccgaacaaccccgctagcgtgaggacatcacttacctgacaccccctgccggttagccacaacatgcctctgtggaacacccgccatgtcgagctccctaccgttgcccgcactgacctccagagtcagcctcccgctgctgccggccgcacgtctcgcatcgtgccggcctaccaccgctggcggtcgcgccggcctacagccgccaccgacatgcaccaggctagctctactagccgtagcctccctaccgattcacgacacgtcgttccacatatatgtttgaccattcatttcattaagaaattaattaattattatttatatatttatagtggcttgattcatcatcaaatattatttataaaaaaaattaaataagagaatgattaaatgtttgttaaaattaatgtcaatggcatcctatattaaaaaaaaagagaggtagtttatatatatgatagacacatagtatatattctgtttgtaacttgccttacttaccacgctgtcgctacctacccagcatgaaaatgtcctacgtctctctattggaaatttggaatctttctactacttggaggcaaacaagtcttaatatgctgacttttaactggtcaagaacaaatgaatcagaatctaacaaggttgccacacagtaatgaaagaagagggtacacatccatgtacgaaactgtctgctttttcatcacagtcacgactcattctaacatacaaaaaccaagaattcaaaccacgtgaattgaaaaccaaagcaacgtgtacttgactaacctgcactctagctaatcctacttgtcatttctgtgctgaccttcagctcgatcgatcgcccaatccatttccaacgtagaatctttcaaaccttaataaacaaaaaaatattcagtcatatattctacgtctcaatcatgaaatccagtctatatatcgatcaataccgcagaagaaatgtacatatatatttctgccaaatttgaacattatatatatatataccaccttacctagtctatatatatagactgggtgtgtgtatatgtacgtacatcctcttctcatttctaagctagccaaagctatagatggatcacagccttgctagtgctttcggcataaatgccggcaaaatgatcatttcgcagaagccacctactaccacatgttgttttcctatacatatggtttggcacaaaccagctgttgctgctggaaatacgtgcgacatcctaagatcagcaagcaggcacaagagtttacaatccgtgtcttgtcattcacatgccccagctcctgttccagctgccgtggaagcggcggcaagttttgagccctcggtgtggggcgagttttttatccaccatgaaccacaaccactgcaggcaagtgtaaaagctatataaaatctagcagtaatcgattataattcttcgaaatgatgtccccctttgattactttttttcttaaaatcaaatgtaattggtcgtacagaattataaaaattttgataatttagggtatatagtgatatctggttgaccacttgaccaccatggcgtgtcatacgtgttgtacattccatttttgcaaatctacggaagtatattggtaatttcaatttacggaagattgaattccagtcttaataaaaagcaaagtcatagaataaactcagtataggatagttgaaaacgtaggacatgctaattagttggtcaattgaagccatgatcttcttcaaaatggacgattttacagagcgattcaaccctggatgtctcgcatcagaaggctcctatatactcccccattttatattataagatgtgttaaccttctgtagtcaatttttttaatcttgactagattaatttataggaaaacatgtgaacattttcaacacaagacatacagacagaccatcaaatatatatatgattgttaggtttaacaaaactaatctgacgttatagatgttgataattattttgaaacataaccaatatattttagtaggaaaaaagtcaaaacattttatagtataaacgaaaaagtattaatcaaccaaccgacttaattgcacgttgcggttaaaccagctaacaggccagtccaaccgttccacaatgaaccaacagcttggatatattgttcactctcccctaatccagcctttttttttccatacatttaggtttctttcttttgcatcgttctttggttacagtaatatcatcgaaaattttattacttcttttctttacaatccttattactgaccaaccaatgcatgtaagcaagcagatatcagaggaatggatgagagagagagccaacaaattgaaagaagatgtctgcggactgtttattatggcctcaaatggcatcttggagaggatgaacttagtggatacaattcaacatctaggaatagatcacctctttcaagaggagattgactctgcactaaaagacatccatgaaaatgatttagctagctctaagctgcatgaggttgctcttcggtttcgcttgcttagagagcatggattttgggtgtctccaggtatttttgtacctatttaataaattgttaagtttcttagtataattgatcaacacggtgaggccataaaagggcttaaaaacatgcacagttatataaccttggcatgctataaaaatatgtagtgtaaactgtgtatatagtgaaaacctagaaacaatcatggaataaaaaaatgaacgtgtaagatttttccatgtcattatgagtaaaacttttattctactatatattttcccaacatgtcacaataatcgcatatattaattgttctcaaatctaatgtgcagatgtatttaacaaattcaaaggtgatcatggcactttcaataacgaattatcattagccgatgacccaagaggcctactatctttatataatgcagcccatctgttcatacatggtgaaccagaactcgtggaagccatttcttttgcaaggcaccatctcgaatcattcaatcggcgtaatgttctgaaggcccctttagctgatcaagtcaagcgtgcccttcacttgccattgccaaggacacacaggagagtggagatggtatcatacatgtttgagtatggccgagaggatgggcacaatcccgttattcttgaactagcaaagctggatttcaacctactgcagcgtgttcacttgaaagaactcaaggaaatatctaggtactaatatcaatttgttacgagtatatcaacggctgggtaatgagaattcatgtggccacaaaaaaaagagagcaaaatataccctaaattcaatataaaatgatattctatctcttgcattatattataatatgttttaaatgcattatcttattaacttttggagacggcgtttaattaatatcatttgtcttattgaaaaattatgtaagtatgatttattttgttgcgaattcttttatcaagtacatggagcatgtcatataattttcataattacactaaattttcgaataaggagaaatgtcaaatattatatgtccaaaatttaatattgtcatgctattaaaaacagacgaagtatatctaagaatgtggaactgatcaatgtaccatcataaatacgcatagactgtttcaattatgatcgttggtttcacacataatttcctaaatatatacctgacgttgcgctatgttgacggtctcaatgtatgtacaaaattgatatgatattttctttcaggtggtggaaagatgtttctggatatatgggtataaaccatattcgagaccgtgtgattgagtgctacacctggtcctacgcagtgtaccatgaggaagaaatgtcgtttgcacggatgctctttgctaagatagttgtgataattgccctattagatgacacatacgatgtccatggatatacctccatccaggaatgccggatgctaaacgcagccattcaagggtacattggatatgtttatatatgcatcaaattatgtcttaattattattagcacgctgacaattagtggttagatgaatgctgactttgattttaatatcgtgcagatgggatgacagtgctgtcttgcttgtacccgagtacctgagaaagttttatgaatttatcttgcgctgctttagggagtttgaggatcaagtgccaagcaatcagaagtacctgattgccttcagcaagacagaggtacatctagctctattaattatatatgttccagaatccaaaaacatgcatgcctacatagataattaataatataatttttacacaattaattcgttttgtccttaaatttcgtcccacaattaatttttttatgacctcctttgccccaattatatatatatatatattcatacagttacaaaggttgtcaagttattatctggaaggagccgaatggtcccaccggaagcacatgcccagcttcagcgagcaggtggctctggcgacaatgaccacaggaacacggccgctggctgctggtttaatggttggcatgagtgagtccatgacaacgaaacaagcgtacgagtgggctgtgaatagcactgacgccatcatctcatgcgggaaaactggccgtttcatgaacgacattgccggatttaaggtatatatataccgattaactaattaattaattaatttgacatgtataaattcatttgcagcacgtacatatatcgatcaatgattattttttctgttggggcaatattactattaataacccatgttttgtattaattcttattgtgaaacaaagaattataatattttaaccctaattttagaaaatgtactttgtttcttactgatctagaaaaaactatgaactatttatataaacataaacatatatctacattaatttaaaataaaaaataagtcaaacaagaagttacaattaatttgtactgaaattaaagttttttgttttatgcaaggtttcggtttcaggcatgcatattagccgtcatatgtaaatttcggtgaccaatatataacaaaaaccagacaactaacagataggaaaaatagttttaacgaaggataatgtctggattatcccatgaattatcgtggtcgtttgaattgcccttaaattcaagtgctagacattttgcactcccaactattctaacctgttaaataatgccattgactcaacccagagtggttttcgttcctacgtgacacatacgcgcgcatgcagcctagttagcaaagttttcttttaaaaaaaaatgttgggccctcctatcagattttctcctcccattatctctttcccctcttcccatgatcgtgagtggcatcgacacccaccccccatcttcctctattgcacggtcgagacctccgcaggtgatgatgacgctggtctagagaggcacagtggtgacctcaccaggcgatggtgatgccattggcggctacccttggtctaggtcgggcagtggagcttcgtgagtaggagagcctcgagttcgcatacatctgccatcgccctgaagtccatgctagtcagcttcaagtctgagctctgagtttcgctgtcggacccaccgccaccgccaccaccacctccctaaagtttgttgttctagccgatgccctccacaggcgagctcggctccatcgccagctgccttaacttctagcatctctccctcactggccgctgcctccagcctccccaaggtgagctcgaactctgctgcagcaccatacccaagcgacctccctcttcgttgttggtcgtggctaccctcttcttcgccaccggcagccacctcaaacatccctgagaagagatcaatcaccgtttaggcgcactccccaagcgaggttccattgcgctgttgttccgctgagaacgacctccaacactctcaccgagcgagctcgatgccaatgactccctccagcgctcctgagcaagagagatagggaggtagagaaggatgagattgttgatacgtggggcccataattattttaaattttttgtgctgactggatagccacatgtgcttgtttctctttgaatccgtccaaaatagtgcagcggttagttcatccgatttaaatagtggagggtgtaaaatgtatggtatttgtattcaagaaatagttaggacaaccgcgatagttcatatggtactttggatgtttttataataactaatactcctactcctttcattccaaaataaatatacttatgcgtgtttctcaaaatgtataaaattcctatatatattctgtaagggaggtagtacctaatcttatactccctccatcctaaaatgtttgacgccgatgacttttttaaatatgcttgatccttcgtcttattcaaaaagtttaggtaattattaattcttttcctatcttttgattcattgttaaatatactttaatgtatatatagagttttacatatttcacaaaagtttttgaataagacgaacagtcaaatatgtttaaaaaagtcaccggcgtcaaacgtttagggaaggagggagtatgtagtataaagtatattgacattgagtatgtgtgctacatggaatgcagctcgggtcgcagaacaaagctgacatgccatgttcggttgagagttacatcaacgagcacaaggtcacagccgatgtcgccatcgccaagattaatgaattggtagaagatgagtggaaaacaactaaccaggctcgcattgaccaccgtgatgtgctccctgtggtgcagcgccttatcaatataaccatggccattccattgtattacagcgatggaattgatggattcacgttcggcgagggcattcaggaggttcttgagaaactctacgtcaagcccattcccttatagacacaaattaatttgttgatggagcaatccatctctgcccatattgtgccatataatttatattcctttttttgtgtgtgattctatactttgtattaactctcaaggttggcaccgatgaaatctcttcatcagtgcaaggacttgagatattatctatatggacaaataatttttgttttatgcttcacaatgaactcgatcttgtgttgttagtattactggatgatgtacggtatgatcgatatgatgtttgacctcaagaagatagtcatattgtcttcttaattttgtgctttctagctatccctccatggtgatgtttataattaatcttattgttaacccatcatacatatatgtaactaatctcctcatgctccgtctggtattttgcatctattgaggcaagattgtaatatgatgccctaatcaataaagctctctattcgcgcaaaaaaaattaatctcctcatgatcgtccactccacctcctctacctccacttcctctccatcactcctcttcctcatctcaactccgttgatggtgggcgcgggagcgggagcggcggggagctctgctgcggtggaccctcctcctcctcctcctccacccctcctctcctttcctctcctctttgtcggggatgggcaggagtgacctgcgccggagggatctggtggtgggcgggagcaggagcggcagcggtggggaactcggtggcggtggctgatccggcggtggggacagcggcggcaacggatacggctctctgccacccaagcggaaaccgacggcgctcaacgcgtggcaccggcgtgcggatcctagtggtgattgctagggtttcaaattttgtttggaattaatttttttggcgggccgatttttcattttgcagttggacaggttgagcacccgcagcggttgctctacacgcaggcaaaaatacagatttttgcatacacctgggtgcagcgggtcacccacccgtccgtgaaaatcgattttgatcgtaagcaaaattcgtttatgtgtgtggtagcgaaagtagaccttggagcctttggcacttgaagtcttcatatactgttcatgagctcctacattaatagatggccaaaatgggccgctcggcttggcccggcccgtccctggcgtgacccaggcacggcccgaggccagtcgggccggcatggcccaaccaactcgccgtacagggccatgccatacaccaacggcctaggcacgactcaatgaggctctcgggccatgccatgccaacccgaagacacgattagcccaccgtgctcgtccttgaataagtatattttgcctccctcatctctttggaatgggacttatatggatagaataagtctatcttacctccctcaactctttgggctgtggctgatactgctgaaaataagtctatttggcctcccttatctttttgggcctactgatcgttttgccgttccgtgcatccctagcgccactgctgcgccccatggcaaaaacactccatacaaaccactgctgcgccacatggcaaaaacattatcggtttgcgacctactttgcgatgacagcggtgatggctaggtgacgacagtattggcgatgacaatggtaatagtttggcgagcaactcagattttcttttttttttccgaaactggcatcactaccggttgacaaccctctagtgatattgccggtggcagtgatgctgtgatgggcatttctgtagtgatgagactttagcgaataaagtgagagtaattgtaaatagtacgactgttttattaactgtaatttttgtgacatcttacataaagaattaaatttattggcaattagttattttgtaattagttacatcacaaataagaatgaacttttcaggtgtttgtctcatccaattgaaatgtttgtcacactcaagctatagtcaaactttggctgttcaggacatttgtttattcatgagccatattatggcaagcgaaacttctatattcctatgcttaatagatatcatatacccaacttacaaaagatactatatatcatccaaatcatacaaaccactgctgcgccacatggcaaaaacactggaacattatcaatccatacaaacttttatttgcataataaacatgtgattgatacaccaagctatctatatttgtgacaataaaactccatcaaactcccagcagatgacaatctctctgactaattaattgcctgatctccacgatgacagcggaggagtttcagagttcttccaggtgttcagaaaagtaccatgatacctgtcaccttgcacaacgtcagctgaagcatacgactcaagttcagacatctcgtcaggtgtgagcttcactgacagtgctcccacattctggtcgaagttgtggatctttgtggttcctggtatgggacagacatcgctcccttggtgatgaacccaggccagtgcgagctgcgacgatgtgcatccctttctcgctgccatggcattaaccttctcgaatatcgccgcgttcttctcgaggttctctggctggaatctaggtaggctctgaagagaagagtggaaaatgcatattatatttgtgaaaaacaggcacggatcaatgtcgatctatgtattgattggacaaacaaagaatcgatatttaagattttatttagatcgtaattaattgttgatggctgtcgtggttgatctcatgggcagtataatcaccttgcggaaatcgtcgtcaggaagttcatcgaccagtttagctccactggagaagaaccctctccctagcgggctgtacgccacaattccaatgccaagttctctgaaattttcggaacaagaagaaataatgcagtttagaaacacatccatagacatgttctgcttcaatacaagcaggtattatatggtgtggggtgctctctgaaattgtgggaatttccgaactttttggcacgaaattatttgaaaaaatttaacaaattttgattgaatttgaataatttttaactaaataaaaaaaagaaaaatgccaagaatttcgggctagatatttgcgtgctagagaggggcaaaatttccaaaatttcagatcgaaattgcaatccctgcagaccgaaatattcccggttttctagaaaataataatagtagtagtagtactgctccatgattcttacatatataatatatttacctgcaagttggaacaatgtcttcttcgacatcccttgaccacagtgaccactcgatctgaactgcggtgatcggatgaaccacgtgagccctccttatcgtcgacgcagaggcctcagataatccaatgtatttgatcttgccttcttcaaccagcttcttcagctcacccatctgcatgtatataaaagtcagaaatgtaggcttggtgagtgctgaattaatacttatcttcgaagttggaattggtatggaaagtacggtttatttttgttgaatttttcccatcgggtcagctcttcagttgagtcaaaaagataaagagtgtgtgacttctcaacaccaacaggagtacaatctttctatccatatctattaataaacggttttgctaaaaatacttactggccgttttttcagtaatgaactttcaattctatggccaagcaaacgtttgggggggggggtgttggatgggactaaaagtttgtaagtccccgtcacatggacactaattagaagtattaaacatagactattgacaaaattaacctattccataatcttggactgattcgaaacacatccatagactgcagtttagaaacacatccatggacatgtcatccattctccttcaatacaagcaggtattatatagtctcgggtgctctctgaaattgtgggaatttccgaaaatagtaatagggtatgattctcttagtagtttaaaatccaaggtaaaaaaagtataaaacgataaataaaaaggagcagacggtttaaaactaaggttttaaaattttattttatttgcggcctataatatctatattttatttattaacttcggtcaaaattaatatctttccatttctccatgagctatttagtcagcaactatcatgatatgatttatttattattaaaaacacagcgttctaccatcaccttggcgtacgtacgtctccgcatcatatgactatctatataaattcaaagcaataacagtaaattaaaatgcgtgtgctacgtgccaacgtaatcagaagatctctccgcattctggtcagttcttcatcaattaatttactcaaaaagataaagagtgtgtgacttttcaagacaaacatgagtaagatctatatatttatctatttttaaaatattaacttaatttggtcagtaataatccagtatatatcatgatataatttattttttaattaaaagaagcgttattccatcatttccatgtgtccacatcacatgatgactgtataattgaaaactgtatcctgactagaatttctgtatgacaaaaggaaatagttaaaattgtgttgctaagtgcctatatttttttcagaatattcactggattattatatgaaaagttatttgttctattctttgagaaaagtacattttcgcaaaaagctttcaataacattgcttagatcacttgtttttattaatttgttaagtttatttttagtaagacatgtaacttattatgcatataattaatcaaataaataatccacaccaacaatccgcttaggcccggtttagatggcaaatttcttttttgttttcgggtgtcacatcggatatacggaaacacatttaaagtattaaacatcgtctaataacaaaacaaattaccgattccgttagaaaactgcgagacaaattttttaagcctaattaattcgtcattagcaaatgtttactgtagcaccacattatcaaatcatggcataattaggcttaaaagttttgtcccgcaatttacacacaaactgtatatttggtttttttatccacatttaatactttatgcatgtgtccaaacattcgatgtgatgggtaaaaagtttttgttttagaaactaaacatgaccttacaccgttctaatttcaaccaaatttccaatttaagcgtaaactaaacacaaccttagtaaagtatatgtttaaatcctaccctctacaatacaatacataggatctaggatctcgtgatcagctgctctcaccgtgatctcaacgggcaccgtggagtcgattcgatgctggtagtagaggtcgatgcagccgacgccgagccgccggaggctgccctcgcacgccgcccgcacgtacgccgggtcgccgcgcacctcccacgccggcgtgatgccgaacttggtggccacctgcacctgcacctcctcctccgtcgccgccgccgccgccaccgccttgccgacgagcacctcgttggtgtgcggcccgtagacgtcggaggtgtcgaggaaggtgacgcccgcggcgacggcgtggcggacgagcgccaccatgtcggcctccggcttccgctccccgtacaccgccgacatgcccatgcagcccagcccctgcgccgacacctccatcccctgcgaccccagcttcattcgccgcaccaccgctgccgccggagctgtcgctgctgctgccgccatggccggccgatcgattcttgggagaggattgagcggctggtgaagtgagacagctttgctcttccattttcgcgccgttatttatagcgagttttatgggtgctccgtggcgtcagcgagtatgtcacctggtgcctctggattactactcaagaaactaatgagacagtgggcagtggcttggtgtgatagtataaaattatgatagaatatatattggcttggtgtggattactactcaagaaacgtttactaattttagctggtctgaaaatatttttgtttgcttttttatttgaattactactaggactttgcctaacagcgtgattttcattaaaagaaaaaagtattttacaaaaaataattacaaggagagcactgaaaagattacaaaggttataatcaataaaaaactattttctttagaggatctttcattttgcacatatgctgcagaagaactttcttgaacaaaattctccagccttcaaaggaaggtcgctcattccgaaaaatctttccatttctttgcttcaaaatatgctagacagcaataataaaacttccaagaaacctttttgtctgaaacgcaaatgcgctaacaccactatttaaaataaattgagattagaatctcaaagaatgctgagatgccgccaacatccctggctgaaaggatagaagaagaaatgaaattattgttgttgttatcaaggaattctattatcccttgataagcttacattaagaaggtattttcaatatcagaatatattgttgtggaaccagctcgctcacccggatataattcttagatttaaaacgtacgggtgctcgcatttaagtctattttattcttttagtggggtagggtgttcatggtgtgcacacgttatcagcacctccgtctgtaccgtgtttgtcaaaaagaaaatatatatatagcactaaaaaaatagtacattttctgtacattttcgagcctgcaaggtcactgtttctaatatttcttgtgtgcttccgcatcaatcatatatataagaatacctcccttgacaatgagatatattaatttttaataattattaccagtaattaagcggagatagattcactactacaaaacatcaaataggtgtcaccactataggtaccggtagtgctaaaaccagcacctatagggccttttaccacctccacgggtagaaatcgcaaaaaaggcacctttaagtaattataggtgttagtgctaaataaaaaccgacacctcttatattttgtgtcggtttttttaaaaaaaccgacacctataatagcaccccaaaaatcgagccgagccggaaccaagccggcgggccccaccatgacgagcgacatgtggagataaggtctcgctctcttcttcgcctcttcttctcgctctcttctctcccttctctgtctcgctctcttctctcctctctctccctcccttctctgtgccggcagctggccggcggaggccgcaccggcgactgtgccctcccctccgctagatctggcgggaggggaggcggcgacggcaggagggatggcgtcagcgcgggcggggtcgacggcgggcgggcggtgtccggatccggcattggcggccggcggggtgcctcgaggagcggaggtgtccggcggagggctcgaggaggagaggcggcggcaggcaaagggctcgtggaggtggcggcaggcggagggctcgccggcggggaggagcccttctccccgccagatctggccggtggggaggcggcgacaggggcggcgggctcgcggaggagacgtgtcggcgggcgacggggcgatggctagaagacgaccgaccgacggcgcgacgacgacttcatcaggcagagtggggttgcggcggcatgacgatattcttcaacaaggcaagccaccaagccaagcaaaccctctttgaatgttgtgggatttttttattgcataaatttgtgttgcaggctgaatccatctttgaacgttgtgggatgaatgttgtggatccaaatttgctctgtgtgggaggagttcttgcagatgtgggaggatggactgctcggcttgatgcgtcagcttgatcgagccgacacatttcggcatcgagccggcttttttgcatcgtcgaacgtaaaaggggatgagtctgcgggtcgggcggccgatcggtttggagaaaaatcgggcgctgacgtcagcgcccgagttacgtgcaaaactattgtaaactgatttttctcttaaattacttatccaaatcataatccgattgcacctttaaattcgttgcaattaaatcttcgaaacaagactatattccgacaaaaatttttttgcttattattgaattatttttaaatgttgcacgatgttccaccaggtatatcagaattgtttcactaaatagatcgaaaatgtttcactcgtttaaatcgggtgttgtttcaccttatgtaaaattaatgttttagttcaccgcaacatttgatccatacatagtgaaacattataagtacactaggtgaaacatatttcggtggaacaaaaaataaaccgaattcccttaatagggggtttacaaaatatgtgggttttttttgttgcaatggagtatttcaattcactacaacattaggtctatacatagtgaaacattgtgagtacactaggtgaaacatttttggtggaacaaaaaacaaaccaaattcccttaatagagggtttccaaaatatatgggtgatttgttgcaaaagaatattttaattcactgcaacattaaatctatacatagtgaaacattataagtacactaggtgaaacatttattgtggaacaaggggagggacaagtgggtgggtccagtggggtgcacgcgtggggggagggggagcgcacgt

SEQ ID NO: 80065 - DNA, 25000 bp, Oryza sativa
caagaaggttcaagaacgacatggacaaagtgtacaaaggctcagccaaccgacggtcacaaaagccgaacaatacaaattcagagccggtcatgcaaaatagatgctcgctatgccacgaactaggccataagaaaactaggtgcccgaagcgagacaagtttaaggatcgaccgaaaaagcgccgtaggacggggggaggtggtgagggtagcacacaggtgggattggatgacattcatattttttaatgttttaaatttagtttgcattacatttgttaagttcatattgttgcttcaatgtttactttctgttgtcctcctttccgttctcattgtgatttttccatttattttttttttttttgcaattactgatgattccattttcatttgcaggatggagcactttccggggttggaggatttctacgaggagaagcacagggctccccagattgtgagcggagaggttagcatcaacaatattccattttttttatggttgaatttattttttcttctttgatttgattctgtatagatagatcaaccatcatagagatatctcaaatcaaacacacacaaaaaagaaaaaaccccattttttttgttctgtttttttcacactgtacatagagagagatcatgattcatgagcctcaaagcagagcatgtaaacacacacaaacaacaaaaactgatctgaatttgtttgattcattttgaaatctcagcttctctttgtccccgttccagaacgcccaaatctgagcaggaaatagttcgatttccgtatgaagcaggtcccaaatgggccttaaacttgatgagttcagttaagctgcctgaagtgtgacacaacaaatttgatgatattttgtacgtcactgtatatctgttttgcttgggaacacaccagttggacgatctggcagcctggcacaattcatcaaattttatcattttgtttatttatttatttataacgtatgcaaggatgccatagatcttcttttcagttttctttttcctagaaaaatggcgtccatgcaacaaagcatcttaatcagataagctaattttcatatggctaagataatcttgccactgaattaagatgtgctttttccatgactttttttagtacttgggaacatgcttaccagtatggtaagtattagtgctggtttttaaaaatagtatttgagatgccaattctactggtcatacagaactagtacttagctcaagattgctcataatgagtagtagttgcttgtattacttgatcataatcacagagattcctgctgacccaatcccaaaattaaagttcccagttgcttgatatattttccacaacccttgtatatgatatattgtcgctaactatatgttgttatgtttgtctattgatgcagcgcttgaagaccctttgagttagaggtcacacggcgcacatactgttcgacgaccggtacgtcccgtacctacagcgggcgaagctcttggcgttcgtgaccatggcccagcgaccgatgcctctatacaacgccgctgctctgacggccctcgtggaccggtggcgtccagagacacacaccttccacctaccgtgcggggagctgacggtcactctggaggacgtcgccatgatcctgggtctacctatccggggtcaggcggtcacaagtgacacagcgtcagggaactggagggagagggtcgaggagtaccttggtgtggagcctccagtggcacctgatggtcagaggcagacgaagacatcaggggttcctttgagttggttgcgagccaacttcggtcagtgtcccgccgaggcagacaaggccacggtacagcgatactgcagggcgtacgtcttgtacatcttcggcagtattctgttccctgactctggtggagacatggcctcttggatgtggctgccgttgctcgcggactgggacgaggcgggtaccttcagctgggggtctgctgccctagcctggtttaccggcaactctgtgatgcttgccgaaggcaaggcggggacgcgaacctagcaggctgtgtttggttgctacaggttagttcacgcatattatgtttcgtaacatttcaatttcttgctaaaaagttggaagctaacgtatgtgacgcaggtttggatgtggatgaggcttcctgttggttggcccatgtggaggacccatcaggtttggccgcaccaggatgccgaccgacgtcccactgtagctcacctatgggaatcggtcccatctccagtagtaggccgcaggaatttggcctactaccactacacaaacgagatggactatctacagccagaacatgtaagcaattcaccattctatcacacatgaagatggtttcttactatatagtactaaatgtgcttcaatgtgttttatttttgttgctgcaggtggtgtggatgccatatgaggcacaggaagtgctcgagctagaactaaatcccatgtgccatatagaggatgcgttgaagaccctacggtgcccactgatctgcttctatgcagtggagttccagatgtgccaccgcgtgatgtggcagttcgggaggcttcaaacaatcccgcaccgtttctccacaagtgtcgacctacacaagttagtaatttcacttaaaaatttattttgcttgctcagttattttcacatcaacatttattaaatactcgagttggatattttgcatatgtgcagggtggaccgtcggaagaacaagaaggtgactgattgggcttactaccatcaggatcatatcacgcaatgggagaagttcgaggagaatggagtaccagaccagggtcagcacaacaggacagagttcgacgtgtacttggcgtggctccacaggacctaccgtcttgtcctacgtccggcctggacgctagccgacatagcggatgaccccgaggatgttgagaagcagagcgagtacgatactcgtacccgtcaaggtaccacggtcgagacgggacctgttcgcgacagagtggttagttctagcattaatgttgtgacttacttcatttcaacgccataaatgttgtgacttacttcatttcaatcctgcaggctcgagagctcttgcggaccgtcaacgatgcgggagtggcgctaggcacggctcctggctccgaaggagagggcggcaccctccgcaacgccctacaggtaatcgttggaataagagatgaaactacgttgttttcttccaaaatcgataacttaacagggattatttttgatacagagactacggcagcggtgtcagaagttggcaacaaggctcggctgcaggtcgaccgatgtggtcgaacatgctcatgcccaccaagagagggatgaagaaggggaggtgggtgacgaggagggcgagcaagacaaggaggcggaggaagaaggagatgaggaggaagaaggggatgaggaggaagaatgggatgaggaggaagaagaggaggcggatgagctcggtccctcgcagctggaggacgcaccagagtcatcacagctagatctctcgcaactcggcccgtctcgaccacgacgccggcaggctccttcgcaggactggaggtacacccccgatgtgcctcatcctcgcactagaggtaggaggaggtgagtgcatggttcaatggatggatggatggatggatggacttgatgcatggttcgatggatgtatggactagaacttttgcttgttgtgcatgaatggatggatggatggatggatgggatgtttttatttgttatatgtatggagttaatgtatggatgtattgatggattctatggatgtatggaatgatgttggaattgatggatggatgtatggttctctggatatattactgcctgtgaatatattattgcctgtgatgtgtgttgtgtgcaaagtctgactggacagagagcagtcttgctaagttttagcaggactgcaaactcagcgccagggaaaatggcgctgagattttcaccctcagtgccaggtgcactggcgctgaggtcccagcccagccatccagaaggcttgctgggccgggccatggccgattcggccaagtcccatccctaggtccagcgccattatggctagcgttgagttcctagcccgcaagccatccagaaggcttgccgggctgggccatggccgattcggccaagtcccacctcagcgccagcccacctggcgctgaggtccctaggtccagtgccaatgcagttggcgctgagattggccatcttagcgccgatgcagctggcactgaggtagctgccacgtcagctgggggatcggcccggccgccacggtggcacgatatcagcgccagccccattgacgctgacacgaccaacctcagcgccaatgcgcttggcgctgagtcgacggcctatttttggttgaagtttttgacaggggttagtttcgaaataagtttttgaaaagggtcaatttgtcaaaaaaaacggggaggagtacttgtgtaagaactaagaatattgtattgcttcagtttaatacaataaatcgattttgattcgttttcttataattttaaagttaaattaagtctacagataaatgtagtaatatttcttaacacaaaacaaatatattatcagaatatattaaatgttacttcccctccatatttttatgtattatgacgttgttgacattttaaccaaaatttaactattcattttatttaaaaaaatttatgtgattattatttattttattttgacttgatttatcatcaaatgttctttaagcattacataaatatttttatatttacataaaaatttgaataaaatgaatgatcaaatgttgataaaaagtcaacagcgtcatatattaaaatatggagggagtagtatttaggaaactaatttacaagtagtatgaaggggagtagttacaattatttctgtaatgatgcccacacgtaataccatatatgtcatgacagagaagctaattaagctgatcatttttatctctgctacatttgtgtagaaaaaaccgactaggggaatgacgcattggcgacgacaaaggtgcagcaaacaatgctctctctttccttccccttcattgccaagtcagatcgatgagcgccagaccacccactgccagatctaagggacgtgtcaggttcttgatgttggtggagcttcggaatagatgacgtcacgacccgcaccctctttatatttttcaaactagctaaagaaagatctgggtgcccaataaatacctatatacaaaaaaatcatttatagggtgggcctcttaacagatccacctacgaaaataaatctattttcgcagggcagcccgtcctccccctactcttttctctcctctcttaaaaaaaatctaagccctcactactctcccatcctccaccggttagcgacgacaagagcagccgcgatgatgggaggggtggcgatggcagctacaacatgagcttgagctggcgctggtggccccgtgcctagctgattcggtattgtagtgggtggatctgttggtggcggcctcatggtgtgattctggcagtagctcatgtggcgggttctaggcagctgactctgggaggggccaatccggaaatggtggccagcgcttcgaggggtggaggcggtgggctactggcaatggcggcaaagcctgggcgacgacacttcatttggtgagctctgggcttcttgtgggcctcaggagttccaggaacaacgacgatgggggagtggtggatccaccaccacggagcttgagttcaaaagtaggatttcatgattttggaacttttatttatgttattttgtgttttattttgtgaaagcagtcaatataacttaatcgtctgtgaaaatcactttttgcatacaattgtgcagccggcttgaaaaatgctgatttctacatatacctgggttcaggcagttgctctacccatttgcaaaaatgacttttgaccatgtataaacatcaattttcctcatatacctcttcccacgcatcaagcagtcaatactaagggtgtaagtgactaatccacgaaatctacttatggaccaaaataaatcatgaacccacttatttagacttacaagtaggttcgaggtttatccacttgcacgatgagccaccgcatcctcgttggtcaccacaaccgcatctaagttctccttaggcctggtttagttcccaaattttttttctaaaaatattacatcgaatctttggacacatgcacggagcattaaatatggattaaaaaaactaattgcacagttagggagaaaatcacggacaaatctgtttagcctaattagtccatgcatgattagccataagtattacagtaacccacatttactaatgacggattaattgtgctcagaagattcatctcgtggttaatggatagtgtcggtaggagtggtaataaacctaactttttaggttataaaattttgagagttgggtctaaaataaggtgggctcaatttctataatgtttctttgtctaaaaatatctgaggtacctagagttgtgaaaaaacaaaagggtcttgacccattaacatctctaagtgtccagtgtataagttgatggctggatgaaatttagaccagttcaaaaagtttaaggatgtaaaaataaacttccttccatatataaactgcttatttgttactttgtatgctagtggtagtcattagctcacgacaacagttttcagtttaatttcaccaccccactgaatagtcttcccaccaatcacggttcacaaggtaaaggtaacataggattagacatgatagtggttaatttgaacaaacatgttaataacacaaattaaaactggtgatggcaacactttatttaatattaccacacattctgcgtgcaatgcacaagcttatgaaacggcgcttcactcaagtaagttttacgcgcaaattaaacatcacgaaagcatatgacacaacacgctacgcatagatcgacaggtcagctcattccaaatacacgcgatgtagaagaacaggagcaagcaacgcgtctgatgaaacacttctgatgaaatcttgtgcaacgctcttccattttgaaccagctattttgaaccaggaactgtatttgaacagacgaaaatgatttactcggatttccaagacgacaagggaggggtctcagagtcctgccaagtagtgttagccatcatcagaggataccggtcgccatggacattgctagcataagactcgagttcagccatttctgcaggggtgagtttcacagatagtgctgcaacattttggttgaaattctcgatttttgttgtcccgggtatggggcacacatcacgcccctgatgatggatccaggccaatgcgagttgtgacggtgtgcatccttttctggctgccatttcgttaacacgctcaaatatttcagcattcttctcgatattacctggttgaaatctagggataagctgcaaaaggcaccaatacaagttgttagttaattgaatgagaattcattatagttctacttcatttttcaaagactaaatagacgagacgtgaatatgcagcacaaagattagcttaattggaaaaggcttatgtccgatcaatacaaagtaaaaatttctaatgaacataaatgtaatttgctctactgaacatataagtgtaatttgtactaccgaatataagtgtaatttgtactaccgatgcagaagtacagaaaatgagaatacagaagaaggtacatatataataattactcccatcatccaaacaacaaggcatataattatgttacaaggtttcaaaatataaggtctgaatgcctatttaatgatctttcttctcgtttttcctacattaatcattcatttctactccatgtatgagtaaactcataaacaagatttgtttcaagaaaggaaacaaattaatttctgttcttcttattctaaaagacattaacacgacaggtatcacagcattttccctaacccgttctgctattttaatgacctccttcaaagccattcttagggaaaactgagtgattagtaatcatggaaatataccttgcgaaaatcatggtctggtagagaatccactagtttagctccactagaaaaaaaccctttaccaagtggactgtaagctactattccaattccaagttctctgaaatgaaaattagaaaaatagttaaaatgcagcatgtgatttttttttctcaacagacaaactaatttgttttttcaatgcctgcaagttggaacaatatcttcttcgacgtctctagaccataatgaccactcaagctgaactgcagtgataggatgtacagcatgagcccttctgattgttgatgccgatgcttcacataagccaatatatcttatctttccttcttcaactagtttcttgagttcaccaatctaacaatgtgaaagggaaatcaactggataatcttgagaagaaaggtcattacttaaaaggagtgcatggttctcaggacaaaaataaaagatagttcagtttatagacaataattacatgcaacgattatatttgtaaagaaaggcaaaacaactagataatcttgagaagaaagattattacttaaaaaaagtgcatggttctcaggacaaaaataaaagatagttcagtttatacacaataattacatgcaacgattcgaaaatatcaggagtaatagcagttcaggtgctacctcttatgcgctatcaaaaagatatagcacaccaaaatgatgaaaatgcatgtgttggtggatatgttctaataactattgctagtttgtagttaaatattctgaaagaaaagaagtcttcttcactgaagatatattttggttcatgtatttcttcattggtttttcgattgttaaactttgaaatgttgggttggttggtggtggttaagatcccagctattacaacaaccacaatgtgtgttgtaacttcccagtgatatgtcagtgaatttactttatgttctttacccttcaaaatcccacagctaatgtctaaaaattgaaaccctgccctatatctaaaaaaatgcaatacataaagggaaagaaaacattgttaaattatagaaaccatctgtcacatagggagtactgtaactgcccagtgacatgacagttacaatggaagatattcataagatatttttcacgcatttgtgctaaacagagagatcttaaggcaaataatattgtacttcatacctttataaatgtatgattcaaacacttgttatgaaaaaacaaaaagaaatatatgcttcattttgtattacaatgaaaaataatagcttattacaatgaaaatttaatacatgaggttaaaaaaataacgacaaaaggacaggtgccagaaaatggagcttgatttggccttccagaattcaggccaagttgctgccggaacaaaaagtcattgtacaattaaccaaacagacgtaggattttaagggtgcatcgagccgggttaaattttcctcccttcaaaattgacgtctcctacattttgttttattttaacgaccaataccacaaagtgcgatgattcattaaatagaataggaaaaaaaaaggctagcaccctggaaagcagtagctaggaaaaaaaacaacaccaccacgcaccgatgatgcctatataggatccaagaaaaggctagcgtcgtcggactggccgccgctagactaataaagaagctaccaccaaaccgcccaaaaccaaaacctaaaaagtgaacaacacactcaactctatacgtatcaaaaggattggaggggagagggaaccactctccccctcaaggcccaccaacatggtcagcttgcattggctaggtgctgccgcaagcccgcaagaggataaacatctagagagagcacgcgcaagctatcagagagaggtttcagcaggggggcctcctagacgacgtctccaaggagaaaagcgacagaacccaagagggaaaacgatgtccgaaacgccatcacagccggctggcaagaccaggctaggttttacacctgccacgcactccctatcgatccgcggatatcactccattgctccaccaccagccatcctccatcggcatgtggccaatactacaccgaccccccttccacccctggtcagtcagcctcggcatgccttgtggcacacaccaccatcaccggcctcattgttgtcaccgtgtagacctcccgtgccgtcggctgggctagcctccctgcagttgcgcacgccaacctcctaacgccttttgcgccgacccgcccacattgacctctcccaccattgccccgtcaccgccaggcgtgcctcctagcgccgctgcgtcggcctaccaccgccaccagctgctcccaaccagcaccacgcttcctcctatccctaccattgtttccagtacctttctcccgccgacggcacttcacgagcgtgccctctgtcgacggcacgtcgtcgtgcccttactgcctcgccccgccacctccacgcagccgtaccccttcgccttgtcatcgttgctggctcaggagttagcttcccaaggcgaggaggcaaaatccggatgggatgggaccagatttggcagctgcacccctgcggcctccacgttcacgcctccgcatccacgtagccgtgccccgctgtcttgctaccgcatccggcttggggaccgacctactgcaccggggagcccggatccatccaggacggggctggatataggagtcgatgccagatccagtggcgccgccttgccgtcgtcaccccggtccacctaggcatcgacgctaccactctcctctttaacgccggcagctccatcctagcaccattatggctgtcgtcacccggagctagtcggggtcgtgggctccgaccccgctaccacggaaaaggaaggcctcgctgctgccgttcttgtggccgcacggtttatggcagcccgctcgaccctgccctagagagcgacacggagccgttactaataatgagtcttatagtttgttttcagcaacatcataatcctccctccaattagtttttccaatgatttttttgtgtgtttggcgggtgttgagggtgggggcagggggcatcaataaaagatgtctcttgacaacaacctaccaccacctacattccctttcagatacagatggatgtttcacttacatataacaaaataaaagaaagggaacacaaacatagaggggaaggggcaccgaccgtgacctcgatgggcaccttcttgtcgacgcggtgctggtagtaaaggtcgatgcaatcgacgccgagccgccggaggctgccctcgcacgccgcgcgcacgtacgccgggtcgccgcggatccccggcttgccgccggcgaagaacttgccgaacttggtggccagctcaaccctgtcgcgcacgccgccgccctgcagcgcctgacatttcgtcgagcaccttcagcgcgcgctcgcgcatgcacaaattaagcccaacccctacccgagcaatggcggggacacagtggagaggtaggtacgtaccttgccgaggaggacctcgttggtgtgggggccgtagaggtcggaggtgtcgaagaacgtgacgccggcggcgatggcgtggcggatgagcgccaccatgtcggcctccggcttgggcggctcgaaggccgggcacatgcccatgcagccgagcccctgcgccgagacctccatcccctgagagcccagcttcacccgcggcaccgccaccgtcgccattgcagcagctgccattgccacggccgctgtacttcttggctgatgcctatatatatatttttctgctgtgtgtcactcacttatataatgctgcacactgggagatggaaaaatggctatattcaagatgattgaacatttcaattgctgctgctgcaggcaggaccaaacatgtcagcatcgaccaacaactggctcactctggcctgcttctgaattttttgttgacgaataccaccctctctgacagtctgactgactacctgaagaagataagctgatatcctgtgaagcagatagatctttaaatttgcttgtgaatttttgttcactgtaggttcttattttgatggagtgcacatatagttttgacagtggtgcagtagctcatagcttacacatagctgaagctgagtacacttttctttggtttgaatcatatatatatactgcaagatgtggattttaatgcttcggtttcaggggaaagtgaaatcatcccgatatcctctcgtttcgtgcatatcacctaaatagtcatcaaaaaatatgaaaaaaaaattggcaacatagactaatatgaaatatatcaaagtttaaattcaacttctacaagttgtaaaaaaaataataaatatagttgcgaatgtgagataactattttcagtttaatttattatttttgttgcaacttatagaagttgaatttggtcttgtatgtttgtggagtgatatatttcgtattaatctatgttgtcaatttttttcaaattttttaacaactatttagatgacatgcaaacaacgaggggatgtcccctagggataaaaatccacatcccggtttcagatatgtttcagagatatgcaactttcttaattagctggttcttgtttgtagagattaagaaatatagaaattcagacatgtttcatgccaaatgcaggtactccatgtccgagccagcttcctgatataaccacactggattctgatgctacatccgaggcggcaacttctagtcgatggggctccggcactttaaagttacaaatagtttccatttttttggcagaaatttgccatgtgagtatgacgaatttgaattccatcagtattatggaatagtgccagtagagtgatctgagcatgacaaatttgtactttgtcagtatgatatatagtaattgtttccgtgatgccgattggaataatggtggctgctcgcggatggaatctaaatgtcagtttgtttaattgcatgtttcttcgttctgaatgacaatctgaatgtctgaacaagtgccaactgccattgcattagtctgaagctactcacaacctagaactacatgagtgaaattgaagctactgattgcatgagcaatctgaatatactgaagctatattcagatatctgatgcttcatgagcatcatgtgattttttttaatatactgaagctaaactgaaaatgttctgtcttttggactcctttcacacatcaatcaaggtttcacaataattagtactccaactaaatctaattactcaatacttcaattcagaaaaagtacattcagagagaatataatactagtacttcagttttgaaaaaaaaaatatttcttgtgtcagttatttcattgtgtatgtaaaactgattctaatcaaaacactgctgttcaatccaattcaattactccaattcaacaaaatctacaaacttcgctgctcgtatttgaaacgagcaatccagatcatctggcacatatcatgtgggactggtacatgtcagtgagcagtactgcggagtaccctcactcttgaaacgagtgatagagacggtcgagaagagggaggaagaggcagcagctagtggaagtggttggcgagcccttgaggtgttcattctcaacgcaaaactttccggattcccaattaagcttcttgggccgtcgtcgttggagatcatcacgccatcctgcagcgacaactgtttgctgttgggtttcccggccatcaccggcgatctgcggcggcggccaccgcggcatcgacggaaactctgccactgattgcaaaaacatcaacacaccaacaaacctcgatgttagttaaaacatcactagctctcccatatctatgctcccgcctttgttggagtggcgaaaaagtttgttttttttttaatcaagatgacatacgcccatgcattaagattttagaacgtgtctatctacttccaacgaatatttggaacagagaattactcagaaaaagagaattattttttttctaatccaccatgtcggcctccggcattggacgggccgtagaaagcggacatgcccatgcagcccaggcccactgcgttgagatatccggcccctgcgagcccagcttcacgtgacgtgaggcaccgccactgccgccgtccccgagaagccggctgccgctgccatgcatggctggccggatcagtcgatttcttactttgtagtgatgctacctgggctctgcatggccactcacatatataaggttaatgctataacaatgtaactgtagtatgtaagggtattgtttagaagagattaagattctaaaaagctgctggttggtaatcagtttttagaatatagaaaagtcggggttcccagcttccgactttattcttttttggattcaacagctatagctttttaggatctaaacgaaaatgtcaactgtttagagagcttatgattataagagaagttgcacctgccaaaaactttctcaaacagatcctaagcgtcactgcatgggtgggagcaggagcatgtgtaagagcttatgcgtgcgacgtgactcgttttgaattgctaactatcacccgtagggctatcaaaaaaagctcgaggctcgtgagtcacctcagactcgattcgagctcggctcgaactcttaacaagccgaaccaaagcctagctgcaagctcacgagttttgtcaagccaagctcgagattcttatgagtctaactatgtgtgtaaattttttatcttttatatgataagttagtagctcaaggacaaattagtatatattcatgtgaaaaattagtgtattttggcatcatatataactttatcttcaatattattgattaaattttttttactaaatcttatcaacaaaatatacattatcctataatcgatcgagctcgcgagcctaaacgagctcgagccgagcctgcttaaaagctcaaaagagaattaagctcggctcgagctttgtcgagcttgagcccagacgagcaagctcggctcgctgatagccctaaccattgacttagcatattaattgctcctatagttttgggttatacgacaaaaagtaggtaaacctctctttcttactgtcaacgtaaaccagaggcggatctaggaacaaaaaattaagggactcaattatacagtttcttcaacctccagccatttaggaagctttagtttatcattcatggtgaaaaaattagagggggcgctctgcgggtatatatccatgggtcttgtgggtgtaggggaacctaagtccccctgcaccacgttggatccacccctgaacataacagctggaaggaacatttcaatttgcaaagtggccatcctgccttgaattttccatcttagacacttccctttctaaacgatattgcatataatcagttaactagttactccgtgtgtcctgtgtagtctttggactaaagatttgtccctagagtttagttttatagacctcttcaatagtaattttatcgttttcttctcgttatcaaccattgagacactttaaactctgtaaagagacttcttagaataaaaatatatactaaatgactaaatataagtaactgaagacaaatacatataagtgatgacttgggattgagttggttagtgccttgaagataagtatgatttgtgcaattgatcatgagttcaaggattgcaaaaacaagagaaaatattttattttattttattttttcattaatttcatattattgtggtacaatttaatgtatctagaaaatgcctctaccatcttatagacattttataaaatgcctcttcgtttgtacagataattcaccgtaaggcaattattagatatttttttaatatatctctatagtattgtaaaggcattttaaaagtgtctctatagtattagaaaaatgtctctacaaagcgtttttcctgtaataatgttcggctggaaattccacacccatttcctaattaaaaagcaacggattcaatatacctatgttgcagcttcatttgtactattaaaaatttatcccacaaagactatttatagcgttatagcctatcaagttagagcaggtacaatagggttcagatagctggaagaaaaaactccacgtaagcatgaacgctgagttggcgaaaaaagagaggagagagaccatcagttgctgactaatttgccactagtgccacacgcactctaagaaaaaatagtctcaccatttgatctctgcaccatccaaaagtgagatagaaatgaaaggaaagagaagataaagtaaataaagaataaaacattatttatatggagagatgggtaaatgtattagagcctacctactgtatgtacttgcttttatattatatttacctgacgtgagaaggattggagccagcagcgagcgcttttattagacttgctcttaacacatacacatttagttgaagcctagaaaatggtaccaagagtactaaaagcaaggtaatagtaagtaagtcaactatatgcatatgtgaaaaacagagatttattactcaaattaacagactcataatcggtacaatgagcaaataattattgcaagctctcgataaagaacaatctattgttcaacatggtttgggtgttgccagaactgtcattagttaaaactagaacatgctaatttgattcatgtatgaagatcgcatgagtttagggtttatttatggactgctctatgtggtgttctaactagttttaacacagttgagatgaacatatacatgctcggttttcaaataactgaacaatttaactttactattataaactttaaccaataattacttggacataatacacacttaattatcagtgtattttattagtgtctgtaaatattttgctaaaaaagaccgatggtgtcaaagctcgaaagcagtatatattcgctgactaagcagtatatattgagtaatatctttttttttttggctaggagtattgagtaagaataactcctgtcaatcggcaaaacaaaagcattttcgtgtgtatgcatggataaatagatagtttattttaaacattgagatgatccttcgccctttgctttaattaaaaggctataaccaattattgcataggctataggacgaatgactgcgacttacaaattcaccatttgattaaaaacaagaaagctatttaaactatttagaataccaccttaaaaattagatagcaaaataatactcagttgctgcatctatcctacgaagccggccggctgcatggacagataagatactaatataagagtacagagagtacaaatgcttacaaataaattatcagctgagccggctgagagagagttcatgtatatatgtgtgtggatcataaaaagctaagagaagaagagggagcgtacagccttggtgaaaagggtagtaggcgtcgcaagtacttccaccatctaacaactaaaccgcccaaagctgtactctctctcttctccatttagccttcacgatatgatcgtctatcgatctccttctcttagttgctctagaagttggatccctctgggtttatatagcacactagcatcggcaaaatgacactattgtgacgaatccatttattgtaatgcaacaggaaattaataattgcaccctccatcccaaaatatagaatcggatggaactcaacttagtactagattcatcgtaatatgttgagttacatccaatcctatgttgttactacctccgtcccataataaatgtcgctttgactttttgcttacaacgtttgaccattcgttttatttgaaaaattggtgcaaatataaaaaagtataagtcatacttacggtacttttgataataaagcaagtcacaaacaaaataaacaatagttccaaaaaaatttttgaataagacgaatgatcaaacattacaaactcaaatttaaagcaccaagtaatatgggacgaaggtagtatattttatgagggaggtagtaattagttagtcaacatcatcttttttttctcgttcccgccagcacatatatacatacatacggagaaaaagggttggtagagagagcatcattaatgtgtgtaatgtgtggtgatgtggtaacttctaactagtatttaaatattaatataattcatctgttttcaaatacagctagatataaactaggactagataggggtttatactagattgtatttaatctaatagtgttaggtttctatatttatattttaggatggaaatgttatataatatagttacattcacttgttcatgcatacgggtgatacaagttatacttcattaaaaaaaaataaagaattactacgaagtgagcgtaactcaattggttaagtttcttgtggtaaactagcccacccaatttaagtactagacttaatataaatgctcgtatttacggttaattattctttcagtgctagacgacatacccgttgtacctttataggggtaagcgtacgcgcgttgtgaggatatgtatttatattgtgctttaaaaaaataaaaaaatattgtttaaaacattataaaggagaaataatattgttatagcggtaaagtcgtcagcgtgtgattccaaccgtaaacatttctaatcgcttgggctaaaaaaccaaaatttaaatttttgaagttgattttaaaattggttttaagatatttttaatgtaaatttttttaacattatataaaaaatttacgtataaattaatttttattttctaataaaccttttgaatttattagggaatacgagctgccacgaggctctgtgtgtgcatgaccagtttcattgtccttggaaaatataacaatggctagtagtgtcacgtacgcgtgtgatggatccaagttgggcatgtggcatgcagtgcaggctgtagctaaggccattccgtcgtttttcgcgagcctccgggctaacagcagccgtccaaaatggccggccggctttggaattggtccatcaactagctagctcaacactgtacaagccgtaaattttttaccaacctgcactacaccgatcctctgcactccaccgatcctctcctggagtttgcattactccctctgtcccattataagtgacaccgtaagttttcgtgcctaactttaatcgtctatcttatttaaatttttttataattagtatttttattgttatgagatgataaaatactttactcatgacttatgtttttaaatttttttaaaaaaatcttcaaataagatggacggttaaaattggacacggaaaatcatagctacatttaaaatgggatgggatggagtacctaatttcgcattacccaaaagggcatatccaacaacctttgtaatggagataacgatgagaatctttaaaagcacttgagaatctaaacgtgtgtttggttcggaatgagttgagatgggtcacaccaatttatgctttttatggaatggttctattatcttttggcatgagattttttttagagatgggagggtatagccagcatgttattgaaaaagaagtgacttagattagtaagctacttaagcttagttagataaggaaacattcccattcagaaatcaacccatcctacctattctcaaactgaacaccccgaaaaataaaaatgaattcccgtcctatcccatcccaatgttcacatgctaaactgttggcaacagctttttcacaaactacctattctcaaactaaacatccttaaaaataaaaataaattcccgacctatcaaaccaaacacccttaaaaataaaaataaattcctgacctatcacatccactgtccgcatgctaaactgttgggaacagctttttcaccaatagagcaaatagattgaggcatggagttcatagaagcttgtagagatctatttagcacggactccagctcttctggaactagagcccaaccaaacagttttacctctacaaaataaaattggaactggatgaaacactctcacaaaacaaactagaagggtggagttaggtttatactactccacaactccacgactgaagctaaatttaggagttgaagcattctatctttaacaaaaagagaataaaaaaggcatataagcttttattgccggaatgcctatctgtatataaaaagagagcttttgctcaagattactatttgtggattccagccgttcagtatgcagtgatctgttcacagcagctattcgccaccaccagatctgcacccacgtttctgatctcgcacagaagaatttgcaaccaagttgtgtgtatagcatagtaatgtttaccagatccaacatacaagctcactggaccgtaagaatgccaaggcttattccaccagccgcagtcccaggatacagagacatgcttaagcaatgttaacaaatggaggaccaaaattcgaccgaaaaaaaagaagagaaggaacacatatctcgactgtcgtattgataatccaccaacaattgcccaatcatatacactctacatttggagaccttcctaaaagatgtagctgtcaccttggggcttggggaggttcgacaacaagcatccatcaaccaaaaaggagatgagactttggatcaaaacagtatgacaagtatcaatatagctcccaccatgacccactggagaaatgaactgagtctgcttctctcccaagaacatctgtgcctcaaaattggccgccaaaaacaactaggccaagcctgcaaaagaataactcaccgcctgcgatcaccgaatcacaggatactgaccagtgccagtgtcacggattggcaaaactggagaaacaaccaagtaatgactctcttcactgcgcattcgccttttccaacttctctttctcaatttcaacttttctttcctcggcatgttgagctaagccattcgcgagtgcctggtagcggaaatctagagtctgcatcaggctctggaacctggctggatcagatgcttgcatacctgtaacagatggtcactaacttgtcaggtaacttcagccatagtagcatagagtaagcacaaacttgtacaagaatgctgttttaccttggatggtatcaacaaagaagatgaatgggtccacctcatcaattggcgattgcaactcctcatcatcgctaaagtcatcatcagaatcatcatcgtcgtcatcatagtgcggctggaaacctcttgcctaaatcacaggaagcatacaaaaacatgagtacagggtacagcataaacatgaaacatttacatgaaataaagatttgaatttcacaagacactatggtaaaaaattagtctagggaagagaaggtgacactttctgtggcgtgctaaaagaagacagcagcaagctcaaaggccagcagagaacaaaggtgattcacgagaaatgtgaggcgctctaatgtagtttttttaaaaacaaatataagggcccctttccccccccatgatggtgccaaacccctccagaattgattcaggggttggcttagaccgtttagcatacttcatggatagatttacacaattttatagtttaggggacaatagtttacaggtttaaatagagcttctcctttttgtttaactagcttttgtgtgtgttatatatgttacagctactgcagtttaggatataaatggccagcaaaacaaactcaaatacactttgttatatatgcaacaactatgcaatttgggattaaacattgctagcaactcaagccgtatatatatagtaatttagtttgtcagctgtaattgtcattattcagaattcagtgatacaacatccttcatagtcaataaaacataagttaatatttatttaaagggaagtatttgtgttactaactttactagtccttttgttgaggggaaaccagactgaaaacacttgttaccagagaccgtgttagttctattaaataataccccatgaaaaacacttgtagaaaaatttaactattttgagcatctaaataaaaaggaacacatttttacatgctaattctacttaagtccatatcacaatacaaacctctcttagtttctgaagattgacactagatacttcatccccatcctcatcatcatatcccatctccttatcagactcaatatcctcatcttcttcatcaccatcaaatccatccaaatcttcagctgcagcctcattttcccatttagattctgcttatgaacaggaatgattaagatcaggcaaaaggaattttaaagacctctcctctacatcgtaattgcaaaaaggagacataagattagaaaattttctcaggtcaacatgttaacagaatggtatcacagagtttttgttcgaagtatttgaattgtcatatgttcatcagaaaataaacaaaagataaaattgaacctgcaacttgatccttgtaagaaacaagaagctctagtgttgctttgaaaatgcgctcaagagcttctggtggaatgtgattagctggaaggctaattagtgaagtcaatcccaagcaacaaaccttcttatcatgttctctgcaaataaagaaaaataatgtacggagtcagtgcagcataaaaacacaacatgtatagtactacaaggtacaaacatatgctaacaagacctacctcttaaagtttgcccttatgccacttttctttacttgctgtaacatgccaaaccaaagattgaagatttcagtagcaactccaagcttatgcaatgttcccaatgtcaatgaaggattgtagtacagtgtattagctatctgcaatcacagtggaaagttttaggtatacatgtcatcagttagcaagagatacagatgccatgtttgaacaaacatgacactacagtgattagattgatgcaacatatgaatatggactaccacattgggaagtgttaggtaaatgcggccaacaaataatagtgattatatgcagttgttctgatggaacataactgaaaattccactgctaatgactaaattgacctatgatattgatcggccagatacagatatgagtttgccccatgcaacatgaaaacctatgttccttgaagacactataatcaaatggttacatcgctttccacaagctggctactgtgctgtctaagctatccctgctttatccctgctttatccctatgtagaaaaactatccctgctttatctataccaaatgacaccctttttgatcaaggagttataaatgctgtctaagctttaagacaaaatgtcatatgatggataatttacatataattgctcataatttctaacttccgctatcactgggtgtaataaagtcaattcatgtgccagatcaatctaaacaacaaagttttattatccagtgatcctgtcacctgctggagttacatagggatgatatgctacaaactagtcacagcacatgcagagtgtcactgtttggaatgcaatagatatcttacaccaattacatcccatagctatacatagcctataggatttgcaactttctatcattttatcaatatctatctattcactgcggtcaagttgtgcaactagtcagacagagcacaacttgagggcacgaccagacttgggccgcttgagagcaaattgggccggcatagtcaatcagaaagggagataggatcccacgtacatagttagatgctagagccagaacgagagcaaggttagaggaagcagcaagagctacacgctggacattggtgctcaggatgcagttgcccatcactttggcaggagcggagccaggtagagaagcttgacagagagctgcacagggctgccaatggccttcctttccccatctgctccctcttttttcatgagcatgatcccttgtaatggactagtcaactcaatcaggactagtgcacaagtcaacacagggatgactcaacttgactttatgacttatacaactatagtttacaaacaaccatgtatttattccttctttttcatcttgcccaccccccccctccccccctctgttctgacagcaagatcactgagtgcctcctgcagtaggcagaccaacaatcttcctgagggggccatcttggcaactgccagtatgaacatgtgttaggtaaactgtggtgccatggatgccttccaacacctttctgccggttgcagtcgcacctcaccatcgtcctcccatagcccattgacaggctgcaattgttggagcaactccatccccattgcaagcaaataatacagcgtcggcaagattcttcttccccttccccaccataaagcctccatgcattctccagcctacatctccagctcccaccttacacctcctcttagagcgagtacaatagtacaagctggactggtgataggagaaacacgtcagctacagtgatgagctggatgagaggagaggagaggagagagagtgagagtgggcgacaactttatcgctggctccagcaccagcttcgagagaaaagtgatgagtgcagagggagtgagctgcatgtgagaggaagcttaagttattttaatatgatgtgaagttgatgggtcgagcattgcaagtcacttattgtatccacaaggtggatgaaattgacaccaactgcctatgctactattaaccttgctcttatcc

SEQ ID NO: 80066 - DNA, 21674 bp, Oryza sativa
catcaataccaggcttcatcctaaccattacaggcaaggtgttacacgaagaagggcaaacatgcacgttgttaagctgacgcgtggtggacaagaatgaccggtctggcactggtcgcgtcatcgacagacagccacggtcccgcgtcatctctgtcttcgggggaggtgggggtaggtgtgggctgtcccatcagaagggctcccggatggaaaccgtaccgatctccgcccattaaagagaaaaagaacagtccagtttggaaagagaaaggtgcatgtggtatccccttgagatataaaaggaggaccttgcccatttagagaggggacttttcccttttggaaggctgaggggaaaggaagttaatcctttgtaactggtccatacacaaatccacaaaaacacaggagtagggtattacgcttcgcagcggcccgaacctgtatacatcgccgtgtctcgtgtgtcttgcgggcgggtgatctttccacatacagagagagagagagagcttgggattgcaccctaagcccctggtcgaaccggcaaaggggggcttgcgcagtctcccggtgaggggcaacgagctccgtcatctggcgcgccaggtaaggggctcagcgtgtgttttctgagctctcatactcttccgtgtgcaccaagtttcccttgttcagcctaatggccgagcaagcaaaggcgcacgacctctctccgagtgtgagcggcgacgacggggagccaaacccgcgccgtcgagctcgtactcccccacctcctccacgccaaagtcccaagcggggggaggcgctcgagagagtcgaaaaatccgcagcatcgccagtcgcgggtggtgcaggagaacggcgagatggggagcgtcgcctcctcgtctacggcgacggcagcacgcctcaaggcgcgcttcaggctgttggcgcgctcctacgtcacccgcctgtcgtccctgacccggagtctccagcccagcgatggctggacgacgtggccaacttggtcatgacggcacagcaacgcctgggtgctggcggacggtccgccaccaccaagacctccggcgccgccactaccggttccgcgtcgtcaagacggagagcgcggcgagcggcggccgctgcacgccattcggctaccactccctcgtcggcgcctccgactcgggaggatcagcatgaagagccggatgcccgcctcgacattgagcgccgacgtagtgatcggcgtactccccgcgcaacggagggtgcctcttcgtccagggtgtcacctcgacatggacgtgaggatcagccctccgtgcccccggttggtggtgttggctgtagagcctttgtggcgagtcttcggaatgtccgttggcccccaaggttccggcccaccatcaccgagaagtatgatgggagcgtcaaccccaccgagtttctccaggtctatacgaccgggatcgaggccgctgggggagacgacagggtcaaggcgaatttctttcccatggccctgaagggacaggcgcggggttggctaatgaacctgccacccgcgtcggtccactcctgggaggatctgtgccagcagttcaccatgaactttcaaggcacctatccacgcccaggtgaagaagcggacttgcacgcagtacagcgaggggatgatgaatcccttcgctcgtacattcagcgtttctgccaagtccgcaatactataccttgcatccctgcacacgcggtgatctacgcgttcagggggggtgtgcggcacaaccgcatgctcgaaaagattgcctccaaagagccccagactaccgcagagctttttcagctcgcggaccgagtggctcgtaaggaggaggcctggacctggaaccccttcagttccggtgtggcagcttcggccgcccccggatccgccgctcagacagggcggcgtgacaggaggaggaagaaaaggtcggtccattccggcgacgagggtcacgtcctcgccgtcgagggcgctccgcgggccacccgaaaggggaggcctgcgagcgacaaaaagaaagaggctggtactcccagcagggagcgcccagccagcaagtggtgctccgtccacaacacctccctccacgatctcgcggactgtcgcgcagtcaaaaacttggctgagcgaacgaggaagtgggaggaggacaggaggcaggaacgccgtgagggcaagtccgcggcagttccctccggtaaacggcgaagtgaggccaaacagaaggcccccgccgctgacatcgatgacggtgatgatgacctaggtttccaagaacctggggccaccattgccactgtcgacgggggagcgtgtgctcacgtttctcgccggagtttcaaggccatgaggcgagagcttctcgccgcggcccctactcatgaggcgacgcgtcgggcgcggtggtcggaggtggccctcacctttgaccagaccgaccacccaccatgcgttgcccggggagggcagattgcgatggtggtttctcccaccatctgcaatgtgaagttggggcgtgtcctcatagatggaggagcggctctcaacatcctttcccccgcggcctttgatgctatcaaggccccggggatggtgctccagccgtctcaaccgatcatcggtgtgacgccggggcacacatggccgttaggtcacatcgacctaccggtcacctttggtggatcagccaacttccgcacggagcgggtgaacttcgatgtggcggacctcagtctgccctacaacgcggtcctggggaggcccgcgttggtgaagtttatggcggcggtccactacgcctacctccagatgaagatgccgggccccggtggccccatctctgtccgtggcgaccttaaagtcgcgctcgcttgcatggagcagcgtgcggaccacctcgctgcggcgaccaagcccgagggtggtgacgagaggcttggcacttccgcccccaccgccccgaggcagcggattgccacatgcgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcgagacttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtggactccactgcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcaacgtactactcgaatttctttgggtagccaaataggacgtaatgttgaggcttatgtcgatgacttggttgtaaaaacgcgcaaccaagaaactttacttttagatctagcggaaacttttgagaacctccgctccgcccgcataaagctgaaccccgataagtgtgtgtttggtatacctgcgggcaagcttctcgggttcttggtctctgcccgaggcattgaggccaaccccgagaagattcgagctattgagcggatgcgcccccccagcaaacttagggatgtgcaatgcgtcaccggttgcatggccgccctaagtcgtttcatatcaaggctgggagagaaggcgctacccttgtttaagctcctcaagcgctcggggccgtttacttggacggaggaagctgaacatgccctcactcagttaaaggcatatctcagctctcccccggttctagtcgccccggagccaaatgagcccctgctactttacttagcggcgaccccccaagtagttagtgcagcattggttgtggagcgcgatgaagacaatcctcatttcgtgcacccccactctgtgctaacttggcccgggagcgagcggggaggagaggcccccgagtcggacggtggcctacggcccctgacgaccggagccggccctctgcccgcttgtcagacggtgctaggtgcccccgaccctcaggagggccccaaggccactgcgggaaggccacacttaacgccctttgaccccgaggctaaccctgtgctgactcgacccgggaaagagcagggagaagaggcccccgagccgaacggaggccagaggcccctgacgaccggagttggccctttgcccgcttgtccgacgatgccaggagcccccgacccccaggacggccccgaggccactgagggaaggccgcccctttcatcctccgaccccgaggtcatcggcacagaaaacaagtgcgcccccaaaggccacttgaacgaagaaccccccgggggtacggcccctagcagagaggatcagccccaccgaagggtgcagcggcctgtctactttgttagtgaggccctccgggacgctaagacccgataccctcaggcccagaagatgctttacgctattctgatggcctcgaggaaactgcgccattattttcaggcacatagggtcactgtggttacgtcttaccccctcggtcaaatcttgcataatcgagagggtataggacgggtggtaaaatgggcaatcgagctttctgagttcgatctgcactttgaaccacgccacgctatcaagagccaggccctcgccgattttgtggcagagtggaccccggctccagagaccgtctcaatccccgaggccagcacgaacccctcgcagctgcctcacaccacccactgggtgatgcagttcgatggttctctgtccctccagggtgccggtgcgggggtcacgttgacctccccgaccggagacgtccttagatatctggtccgcctcgactttcgagcgaccaataatatggcagagtacgagggactccttgccggactcagggtggcagccgggctggggatccgccgcctcctggtgttaggcgactctcagctggttgttaaccaagtctgtaaggagtaccggtgctctgacccgcagatggacgcctacgtgcgccaagtacggcgtatggagcgccattttgacgggatagagcttcggcatgtgcccagacgggataacatgatagccgacgaactctcacggctcgcgtcctcgcgagcccagaccccaccgggcgcctttgaagaaaggcttacccagccgtcggcgcgacccgaccccttaggggagacggatgcgcctgaccggcccccgaggcccgtcggagtccaggcctcgggacccgaagggagcgctccaagctcccttagattgattgcttggatctctgagatccaaacatacctcacagataagactctacctgaggaccgcgaagggagtgaacgcgtacaacgcatttccaaacgctatgtgctggtagaagggaccctctatcggcgcgcggctaacggaatcctcctgaagtgcattcctcaggaacaaggcgttgagcttcttgttgacatccatgagggcgattgcggagcccattccgcctcgcgcaccctggttggcaaggcctttcgtcaaggattttattggccgacagctctcaatgatgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctcttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcaaaccgaaccacaccaagccgagcgaccggggaaacgcctttcttcctcgtctacggcgcagaagcggttctcccatccgagctcaccctgaggtctcctcgggccaccatgtactgcgaggctgatcaagatcagcttcgcagagatgacctcgactacttagaagagcgaaggcggcgcgcggccctccgagccgcgcgctaccagcagagcttgcggcgctaccatcagcgccacgtccgggcccgatcactctgcgtcgacgacctcgtcctacgccgcgtccaaacgcgtgctggattgagcaaactctcaccaatgtgggagggtccgtatcgagtgatcggtgtcccccggccgggctcggtacggctggccacgggcgacggcacggagctgcctaacccatggaacatcgaacaccttcgtcgcttctacccctgaggagggggggtcgggtgtcaggttttggctcaggccaaccccgcacccccctcgggtgtgtagggttggccgggggctaccacacatgcattacattcttatttctcttttttcaacatttcaatagaagcagtttcaatttcctaaaggttgtgtctgtgctgttctttccttttgaagaatcttggcttaaaataaggtcactcgtactcaaccttgccatcgggggttcggtccggtcagctaaaatcgccaaacggggcccagaaccgagccgtgccccggggcgtggtgaactccgggggggaatcgacaaaaacccacaatcgggtcacccatacccctcggtcaccacgttcccggcctggccagtctcgacatgtggatctccccaggcactagccccgacccgagccattcgaggactgggacttgggcacgagcccttatttcaagctaagacgcaaaaggaccacggcacagatcatcctcatctcgtatgtatagcaaaataaaactaacacaaaaattttttcatcatttctgattgcagattaagttaatttgtacacaaaagaggcatgaaggccttagaagaaagaaaaagaaaaaagtaaagattggcgggggcccgggggctcattccgacgcgcccgagtcgacggcctcgtcaccaccatcgtctgcactgctggtgttgccctcctcgtcggagctgggggcgaacgcgagccgaggggccgacccctcgaagctttggacgatgtggttagcggcatcccggacccgcgcgcgcgcatcgtcctcggtcccgggagggaactcctccagcgccatccatggagagaagttggggtcccgggcctggtaactcgccagcacgagttcgaccgctccccgcgcgaggtccctcgaggatgacttgatggtcttctcaagctcctcggggagttgttcgagaacccaggccatcctgttgaggtgcggagcgaggccttccaaattggtggggggcaccgtcgtctggcctttccagagacccgcttgccgaccggcgcgcttcaggcgggagaccgcatcccaaagcatgtcgggcccaatctcgcccgccaagcgaagggcctcggcctccccggtggaggagtccagcgctcgctgcatatcggcgacggtgtgttcggcagctgcgaggcgggcggctaagtcgctttcgcccgcggccgccccaccgatatgcgccctcgcgtccagctccttttcccgcgcctcgaggtcagcagcccgctgctccagtgcggctctctcggcgcggacgcattcaagattgcggcgcgcctgctcctcctgcgccgcctcgcgaagggacaggctgtccgccagccgtttggtcgtggcctcagcctcctcgagagctcgctcccgctcagcgagtgcgtcctcgcggaggcggagcgcgcactcctcctcggcgcaggcggcctcgtgcgccgccagcgtcgcctcccggagagcagcggcggcctcgcggtccgtcaagccttcctccacggcgccggcgtgttcttccagcgccatagcacgggcctcaagggactcctcgcgccgccgggacgccgcctcactctctgttacccgccgctctcgggcagcggcggagtcaaggactccctgggcggcgtcgagcttttctttcagctccgcctcccggttggcgttttgaaggcggagggcgtcttgcgcctcaatcatcgtggtggtagcgataagggcggccgctcgctcctcctccacctcacgagcgatctccgtcagcgccgccttccgggcttcaagctccgagacgtgacggcggtgagctttacggcccacctccaccatggcgtccaccgagcgccgcccctcctcaacgcgtgcccatgcggcctcgagctccgctcgttccgcgcgcagggcctccacttgggcgctgaacccatctagcaccgcggtgtttgcggcggccaaggcctgcagaatgggctcggcgctcagcggggcgacggaagatgaggagaagagccgccttggagagaaggcgatgcggctcggccccccggaggacgtgctgggctcggggatgtcccccggacccgtttgatcctgggcgtcgcccggggaggtgggcccaggcgatgtgcccgcggcctcgtcgtgagcctccccggaggctgtcgcctgagggttgcccgagggagtgggcccagttgatgcgccagcagcagttgttgcctcagcctggcgagcccgggcggcctcctcccgagcagcttcctccgcttggcgaatccgggcggcctcccgggcggcctcttcagcttcccgaaggcggtctgcggcttcacgccggtcagattctcgcctccgctcctctgcggccgctggatcttcggcctcggactggccggacttggggtggcgggaggaatgcgacgggacatcgctgaagcagaagaaaaaaccagaagacgaacaaaatgagtaagaaaaaacttccttttgggagaaagatggttgcaatgagagtgagacgaacctgcgagggggtcggttgaatgaccaccttggaggggaaatcaggtttccccggcatggttccgtctcccccgtcttgcggagccgtttcttcttgcgctccccctcgggctgcgacgtcggcgcggccccctccgggcgccgactgctggcacgcgccgccccgccccctcggggaggagatgggggaggtgttcctcccagcttcctcttcccctgggcgtcggcagggcggctgctccccgagcccccgacgcggggcccagaagcacgaccccctcctggggcagattgttccccccggcggcgctcgcccgcgccgtcgtggcccttaggggctctctcctctgaggccccgacccccatcataatggttagaatggaggcgcggtcgggatcgctgcagagggggaggatctcctgaggaatgcgagacgcctccacggagctaagattcagcaccctttggaccacgatcttgaagtcctcgggagcccaatcccatctggctccctggtgggtccgcatgtagtcttcaggcccagtgtactcccaggcgctccgggcgcgccgttggagcggcgcaatccggcgacggaggtaatcgccgtacaccatggccccggtgagcccctgggatcgcaggcccgccaggcggtcgaggacggcgtcgtagtcctcccccagatctaccggcgcccgccagctggagacctgcgccgggggctggcttggaagtcggaggcgcgcttcgttggcgaggggggtgtagaaccagtcactcttccagtcgtcccacttcttgcggaggacgcaggggatgtagcggttcaacaccggcccccgcggctggaagtagcagccgccaaccaccgacggcggtgacaccgactgcacggtgaagaaccaccggaacagctgaagagaggggcgcaccccaatgaacatctcgcacaggtgcgcgaagatggccaatgtcatcaccgcattgggggtgaggtgcgccatctggagatcgtagaactccaggacatccatgaagaaagaagaaaatggcgggaccagcccagccattgcgaaggggaggaagaagatggaccgccccgggtagtctggtgccgggcgtccctcgcccagcatcactatctcccgaccggtggcggactccggcatgaagcggcgcggcagtccggcgtgcctctcgctcacgatgcgggaaggtggtagtacactgccgtcgagcagagcagagccccgtgccatggcggtggaggaagagatgattgagaacgagcgcgtgtggcgaaagtagggcgtagcagagaaagagttagagctcaggcggcgaaggcaagaggaacaatggcgaaaggaaggaagcaaatccttttctcgatgcttttatacccttgccatcgctgggcctggctcctcgtttctcgcgcccactacctcgctccctcgtatctcgctatctcgctccctcgtttcccgtgcccacgcttccactaatcccattcgcccgcatacggcgcatgatgtggatatgcggttgtggcaatcgaaatggattgtatcgtgcgcgcgttaattacgctcgccgaccgaagcggcgttaccatatctccgggcgagacaaatctgctcacccagattcgcgcgctgctcaagtggtgtggcagtcttgaatagaccgcccattatggacaaccaaagttaccaataccaatgtgcatggattgagaccgttgggtattttgcccaactacggagaccggtcccacctgtcaccaggctttaggggtggcgtcacacctgaccgcttccctggggaagggaaattgctctggcataacgccgggggctactgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggtcgggttgcctcgggggtcgggttgcgcttgccccggccccgagggccgaggcaccccgaccccttaaggaagtctgcgccacatatatgggataagtgagcacagctgtgctcacctaacagcatttattgcagtctggtcaaagcgtgtcacgctgcatgcaacgcagtacagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgttatctcttagagatggcacgttagccctggtcagatttataccaggcttcatcctaaccattacaggcaaggtgttacacgaagaagggcaaacatgcacgttgttaagctgacgcgtggtggacaagaatgaccggtctggcactggtcgcgtcatcgacagacagccacggtcccgcgtcatctctgtcttcgggggaggtgggggtaggtgtgggctgtcccatcagaagggctcccggatggaaaccgtaccgatctccgcccattaaagagaaaaagaacagtccagtttggaaagagaaaggtgcatgtggtatccccttgagatataaaaggaggaccttgcccatttagagaggggacttttcccttttggaaggctgaggggaaaggaagttaatcctttgtaactggtccatacacaaatccacaaaaacacaggagtagggtattacgcttcgcagcggcccgaacctgtatacatcgccgtgtctcgtgtgtcttgcgggcgggtgatctttccacatacagagagagagagagagagcttgggattgcaccctaagcccctggtcgaaccggcaaaggggggcttgcgcagtctcccggtgaggggcaacgagctccgtcacatgtcctcaatgttttttttggagttaaccttttgcgcttattccttttcaaatcagcagcatgttctctgcaaaacaaataaacataaaaggctaagcaaaacactttacgccacatataaaaggctatgtcaggacaatacgtactttagatatggtactatagcatcacagttgtatagcacatacctatgggcttgcaatttctctctaccagttaaggagtacactgatggttttcccaatggttttcctactggaggaaacaaagtagattcttgcctactcatgggagtctcaaactgatctggcttgtcattattccttgatggtaggttatgcttggtagggaaaccttccaaatatcgtgaacaaaatgccatacactcatctgccaaatatgattctgcaattgaaccttttggacgcgctttattgcgaacatacgacttcaatttacccaagtacctgtaatatatatacaagacacaaaattaataagttactactatatcatatgacatatgacaaatattataaattgtatactaatatatttaataaagtacctttcaataaagtacatccatcgatagcaaactggcccagcaatcttacattcagtagctaaatggacaaccaagtgaaccataaccgtgaagaatctaggaggaattatcatttccattctgcataatgtgatttgaattgcttcttccaaacggtcaagctcatcaacatgaagaacttttgaacatattccttgaaagtaagcagataagtcaaacaagacggatgtgacatcatcgggaagaatacccctcaaagcaattggcatcaattgttgcattagaacatggcaatcatgtgtcttgagcccatgaatttttccttcggcatagtttacacatctggatatatttgcagaatagccatcaggaacttttatatcccgaagaactttacagaacaattgcttctcgcttttcgacatagtaaagctagcaggtggcaagtaaaacttgcttgaagttctttgttgtggatgcagctcctctctaatgttcatttctttgagatcaagacgagcttggagattatcctttgactttccttctaaattttagaagtgtaccataaatattgtcgcacacatttttttctatgtgcatcacatcaagattatgccgaagaagattgccatcccagtaagataatgtgaatagactacttactgccttataagtttttgacttcttaaaatcaccaatagcatttatttcatccaatactggacgcctatagtaagttataggctctgcactaatctctgtggttccatcaaaagaatttctatcaaaacgaaattcatgattaggtggcaaaaatctacgatgacccataaaacaagattttttcccatgtgccaaacgtttggaccatacatttggaccacaaggcgggcatgcaaattctctatgcaccatatgtgaagcaagcattcctaaagctggcaagtcatttatagtccatagtacagctgccctcaaattaaaagtttcatctctagatgcatcatatgtggaaatgccattgaaaaatatgtctcttaaatcttctagaagtggctggaggaaaacatgaatgtaatctccaggacttttgggcctaggaattattaatggcattagaagattaggttccatcatgcagagccatggtggaagattataaattactaaaacaattggccaacaactgtatgtagagctcaacataccatatgggttaaacccatctgtagctaacccaaaccgtatattacgagaatcagatacaaattgcttgaacctttcatcaaagttcttccatgccggagaatcagttggatgttgaagcgcaccatcctctaagcgctcttcatcatgccaacgtgggagcgatgctgtttctctgcacatgaacaatctttttagcctatcctttattggaaaatatcgtaaaactttgcttggcgttgctttctttctttctttcgttaacttggtttctggctttttacctttccatctagaagccttacaaattgaacaaaaatcatcattaaccttatctttccaaaacagctgacagttattgggacatgcatgaatttgttgataatctagaccaaattttgaaaccaccttcttagcctcataaaagttttttggcaattctttttcatttggaattgccatgtgaaggatatcaagtagatcgccaaatgatttatcactccatttgttcatggatttcatattgaacaaaagcactagcagagataagtgtgatagttcacatccatcccataaaggcttctctgaatctttcaccagcttataaaatgcttgagcttctaaatttggcccatcagtatgtgtacatggtgaatctgcatgatcactcataggcacgtcgtcatacacagtcctaaatgcatcattaattaattcgtgcatgttagcacgcatattttcattgtggggctgtggttgctgattcctagtttgctcctctgaagactcaccatgaaaatcccattggtcataactctggagcattccattgcacaccaaacgatcatagacatcattttttgaaagtagcatagtatgtacgcatgtttcacatggacaataaatctttgtatcctccgacttatctttatatgcaaattcaagaaatccatgtactccagctaagtactcatcagaacctctagggtagcgcaaaagaatcttgatggtttttaaatccattttgacctgtatagaaaaatgatatttaagattcttttagataataacaatgacaaggaattgtctcttctgataattttttgaaagtagcatagtatgtaagccttagtccataaactgtaaaaacaggctatatactacctgaaattaaagaaaagaaaatggattctctcagagaaagtgaacattaagggttaaaatttaccaagaaagaatatatatatagagagagagagaagtgcagcacttaagaaaaacccaggatggctgtagcttgcaagaagatgagatcaagcaaataaatgggacataaatgttctaatttcaaaataactgtatggaaccaaatacgaagtataataaccatcaaacttcatctgccagcagcaagtatctcaacataatcaaatttcatgcactgctatataatgtatatacacacatatcccattcaacttcagtccatcatttttatgaagacatttctaataatttatcaaacaaatacactaatgaaatgagtggagcaggccggggattggactcagaccttagttctgcagcctagccgtagaccaccttcacccgcgtttaccccgtcagcggacgcggaacagatcggggcgctgccaagtggtgagacctccggcgatcgactgcggggttgaaagtcacgacgttgacggaggatcagcgccgggactattaaaggatagagagaatgtttttaagtacaaatgattcaaggttaaacatgagaaataaactatcaaaattatattatcatccataaatgtaaattagtctcttgaaaattcagaacttagttaattcctttaattggaaaagaggcaacataaatgaaggggatcatcgctttggtctaaatccagtgaaaatattgttagcacaaatttatttaaaatcctataggcatggcaatgtagagaaacagattggtaattgttttataaacaaatccagcagcataacatattggtgtaatactttcctactattgactactacctccgtcccattataagtgcagctatagtttttcgcgtccaactttgaccgtccgtcttatttaaaaaatttttgaaaaaaatttaaaaacataagtcacgagtaaagtactattcatgttttatcatctcataacaataaaaatactaattataaaaaaattttaaataagacgaacgatcaaaattgggcgcggaaacttatggttgcacttataatgggaccgagggagtacaactttgcttgattaacagggtagcagaaagtttctgcggcattcaatagaatgctgaatgtccatggtctgctcgtacatggcatgaactagtcagaatatcatgttcaactcaacagctaaataagtttaattggtgtttgcatcattaataatgccatatcatcgaagatcgggcccatcaggtagctatcccatggataatatgctatacgtaggagttcgagagaagcagtagtgcctccaattccaaataccgtcttcggaggctggggttggcagtcggcagcccgacgaacgaggcggcggccggcgtcgctgtgcccggcggcggagggcgacggcggcgcggcacagcggagggggatggtggagcggcgcggtgccggagggggacggcgcggtgtcggtgctgcgcggcgtggcggcggaggccggcgccggcggtgcgctacgacgcgaggaagaggcggagcagagttggggtcgaggaggcggcgctgggttgagcccactgggctatattttgttcacgtatatcgttctgttggttctcattaattaaattactaaatatagtatagtagttatgcctacatataaacacaaagcataacattaccaggttgttaggtgactggacggagagcactttttcacgaatgttgcgtctctgtttcgattaacacaggccgatttgttttttttttaaaaaaaaaactcgcttgaatttttttaaaaaaaaacagctcgcccagtacacagtgtaaaaaaacagctcgctcaattattattattttctaaaaaagcttgctttagtccaaaagtttttacatggcaaaaaaccaactcacttgatgatttcttaaaaaaaacagctcgctagatgtccgaaatgtaaaaaaaatatatctctttcaattattttataaaaataaacaataagtttgcttagtccaaaagtttttacaggacattgagaccattgcaacgcatgttatctattgcaaagtggactcaggcgttgcaatatactcaatctctgcaacatatgttctacaacacatattatctattgcaaattaggctcacccactaataagcgttgttaggctcgcattttggtaacgcatgcttcatgcgttgccaagcatgtattgctagagggggttcctgttgtagtgcggtgggtgcgactccggtcggtggcaagcacgacaaggaggggcgacgagcgcggtaggaaggggggatcggctggcagcgtgtggcgagcggcgagcagcgacgggtgcggctgggtagctccggtcgactacgggtgcagttgggcatgcgtcggcgggtggtgttccggtcggcggtgggcacggcaaggagggtgaactggtcggcggcgagcgacaaggggcgacgggagtggatgggtgcctgtagtcggctacgggcacagctggacgagcatggtttagcgcgtcttctgctggcagcgatcatcgctggcatgagaagttcgtttggttatagtggtaatcagcaaggggcgcggctgggtggccctggtcggtggcgggagcagtggggagggaccgccaccgtcactgatgccgccaccaccgccgtcgctgctttcccggcctgccctgccccccggcggttccttcgccaccaccaccgccagacctggaggaagaaggggaaggaaggggagaagcggctgtggcgaggaggtggcttcgccgacagcggctcgctaccgagctgcactcgtcgccgctggcgacccagctgtgcccgtcgccgccgctcgcaccaccacccacctcccactcctgcgcccccatgagagagataaagtgaagagagagagagaggaaaaagggaagcggagtatgataggtgggtcccataatttttttaaaacaaaatgatgacatgattgccacgtgtatggcatgtaggacaaaatcgctctggattaggtcaaggggggtaattcgtgcggtattgaaagttcagggtgaaataataacaaaaattacatgaaaaaattacagctcataatctttacaaaattagttacaaaaagttcaatcttagataaaaataaagtaaagccatatataacagcataagtacagttaaaaaaggtaaccatacacacgcatacctagtacaattttagacttaggagtgtgcaattttaggctttattttttaatatatgatatcattgactttttcatatatgtttcatcgttcataaaaaattacgtaagtatcattaattttttttgactttagaagagcatgtagacttactgtaagaaacatatttcttaatgaatgagagaaaaaaaataatctgaaactaaggttcatggagttttccatacaagcttaacccgattcaacaaaagaaatatatttttagtgtagtcactagtagaaaaacctcatagatatctgttccaagaccagcaccaatataattaatgaagctagctagtgatggtacttgtaggtgcctcttatatatagtaatcaatatgtgctggtttttcctagtacatatatgccggtttgttataacaaccggcacctattactccttaaaactattaattggtgccgctctgtattttaaaccatcataaatggtgacggattttaatttgaaccagtcaatgaggcttagatggatgagaaattggtcatatttgtgctggttttaagcgaacatgcatgtataaggacgttacatatgtgacgcagtgtattagtgaattattaaattaaattagatgataactagaaaccaattagatctctccttggaagtagactttttgattagtagtatatggacactccagccaatcatttattaattcaacacagtgggattgttgcgcacagctccctccagtgaatcaccaatcctcgactccctcaagtcactactctaacaaccattgtgcgggttggtataatgtttctttcttttaactaatcatgctgaaacttttgcatcgttttgcctgaaaaaagtctgcattaccacggagaaaagatgacaaaataagacaatatccataattccatatatagtcctgccggcgagcttgtcaatcaatcccttaattcatcaaatcttgacgggtcccctatctattaatctcaagccaacagataaattaaaatcacagataaattgattgggccacgttttgtccctgacatcacagataaattttgaatttatataagaagaaaagtataaatctatagtataataatatgagatatatcacattgatgcgagtggatagtcatcgagaaaactctacacaacacataagccatgggctcatggcccgactcaattgatgttagttaggccaaataggcccattcagcaatgtaccatgaggccaagttttaacaaaacacaagaataatttgtagaataataaaaatattctatttgaatgctagaacctattcatagaaatcataggaattgtcgaaactggaatttggcaacaataaacggggtagcgcagagacctaaaaatggatagatgcggagataatggtttagataggttcaggccctctcgatgagaggtaataccgtacttctgtttgaggattgtatccgcgagttatgtattgatttgaaaatttggttgtggttatgtgttcatctacccttgagagggcccctgctcgtcttatataggttgggggtggggcagggttacaaagacagaaacctagccggacacggcattagtttcctaatctactatatgttagataatagagaaatgatgaaatgacttggattgaaatattatgaaaatgatctagcatgtgtatgtttagttttagaatgaagtaaattgtagatataattactatatgtttgcatgttaagccttgtgtgtttaatgggttgatgtggcatgcttgtatgtaggttttaggagtgctaataaatacaatacttgcatgttttgctttaggtagtacccggttgggctctataccatgccttatgatacaaggcaacatagcaaccgagtcctactctataacataatatatgcatcctgcccacctcatatctcttgtcgaatatgcactagaacggataccctcatctcaattgggtggtaagccccatctcaatcgggcatggcgtccgtcacaggctagaagtcactgatgtgaagagctatctcaatcgggcaaacggccgtcacggatgattctatctcaatcgggccctaagtaaagcccgtcaccgatagctttgacccagacgaccagtcaaactatatgacctatctcaatcaggctacaactagcgtccgtcacagatgacccttatctgtgacgggcattaattatagcccgtcacatatgagtcatctgtgacgggcattaacctatgctagagttaatgcctgtcacagatgagtatattccaaaaataaataaattttattttttggctagccctcactcgtcacttaacgtcaaagttctctagagattggcttccggaaaagtaattgtgacatgttggtatgagtattctattaatcctattatgccctagtccaggatgtcaaattgggattattaaatgatttcaaatggaaaagtcaccaaaaccaaagttgtagaactcatcgaggtgcaaaatttttattttggtaatttctccatctgactctatttaaacaatttgaaatttgaaattcaaagtttgaaaagttcaaatagaattttagatcagtgaacgacttcaactgaaaaagtcatcaacaacaaagttgtataactcatcaaaatctataacttttattttggtcatttttctatataacattttttgaaccgtttgaatttgaatttaaaaatatgacaacttcaatcaacattttcaaatactaaatgatatcaactgaaaaagtcatcaacaacacggttgaataactcatcaagatctaaaacttttattttggtcatttcttcatacgacaaagtgatagtaacattgttcacaaaattgacatatctcttatctggttttataaactataacacatatatgtaaaatttgtgaataatattactaacatttcgtcagatgaagaaataaaaaaaataaaagttttagatcttgatgagttattcaactttgttgttgatgactttttcaat

SEQ ID NO: 80067 - DNA, 12505 bp, Oryza sativa
acccccaggcgagcgatcgccctatagcatttccgcttgctactcccttaatacaacttcttccaccgctctcgtgccacgcacatcaaggcccctctatagatccgagtacgagtacgatagcagatggagttatttggcttgaacggtgtggacaacgcagggtgtgccacccaccacatgcgagtatgccctgggcttctaaccatcctctacggatcttcctgcctgtagtttatcaatgtggatatagggcaggtaccttcctcagcaagctcatggagcctaccatcacctttgtatagcatcgaaacataagaactaagcaagtcttaccaccaaaaaccaaaacttttagcggaaaaagttaccctcaagatctgaaggagattggtctgaccagagtaaatcagccggtccaactgtcctttgtggtgccaacgcctatcgccatgcatcgcagttctgaccggaatagatcggccactccaaccatactttgcaccaccgatgcttgtcgccgttgctggtccaacaacccattatgccaccggtgttaccgccgaacccgagcaaatacaaatcaaagaactctattagtgtttacaaagtgcacaacaacactcatctctaaaaaattgactaaactcgaaaccgtaactttttctttcaactcaactctcaaaaaatcgataccgagaggtctcaaccactcttctatatatatatacccgaagtagaagcctaaaagccacgaatccaacttgtacaagtcatcctaatccacaaggaaactttcccatataaatatgtaacttatctcattacaattcaaactctaatcttctcaaatttggcctcctctcaaatttgactctgctttccatacatacacaatctcccatcatatgtcgcatggaatcttcaccaaccacgcacattgttctttagcctaagcataccacatgatatcctgaatgttcggacgtcatcttctcccaagttgactcccaatcatcactaacaatactatcccgaggcatcaagacacacctacacatgaatcaaagaagaaaccatatccgagcataatttttttcccaacttgactcaacattagcacacaacagtattacatatatatagaaatcatccagaagtcataatcatgaaataatcatgagtatccaaataaacaacccgaaaccaactccaaacaggaaccagccgattagaccgtcgagctagccagtctgatagcatgctatacgccggtctgactggccttctctacctagtttgaccggtccaacacagtcagctcaccaattattcaccaaatattaaaatcaattatctcatatgtcgattattcatgacaaaataaataataagaaaaaacactttgatttcacacctcatggatcggaggccatccgccacctcttcgatcctccgtgctcatgttgcaaaagggaggtggttgaaaggagaggggagaaaaaggccttgacatgtgtgccccatagaattttatttcctttgacttaattgatacatgagccacataggattaaaacttcttcgaattgagtaagagggggtaattcatccattttgataagttcggaaacgtcggacgtccaggtattacagttaagggcgtaaatcagactaccaaggtttatatgttaattcagacttttccttatataaatggcttgtttcttttcatacaagttttcctgcagcaacgtatatataggatatcataatgttacatgtgcatcacgaaccaaagatgcaagtagagcattgtaagcagcagcaacgtacagcacatcgtcaagttacatacacatcatgaaccaaacatgcaagagcaaaccatagcaaacaagaatatatattttcttccgctattcatgtgcaaccaggagcactacttcttgaagagagacccaagcagctactcctctttccatgaggacaacggaggggtctcacaatccttccaggtgttggccatctgagcgtaccagtcaccgtgcacatcagcagcagcagcgtaggattcgagctcagccatttcgtcccgagtgagctccagggacagagccccaacattctggtcgaaattctcgatcttcgtggtaccgggtatggggcaaacatcgtcccccttgtggtgaatccaagccagtgcgaactgcgcagccgtgcatcctttcctcatcgccatcgcattgacgcgatcgaatatcttggcattcttctcaaggttttctggttggaatctaggcagattctgcaacaagtgaaaggtcgtactcagcaaattaagctgccaattgattgctcaaaggagtttaaaaaatgttagagtttttgtcaaaatatttgtacgtagtcggttatagtttagaacttggagttgtaggaggtaaaagaatagagagtaagaattagacgctattatagactctctcttagatagagagacgaacatgttgtaaccatatgatgacttagcatagccgagaaggagcggctgcaggtggcatccaaccgatggtcattataactctagttcactgtaatatgttggatcggggaggggtgcacgtaaagtgcctcgaagatgtaggcttcggctgaactccattatcaaatatcgtgtctcggtgtcgtcatcaggtgtttctttcttgtttagccatcaatgatgatttcggggctggtttgtaacaaaaaagtttcatgatttcagacctgtttttgaaatgtaaagcgttcggaattgttttagaacttttcaataacgaaaacaaatttggaattattttttcttggaacggttttggatttgttttttcctaataatgtctactgtctaaaaagatgataagttagatttgacaatgtgatctctgaactgtggtattatcttatgatagtgctattttttgttgctaaaatttggaaattttatctgttgttttaaaaagatttggaagctcattttgacagttttttatattcccataaatattagttaccgtattcgcttttattcatattcgctccattttttatttgataatattttattctgtatatagggatttttattccaattttaattcctaaaaaatatgaaaatgaaaatgaaaatggtagagttggttttctaactgtttccatccctataggagaccgcttaaggaagtcataaagatcatttctattttcacggccagccacttgattttcacgggtgggtgctagcagccacttgatttttacaggtaccagtgaccacatgtggtaacacgattttaccctgtacgaaaatctgtttatttacacaagcagctccattcagatagctacccatgtccacgacatttttcagacattgctcttaaatgcccgcctatgtcttgtcttttctactattgattatcatgcgaactcctcacaagacgaaccatcggatgccaatcaagcccgccactaccacactacgcctcctcacctcccatgccatgtctattagagagcaatgagaaacctctccataatctcccaactttttccactatctacgacaataatgtactcgtcgcgtcagccgtagtacatcgccattagcgaggaggacaacaatgatatataggagcatggggacatctcatcctccttatcgtcactggccgtattgtcaggcgaaattcctggggataattagcatagcgaggatgaccggtggtacaacaggtcctatcaaaggactccaacgagggcccactatcgctgaaggaatagaacgaggacaaaagtggcaacgaggctgacgactcggatgagggcagcagaggcaggtgcgaagaaagagataacctccttgatcaccatggtcatggcggcgatggcagcctatgaggatgacaccatctaagaagaggcacggctagagccgatgccagaggcatacccaacatggctgaggtgccgaagctgatccccagcttggccaaggtgcaggaggagggcacctatgtggctatggcaccataggatgaggcgaaggatgggccactggctagagtcaagcatagccgtcaacagaagcagagattgaggagaatgcatggcccttccccattgcgctggccctatcgcgagctctgacactgggctaactgtcaacgtttgatccacaacgatggtgaagcgccgccgccacaactaattgtacatattatttttttagtataggcccaaagtacgacaagtagcctcagtagtatgtaattaggggcaaatttttgatttgtattatagtactgtgttttctaggttaaatcttttgtagaaattgaaatatatgttaaatcattttttcatccaaatcaatatatattaaatatttcatctaatgtagtatccagagcatttgacaggtggacaatttgttgtctcacttaaatgtggtcccaactttttcccaagcggctttcataagccactgcatatgaaccaggtctacttgttattcaaaatttcataataattttatatgaaggctgattgaaattaacagaatttcagagtgatccttgctacaattcctttagtttaattcagtcaataactctttcaactacaaacttagtagggattaccactaatatcatgatatctgacaaattaaagtcaaatggtatgcaacatataacgatagtaagtaaccctagtaatgcagatattttaatgaagaaacctaacatagctggaacacattacacatgtgtagtggggatcatagtgataagttgtttatctcaatcagagttcatatgaatttttcaaatctttgaaaattgttatcgcaggcggcgacttgcatccgcttggaaaaattatattccaatgcagatatctgaagacgccgcctgtaaaaatgatttagacataataaatggccaagagtgattcaaagctctaactccatgaattggaaaatataatccgaaatcgtcaacgccgccactgttgcccactagatctgccaacacagccgctgcccaccagatttgcacttgtcacgacatgaggccatgacgggataaccaacgctaggaggatagccagtagcgtcggctactgcagaagggagcgcatccatatctaggtgagtgttgtcctgttggatctcccaccatcaccgctccacatccaagtacgtcatcctgtttatccgacggtttgtccggtgatcatgtggtatgtattgttcagcattttttgcagtcccacatttcatgactaccttgtctgatagtccacgtttcgagaaaactgagcgagtagtaagcatatgataatttaccttgcgaaaatcatggtctggtagagaatccactagtttagctccaccagaaaagaactaaccctctaccaagtgggctgtaagctactattccaattccaagttccctgaaacagaattaacaaacaatagttaagatggagcatatgattttttctcaatagacaaactaatttgttttcttttcactacctgcaagttggaattatatcttcttccacgtctctagaccataatgaccactcgagctgaactgcattgatagggtgtaccgcatgagcccttctgattgttgatgcagatgcttcacataacccaatatattttacctttccttcttcaactagttttttgagttcatcaatctaatggcatccacaatgtgagtagaaaccaagtagtaagtattaaatatcaccttattacttggtagtaaatattttaaaggtggtatactaccggatggaaggaaaaaacaatcttatgtgaacaatgtctccgacacacccggtcacaatgctatcagcaatggataatttttttctcaagtggcccccaccttattcatcacccgtacacataagcattgcagatgcagtaaagacctactacccactattgtttgggcccacactgataccgagtttagtaagaaacattgagcatgctctaataatgtgaaaggactacaagataattgagctattccactaaattatcacaacaaaaaataattcgtgccaatatattgtactattgcaacgataatttttctgtgacaaataactatattttattgcaacgacttaccatcattgttttatttagtatttttgttgcaatagaaaataagatattgccaaaaaaaacattaccgttgaaaaaacatgttctatcatcacaattttaattttgtggcaatttgcatagtacatggctgtggtatgttactttttactattttctattgccacgatcaacaaattcgttgcaataaaaaattgtcatctcataatttaacttatttttttcatatggacatggattagaacaaattttatatgaaagttatagctctcaacgagatctacaattttataggtgataactttttcatttgaaatcttttatatatttaaatccgtgattcaaatcttagttagatatgctcaaatggaacgatatgcattttctaacagaattgatgcgtaggtgagttggtaaaggagagcacacgtgaaggataggtcttgtgttcgaatcctagcaaagacaaggtatcaaataataaatagttatgatgtagaacaaaattagttaatatttaaacttttaatttagtatgtagaactaatgccacatatggagtggtggcaataattatttattacaacgatgtgaagtgttgcaatataattttttggccacatccattccgtggaaacatcaaaatttattaccgctaaataaaaatcgttaaaataacctattaccacgctatttattaccacggctagtaacgattttaaaattgtggcagcatgtatctatcgccacaattttagtattgatcgatgccatgatttttttcatggcaacaaattatttttctagtagatcaactagataaacttgaaaagaaaggtcattacttaaaaggcatgcatagctctcaagataaaaaaatacaagggaaggtagtgcagtttatacacaataatttaaagcaacaattcaaaaatgtgtgctagctcgtatgcgttattagaaagatatagcacaccagaatgatcaacacgcatatactgtggggcgtgttatagtaattattgctagtttgtagttagatgttccaaaaggaaaaaatgagtccttcaatcaaagttttttctttcccgaaagaatatgaaattaattatatagtgaaatcgataaataatcaaatgctccttttttttgctcttcattaataaaagaagagtaaattgcactcacggtgcatcaacttagcaggtgggtgtaatttggtgaaaaaacttgagaaatgagcgttctagtgcaacaacttggtaggtaggtgcaatttagtataagaactttataagtaattatataaatgtaacaacttgtaaggtaggtacaattttgatacaataaattaagaagttatgagacaacttaattatttggagattttttttatagattcaatttttaagtacttattttgataatatactagcgtgtatttgtataagcatatttatatttttatcctaataactaattactaaaagtcaattaaactggatgtaaaaattattatatttcggttgatatttgagaaggtgaagaaaaaaaaattcttaaatgttaattggatgtaaactgtatgtgcagtataatttttaaagattaaatctaatattataaggtaatatatgtaggattatatgttaatgatatattgacatcgtgaaaaaaaaaatcaactagcatatgcttagccaagttgatgcatcaaaatattaaattgtcaagttcttgtactagaacacacccacttgtcaagttgttacacttatacgttcatttctcaagttctcatactttatcgcacctatctaccaagttgttgtaccatgagtacagtttactcataaaagaattaagagttaattatccgtttttccaacaactgtccgaataattatgaaccttgacaccaaccatttgccaaacccttcaccaggccaccaccaactttccctttcataatcagcttttcatcactcacccgtttatgtttctcataacaaaacaataaacacaaaggcaaaaagaaaaaagaaaagaaaagaaaaaaacagaaagagagacctgagaaagggaaggggcacgcacagtgacctcgatgggcaccttcttgtcgacgcggtgctggtagtaaaggtctatgcagtcgacgccgagccgctggaggctgccctcgcacgccgcccgcacgtacgccgggtccccgcggatccccaccttaccgtcggcgagaaatttaccgaacttggtggccagtgcaacattgtcgcgcacactgccgacctgtagcgcctgccttttttccaacccatatgcaaacaagcattccgtcgagcaccttcagcgcaccactactcgcgcatggcgcaaatcaacccaaagaaagagagggacaccagtggaaggaagaggaaggtactatacgtaccttgccgaggagggcctcgttggcgtgcggcccgtagatgtcggcggtgtcgaggagggtgacgccggcggcgacggcgtggtggatgagcgccaccatgtcggcctccggcttggacggcccgtggaaggcggacatgcccatgcagcccagcccctgcgccgagacctccaggccctgcgagcccagcttcacgcgccgcaccgccgccgtcgccggagcagcaggtgccatggccggccggaatcggatcgatcgatttccctccactgtacatctgtacccatataatgctgtgcgatggcaactgcgtagttgggaggagtacccttttttttgacaaattgactctttttaaaaacttatttcgaaactaacccctgcgaaaaacttcaaccaaagataggccgtcggcgcagcgccaagcgcatgcgcttggggttggccgtgtcagcgccaacgaggctggcgctgacatcgtgccaccgtggcggccgggccgatcccccagctaacgtggtagctacctcagcaccaaccacttcggcgctgagatgccaaagttcagcgccaacgggtttggcactgaggtttggtacttagaggccggccgaggccgccccagccagcctctcctctcttctccccaccgcggctgcgctagggttcgtcgccctctcttctcccctcaccaaatctcccccaaatcaactcaaatcgaaggggatttcgtcgggattgagttgaggatcgattgagaaggtaaactcctctagaaaccctaatttcccccatgttttattggatatttcgcattgtttggttccaaccgtgggttgataatatttggctccgattgcgatgttaattggataatgtgggtggggatgtagtgcggaagacacatattaatcttgctccatttggttcatgtgtggtgatggttagggctttgttggattgttgtgtggtgattgaaatggttgcaaggggttgatttgtggtgatgtctaggcactttgtaggagaagagaaattttttttgtgaataatgtgtagtatatgagttgaaacaattatgttatgttttatggaaaaagttggacatgttgataggtttggaagttttgggattgctatggtatttagagattattttcaattaattaatgtttatgtatgggttaaatattgtagatggatagattggtccggcttcattatggtggttgtgtggtagatgaaagtaccggtggaagccaatttgagggaatgattgttagacagttagtgtttcatgcgaagcctacatttgaggagttaatgtctcgcattaagcatgaattggattggagtgatgagtcagttggtatgcaagggagatacgatgtgggcgccggtgtcatgttgcataagtttatgttagacttgaatggagagatcgaatggcaaacatatatagatatagtattggggtcacatttcaaagctcttgaggtgtttgcatggaagaaagagggtaggaaagggaagaaagaacttatagacctgaatgaaagtccactcatagaataacccattagttcccacgaacagtcggagaggtgtagtaggaaggaagaattaattgaggtggaggtgggcgagggagtaaatgatacagcggatgtagaggtcagggaggaagtacatggggaggagaatgtcccggtaagggaggaagtacatgtagaggagaatgtgccgttaagggaggaagcaaatgcagaggacaatgtgctgttaagagagggagttaatgtagaggagaatgtgccggtaagagaggaacgagatgttgacgatggtcgggaggtaggtgatgatgtggagttgcctgaggaagaagcgaatgctaaggatgtaagtttgggccttagggagttggttaggctgaaaatctatacccgacaggagtgtgaggaggttatgatacgcagtggattgaacccaggctgattggagtatgatacagaggatgaattggatgagtccgcttctgactccgatgatgatcgtccagtgcgcaagatgtcggagcatgaaaggactgtgtttgagaaactggtgggtagaaacccggaaataacacaattcgaggatcttacaagagccgggctagcaattgctgatgaagatccacaatatgacggtgccttcgaaccaatgtgtgatgaaccaaggaaggggttggagttttgatcaatggaagatctgaagatatggctgcagagttattctatccgtgtccaccggccttaccatgtcaaggaatctaacgcgtcagtaaagtatactgtggcttgtctcgatcgccgttgcaaatggcagattaatgcaaggaagagtggaggagataggtggcgggtgactagggtgggcgaagaccacacatgctgtagtgcggaagtaaccggcaagcatttgcaacttacttcgaggtttattggaaataggttacaggcatttgtgcgagctgaaccaactttgtctcctgtagctattgtcgaggcagttgagcaaatctggcactatcggcctacatatggcaaagcttggcgtgctaagcaagttgctatgaaggtcatttggggagattgggacgaggcgtatgttcgcttgcctacactgatgcgtgccatcaaagcaaggaaccctaccatgagtttccgtgttgaggctcaccccgagaagtcaaggatggtggagggagtacagaggcgagtatttggacgtgcatattggatatttggccagtccatagaagcattcaagcacttgaggccggtgctagcaattgatggcactttcttaaccggtaaataccaaggtacattgctcatggcaataggggtcgacgcatggttacatcttgttcccttggcgtttgctctggtagagaaggagaatacatccaactgggagtggttcatcaacatgttgagacacaagctgatcggtcctaatagagaagtgtgtataatttctgatagacaccctggcattttgaactccatcaaccacaacatgcctcatcacctaaccattcaccacaggtggtgcatgaggcacttctgtgctaacttctacacagctggagctacgactgatcagatgaaagatcttgagcgcatatgtcaaataaatgagaaagcattgttcctagatgagataaaacggctattgggtgtggtcggagagaggccaaagaagtggctagaagaccatatggcacttaaggtcaaatgggcaagagcatttgataccaacgggcgtcgccacagcataatgaccagtaatatggccgagagtttcaataatgtcttgagaggcattcgaaaactgccggttacagctattgtggcatacacattttcgaagtgcaatagttggtttgttgatagacacaaagaggcaactgtagatatcctgagtggaaagaagtggcccacaaaagttaaggacatgttggaggagcagcaaagacgaactttggggcaaagaacagcatgtttcgatttcccttcgatgaagtatgaggtcagcgagcaaggcggagtcacggcggctggggtgcaatggggtggacgtcactacgtcgtggttgcgagagataacacatgtagttgtcagttccctcagctccatcacttgccatgctcccacatgataaccgtttgtaagttgcgaggtttggatgtggaggtggccccccgaatgtgttatgaagcttccaatagggctgtgcaggacacgtactcccctaggtttgaaccttacctagatccatcgcagtggccaagttatgatggagagttcttcgtttc

SEQ ID NO: 80068 - DNA, 59062 bp, Oryza sativa
cccaatccgccaagagaatccaacacagccttgatcattgtcgacagcagacaaaggccgcagggacaaatcgctgagtgaagaatggaggggagcagctgacttgtggggaccacatgggtaaaatggacatttcgtaccacccatttgcactggcaggacttcttgttggcacttggcacgccatgtcgatgaaagtggcgaaatataaaaagttttgtctctctctctccagtaactaaatgtaatactaataacaaataggagaggggtatatgggagattttacaaatttaatagtgacaaattagttaaattttccgatgatcataacactgctcatcaacacttaaaaccgcacagtacgtatcatactatcttctccatatgttcaatagcctatgacaatcggaggataattaaaaacattttggtttgaacaaactgtactattaaacatgacatatggtttggtaaaaaatacgatatgtcattgcttacttgtcttcatacgtattagagcacaccaagcttcacctcggttagtgagccagcagcatgtatggtttggttagggccaggagttcggccatgctgggccttgggcctgttgggcctactaggctgcgcaacggtgtaaatgggccaatagagaggaaagcgagctgggctggtctggaaaaagtgggccggcctgtaagagagaatgaaaagatgtcgagggggttggatcaagggagtggatggaaagtatgggccagtagagaagaaagaattgaatgtggcccaagtgtgatatcctaaaattaaatttgggactttctatcatagtatagtgggccggatgtgtataatttaaatttgctgtcatacaatgtcccatggcacataaaagtgcctccctgagtccctgtttacttcgtgtagttccctgtttatgtaagtatagtaatccttatggaaggtagttctgtaaactacactgtaacttcatgtcttaactcagttaaagaaattggatgaaatattctaactaacgagctagcttttccttatcatatcgaggctgtttgatctctcatgtatgtcaagcctgcggtcatgcatgtcacatggagcgtgttcaacgaaacacatgacattcagcccaggaaatcaagcagctaaacacattgcgtgtgtctccggttctctccctttatatgctacccaatctctagctttatataataaaaagaattgaagttttattattcttattatttggctgtgaaatgagatatttgagagaaccaagcatatcaaagtgtccttagcagggtatggaaaacattgagatgatcgcgagaatactcaaatcatccgtaaattcgagttgctcaaacacaacagcttgatcccaaatctcacggacaagacgtggaattcttcttaccaaatccatgaattccagttgctcaaacacaaatcccaaatctcacggacaagatatggaattcttcttaccaatactgaaacatgtggaattttgctcaccaataccaaaagaggcgtggatcccaataccaaaagaggtgtgtacgttctattgattataatgatcaaaatagttctattgagtataacgatcaaaatacaaatgtgtttattgaacaatgcggctgaataatctctgctgaaattgcaagtagcactagtgcagagttatataatagggatacaatatgcctactcgagaagaataacccatcataccagaataattttctggataattcaaattcatcattattttttatgatgggacaaatgattataccattctattcttttatgttttataaagaaaacctcatttaaaacagaacatggatttctattttcaccaaaatctaccatcatttttgataaaaaatgaatgctttctgtattatctgtactactttaaaaaaatgcatagtggttgaaggtaaagccaacgtaaacacgcgaaccaatatagacacatgaccttaaccatggcatcagaaatccatagttggcgagaaaaaaacggcgcccccaatccctctctatctcccccacaccctcaccccgccgctgccgcctctatacctcgacgcggcgccatcgcgcatccatcactcgtcgtgctctccgcactccgccgcatcaatgcacgcgtcgcccccctctctcgatcgctccctccgtatctcccctcggctctctcctcctcaactcctcaatcgacgccgccgcagccccctctctcggtcgctcccccacaaccgcttggtccgcttcgctccgaagactcctccttcactgaatcgccgggatccgccgcccccacctcgccctgcggcctagggtgctgctgcccgtcatcgtcgaaggagctggtttccgccgccttctttttgatccgtcgcgtcgcgcaccgtggcgggggatctcgtggggcgaatcccgcgccctcctccatcgtcgtcgtcatcgtccctggtccctggtactacaattaagttgaaattgatgcgagtactatgactacattgatatcatatattttagggaaagaagaaaacaatatatatagaaaaaataataacgcaaataatgtaaaatattggttcaagtttttacattcttatgagccattttttctatatgtttattttctactaggttctaatgaatatgtaaaacttacaagttttataaaatcactgcaatttaacacaacacacttactattatttttcctaacacatgcacctatactcatgaacttaaacaacacaatctacccaaataattactgacaaatcataaattactatttgatccatctcaattttcgacaaacatatagataattaaaatccagtaaaacattcttttgaatatatgatttatgcataatttgaaataacccatatactcaaaaaataactaagccatgtaatattatacaaaatttccatattcaagatgatcgataaataatgtatatgggctataaatttctagcgcgccaactaacgcgctgattttctagttatacgtactatagatttttttacttttcttcttatataaattcagaatttatctgtgatgtcatgggctaacacgtggacctttaatttatctgtcggcttgagattagtagataggcgacccgacaagatttgatgaaataacggattgacaagctcgccggcaggactatagatcgatattgtcttattttgacatcttttttccgtggtaatgcagaccttttttcaggcgaaacgatgcaaaagtttcagcatgattagttaaaagatagaaacactatacctacccgaacaaaggttgatagggtagtggcttgagtaggtcgcaggagtggtgattcattggagggagctatgccacaatcccactgtattgaattattaaatcattggatggatgtctatatactacttcctccatcccaaaatatattttaggacggagggagtactaatcaataagactacttcgaaagagagatctaattggtttcttgctatctaatttataatttaatgagtcactaatacattacgtcacatacgtgacgttcttatacatgtatgttcgcttaaaaccggcacaaatatgacccatttctcatccaactaagcctcattgactcgttcaaattaaaatccttcacctatgactactcatttgtgatgatttaaaatacagagctaattaatttttttagataatacagagctaattaatagtttaatcaagtaataggtgcctatttttataataagcgcgcacatataaatgccacatacggtgtaagtaggttgaaaaaaccgacacctatttgtataagtggcacctgtaagtaccatcattagctccattatattggtgttggttttggaagtgatatctatgaggtttttctactaaggactacaccaaaaatatatttcttttgttgaatcaggttaagctaagctacacatgtccacttttcatgctactgtagagcaaccattagaggagccaattactaaggtttctttgtgacaagttgatttatttgttattccttgtggtaaagaagagttgtgttataatacttcacttatatgcatgccacaactaatgaatgaacatactattcctagtgttcttttatgtgctgattttaagcatgttgttcataattgcgaatgaagttgaggaatgtgaattgctatcttctttaaagactttgggctatattatgtttgatgacttttgtgtactcgataatttgaagtagaatttattagctaagtctaatttggcatgtcgaatgaatactatttatcatatctttggtgaaaataatactatttatcatatctttgatgcataaagtttacatatgttcagttttgtaacatcgtatattcatagaagaaaatagtaagtagggagatacattatttgtaatcatgttatctcaagtttatctcatttcaatttaaagaataagttggttctaaagaaggggagctactagattgctcaatattgcttccatacaccattacaactacaccattcgagtactttgttcataaagaaggagagcgatatacgctgcaaagggaatagtttcaatgtagcatataaatcctatgttgtgcatccacattaccaggtataaccgtttcattagacgttaatattatttgcgaaagaattcatgatattgcatgacaaaagttttttgtgttcgtgttcatgtacacacgtctatgcgcaagatcatgcactacatgaacaacaacatatggaaaaattgagaacggtttcctttgaagaaggggaggacgatgtgttcatgcctactatagaaacatgaaggcatggagaacaagcaaaaacaattcaattcggccacgttgaacaacagtgacttcaaacggtcaccaattgtgcataagagctttgttttgggcccatgatggaaagctcttggagtcctctttccaatggatccagtcgcatctccaaattccatctaagttggccacaattgcaaaatcaatgtactgtatcacctgggaccccggcctggggtgcgccccaaacttgtggagcatgaccctaggaaccccttagtcgtcgccccacctccttaaataaataggttccccttccgaatttctttggttttgttagattaaaatttagccattactactaaccttgtatttgcgcgtgtcggctagaccgtctaattacttgtcttcggagccccaccttatcgtgatctttaattcctatttacaatttagattgtttttatcttgttcttgcttgtttctttgatttacttacaggaatatggctgatctgcaccggtaagatcaacaacccatggtaaggcacaacacaacaacgcctcaaacaattgtaattgcgccgacaacttctctcccaaatcgtatttatctcaactcatcgaaagaaccggccaatcatagcagtgtgtgtatcgatcggagcttagggcttatcaacattattttttggagatatgagttttttcttatatatgtagaacttttttgaatagttcaatcggaacctaggaaacaacacttaactttttggttagggttagagaaagaaagttctagctttaaaaaaattatgtgttggtgtgaaccatgccaatgtacaacaaataatataatctgcattagcgtattaaattgagttaatctagaatttaaaacattttacaaagtcaagaagatgaaatcaatttatgctaaatttgcattttatttctggtgctagtttgcagtaagtaatatacaatttgagttgactgaactttttttttgttgttttatacttttcattatgaaaatcaatagaatacataactcacctagtagaagattggttttcctttttttttttagaagttgtacactgcttcattttctcatcgcactctaattatatttataccttctgttgctctcctaagaaatccaatcagaaggaaaaacctcacttcattcatgatagtcgctcgagttcccttttccttttagttcagtttcgcctctcctcgtttccttgtctccattctgattgattcgcttcttcgtacaagcacttggttcacccttgactacaataatcgcactcaatcttttaaaccgatgtttcatatgctcttgatcacatcatcataagaaaatactgttaaatcttcccgatacgagagaacgagggaaggcatgttacaacttactgcttaaaactacaagattagcgataagaagaaaccctagtttaagtactagcgtcccaccccaacgttcttgtagttaaaaagcctctcccagctccttgctgctcgcctcgccattcgtggcttatgtagtggttggcattcctacgtactccgagtgattcccacacgagattatatgagaagatttatacgtgctccgacttattgcctcagccttttagaagggcatttggtgcaagtgtagtcaccaatagtattgtggcatattcctcgacagatgcctgttatactacactagtccacatctgtaaccacacacattgagagcgaagagatgtcctcatcgcaccttattgaggagtcttagcttcaagatgtcattacagacattatagaccttactgacctattcacgaaaggatggtccaataatttggatgcagaaggtctatcatccggatatggtctcaaacactggcttatgaaatcacgagcctcctttgaaaggtattttgggattgctggtggttcaccccttccgatcttaaataaagcttgtgcctgtaaaacaacaattgaagaaatagttggacacatttaattgaacaagaattgaaggaataattcaagggaattggatcatagtggacacatttaatttatcgaattttgacacataatttaattctacagtggaaaacaattttcctgatgaagaataactcacccattctaaatttgggtaaggcagttgacgtgtcaacatctccaggactgtgcaaccgagactccatatatcagctgccgttccatatgtcctcttgggattgacaacctgaatgttcagtgtatagatttaagctgaattaagcggcgtactgctggtaaatttcagtacatgagaacaaaactctacctttgccatcatagacagtttttactatttgatataatactagctagccagttcttagcgtttattaacattaaattgttggatatatccatggccacattgtgccagctgactttcactttcacccaagtccacaatgtatatgtgccgctcatttttaggataatatttcagtactttttattctggacaaaacatcgaaggagggggagaaagctatggtgacaaaaaatcttagcatgtccattttgttatttctttattttttatagaaaaaactcatcgatcatgcatggtggtatacctcgggtgccatccaataaacacttccttcacatgatttaagcatgctgaatttgtttatctgaaagagataactaataaatcaagagtagaacaaagtcagtaacaaagaactgaaagatctaacacaaacataaatacagattctgcccagcagaaagcagagacctgcttagcaagaccaaagtcggcaagtttcacagatccattcctatgcaccagtatattgccacacttcacatccctacaagaattttgaacattgaagtacatgagtatataattaatattttattcctttgcaagacaaattgagaaatctagtgagcaatttataattaagaaatcccatttatgctacaaaattacaggttgaaattgcctatggtgcaaacagacgtatgaatattaccgatgaacaatgtttctgttgtggaggtaagtcaacccattaaggatttgttttgtatatcgcgaaacatgagaatttcgcaggcgatatttctggtacaaggatgcaagagagccttgtgacattagttctaggaagacgtaaagttttgagtcctcctgcagtcgtcacacaatggatgatcatattaaccttaaaagaaatatgtataagaaaacctatgaatttatatacaacacaataacacatattacttcaacaaatagatgaacaaccacaagatcccctaaaggcaaagatcacaagatcgatcaggagcttactttgtctgtaccatagtactgtacaatgttattgtgttgcagacgactcaggagtgcaatttcctgaacagattattagaaattagtagatgctttatgatctgaaaatacaccattaccaacagaaatatatatactccatatattatcaacaagagaagcatctagcgaaaccaacctgctgaagctgaaaaatacactgttgtgcatcgtcgtatttcccttgatcatctaagtacacttctttgacagcaaagaaaacaccctcgctgttacgataaaatacttgtcagccgtaacatggttgtataggtagctatacaaattttattttctttctcgaagaataacactcagggtaataaaaaagaaaaacaaattaaattacatatctgttactttttaatttgagtttttataggtattaattagagttgaaactaaaaaagatcagtactacaacaaagtgattgatcagtagtaattactccctccatttcatattataagatgacttcattaaatttctttagattttatgaagattctattaaaacgtagcaacatttctaacatagaatagacatactaataaaatatatatgttaacggcaaaatttggtgcatgccgttaggcaaagcaagtcaaagagatggttgaagttgtgattctagcaaggatggttggaaagtgtatcagatatatttaaccaatcttagaagtattttgtttttagttttcgtattaaggcaagtttgttagtttccttttctaacaaagttaattttgatgagttctaagtatcgagtttagactgcaccggtttcgatctccaacgagaaagtaagctccatcaacttcgcttatatcggcctaattagtaatttctcgattaagtccgatattctaatcacattttactaccgttccttatctgatatatcgactctttctttgatttctttgctttcttaatttgattcaatatatctgatatattggctctttatttgattgctttgctagtttgatttaatatagatctatcaagcctttcatcaaacttatattgtcttggttaagtccgatctgctagtcttttattcgttagatagacttattcaggcttgataggctctgttcaaagttctatcggagttttagctgatgagttatccatcacgattgtatagatctatcgactagatagtttttcttattgtcttcaatcctatactatctcattttgtcgacgggtgatacccgtagaccggatatagagggtattggggtacgttggtacaaggatctacgtaatacgacatcaagcagacaaaagacaaagattatactggttcagaccccttgatatgtaatagccctaatccagttgatgtgggattatatgatggaaaacacaggttacaaagggaatagtggaacttgacgaatccggcgagatcgtggtcgagttggctcgactacgatccctggcgatttggctcattgcaggctccgacttcgtaggctgtgtgggttgtgttggctctgagattcgatgccttaggtcctccccggggggtcccttttatatcacaggtcaggcggtttccaagtagaactcggaaacatcaaaccttacacgatacattgacgacccagtcttgtccgagtaggactcttttcatttgtaaactccgtgaggggtttccttaatttacgcggagagtatccgtatacgtgtgggtatactacataggtatgcgacgtacgtcaaagggtaaagggtatacctaacccgtaaccctaacagtagcccccgacttctgcttaaataagctcgtgtaaccattcacggcttcttgtgtcgagactgttgtcgttcccgatgcgaggaccgtagagacaggacgtagtcgagaacaccgtttgaagcccaacggtcatgagcgaatttaaactgaagtccaaaaaactgccgcgcgtaaaggacccagaaatttccggcgagcatctctctcctttccttggaattcgcaccgtcggtagtgtgtctatttaaaggaattttgaggatccaaagtccgcccatcgtgtagaaaacatccagcctgcaagcgctcttcgtcttctccactcccacaagaaaccctagttcgtcggccttagccccttctccggtgatctccgatcgacgatggatcttggcaaatcatcctccaccagcgcgtcgctgaagaagctttaggaagatggcgcccttcccggtcgtgggaccatggaaagggaagcaggaggtactaatccccagcctgtcttaggtcgcatggttgtgatcgaagactacattctctgtgattttatccctccgccttccgaatttcttctcttggttctgaacttctacggtctttctctgctccacctgaaccccaattccatcgcctttcttagcatcttttctcatctctgtgaggcctacattggggtagagccctttcttgatctctttcgcttttactatgagctgcgttggatggagcccaacagggtgtctggatgcgtcgggttccgacttcgggatggcctgaagtcgcgttatatccccttccagtgcccttcttctcgcagcaaatggcggacgaggtggttctaccttcagatcaaagattcggaccctgtcttcattgttcctacggaacaaccggacaaaatcccgtcttggactgcaaagccccctttgactccttctctccaatcgttcatcgacattgtcgatgatctccgagtacgaggcttgtcgaggtatgaagtcactgcagacttcgttagaagacggatccagccgctccaggctcgagtccatccagcctttgactattccggaccggaggacgcgacccgggtttctcctcagggtatctttctcgcatttatcctgacatgctcatgtccacgttcctcctgatttatcaaaatttggttctcgattcacaggtctgaacagcgaaaccgtgggacgtcgtgtcggccaggtgatgatcagcagcccgacaacagcgagtaacatccccgttcccctttgtgaaaagcgggcggctgaacgtgatgctgccatcaatgtaagtgttctcgataggcatcctgcgttttccttttgagatcactttatgacttgattaagcgtaggctcttcctctgactaacatcatcgggccgctcgcggaccatcaggtggcggcgtcactgaaagagaaggtcgccaaggaggcgtctgatgctgccgctgctaccacaagtggtggcaatgttctgagaaaggggaggaagttctctgtaagcggacatcgtcgcaaggcatcaaccccctcgataagctatcctgtcgtcagatcatgcagctagaagaatttcgccttacttcgcatcaaccgtttttcaggcctcggacgcgtctcccctgcctccacggcgacaacgtcttgtgacagttggcgagaagtaagtagatgaacttaagtcttcgtgattttgttcgagtgttgtctgaaccatagctgtctcacagggcggcgcgggcgaaggcggtgcaagacgagtccggagggacttccggcgcgtctcccgctgcagcctcgacggatgtcgtgcttgcgcctgggagccgcgaggtgacaccaagcggcccagtcagcgatcccgcagctggtcgtggtccactggctgccgtcctcacctgggaggatctccaggtcgaaatggggcgcctcctcgaggctagtgctcgcggcattggccgtgatggaagaagtcggtgatctgggggaatctgttctccccctttttgaagagtaggacctcttgtaatccctagacatgctgtgtaaacctggattttaaccgcctttgtgtgtgcagctgttatgctagttcactcttgtatgttgatcttgaaaactagttcactcttgtatgttgatcttgaaaacttttgtcccttgtagagatgttgatgacgaggatgtccagcaacgcgggcagcccgagtttgaaccacatgcgtcgcccgacaatgtagaccagacccttgctacggggccagagatggtgacgacttccttaggttagtagtccattcatccctttctgctcctccgactagatcagctctgttcttgaaagaggcgtgtagcttgacttagttgttcccacactgagcagatctcgagagtgctcttggtggccaagatcgtcgtatccaatattggaagacaaaatttgaagtagcggatcttgagagaaccatgcttgcagtgaagaaagagcaggctgtggaaacgctccgaggtggtgaggtgtggttcaactcgtacttgaagagttgctgcacatccatggccagggtttgtagagaacttcgagtaccccatggagatcccgaggagtcagcagctggatacatctcatggctgaacggagcctgtgctcaacttgatggcgtcggcaagcgtatcgacgaggccttgaagcaggagtgtcatcgatcgagccgatatgccggagggcacgtgttggcttgcctacgagatctccgtgagggctttgctcgttctcggaggactccggcggagatagaccacctggcgaggtcgatggcgccgttcgcggagaagatcttccagtctatggactggcgttggccttcttggtagtcttcgtaccctgtggtagatatctcaggaaaaatgtgtaatatagctttggatttgtgtaaaaactgtaagaaatattttgtgaaatagaaaagaaatctatctttaacaaaacaaatctttcttactccagatgtcgtgtgtaagagtgtgttcttagttcacgactttagtcagtcgtttgagtcgtacactctccctagcccccagccttgtcgtcggaggaattttctcggaggataaggctcttggacctttgacctgccttggttgaataagctctgatcctagcccccagccatgaagttggaaagttaatttccgatttcacggcttggttaatacgcacggcgagaactcttacacgaccagatcttacatggtctttcgtctctacaggatctgacaaggccttatcggctctgggcgtccccagccgaagatcctttaggttcctcggaggccttgtcaagacagcgtaaagggacatgaggataggtttcaacgctaggtgtcatcagggtaagggatcatcgggcgggaacactttgattgtaatatgggcctaagaataggctttactgatactgtaaggtgtcttacaggtacggatggtattgagtcatacatagaatttacgtagttggttaatgttccaggaatttgctaactcgtgaccatcgccgtctgcaattttgaatgcgcctggccgcaagacttgtgtgatcgtgtaaggtccttcctatttgggtgagagtttgtttcgcgctgcttggctttgaacccgtcggaggacgtagtcgccgatcgaatgtatgcatactcggatgcgcttctcgtggtaacggcggagggcctgttgatagctggctgctcgaacgacaactcgttcgcgatgttcctcgagtagatttacatcgacgtttcgctgctcctcctggtcctcgtcggagtgcttctgtactcgtgtactctgatgtcatagctcgctggggagcatggcctcggagccgtacacgaggaagaaggttgtttccttgttacacgttgtcggtgtggtgcgtacggcccatagtactgatgggagttcctcgacccattttttgtcatgtgacatgagcctgtcgtagacgcgggttttgatcccttgtagtactatgccgtttgccctctcgacttgtccgttactttgagggtgagagaccgaggcgaagcatatcttgactcccagcccgatgcagtaatcctggaaatcagcgctgatgaactgggagccgttgtcggttatgatgcggtgaggtagtccgtatctgcaaaatatccccttgatgaatttgatggcgttgacagccttgatttcccccatgggtactgcttcgatccatttagtgaatttgtcgatcgccacgaattggaacctatagccgccctgtcctcgtgggaatggcccgagtatatctagcccccagcacgagaacggccaagtaagagggatagtctggagcgcttgcgcggatagccttgtgtgtttactgtggaattgacaggcttcacatcgctggaccatgtcgcatgcatatttaagggtggttggccaaaaaaacccttgtcgaaaagctttcccgaccaatgtccaaccggcggcgtgtgacccataaatgccttcatgtatatcaaggaggaggtgtctgccgttgtcggacgagatgcttttgagaagtaccctgtttggcgctttcttgtatagattgttgccgaccatacagtagatctttgctttacgggttattttctcggcctctgtatcgtcctcgggcaactcctcgctgttgatgaatttgatcagtgggaagcgccagtcgtctgtggtctcgatgtcggcaacggcgcgttctgcctttgtggccttcgagctaatatcgagggtgaccggactaacttcgccactaacctcttttactgatggcttcgtcaggatgtccagaaaagtgccgggctcgagcggttcttgtctggacgcacgtcgtgctaggtcatctagctcgatgttgtctttgcggtagacgtgtcggacttctatcccatcgaaccttttctctagcttcctgacttctacgagatacttggataactcggggttagagcatttataatctttgtgcacttggttcgcgactagctcggaggcccctttcacgattagtcgcttgaccccaagtgtggctgcagctcttatcctggcgagtagtccctcgtattcggctgtgttattggtcaccctgaagttgaggtggattacgtgcttgaattgatctctggagggagacgtcaagataaatcctgcccctgctccttagctgttgagtgcaccatcgaacgccattgtccacgtttcgttgtcgagttggttgtctgatttgttatcaggcatagtccaatcagctacgaagtcggcgagtacctgggatttgatggctgttcgtggcgcaaagtggacatcaaactggctcagctcgactatccatttcgcaatgcggccgacaacgtctttgtttctcacgacttcaccgagagggaaggaggagacaactgtgactctgtgggcttgaaagtagtggcgtagcttccttgatgtcatgatgaccgcgtaaagcagcttttggatttgtggatatcttgtctttgcgtcatggagagcttcgctgacgtaatagactggtcgttgtactttctctctctcgacaacgatgatggtgctaacggaatatggcgtggcggcaatatagaggaataattcttcattaggttggggggcaacaagtacaggggggtttgataggtagcgcttgagtgcaacgaatgcctcttcggcttcctgtgtccatacaaatttgtcttgcttctttagcagagctaagaaaggttgccctcgttctcccatcctagcgacgaatctgctcaatgctgccatgcatccgattagcttctgtacttccttgagtcttgtgggtgacttcatgttctcgattgccttgatcttctcgggatttgcttctattcctctgccagagacaaggaaaccgagcagcttgcccgacggtacttcgaacgtgcacttctctcgattgagcataaggtgatatcgtcggaggttgtcgaacgtttcccgcagatcgtcaatcaatgagtcgcatgtcttgattttgacaacgatgtcgtcgacgtatgcctcgacattgttgccgagctgatcgctaagtgcgccctggaccgtgcgctggaaggtattccctgcggttatcagttcgaacggcatcttaacatagcaaaataccccaaacggcgtgataaatgttgtcttctcttcgtcctcttttgccatgctgatttggtggtagccagagtaagcatcgagaaagctcaacagctcacagccggctgttgagtccactagttgatctattcgagcaagagggaagtgatccttggggcacgccttgtttgaggtcggtgaagtcgacgaacattctccattttccgttggccttccgcaccatgactggattggctagccactctggatgaagtacttctctgatgaagctagctttgagaagtttgtcaagctcttctcgtatggcttgttttcggtctggtgcaaatctccgtagtctttgctttactggcttggcatcgggtcgcaccatcagtttttactcaatcacctccctagggacccctggcatgtcggacggctgccaagcgaacacgtcagcattatcgcgaaggaaggtgatgagcgcgagttccaatttctcgcttagtatcgccccgatcttaacggtcttgtcgtggttggcactgtagagcggaacgatcttgattgcgccgtccggtttcagcgtcttgtttgtcttgctcactttcttgggtggctcagtcgtgtcgggtgggctgggcgtttgctcgaccatgtcgaggctccgtttgtcgcattgcaccgccagctttgtgttcccttgaatagtgattgttcccttcggtcccgacatcttgagcacttgatacgcgtagtgagatgcggccataaacttcgcaagtgcagttctcccgatgatggcgttgtaagctgtatcgaattcagcgacatcaaaggtgatctgctctgttttctttgcacccccaacctctgtcggcagttcagaacttcatcagataggactgtcaaaaatccccatcgtcagtgaattcggtgacgtatttccggaagaactacccggtatgccgcccaagcgggagatcgagttccggatagattttgctccaggaacaactcctatgtaaaagcggccctaccatatggccgcgaatgaactggccgaagtcaagaagcagttggaagagctgaaggaaaaggggtacatacggccgagcacttccccccagggtgctcccgtgatttttgtggaaaagaaggacaagacaaagaggatgtgtgttgactacagagccctcaatgaagtcactatcaaaaacaagtaccctcttccccggatcgatgatctgttcgatcagcttaaaggtgccactgtcttttctaaaatcgatcttcgctccggatatcaccaattgcgtatccgtgaagaagatatcccgaagaccgcattcaccacgcgttatggactgtatgaattcacggtgatgtcgttcggtctgaccaatgctcctgccttcttcatgaacttaatgaacaaagtgttcatggaatacttggataagtttgttgtggtcttcatcgacgacattctggtgtactcacaatcagaggaagaccatcagcagcatctccgtctagtgttgggaaagctgcgggaacatcaattgtatgccaagcttagaaagtgtgagttctgtttgtctgaagtcaaattcttagggcacgtgatatctgctaaaggagttgctgtggatcccaaaacagtgaccgccgtcactgattggaagcaacccaagacagttactcaggttcgcagctttttgggtttggcaggatactaccggaggttcatcgagaacttctccaaaatcgctcaacccatgacacagttgttgaagaaagaagaaaaatttgtgtggagcccgcaatgcgagaaggcgttccaaactctcaaagagaagctggtttcctcgccagttttaatcttaccggatactcgcaaggacttcctggtgtactgtgacgcttcgcgccaaggattggggcgcgtgctcatgcaggaaggtcatgtggtagcctatgcctcacgctagctacggccccatgaaggcaactaacctacccatgatttggagttagccgctgtggttcatgctctaaagatctggcggcactatctcattgggaatcgctgtgaaatatataccgatcataagagtttgaaatacatcttcactcagtcggatctgaatcttcggcagagaagatggttagaactcatcaaggattatgatgtgagaattcactatcatcctggcaaggccaacgtggtcgccgaccctctaagtcgaaaaagccattgcaacactcttggcgtccgtggcattccaccggaacttaatcaacagatggaagccctgaacctaagcatagttggtcgtggattcttggctacgctggaagccaagcctaccttgctcgatcaaatccgcgaggctcagaagaatgatccggatatgtatggactcctcaagaatatgaaacagggtaaagccgctggtttcacagaggatgaacacggaaccctatggaacggaaatagggtatgcgttccagacgactgggaacttaaacagttgatacttcaggaagctcacgaaagctcctattccatccatcctggcagcacgaagatatacttggacttgaaagagaaatattggtggattagtatgaagcgggaaattgcagagttcgtggccctttgtgatgtgtgccagcatgtcaaggcagagcaccaacgaccggccagacttctccaacctctccaagtaccagaatggaaatgggatgaaattgggatggatttcatcaccggacttccaaaaacccaaggcggatatgattctatatgggtagtcgtggaccgactaaccaaggtagctcggtttattcctgtgaagaccacctatggagggaacaaactagccgaactttacttcgctaggatcgtgagtctccatggcgttcctaagtaaattgtatctgatcggggaagccagttcacctctcatttctggaagaaactccaagaagagttgggtacccgattaaatttcagcaccgcgtatcacccacagacagatgggcagaccgagcgtctgaaccagatcctcgaagatatacttcgcgcatgtgtcctaaattttgggaagacctgggataagagtctcccctatgccgagttctcctacaataacagctaccaagccagcatacaaatggcaccctatgaagcgttgtatggccgcaaatgccagacaccgctattgtgggaccaagttggggaaagccaagtgttcgggaccgatatcctgagagaagctgaagttaaagtcagaaccattcaggagaatctaaaggtggcacagtctcggcagaaaagttatgcagacaaccgacgccgcaacctagaattcgcagtggacaattttgtgtaccttcgggtcacgccattgcgaggtgtacacaggttccagacgaaagggaagcttgcacctcggttcgtgggtcctttccgcatcattgctcgacgcggagaagttgcttaccagttggagctgcccgcctccttgggcaacgtgcatgatgtgttccatttgtcgcaactcaagaaatgtcttcgagtgccgtccgagcaggccgactcagagcagattgaagttcgcgaagacttgacctacgtagagagacctgtgaaaatcctggacaccatggagcgcaggaccaggaatcgggtaatccgtttttacaaggtccaatggagcaaccacgccgaggaagaagctacttgggagcgtgaagacgagctgaaggcagcccatcccgatctcttcgccagttcttctgaatctcggggtcgagattccgtttaagggggtaggtttgtcgcgtcccaaaaagaccctaaaatatatcctttaaattatgcctagaataattaaaatccgtgtgaaagcctccaaaaataaaaatgtgcaaagtaaaagaccaaataaggcttagaggatttttgtatatttcctaaaaggctaaaatgtgtaaataaattttagtggaattttcagagcacaaataataattgttaagaaataaacaaagttaaaaaggttttataaaaagaaaaaccctaaaaaaagtcccctccctctcttgggccggttcggcccatttccctccctctctcccttctctccccgcggcccatccagagtctccccgcgcgcgcgccgctgacgtgcgggcccgcccaccaccctcgctgacgggtggggcccacccgtcatccccgtcctcccgccgctcccgccgccccgcccgcgccaagcgccgccaccgccgccaaatccgccgcatcccgccgtccctgcgtgcattaaagtggggggaaatgtttcccccgattccctctccctttccccccaattttccctccctctctcccttggataagtttgaaaacccctcccctaatcctgccggcgccattgatggagcccgagaacgccgcgctggtttccttcccctccggccgccctctctcgccccggccctatttaaaccctccccgcgcttctaccgtccgtttccgcctctcgccacccttcctcctcgctggattcgagctcgcgacgtcgctctctctctccgccgtcgtcgccccggaccgcctcccacctcggcgccgcctccttcggcttcgccgcatccttgccgacctcgtccacctctccgtttcggtcgccgaccgccggagcgccgccgtccccgtcgacccgagccgcgccaccgcctccctccgctccggccgcctcctccgtagccgccgttgcctcggggtgagccgcggaccgccgcctcgtttcccccttcccttcccctctctcggccgcctctccgccgtgccatggccaccatcggcgaccataggggcgcgggtgcgccacctctcaccgaccgcgccctcaggtgcggctgacgcgtggggcccacggcgccggccggtgtgagcccgggtgcgcccggtccaccgtggaccgtgaggctgccgcgtgggccccactcccgtggacccggtccgcgcgcccctccccctcggctgacgcaataaatcccttttaaattaaaatttaaatgaagaaattcgtaaatattcatttaaagagcatttaaacttcaaatggccataacttgaccatttgaactcggaattggaccattcaagtctctaatttttccttaagaaatcaagaacccatttttgtgctttattcctgcttgttatgtggagtttattagcgtaaaagcccttttcttttccgttggtcgtgtagacgctgcagcttcgaaagatccgctctacgtggaggttgaagccgacgtttgggaaagccagcaaggcaagtcacatcatccttgaatatattgaatcccagtttataaaattattttgatttaaattaatgcattatcgctttatttaaattcccgcgttatcactgttttatttagccatgcctatttacctttgttatgaccttattattgctattgttattattaccttgttcaccctagaataaataaaaccccaactagtgtatactctattcatggcaccactagtatgaatttaggtagatgcttcgttggttaattaggcaacattaggtggttttacaactctagactttgggaatattcatatcacctggacactatggaatggttggattatggtggaattggattcacacctccccctctattcaaaatcctcaaaatggttttaggctgggctcggggtgcatggttttgatagtagcacctcggccacataaggaccggtcttcgggcctctattgcaaagcactaccgtacttccacatgtctagtgggtaaggcttagtttgaggctcagtctggttataaacaaaagtacacagatggagatggacgaagtcgggggtcgatggacatctctagggcaaatgaaggctacacgagctgcggctcggtagtcgagatgtcatggcacagggctggtgtcctgctgctaggggctcagtcctgcctacctgtcccagaggttccggccgtaggtggggttgggttggtactcttgtctatggctaggatgggttggaaactatgtcacgtcttccgtccatataccgtggtggtatgtggcatgtggttacacgtgaggaagatgtgtcttgtgggtaaagatgtacacctctgatcagagtataacctattcgaatagccgcgccctcggttttgagcaagccgagcaatgtacccaagttagtgttttaattcttaaaatctgcttaacaactaaaatgtggaatggttggcctgggttggcttgggacgagctgggacctagggtcaggttgccaattcggtctaaatcatcgtaggccttgggttaaggcaggttcgtgtgggttcacggccttgattaataatcttgtatagctctaggatcgtatttacaaaatagctttgagcaactaagtgtcttttaatgctgtttactgcaaaccctaaccccttatattataactcccttgtactcccttgcatttattctgcacttgtgggtgtgtcttgttgagtacggtggttgtactcagtcttgctcaattttttccaaacccagaagaggagttcctagaagatgaaggctttggtgtctagctcgtgcctgctgtcaagcgcctgtggtcgtcgccctagtcttccgctgttttttatttgtcttcctgtgtgctaggccttcgccgcccatgtaataaattaactatttacgcttccgcttgataaactttgaaatatatcaacttttggtgtaccttgcctcctgggacaaggaataatacacgcacataaggaacgcccgttgggttatttccggtcatgacaaacagacttcgcgttccactttcttgtactctcgcttagaggagtacgttgtggaacctccgaagatgtgtaaaacgtggaggtcagagtctggatatgctaaatccgattcctggggagccgcctccgcatccttttcgaccacgcatactcgtttgcctttttcagatgcaatgtgcttctcgagcgatttttttgaaaacaaggcaatcttccagacagtgtctgtccgtcttgtgtatggggcaccatgctttctttgtgtcaccactttgtgggtctgggcgcttgggagggttcgcgtattctgctgcgaggacttccgcttgagatttccttttcccagttttgcgatttttcttcttgcttgactcaggtgcgtccgtggctggtttcttctctcccccggtcttcggcttatcattcttgcatcttagcgcatcatctgcgtgggcgcatcgctcaacaatctcgaacaatcatcgagtggttgtgatgcgtcttgtcgccaactcctaggtagtatagcaatctctgacaccggatttgaaggcgtgaattacagaagcgtcggtgatttcggggattgtatttctgcactcgttgaagcgccgaacatattccctcaaggattcacccgagttctgtgtcaacgcgtgtaggtcgtcttcgatcgcgtggcgcttgtaggttccttggaagttggcgacgaactgttgccacaggtctgcccacgaagagattgagtagggcagaagatgcatcagccatgaacgtgcagagccttttaacgcagttggcaaataattcgccaatgcgttgtcgtctgctccggcagcgtagagtactgtgaagtagacttgaaggaactcttctgagtcggtgctcccatcgtacttttctattgctccgggtcggaatctctcaggccatcagacatcacgcagggaacgactgaaagccctacacccagcgctggggcggtgggttgccggcgattgtgtgtccttcgtggatgtctgtctgatgatgaggaagccgaggatgatgacgatgacgatgggtcgcttggttccggcgtacgatcacgaggatgtcggcctggatctcgagaatcctgtcgtcgtctcccgctgttgtcccggcgccagtctccatcatcgtcgtcgttatggcgacgtcctcaaccagtatcgtctggcacccgccgttcgcgatcgttgtgatcgtggcggttgtggcggttatcacggcctcggtcttcgtttgagcggtctcctcgatcttcgtcattatggcgccgtgaagagacatgacgccgggaacgattttcattgtctcgtgtgcgtcgtgcctctcggcggccgttgacgtgatctcggagatcgctagtgccgcaaggtggaggggtggctcaatgaggcgattccctccattcaggctcttcaccattggcatcgccagttggtggctgctccgggtgcgctgcggcggcggcctcttcgaacgtgttgctgaggttagtcactgattcccgtagtcgtgctgtccaacgagcgagatcgtcgttcagaacaggatcgtagggggtttccctcagtatagcgttgacggctctgatgtgctgggccggggtggccaattgattctctgcttctgcattggtgcgcgctgatgtgccgacatcatcgatagccaatacctcccgcagtgcgctcgttgtcgatgatccatagtcttcgagaaggtgcaagactgatggttcgtgaggatcgatatcgattaccccaacaaatcgatctgaagttggcgtcgctcctcgttccttgtctttatccctgatggggatgtgtgactgttggaccttaggaggtggcgctttcatggcgctgagaaggaccttgcagcttgagaggtcgtgattctttgtcttgtgaataggacaatagacatcacgagttggagaaatacgctgaattccacgctctttgcagatacgaatttcagcgcggacgttgaggaaaacccagcaggtttgcaaagtgtgtttgctggttttgtggataggacaccaggaccttgttgcttcggaagtcatcttcgtcggctcgcggttcatgtcggaacgacaaggtttggccgcattagaatccttctcgagctcggatgtcgtcgatattccgttcttcgcctcggtgggagtatctttcgacatggagtcgtctcggtttgtagccactgcgttctcgtttccagtcattagtggacaggttgagatcggcattgtggtgtaaaccgggaagacgatttcgccgacttgagtccacactagcatcgttgaagcagggaatacttggctgaggttggtgttgacgctgttgttgacgaggctggatgacatagtagtagaaccttgagtaccaagtgcccctacctggcatgccactgtcgacgggtgatacccgtaaaccggatatagagggtattggggtacgttggtacaaggatctacgtaatacgacatcaagcagacaaaagacaaagattatactggttcaggcccctttataggtaatagccctaatccagttgatgtgggattatatgatggaaaacacaggttacaaagggaacagtggaacttgacgaatccggcgagatcgtggtcgagttggctcgactacgatccctggcgatttggctccttgcaggctccgacttcgtaggctgtgtgggttgtgttggctctgagattcaatgccttaggtcctcccggggggtcccttttatatcacaggttaggcggtttccaagtagaactcggaaacatcaaaccttacccgatacattgatgacccagtcttgtccgagtaggactctttccatttgtaaactccgtgaggggtttccttaatatacgcggagagtatccgtctacgtgtgggtatactacatcggtatgcgacgtacgtcaaagggtaaagggtatacctaacccgtaaccctgacacatttaggaccgatctatcggctagatatgtttaattcttgaaagccgatatgttttatacaacgtttcatcggagtttaattctagccaatgagtcattttttatagtcttgaaaagtatggcaccgtcttatgttcacatcggtaaaatcagtaactaggccctgtttgtttcagcttaagattattgtaatctagattattaaatcagattactctaagctgaattataataagctgacatagaataagctgcgagttgtttgtttctctggattattagaggcattaagggtagtgggtctttagccactcaataatctggaaaaagctcattcagaggagattattagattatactaatctggcttatagattatgataatctagcatgataatctatttgtttgtttcagcttactcctaataatccagattataataatcctaagttgaatcaaacagggtctaagtcatcctttgttagtttcaatggtttggtcccagttttgtgaaggtaacttagctttggaaagtttaaatagatctttcattactcttgttcccaaaaaatcaacacctgagagggttaatgaatacagaccgatttctctccaaagtgtggctctcaagcttttaacaaaggttcttgctgataggcttcagtctgtaattacagaactcatccatcaaaaccaatatggtttcatcaaagccaggacaatacaggattgtctctcttggtcttttgagtacttacacaagtgccaacaatcaaaaagggagatagtgctgttgaagttggactttgagaaagctttttatactatagagcactctactattttggacatcatgagacaaaaaggttttgattcaaagtggttgaattggattgatttgatcttttcttcagcatcttcttcagttcttctaaatggggttcttggaaggaatttttattgcaaaaggggtgtaaggcaaggggatccattatcacctcttttatttgtgctaggtgctgatttactacagtctgttgtcaacaaagcttattctcagggtgttttgactattccaatcccaactcctgataatggctttccagttgtacagtatgcagacgatactctccttttcttgacagcttcctcaaaagagcttttctgtttgaaggttattctcaactcttatgcagattctaccggtttgaagattaactacagtaagtcatggatgattcctctgaatgtggatatagaaaaggtgcagcatttgtccaagatgtttggttgctcagtgggcactttacccttcacctatttaggtctgcctttgggaacaactaggccaaagataattgattttgcccccttagttgatagggttgagagaagattgtctgctacttctgctcttctgtcttatggagatagattaactatggtcaattcagttttatcttccctcccaacttactatatgtgctctctttcccttccaaagtcaataattgaaaacattgatagagctagaagaaattgtttatggagaggaactgatattaattctagcaggaaatctttggttctttgggaaagggtttgtcaacctaaaagtagaggaggtctaggagtcattaacctgaggctgcataataatgctcttttaatgaaaaatatgcacaaattttataataggctctcaataccttgggttagcttgatctggtccacttattatattaataaagttcctcatgctgatcgccctagagggtctttttggtggaaagatgttctacaatttgcagacatttttaggggattgtccacctgtaaggttggggatggaaagacttgtctgttttgggatgatttctggaataataaagtcaggtcagtaatgtacccaaggattcactcttatgctgtttctttgaaggattcagtgagtttaacctcttccaagagtatttcgcagcgttttaatctccctctgtctgagcaagccttccatgagtatgatacaatgtctgcagctgatcctttagatcaattatctgatgagaatgatgtctggtcttatgtttggggaaatggtttgttctcttccaagaaaatatatgacattaatttcatgcatatacatgcgcctagttatctagcttggatctggaagagtaagtgtgctatgaaggttaaagtttttggatggctcctgttaattgatcgactcaatacttatgacatgcttaacagaaggcattgccctcccaataattcggatctaacttgtgtcctttgctccacctgtgcaagagaaaccacctttcatctatttttttaatgtccttttagtgctgattgctggacatagtttggaattgtctgggatatttctcttgccttcatagatatgctgcatcagacaatgaattcttataagtctacgcactttatggtgaaaattcttttatgcagcctggaatatttggaaacagaggaactccctgattttctagaatttagcaccctcaatttcttcttggaaagctctctttaagagtgatctttcccttttagtttttagactaaatgtttctgagagatagtcccttttgaattggttatatcttttgtaatttattttctataataaagctatttaactgtgggggcttcccctacagtgccttccaaaaaaaaatggtttggtcccaactatcaaggttgttttaaataaagagttattcatgattggttatgttcagtttccgtaccagtcgatggctatgcattttagttacgttatttgattaattcactattccattggtcaagtagccaatgaccctaactctatcggtatttgattatttaagttatttgattaattcactgttctatgtattttcgttagttacatgataactaagtggcacactctaaatccgattgataggacctgcagtataactgtacgagagctaagcaaatgtctcgtgccttcgtgtgttagttgtagggtaaaactacactttcacatatacactctggcttctatcggtttatccgtggcgggattaggcacacatcgacaccgctgtaaatcgaaaattagttaggacgcctcaaatctggcctaatactagcttgtcactgcatttggtgctgatgccctaccggtagctgcctaaatcgttcacgtgctcggtgaaatcaaaagccccgctatggatagattccgagacgcggatccggacggccaccattgacgccgatacccattgaaatccccaggtcatcgcctccgtgacagcgtggacgccaccgatgctggagttggacgatgtcaatgcccaacatcggcatgctcttcttgctccccaatagttatgtattccatatccaacgaaacaagcttctagcggcaccaataacgaattcaggacactgcagactctgatcgatccattgggaagacgaatttatgtatgcgctcacgaaaaggggagggatgatggggaattacagcgaggcactaggtgagtaggtggtgccactgagtggagtcagtggcgaatcgtggcgctgagatggaacaggaaaaatgttagccccatcgtacctatgccttgcctaatcaactgttagattttttttttacctcttggtagctagcaattggtggtatatccttatgaatggtaaaaagctatgaaaaaaatcgctcgctcagatctgagcatctcgctccacggagtatctgttagaaaattagccccgaaatcaccattgaaaccaaacaagaaaaaaacattatagaaaatccaaacacgttaatgataccgaggaatgatatttaataacgaggttaaattataaactgatccccaggacagtaattgagaggaagagcatttcacttagctttataactgctagatttagttcatgctaaatgacgattttacctctcaatgccttttttttttttttttgacagttacatctctttacgtttctactactgtcaactaagatggcagtagaaatagatggtagcatcatagcagaaagtaaacagatgaaatggagggaatagaaatgatggatccaaagttacttctaattagatgagtaggacttgttacttacttggtgatcccctcgaacaccatcccaaaggatccacgtcccaggaagctcccccgactccaggaccggaccttcctcctcctcctcccaacatcattactcccgttcgtcgggatgtagaacatggactcggtggtcgtcctcctcgtcgtctcatcatccgtcgactccgacagcgaagaccagcacgtgaagaactcaccggacagcaacaccgccaccgcctcctcctcctcctcctcgtcggccgccggaggaaatacggccatcgacggtgcagcagcagcagctagatgctgctgatctggggaggcgatttccacgtccacgcttggcgtggtctcctcctccgggaggtggggaacagcggccacggacatggccagctgcagcagggcagccatgttttgactgacggggagagagtcctgaagggggttgtgtaggaagcagagctggacggacgcggagttggatatctgccaatgttgactgactgatatagatgactagcgatgaaagccttgattggatatctggcttgggacgcgtgaactcagaaaatacttttcctctactgtgcatgcgtttccataaaaagaatatatcgacccactacagcaattatttactacaaaacttacacatcgtttatttttgagctgttggattgtcctgcaggtctcagaatcgttggggtcggcatttgggccagccttctcattcgccaagttccccaccactgggttgtaaattttggaaattttggacatttcggtgggttccgattgtaagtgaggtccggtcaaatatttcggccaaaaaaaagtttgacgtgattttctcccttaactctaaatcgccgttctcttccccctccgtctcccctcattgcgccgcaccgcatccagatcgaaaaaaaatcgccatctcgccaagtcgccagtcgccgcctcgatgtcggtcgccgccctgacgcagcccaccgccggcgcccctagccatcgcctgcagccgccctagctgtcgcccgtagctgccccaaccggtgcccccagccgtcgcccctagccaccctagccgtcggcccgtcgcccgctgctcgatgcccctagctgtcgcccgctgctacggggcgctggcgcgccgctgagcgcgggtggcggtgtgccaaattaccacgctccgggtgatggtggctgcgctctggattcaaggacggacaaaaacaatctgaattacaaaattcaatacaatgataagttgggattctgaagacaaatagacgggcggtctagccgacatgcttgcatcatctaagcgaacacccatatatgatgcaaggacaaaggacaatatactcaaaaacaaggacggcgcttcttctattcataattcaagaatacctaacaactaacctcgccatcacagctagtgtaatccatcgtctcatgtattcgcatcgccttgagatggccgatattattatatcgcccttagttgtttttaaactgtaatcggttgtattttgccgatgtacaatggccgatattggtatatcgctcttagttcaattttttaattttatcaatgcctttgtcattgcaaaagtagggggcacatatattcacaagttgcaaatttggaaaatttttaagcaaaaagcatggagttatattaatcggcacaaggtttgtcaagactagttacagaatcatcttagccgattacaaaatgtgctaagccttattacagaatgtcactgagacaagtatcgttggatagccgatatagctctttgcctaatttgttctacttcttcgatggcttgggcatcttgagcatcggttccagggatgacttttagggacttggtcatatccgcgacattcttgatagccgattttagtcttgccttctgttcttcgacagcttgtgggagatcggctagctttttatgttccatgtccagctcggtgttgcattcttgaagttgtgccaagagttcaatcttgcgagcttcaagtcgatcaatattggatttgatcgggccctcagataactgatcaagcttggccttttcttcatgaacaagctgccgattagcctggattgtggcctcgatgtctttgcgctcccgacgctcggctagtctcagcttggccttctccagcttgaattgttgttgcttaagatagacagctggagtaaggacatcggctagctcatctgggatcagagcttgaacctcatgaagccgagtcctgataggcccacagtctaccaccaaactgtctagtgatgatgcttccatccgatgagagatatcatcaagagttctcttcacatcatcggataagggggctaaggctttgcttgtggtatcttcttttgtctcatcgaagtagtccttgatgtcaaaagagaatagatcggctaacacctgcaagaacaatttcaaggaagttgagagctaaatagtgttaacaaccaaatttggtaatatcagcatcggagaggaagatgggatcgaagcggaatcaaagataaggattgtcgtggaaacagagtaagaatcggctggagtccggatcagctacgattaagatcggctaagtcttggtcagactaggttaagtgattcagccgattccgacaatacgacttgtgtacgacatcgggttcaagttaatgtgcttcaagatgattgtcacaaacggatagagtcctgggaaggcaattgtatctattaattaggatattttatgtaaattccttatagataaatgtgggcaaaagtctgccgcaaagacttatggtatcttagagtttgttagagataatagtcatgtctagtatgggcatatcttgtaattctcgggtataaatagaccccgagccctatgtaacttttaacacacacgttcaatacaatttcggcgcattgccacccttttgctttagttttgtttcgacgagttcttgctttcgggttgagctgcatcggtttcgatcttcaacaaaaggtaaaacttgttatgacggcttatattcttgggattagtgcttccatctttatgatgctctaatcttttttatgtaattcgtcgagttatcatatatcttatataatctctaacaatatcgtcatctaacctacaatccgctaacatctgctaatagagggcagccgattaggttaaatatcgatgttggtttagattatatgagatatccaccactctatgaaacttccagcggcttgattgtctagatattgttcttcttttcatacttaatgctgcatcagttgagtttgatctattcagtcgtgtttagaatatcaatctctagcctgccttcttgttgccgattagggtagcatcagagtttcagccgatcttatttgatttaactatattttctctatatgcttcattgacatgttaaatctaccctttatatcaagatctggtcgcatctaagtatattaggcttctgcttgagtattttacttgctttaatatcttaatataaagtagtatcggagcaacttaaattatcagtatcagcctccatctccacaagcccaatattagccagggaggacaacccaacctcagtttgcttctcagtacagtcagttcgagcctatgcaacagcagcctcaaggagcagttcagcaacgaccgtgggccgacgtgatttccgacgtaatgagggaacagttcggcctcaaaccaaaagagactaggagcttgtatcggcagccctaccctgagtggtttgagagagttcctcttcccaatcgatttaaagttctggacttctccaaattttcgggacaggatggtgtgtcgacttatgagcatattagccgattcctagctcagtgcggtgaagcatcggctgtagacgctctaaaggttaggttattcaggttatctttatctggatcgtcttttggttttcctctttgccatatgggtcgatcaatagttgggccgatttggagaagcaattccatagctacttttacattgggattcatgagatgaagttatctgacttgacagcgattaagcagcggtatgatgaacccgtgcacgagtatattcaaaggtttagggagatgaggaacaaatgctttagcttgagtttaactgatgctcagttagccgatttggccttccaaggtatgattgctccaatcagggagaaattctcgtctgaagactttgatagcttatcacatctgatacagaaggtaaccttgcatgagtataggtaggcagaagtcaggaaaagctctaagaaggttaatcatgtttgtccatacatgtatgggtcggatgatgagaaagacgattctgaaatagctgcagccgaatgggtgaggagtaaaaaggtcatatcatgccaatgggtaaaaagtcctagaaaagagaagaagtatgacttcaatattaccaaagctgacaagatctttgatctactactccgagagaagcaaattcaacttcctgctggccatataatcccatcggctgaggaattaggcaaaaagagatattgcaaatggcataattctggatctcattccactaatgattgcaaggtttttagacagcaaattcaggttgccattgaggggggaaagattaggtttgatgattccaaaaagccgatgaaagtcgatgataatccttttcctgttaatatggtgcatacggctggtcaaatagccgatagggtccgtgcaaagggttttcaagtaaattcggctaagattatcaacaaatatcaaaggaaatatgacaagcagcaggagaagcattatgaagaatacgatgatggttttgatcctcattggggttgtgagttctttagattatgctggaatgaagggatgaggttatgtcacgcccagaaattcactagtaatttccgaacttatttgtgcataaaatcctcgtccaggaatcagccgaggtacacaaactgacaatttaatatactgattcatcaaattaactaaaacgataaatacttacttaataggcccttagtcctcaccatgaagaaaactgcagcgaaaaataaaatctagcgaagctccggctccactcccacaggcagctcaactggggtatatgccaaacgtcttctccttcgcaacttgtcttcaactgaggtttgattgattattgcaaggtgagcatatgacatactcagcaagctacacagcaaatatgcaagtgcataggataccaaaggatggcataatatagggctcatttgcaaaagcagtatttagcaaacatttaagaattgcaaaacagtagagtaattaatcatcaatattaatcaacactgaacagcacacccatgctgatcaggcccaaccatcctgaacaaccatacccggctgcacagatctatctccaaaccaggaatgtaccattccaaaccaggagctaaattaattaccatcaattatcacattattattaatgagtagtgtgggactaatcacgaaagacattgttagacccgcccataaccgcgggcacggctattcgaatagttttactctggccagaggtgtaccactgtacccacaagacacagccctacaacatgtcaccatgcgcctcaataccaccacggtaccacggaaaggagctgtaacagtactcatcgcacaacacaatccaccacagcgcactgttcctggatcataatcacccccttataaacaaggcatggactccccagcgacccccgtgggcttaactctgccacttctcagtctggtgctccacaatgaaccatgctatacaaaaggtaaagccgttgcctatgctggcttgtggttggcacggttaatgtttcacaaccgaaactcgtgaaccggtccttaattgtcatgaacacgaccatcaaaaccatgtgctcacaacccaccattatcaagttttagttggcacattaattaattcacaatcacgattgaccatcgtgagctacaattaaatatccatcattaagtaatagtgaagcattagttatcccaatagtgtgctaatgtttctaagcatggctaagcaattatgtctaacatctagctgaactaatatataaatccaactagtcaaattataaccccgaggtaatcaagaaatagggtaatcaatgcaaattggccataacaaaggaataagttcacaccacccggtgacattcaaaaataaatgcacagttaaaataaatagagaatttaaatataagatcaacatgctcaaaggaattgtgtttgggatctgtgtgacttgccttgcaataatcggtcttcaattaatcttcttgaatacttccgacgcacacgcgaaccatcgaaataacggaaacgacaagctaacatgcaaaacgaggaaaaagactaataaaaaccaaataaacagtacataaaagtaaacaaacatgtgtcatgattttagatgaatttagagacttgaacgacctcattccgatttcatatgaattaattacaaattttacaagattaaattccaattaaacctattgaagaaaagactattccaaattaattaaacaatttacaaatgatttataactgagataaaagattaaaacaacctccggaaaagattagattatatttggtagatgacatatattaaaaataaataatatgccactgaaaagagagaacggatttatatcaattttggacggctaagattaatcttgaccgagagttgaccaagatcggatggcttagattgatctggcaagcgagcctcacgagatatcgactcaacgaatcaattctacgtgacacgggatcacccaaatgttcaaccgaaaccggcgaacgaaactggcggctctgaacggctctaaactaatggacaactcaacacgggcgaacgaacgaaacacagggaacacctcgttcgaacgaacgagcgaacgactcaaccacggctacggctaaaccggtggactaggaacgattcacggtaaagccccggtactgcaaatgataggctggtaggaacctagggatgcacctacggctagacaacttggctaccgagcaacagctaaagcggcggctaggttaaagcggcacacagctgcgacacggtggcactagggcaacttggtttggctaggcggctagcacaacggcggcgacaagcaacaacggcacaaccggtagcgacgatgcacagggcagccggcaagtgacgcggcagcggctgcgttagggttagagcaacagcggcgacatgaccgagggattgaaacctaacccgaggggtcacggatagaagtctcaccgaaccaaagcggtcggagagagatagatgacgacggtgaaccggcggcaacacatggagatgacggcaatgctagatagacaacggattagattgaattaagaccctagggaaaaactcacaggtgaacggcatgggagcggcggttgccggcgaaccacggcacagtaacgcaaacggagggcaccgggagcgagaggggatcaaagtgacccttaccaccacttacgcgacgacgaacggcaacggaagatggccggcgacgagcttcgaagggcggcgaggtactgtccacggaggcgacgactttccggcgatgtgcggcgacaacggaggggtggccgggcttcacttcgcagccgcgaatccaatgcaggcagcggcgaaccttggcgatgacgggaggagcagcagggcttcgccggagatcaaaacgcgacggcgagcttcgggttgacggcgacgatggagctccggtggatttcggcttcggggagatggctgccgggctccctctccttcttgcgaacccaacggcggcagcggcgaccaaaagcggcagctaaggcggctgctagctgcggctggagatcggaacatgacggcaacccactggttcatggcgaggactgcctccggcgaggtttcggcacaaggggaacggcggccggggtggagctcgaccttgcggagccgatggaggtggcggcgcaggaagcaggcagatgaggcggcggctagggacggttggagcggcgccggcgcttggagagagaaggagagcacggggagagcgtttccggcgacggcggcggacggaacttgaagggatagggagaggacgactagggggtcctttatataggcacgggagctcgggtccaggcccaaatcgacgagaaaaaaatcgggaaagtctaggttctcgccggaaaaaggaaggatttgatccgcgaaattggaaagaatttccatagaaaattttggggatttcttggggaaaaggaagaggagattgaggggattccattcccgcaactaatttggaaagaggagcaacggggaggacggattggtgggagggggcggcggcactgtgcacgagcacggctggctcggctctgtctggaagaggaagatggagtactgtagcgcgagggaggtaaatcagactttgtctgggctgagaggaagggagagaatgggctgaattcggcccaagctgaggaggaggatttttattacttttccaaataaattaaccaatgagatgatctttcaattgttaaaaatactttcaatgctcaaataattccaagaaaaatcttgaacatacttggacactcaaagtatttaaaaatattaaaaccataccatttcatgattaatttattaattaaataattactgaaatattctttgtattattaaaattaggaattgagctctgaaaaatccgagaaaattctagagagtataattaatcatggagaatttaataaaaattaaatccatccatgctttatatttaggaaattttatttcccacatttaacttcacttgtaaattaatgaacatttaatataaattctattaataatttattaaatgatttataaatcctgaaacgaaaatcaggctgtgacacccaatttcgggttgcggcctcctctgctgcttcacttcgtagacttgtgaattttggcctgattcatcgtgtcaagtctgcgttcttggcccatctatacacaagtctggttctcgacatcgtccgattaatttatcgtctatgttgatgtcaattcttctccactttattgtcattctctgcaaaaggttagtagacctaatactagtggaatattattgttctaacatatttatgcattgcaagcatcactagttctctcctgttttagtaatattgacggtcagaactgatcgataacaaccgtcaacattgatgtacttcacgtggattgccacacacagattgagtcctaagaaggtaattgtatctattaattagggtattttatgtaatgtctttagagataagtgtgggcaaaaatctgccgcaaagacttatggtatattagagtttgttagagataatagtcgtgtccgacatggatatatcttgtaattctcgagtataaatagacccgagccccatgtaatcaaatcaacacacgttcaatacaatctcggtgcatcgccacccttttactttcgttttgtttcaacgagttcttgctttcgagttgagctgcatcggtttcgatcttcaactagagttaaaacttgttatggcggcttgcgttctttggattagtgcttccatcttcatgatactctaatcttaattatgtaattcgtcgagatatcatatattctatacaatccctgacaatattgctatttaaccttcaatcggctaacgtctatcactggaaggcagccgattaggttaagtaacaacattggcttagattatatagaatatccactactctatgaaacatcaagcggcttgattgtctagatattattcttcttttcatacttatagttgcatcaattgagtttgaccttataagtcatgtttagaatcttaatccctagcctgctttctggttgccgattagggtagcatcggggtttcagccgatcttacctgatttaactactttatgtgttatatgcttgattgacatgttaaatccgccctttacattaagatcttgttgtaattagatacgttaggcttctgtttgacgtattttacttgctttaatatcttaatatagagtgatatcggagtattagccgatacatgctagatctatctgatcggctatgctataaacttatataatccagttgttaatatatatttcgatctaagtgatttatactgtctcggcatggcgaccgatctatcctaatcacttgatttcagtatatatcgacataaggattatatattgctaatatctacagccgatcgagtagatttaattctttattatttatttacgaccgccgatcaatatatatatgacatcggctcaaagataaatgatatgtcatcggcaattagccgatcggttgtcatttatggatttaaccgcggtttctatctttctttcttgttgattgcaggatcaaatcaactggcacgctcacgaacctaaaggcaagcttttggacatgcactggagttaagcagatctctcaggcctggtgtttttacatcaacaccggtaagttggataccatgttttattttattatatgcaggtattgatggtcaaatgttatgatttaagaaccgtcaacatacccatttcccaatcattgatgtaactgtaatgtttatttggtttttgttagtgtttttcctcgttttgtgctctaggttcagtttttagtcatttggaaggattgttagttcgttggaggagttcctgaagacgatttgaagacgcttgtttgcgaggcaagtcacacagatcccaaacacaattcctttgagcatgttgaacctatatttaaattctctatttatttaaaatgtgcatttatttcgaatgtcattgggtggtgtgagccttttccctgtattatggccgaaaattattttattttcctatggtttataatttgactagcttggactttatatattggttcagctagatattaaatatcattgcttagctatgctgaaaaacattagcacacttttgggataactaatgcttcacttatatatcattgatgattatttaaaggtagctaacaatggctaatcgtgattggttaattaattaccaactaaaacctgataatggtgggttgtgagtacatggttttgatagtcgtgctcatgacaattaaggaccggttcgcgagctactgttgtgaaacattaaccgtaccaaccacaagccagcgtgggcaacgactttaccttttgtatagtgtggttcattgtggggcactggactgtgaagtggcggagataagcccataggggtcgctggagaaagcataccataagggggtgattatgatccaggaaaggtgcactactgtgaattgcgttatacggagggtactgtcacagtcccgtttcgaggtaccatggtggtactaagggcatggtgacatgttgtggggctgtgtcttgtgggtatcgtggtacacctctggccagagtaaaactatttatatactcgtgtccgcggttatgggtgggtctaacaatgttttggtgattaatcccacactactcattaatggtaataatgtgataattgatggtaattaatttaactcctggtttggaatgtttaattcctggtttggaggtttgatctgtacgaccagggttggttgttcaggtttggttggacctatgcaacgggtatgttgtatattgttggattaatactgtttaattgatttctctactgttttacatattttcaactctttgctaaatgctgctttcgcaaataagccctatattacgccattcttttggtatccctgtgtacttgcatatttcctgtctggcttatggagtattccatgtactcaccttgtaataaacaccaaatctcagttgaagaaaaatgatcaagaaggagaagaactttggcttagattctagttgagctgcatgtgggagtaaagttgaagcttcgatagattttgttttccgctccagttttcttcgtggtgaggactaagtgcctcttatgaaagtatttttcgctttagttattttaaagaatctatatataaaattatcaatttgtgtacatcggctgatttctggacgagggttttaatgcacaaattagttcggaaattacttgaatttctgggtgtgacaatatcaatgcagcgactgcagtgggaccagagatgattaaacatcatagagaattacctgcccaacaacataaatggcaatgcacttcggacggtgccatctttatttactaattaccaacgtacacatagagtatacgcataagaattgctacctgcatcacaaaataaatttcattctatacatgagtctggatatagaccatgtccagatttatgtacaaaagtgaacttattttaagatggagatagaattacataagcattgtgtaagcacatagtttgctgcattgttgatagctcagttctaaagggtgacaggattcacaaacagattcccaacatttccctgatgatacttcgaaaatgtatatgcatctttcttcttatcgtaaaagaatggcactgctacggccaaattcataactcgttgcaccacatggaactgcttttgatgatcacaacgaacctgattcagggttctccattcactttcaatcattgattcgatcttgtctaaggcaacttcgcttgtaaccttgtgctcattgatatagcactctactgtgtttgcggcatctcctttgttctttcttccagactgcatgagtgtgaaaaaaatatatgttacttcctctattttacaatatataattaggttttcttgacaatttttgtttcaatattatatgctgtaggaaatagctagttatatacatataacatttcagctctccactaataatttagtaatgtaaagtgattaagtagctggaccacattcagcatccaattccagactgcatacacatttaggctgtgttccataaactatgttgggaacttctcccagtgtacgtaaaacaggggacttattagcgcgcaattaattaacttttagttattaaaaacttgaaaaaattaatatgatttttaaagcaactttttatagattttttaataaaaaaagcacaactcaacagttcacgaaacttgagcatggaaaataagagagtagaagttaggaatcgtagttccgaacacagccttacatatttaaatacaataaattagggaagtacatggaattagtactctcaattttttttccaaaacagtaaaattgaattactgcatctataccttgaatgcagcaatgtcgttcatgaaacgcataatctttgcacaagctataacggcacttgaacgtactgttgtcaattcaaatgattccttcgttactgcatcaccctggccaactgcagcagtcacacagagtagtggaacagtactggacagggttgacaaagcaacccgctccttaaatgctggcttgtaattttgatgcaaccattcaaattcttgcaggtaatacgtggatagattttggaactgcacccatgcaaatcaaattagccaaaaaaaactagttagctacatcattataattattttaccgcactactaccatactcatcaaacaaagacatactccacccggttccaataattatcattttaggcaagttatacatagttaaaggttaacttcgtcgagttatttatgggtgagtggacagtgtctcccccctcctccacttgactatccttgtgcgctgccgtttgctttcgaggtcaaccaactgtaaggagagcatgtgccggccacccccttcccctcatcctcggcagtcaccacccaccggctacccgatcgagctagccagctagccatctttggaggtgagcgttgtttcaatgtatccacgctaatgtcaggttgatgcatctattttactttaaactaaccagtttgcttgtagccaaagccagtctattgtgaaatgctaagatgggatccttgtctgtaattttctttcgaatgctttttgtctactgtattaagtaaggtgcttgaatgctgagaggttgtgacttcatagtttcctattgtagaaaaaagccatggccttcccttggtttcttctaatattgttatgattaaaaaacaacatatttagatcgatgtatacacttaaagtctctagctagttcattattttgcgtgtatcttcagtccctgtccatcttgttaaggatatgtagttcgtgtgtcagtgaaggatatatattttgtgcaaagcccgctggaatacgattagattaagtataagctatgggttaattgtgcttcctgctagctagattgatatggcagataattccatttaagctattgggctaaataatatatgaatttcataaatagtatagaacattaaagcatgataatagcagccatatgattaatcagttatttatatccttggaattcttagactgacagttacttacatgtattcaatattatgctgtttgtagtatcctcagtaaccacaactttttaagcatatagcaggatcttattgaccagcttacaatattgtgtgtctcctatacgttgatatatttttaccataatctgtagtattctcaaggcaagtaaagaggagaaaatagatagagataaaaatgcatcgaaaagggataagatatctgcattcattgtctcatctagcttggaatattgctgccggaggacatgtagtaccataacttgtaacttatagtggtgaataaaagattcttgttgatgtgaattggcatgtacgtgtattggttatataacttacaggattgaagtttgcttaaaatttgatgctgaattgttgtgcatgcctatctgtagctttatcacttatgtatcagtaaaaaaaaaagagttcatttgcatattttgttgaaaaagttatgttcaataatccatatggatatgtggattgaattgttgggggggggggggggcgggaggttttcttgaacccattttattttatggtgccacatgatcttttttcctgacggcagcacgtcacaatttaggcgacaaaacccgatgccaatggaagttttctgtgttaaacacatagggaaacccataggaaaatataatttctccgttgtgatttttctatcggcaattcttgtcggttccctcaaaaatacaatttctacggataaaccctatttttctgacaatttttgatccgtagggttagcacaagtctggtagtgcatagaagtctacgtgtgtacagtatgaaatgagaagtttagtcctaccatgctaattttgggagggttacacaagtttacgtatctagttgtccaagttctagcaacacttactaaacattttacataaagtgaggatgaaaaagcacgtgtgttatcgtttaggcatggtttaacaaattcatgttgagcatacagctataagtattggtacctggattattacgattttctatcagtaatagatgttcaatatggtttcaaaattttaggtttggtggtgaaaagttagccctagattctatcccaaaattttctcattagtgatttaaacaaaagatttcagggatagaattttgggaactgttggtgatgctcttatattgaatatataataaatgtggatagtttattccaatagatgacaaatttcattggtgcacacgatcttttcttggtatatatcgataacatacagtaagaagaatccattaacgatcaatgcataatatgaagatttaaacaaatacaggaaataaaagtggaaagatgcagtacatatataactggtatacctcttttttcatgcaggtcacccggtatttgtcactggcctctacttgagcttcagtctccctgaagtaattcagcagtgcacggtagaactttttcatgtactctggtagtaatgagatagcactttcatcccatctgtccaataggccaattgggaatttttatgaaattacttaattaggcaagtgtaaataaatctagccgaaaaagatagtttgacagggatgtatcgcgttgaaaccacaaataaatgaatgaaatactttgtaaattatgctcaaatggacacgccatgtaccagtgacgaataaagtggtttgatgatgtttaatatttctcgaatgaaagacttgttaacattgtgtgaaacgcgtgaccataattaattgagatgtatagtgatcgataaattcgatggtaactgtacaacaaatttatttagttagaggatcaacatggtttttcagttgtgctttactcagattaattgtttaggtgcattaaacatcaaaaggtaaaataaacaatttcttttttatttgctctaagtagctcgggttcatggaaattgttggttcatatcatgctggcagcaacagctcggtaacaagaatactgatgccagctacctttggtagttgtagctagctctacctccagttgcacatctctgttttaattaactaaaagttggccttagctgtttcttgatagaatgacagtagaatatatgtgtatgcatgagcggtactctgcttggtcattgcatagtagttggaaaaactcgcatgttttgctgctctagaattagaggtggaatgttgaatgctcggaaaactacttttataggcggttacaatataattggtacccccatttttgaaagtgtttagccaaccaaatgttacatagggcctatagaaatcgacagttttgtgctagtggattgcacaactgcatgttaacaaatctatttttttgtattttaagttcgactttcaagtctttaattattgtaggcgcaaaaagtatttcatattttaattatcacaagttcgcaattttttcacacaaaatatgcatctagtatgtaggattcaaatccgggatctctcccttcatgtgtatcttacttattaccatcttacatatgaagcactttgttaattactatgaaatagacgttggtcttctaatttaaactctcctaaacttgtaacacatattaaaaccttaaagatttatgtagtgttcatttgaagtgcgattgaggtgaactaaagttatatatgatcccaacaattttttcattaaatttgtaaggtccatattttggtaatatccttgttcacttatgtcaagttcccattgtatgttttgatgtgttatgcaacttgacatttgtgaatgttcataataaaggaaatatcaaaaaaaaaattgactaggccatatttgaggaaatattgtaaggatctcatagaactttggattaactcaattggacttaaggtgtattttctatgaattttaaaactttagacttcataaagatctgtttgtaaaatcatcctattttaaaaagtagattccgaatttgtaacgaatatttcggcacctaaatgttcttaaatgaaataactttgactagaaagttacaaaccttgtcgagcgctatattgttttatagaaattgtacccgtcaacgtatgtaacaaaaaattctaatgtagaccttaaagcttcttataatgaacttttgatcccattaactacctaaaatagaaaaacattaactacaacatctcaacaagaactataattgtcacataacatttgtcattaggcgacatcataggaaagagttacaagtggtttcctaatagaactgcccttaaaaatcaattttattgattttttcttatgagatccgtatataaaaatgaccccacctttcaaattacgcgacccatttgtgttaatagacctattttcacatgcaatttttcataaggagctatctgtaaaaatagttttcttttgttatatgaccctgggcggcattagtcatcttcatagggacacggaaatggtttgtagtggttacgatgaaaaatgtgcatgtgcctattattgaaataaaaagactgccagcttttggccatctagacaatgcgtcagagacaaccatcccaatctatcccctccccatcccatctagaagtaaaagtataggtagggtcttccaaaaatacacaaaatattgaatctgcatgggaggggcagagggtagctaatgaaggggtgggagaggtgcagaggatcgatgggcacgcgtgtgacacattgcttagttaaacaacatgctacgtgttacgcaatagcacgttctctctctctctctctttctatctatctctgtatatttttccatagaaattactttaagtatatgaggttatatcacacggtcatgcatagcgtttagaagtttcaattgattcagatttacaggtataggggtagaatagttaaattttgatttatttttgggcttctgatttgatcatctgtacctttcaattttgaaaagcctgatctttaacatattataatattctgtgaaactttagaacttttaaatataatttgttgtgcggttttcttgatttctcttacaattggtggctcgagatgaaggatattaatttctgttgtttttgacctattaattaatcgtacctttgtatggcttcattcagcttcctgcattcctcgatggtggcatgatcatcatatgtgtcatccataaggacaatgaatacaattatcttggcaaggatcatccgtgtgagtgttaagttttcttcatagaacagcgcataggaccaaagatatgactccactgcacgatctctaacatgacttagctcgacatatccataaagatctttccaccacctgaaaattaaaatgatcgattgttttaggtgcttgttttgaagtatatttaagatatatatattagatcattagaagcaatgagtattaattgatttatgatagtaataatatgtacatagcatatcaggcataccgaaaacactaacaacatgaagagccatattgctagttatttcagtatatgtcactagttattggatgtttaaagccgcataaaagcctctagtgtattgctgctgcaaatgctgagacaaagattgataaaatattcggatattccttgaaggctagctgtccttcttttttatctgagagtggacaaattatatagtagtataaaccttaattttctattgttcaatacttgaaactacagataaagcgatacctaaactcggatacactaactacctcattaacatgacatatattgactacttctggacaaaacataaagttgtacatgtattttgtgattaattaacattaaattggttgcacaaacaaagcgtcaatttgtctaaaacgaggtacacattttatgtatttaccattcagtacatcgaaggaacacaacgtctctccagaattttgcacttatctatatctgtctatcctatatagtcagagctaaaatatccacatgtattgattaagttcatctgaaatacaacagcctttggattcctcctttactttgatcatagctacccacatgtcatgtgtattcagaattaaccacttagtataattgctttagagctcaagatgtattgagcaacatctcacctagaaagtaaaagccatcgaatccctctcatacttgtcataactattcatgagttgaaattacacatcaacttctacgtagctcaaattatagtccttttaggtatgacgagtaaataatttccaataggtttttatcaagctttcctagaaaacaaatacttctaaattctccactgtaatgcacggcccattcactaataactaaatgttctctaaattatctttactaactgtagagcgaagatcgaaaaacatattttggtagttgtatcgtgcacatacacagatttgagattattacagtggtttgtttctgtcctaaagggcacaatcaattactttcatggtatatatttacttattatatatataaatatcaaataaatactctttttttagataaaggaaatgaataaacctggtatctacatccacaagacatgtacaaagacaaagcaaagaaagactcttactgagaaaaagctttgagctccttcaagtggacatgctgcagaaggttaaattccagctttgcaagatctaaaagaacaacaatacattcttcctcctgtccgtactccagcatgtaatgcaacatttcaactctcttgtaggttctcggtaatggtaagtgtagggcacggttgatttgattatctagaggggccttgagcctacttccgtccctcattgattcgaggtggtgccttgcaaaagacatagcttcttcaagttctggctcatcatggacaaggaggtgagctgcattgtacaaacttaataatgcccttggttcatcagctattgtattgatgaacctcccatcctctcctttgaatttttcgaatacatctgcaaggcagctaaattaaatgtggatttttccttccaaaagacactagattcccttttcatacaattttttaatacatcggatattcttgactaatttttatgtatatattctaatctggacttgtattgaaaagttgtttgacacaaccataattacgaaaatgaatgaatacctacaatacaatgacttaaaatttgtgatctagagaaaaatacaaaaatttgtatatgtaagtcatcaccaatataagaaatactggcactattgaaaattgggcctatctgtcatatgcacatagtggataaattgttactccctccttttcatattataagtcgtttgacttttttgctagtcaaacttctttaagattgaccagatttatagaaacgaagggtgtattttgtaatagacttgtttggcattgttgttgtttgtaaaatacatagtaaatgttgcagtgagatagttttgaccaagttgcaattttgtgaaaatcactctgcaagttatctctttcagtatttattagtacctggagatacccaaatgccatgctccctaagtaagcgaaagtggagagcaacctcgtggagactagagctagtgaattcactttctttgatgtcacttattgcattgtttatctcatcttggaaaaggtgatctattccaagacgttgaactgcatctactaagtgcattttcttggctgtatcattgtgcgtctcaaacagtatacggacgtcctgttttagtttatcagccttttccatcatccaatcctccgatctctgtttatttgcatgcataaatttgatttgttagtatcggatgaaagaaatacaggaatgaataattaggtgaaataaaacattccttttagataacttgttggtgtgttgtggatttgaccaaattttttcttgccaaaagctgcattaaatcaaatgtaataaaaaaatatgataaaactccattgatccactaggaaaatgtgaactacgtcgcccctccatccttttaatttccaaatatgtgccgttctacaatgagtgcttgcaaacatttttaaagtacgtaaatagatatagaagtattaattatataatttgtcatgtgaatattgccgttgattttacagctaaaatatgccattcttactataaaagtcaagtcttagttgaagttgtgttgggaaaatctgcacgtcagaataccaaatgagaaacattggagggagtaattgcccacgctataaagaactattttcgtgaacaacccgtatatttttataggcggcctaagtaagtacctacctgtgaaaatgcgtaggctctctggtcaaggctctacgatgagagtcaattttcataggcaagcatgctagctaggaggcacatagaaaaataggatcattcttttaggtgcccatcttaaaggccgagaaaatcgtattttttaatagaaaatacccagagctgtctataaaaacaattgacaggtcggcctcataatagcaccacgtgtgaaaaaggcgaaacctaaataatatgcccatcaatctgcccgacctctagtgactctttatctcacatcatctcgtccttattccttaattatgtcatctcatatcgattgccacgatgcttgtattggatcaagatagggtttctacaatatgaaaataaaaaaggtatacctgtagtggctttgggtcatagttgataaagaaatccccccatacagagggctcaaagctagatacttcctttacaggagtgattgattctgaggacacaacatgtgcagcatgtcgatgcgcactgctttgtcgtcggaaggagacttttgccggggcaccagcagaaagaagcccaaccgatggctggattggacgatggcctatcctagcatgcacaacaccatgagagaagaagaaagggagagggatggaagttgacatactagtatatttcccttgggagggcaatagcagttcactgatactattgtagtgtggtagtctgatcgttgctttagctagctagctagctagctgctttatataggataaggcatagggcttctagaatgtactcttaaaaaggatactctctttgtcacaaaatagatactttctccgttcaaatattaggtgggcatggatattaaagaaataagtaaaaataatagggcttccacagtgaactcttaaaaggatactctctatcacaaaatagatactttctccattctaatattaggtgggcatggatattaaggaagtagctaggtaaaaatgattggatgaagtttgtgattgattgagaagaaaaaataggtagtaaaataaatagatagtggttgctatgtgtgggatgtgtgaaaaataaacttattttgcgagcagggtgtaataagcaataaatacatcccttataccaaccagtaaacatgatggaggcactaagcaacaaatatcaagcaagactataacctgctagtaaggaataaaaaacattaattcttttagcaagaaataattgcattgtcatttgagaaagcaagtgtattattgtctttttgttttgtattggtgcatgtgagatgtgtgaaaaatgaacttattttgggacgagggtgtagtagtaagcactaaatacatcacttatatcgaatagtaaatattttggaggtagtaagcagcaaatatgtgacaattgcattacaaccagctagtaaacaaaacttattttagcataagggtgtagtaagcgataaatacatctcttataccaagtagtaaacattgtgaagatactaagcaactaatatcaggtaatagcactacaacctcataggaaggaataaaaaaagcattgttactcttagtaatgaataatggcattggattttgagaaagtaacggtattctagttgtgttggttatgtattggtaggtggaatgtgtaaaacgaacttatcctggaaggcgggtctagtaagtgataaatacatcccttataccaaataataaagaaaaaggtatgaattaccccccccgaactatctcggtcgatcgaattaccccccgagtgggtggcgagccgctgtcagcgacgccacctcctcgccgcagccgctcctccccttcccttccccttcttcctctaggtccggcggtggcagcggcggaggaaccacttgggggggggggggtagggcaggcaggaaaagcggtgacagcggtggtggcggcatcagtgacagtggcggtccctgcctgtcactcccgcctccgaccagggccacctagccgcgccccttgccaattgccgctcactgccaaccaactcctcctccccgccatgccggagacgcgcccgccgccgctcggccagttgcgcccatagctgactggaggcaccgatccgtgtccgtcgccgctcatcgctcgccgccgactagttcgccctccttgccgcgcccgccgccgatcggaaccgcgctcgccgacgtatgctgaaccgcacccgtagtcgaccggagccacccagctgcacccatcgccgctcgccacttgctgccggccgattccccctccctaccgcgcccgtcaccgcttgctactcgttgcgagtcgcacccaccgtcgctcgtccaacagtgccagtaaaggggaattaatatgattggatttccatgtcagcgcctcgtaggatcgagaaggtgaccagtgtcgggactaactgctcctgtatcttccttgcttatcatgaccagttctcaagcaaggtgaccatgattgagagctgcgcgctaactgctgcgggtccactcgaggcaatttatacggtcttgtgtggaggagaataacctgcaggcagaaattccggtgcttggtgatgtggatcaacagtataccaccgtactaattcgtggattcgtctgccgaattccctcatctccctatcccagctgtcccgttctgacgttcacttccgtagcgttcaattaggattagacttccctatgctcaatcaggaatcagactcggtacatccaattggccattaattttgacaatttgaccctttgcaaaaactatttttacaaatgaatcgctgccaaaacttatttcaaatctgacccttttgctcaacgccaaatcgtgtggcgctgaacttagacagaggccgggttttatttaaatctattattaaaaaaatatctaattccacagatgaataatctgaacataagttcatctttggcgttagactttttttgataaagggagtagaagtagtacaagtactaataaatacacgcactttttccttccctatttttttgtttttcagatcgacaatcgaaacgactactaaaatataaataaatgaaactattcttcgatcaaagcaatatttaaggtcagcacaaaaatgacttgtaggattatatcactgttgcacaaaccatcttttaaccccggttgcaaccccttggcggagttatgtatatgggactaaagattactattttaagttccgattcaaatacctggcactaaagatcaatctttagtcccgattggtgccaccaaccgggtataaagatttttttttcatgctgcttgttgcatgtttatatattatgcatatatatgttccaatatatatatcatatataattatatatatggtggcgctacgtgaagcgacaaacagacgctgcgtgctatgaaacttcgtagcgctactcatgacttcccccaccaccgaggcaaccaacctctctgtggagttaaaatttaaatatgatacagttggttggtggattgagatgacattgttgtggagtaaaaattgaactttacaatgtgagttgttgaacttggagttacgtaaactcaaaatatggatgagttaactattaactttaaatcgatgtgataataactgacattaaaaacatttgttttattagttaaaaaatatgaagttgtagaaatacttatacggggactgaatatgtacttaaagtttagcttgtaaatataagatcttgtaatagtagttaaaaactaatttatgaaatttgtgtgatgttataattgttggatttaatagttaaaaagcaacttatagttataaaaacacctatatgatgtttgaaatgcatagttaaaaaataacttttagtttaaaaaaatgtgtgatgtcataattgttggatttaatagttaaaaaataacttatagttttcaaaacacctatatgatgtctgaaaaacatagttaaaaagtaactttagttttaaaaaaatatgcatgattgaatggagtattgattcggtgttaattgaaaaaacggttagacgaggtgcccaaaaaaggtgctttttttgtgcaataattcctctgaacaaaaccggactcttcgtttggatctgcaaaaaatgatgttacacatttttttggcgtgaattaagggaaaaaaaataggttgcgtaattgtcacgttgtattcattagaaacccgttttttacatgggatgcagcttaataatgttaaaaacataggggcgactatgtaaaaaattaacttggtatccttcctgagtaaaaaattaacttggtatgacaaaaaattttttactcaacatatacatcctcacaatctataagcataagttaaattttaattggcacttgctccggacatcgacggcggcgcgtcgtggaggtggccgcagctgttcctccatatccatcggagtccgagctcgccgccgcggaggtcacgtcgtgcgcgtgggggcggagtggtggcccgatccaccgtagcctcgcctcccgcctgtcacagccgcgctcgccgtcacccgtgcaggatccactccgcatcctccgttgcgccgcccgcatccatgcttggatacgctccaccgcaacaggatccgcgcacgtggggcacggagcggcagccggatgcgccgtcttctcgccacccccctccccccccacccccgcagtcgcccgtcgccgccgcacccacagccaggccatgccggatctgccgccaccgcgcccgccgccgctcggtggtggaggtggagtcgccgcgcctcccgcccacagtcgcccgtcactgctgcgcccgcaaatgtgctgtgccagatccgccgacgccacgccctctgccgctcgacgggagaggtggtgccgccacgcctcccgcctgccgatgcgcgttcatagtcgcctgtcaccactgcgctcgcagccgtgccgtgctagatccacctcccacttgccgatgccgtgcccgcagacgcccgtcaccactgacccaccgcctctccctcatatccaaaaaatcagattgggatatgcagttggttacgggatgggggaacaacacatgtatatatatgttgaaaagttgggcaacattaattaaaaaaattactcggacaatgggagtgggggacggggcacaggggtgggaccgagattggtcgtcgatgagttaaattttaactatatatagaactactaagaagttggttaacatttaataaaaaattacttggactatgggagtgtggggaggggcataggggtgggatcgagattggtcggtgagtaaaattttaactgcattctgtggacctagtggtaggcagggtggggagtgtgtgtgggtgtggggttccacagtgggtggggctgggggctggggttgtatcacgtgccgtttagtacatagccccttaaggtgccatatagtaattctctatatataattctctatatatatatatgtatatatatataagtcagggtattgttcgggtttataaagcaatcgattggatacaatatcgtggcatttttgctacgtaagtatgcatttttatttatagaccaatattatggcttaggctgattatacattttggtcctttttaggcggctggtaaatcctttatgagtttatttacacggattttacaccacatatgccgtatatttcttggtgtagtgaaaccatgtgtcttttagtgagttaagcatatttgttaaagcagcgtgcgcatggcatgtgcccgatactttagagatttctttattcacagcatacaagcttctttatagctatttttctatgtgaattttgaaagatgtagtcaactttaggttgtacgcattatattttttaagcagtcagttttatcacttgagtatcgtatactcgagggttcatactactattattatgctacttaggtggcttaaaccacttggatggttaaattatttatctcttgactatatgcttagattgttcaactaaacacatagtcaggaactacacttaattaggtgcatctaatcaattcacttaaatatatattcgatattatccttaaattttttcggccctccatagcctcatgatttgataaaagcgctcgcgagactatggcgaagatgattgaaatacttggctttttggtgatttacctcagcagaagattatcttttcgactgtgatggtcgtcttagtggctactgtggagaatatggttaccgggtacccacatggcctccatcactagtacagatccttctatctgtgacggactctaatatgcttagaaatagcggcccgtcacaaggaagtcatctcaatcgggccgaaaagtgcctgattgagatatggtcgcacagacatgttagatgggtataaaacttaagcccgtcacggatgacacctatcagtgacgggccacaactttaggcccaattgagataacatttcatatctcaaacgggcctaaagttgtggcccgtcactgatgggtgtcatccgtgacgggcttaagttttatacccatctaacatgtctgtgcgaccatatctcaatcaggcacttttcggcccgattgtgatgacttccttgtgacgggccgctatttctaagcatattagagtccgtcacagatagagggatctgtactagtgatggaggccatgtgggtacccgataaccatattctccacagttgccactt

SEQ ID NO: 80069 - DNA, 84969 bp, Oryza sativa
ccccccctccccctccctctctccacctctggtttccttttttggcaccgcattacttttctattttagtaaatttatgcacctaaagtttatatatctcaagtttacacatctaaagtttagagaccaaaagtttatatctcaaaagtttatatatccgattcaaatttgaatttgaattcaaatattttttcatatatagtatttctatacatctaaagtttatacacctaaaatttatagacctaaagtttatatatccgattcaaatttgaatttgaattcaaatattttttcatatatagtatttctatacatctaaagtttatacacctaaagtttatagacctaaagtttatatacccaattcaaatttgaatttgaattatatccgattcaaatttgaatttgaattcaaatattttctatatatagtatttctatacatctaaagtttatacacctaaagtttatagacccaaagtttataagtcaaaagtttacatattcgattcaaatttgaatttaaattttttatatatagtatttctatacataaatttttctaacttttattttttttaaaattttttttgtggtgtactgtagtaggaagagaagaagggaaggaggaagggggaggagtgggaggaggtattgcctatagggggaggggggccggatctgatcgcttggatcgatcgctggcgattgatcgcccgttagggccccctagtagcaagagacataaaaaaccgaggctatacaaaaggaaataataataataataataataataataataataataataataataataataagggaaaattacaaaaaccaccccacaagtcacccacaagtcacttgaagtttgacattccatcccataagtcattttgttgcaaatacccacccgctactaagttttgttgaaaaaccacccaatgctagggtttgaaattttggttcgaaatttccgaaatttcgccatcccaccggcatgctcaagtctcgcccaaaatttttggatttttgcattttttaaaaaaatttggtcaaattttattcaaattcagtcaaattttcaaataatttcagccagaaatttctgaaatttcaggaatccccggcataaaatccaatttcagaattgaaaaccctacccaatgcgcacgtgcttaaccaaatcagtttgttattgcggatgtagggttaccacatgctaagctagccaagtcaatcttgtctaagtgcttaaattagacttattttccatatttgattgtttttttttcatatagcgaaactcagtgcgacaatgtttaaactctcgtccacaattttatttgtggaatcttacataaaatgtatcaataatactctagaaatatttagttttggtaaggaccacattgatagatcacattttataaaaacatgttgattcggttaagcatacgggggcgtcccgggggcccgtgcggactgtgcgaccgaacagggcccccaaattttaagggcccttaaaatattaagtatgccatatatataataatattagaggctttaattttgttaacttgcagtccaaatagtatcaaacacaaggcccaaaacgctgcagaaggtgaatcgatccatcttccatcgtgctcccatccaggcgttcgcgtcgtcgcgtatcgccaaagtcccgatgccgcagccacttcatctcctctccccagttccctctagcctccgcttctgcttcatcgctgatgatcagctaatcgtcacgcccgtttttaattttactataaaaaaatttactaggctactatggcctattttaatatttcgcacggggacctgatttgaccgggacgcccctgaagcatgtgtttactggggtggttgttgtaacaaaattgagtaggtgggtgggcatttgcaacaaaataacttacggggtggaatgtcaaacttcaagtgacttatggggtgatttttgcaattttccctgataataataaccgacacgcgtaagctcttgaacacatgacacattccttctcccaccaaccactaacgattgctctgcactgtatttgtatgtactccaccattatataagtgacggagtgaaccaagaagcggcggagagaaatcgatcgatccgattccggccggccatggcagctgctgctccggcgacggcggcggtgcggcgcatgaagctgggctcgcagggtctggaggtctcggcgcaggggctgggatgcatgggcatgtccgccttctacggcccgcccaagccggagcccgacatggtggcgctcatccaccacgccgtcgccgccggcgtcaccctcctcgacacctccgacatctacggcccccacaccaacgagctcctcctcggcaaggtacgtacctactttcctcctgtcctgcccgctctcttgcttctttgggtttgtttgtgagagtgcgctcaaggtgctcggcggaatgcctgcttggatcggaacggcaggcgctgcagggcggcgtgcgtgataaggttgagctggccaccaagttcggcatcgcgttcgaagacggcaagcgggacgtccgcggggacccggcgtacgtgcgcgcggcgtgcgagggcagcctccggcggctcggcgtcgacagcatcgacctttactaccagcaccgtgtcgacaagaaggtgcccatcgaggtcacggtgagtgccacttccccagtctcctatccttctttcttttagaaaattttgtgatgtgtggatgcaaaagatacacgtgtatctgaaagggaaagtaggtggtggtgggttggtttgtcaatgggttggtgtcaatattctacaataattattaggacagctgccggaaaaatggacatcttttattgatgaaaagcaaaaaagaaaaaaaaaggagcatttgtttgttacccacttatctagatgattaatttcatattcattgggaaaacttactagagggaggatcatgaagttgttgaaattttttttaagagaggtcaattttgaacagaggaaattttaacccagcttaaggtacacttaaattcttaagtttgtttggctgtttgtacattgacctttcttttattcagaccaatttggtatgagttctgaaaggacagggtatgtaatggagagaaaggataaaaggaacctccatttcatggcacctatccttttattgttgtttttctacctcatcttagggctgtaccaattaaattttgactaaacatactagggcatttgtaaagatacgtggtacaatattatttgcattaagatctttctgtttggcataactccctatttgatcgctggtttctataattcaaaaatgttttcttctatttaaatattatacttagtttagatatatagtatttcatttactctagacattagctgtgaaattttgatgggtgacgaggcaaagtaaagattgagccaataattttcatttacatgtcactgggcagttacaacacagaatgctgtttttgtaatagcttgggatctgaagcaccaagtaaaccaatatttcaaagtttaataaaccaatgcacaaatatcaaaacaagtaaacatgagaggactgaaaatttgtgcaaatatgtttgctgaagaggactcgttctctttctgaacatctaactacaaactagcaaaatttactataacattttgataatgtgttttgattattttggcatgctataaactgaactaccgtccattgtatttttgtcaagtttatctagttgatttacattttacattgttagattggcgaactcaagaaactagttgaagaaggaaagataaaatatattgggttatctgaagcatctgcatcaactatcagaagggctcatgctgtacaccctatcactgctgttcagcttgagtggtcattatggtctagagacgtggaagaagatataattccaacttgcaggtattgaaaaaaacaccaaattagtttgtctgttgaagaaaatcacatgctccatttgaactattgttcttatttccatttcagagaacttggaattggaatagtagcttatagcccacttggtagagggttcttttctgctggagctaaactagtggagtctctatcagatcaggattttcgcaaggtaaattccatggtttactactcagtttttcctaagaattgggatgaatgaggtcatgaaaatagcagagcatgacagcgaaaacactgtgatatctgtagtgttattgtctttcagattaagaagaatagaataattaatttatttcctttcttgaaaccaattttgttggtgtgtttactcatacatcgtgtagagatgaatgatcaatgtagagaaaaacaagaaaaagatcatcaaataggcattcatgccttatattgggaaaccttctagtttaattctatgccttgtagtttgaatgatgggaatacccattaagtacctcttctgtattctcattttctgaactttctacattggtaacacgaaatacttatgttcaatagaaatatttactctgcatttatcggactcaaacctttattaaactcatctttgtgctgtgttgtctatttgttctttgaaaaattaaatagaactacaatgagttctcatttactaagaacttgtattgatacttttgcagcatattcctagatttcaacaagagaatcttgagaagaatgctgaaatatttgagcgtgttaacgcaatggcagccagaaaaggatgcacaccgtcacagctcgcattggcctgggtccatcatcagggaagcgatgtatgccccatacctgggacaacaaaaatcgagaatttaaaccaaaacattggagcactatctgtgaagctcacacctgaggaaatggctgaactcgagtcttacgcaagcacagatgatgttcgaggcgaccggtatcctcaggcgatggccaacactacttggcaaaattctgagacccctcccttgtcatcttggaaagctcagtaattgttttcatctgttcaaatacaaagtcctggtccaaaatagctgaatggcagagcgcacacaagattttgtagaacgtattcatcagtcgctggacgctgcttgctcctgttatacatcacgtatatttggaatgagatgtcctgtctgtctgtattgtgttatgttctatgctttcgtcatgtttgtgcctacaacctacttgtgtgaagtgcggttctataagcctgtgcactgcacgcagtacgtgtgctaataataaaataatgttttgcaatcactaattttgtgttactaacatgtttgttcaaattaagcaatgtcatgtcttattctatattcatatggtctgttgagtgctgactgccttgacaaccttgtttgtttcttaccttccccaaagaaaagttcgaccggaatttggttgtgaattgtgaccggtgggaggattattgagtggggtggtgaaattagcctgaaaaccgttgccatgactgagctaatgccatattgatgaggacacgactagctcggatataaccatgattatcttatatattaatcaaccaaaggtgcatatgttctatatttgatttacttgctatatatttgaacaaatgttgctacacaatgagttttgtgtattttcgtttgcagaggtactttcttgggcgaaagaaaagagaccaagcgtaaggaatgcatggatgattgaagaagttgattgaggaccaaaccaagaccttctccaagtcttttttcatatcaccacgtcacttttggtccataggagacaagagataaagttttacacgttttggattcggattcgggcctcctaacagcattaacttcaaatggacctagccgctgatctagaaggaatttagggacccatgagtacttattggaaagcttatggagtctacttttagatggtttttgtcccacgtcaaaattcctaccgagctaccgggaatctgcaaaacaagccatgtaccttatccagtccgaatttgatttgtgttttgggccttataattatgtcatgggcttaccccaagggggtgtgtgccctagggcaaccccagaacgtccctaatcatatttattcagtacccgtcattgtttagagtcgggttttgcttagattgttctgttaagaacagtttcgccgctagatcggtttgtagaaccataaattcgagtgcttaatcattcatatgcaatttggttgcaatttatcttgttcttgattgtgttcttcaattcacatgcagtgattagccttctcggcgaggttaaccaggttttggcacgattgataaccaaaggagacgtggtgctgcgcttgcggggctcagtagcgtgttcgttcagaagtcggatcgagttgtgtagcgactccgcccaaatcgactgtttattaatacatttcgaaagatcaggacctaacaccttcatcacatctggacctgtattattttataagcagtgatatatatttaaatactttgttccgctgaataagaccagtgataacctgattttaacactctgcgtgtaaaggtgttcacacgtagttttgaaaattaggcaagttttttttaaaaaaacaaccacacaagataaacacggctttacatgtacggaaaatgttaaaatcggcacctataatgcttttggtatctgaatgcgcgtctatgggatgccattttttaaactggcacctatatggtgacatagatactggtttttaagaaggactggcacgtatatgttatatcagacgtatgtgtcggttgttaacagaaaccggtacgtttaattgatacctgttctatcaaagtagttctttcggacccactttaaaatcgacatgtttcagactgttatatagagataccggttctaattaaaaaccgacacctttgagacatatcacaccgaagtgaccgaagtcatcatcagtgcggtttgcggggtgccggttgagaaatccgacatctaaaagggtttctcaaccgacaccaatctaatatttttatagtagtgatagcacgatcaactcgacaagtaactgccacccccaagaaatatagttaatgcagataatgaggaagtagatgaaacctcgcacacacggaactattatcaggaagtacttagtagtaattagcaattcccattaaataaccccacaagagtttttccacaaaaagattttgatccatacatttataaagatatgtagtataatactatttgcaataagatctgtatttttagcataattgtgcaataatttagctatatatatatcataaacacatacatgcccatctgtattatatacccactcctttccaaattggtcatcatattataaaattcaacatttcttaaattgatcatcatataaccgcatagacacggattttatcagaatacaattaatgtagcatgagagaatgtgtgcatgtaattggcatagtgttttaatcgatgcatacattgtgagagaatgtgtgcatagtgtcttgatttatgtgatttaaattatttttcgtctttgtgtataaatagatatgacgatcaatttaggaaggagagagtaactcttactccagattggtagtagaaggaaataggaagtacggtggctagatgttgggcttgaaaattggcccataaattacatgcagattagatcgatgttgggtttgaaaattggcccataaattacatgcagattagatcttaggatctaacggtcatgatatatcatgatattaatcaatggtcaattttttttgctgattaacatgagagctaatagaaagtgtatagatatagatagatatagatataatatagatatagatatagatatagataaagatacagaaatagatttagatatagatatagatatagatagagatatatagattggctcttaacattattttttatatactttttgttaataaataaatgatggaggtcccagcgacagagcccaggcggccatttgtccggcctgggagctttattcgccgctgtgcgggaccaagatattgcattttacgaattcacattccttttccaaaatcccagctctctgtacaattagaaaaaaaaacctacatctgtccactcactgattatgaagttgtatattgggggttacatggtttggaaagactcgcgtattattgtattattaaatggtatcgtagtgttaccacggcatattactatgtctacaaatgaaagcattatgttgctttcatcccctttttacctaaaacaaagtagattaactaattaagggatgacccctatgcaatattgtttagaaagagaaaacatctatctgggtaatccgagtttaagtccctagccagaataggtgctcatatttaagctaattattctatcatcgatagacgatgtacccgttgatactgagatgcattcatgtggttaattacttcgtcaatattaaaatattataacagtccagtgtttagaggtactcgtaaagatagcgtgtgcgtgtatgttatatatatggtgagtgagctcgtgcgtattagcgtatatatgagcatctggccatctgctattatcgtgaggggaaaaaaaagaaaggaaagcgacacagttggaaatttaaggcagcacgaccaccttttgtggcaaaatttgctacaaaacacacaaaaaattttatgtaatttattgatagacataaaaaaatatgtcacaactaaaagacatccttaaaagactggtaatttactagatgacactggaatgataaattcttaataaaacgagaaagcccctaaaatcacatgcttcaaacatgatgttaaagtaaaaatttagaaattatgaaaaatctaaatttaccatcaccccaagtacatcattaggatccattatattccatcttcactctagtcttaactcaaaagcttttgtcccccaacaaattaccagttctttagtgtttttttagccgtaacgcgtttttatgttctttagtgtcttgtatgaaattttgtcctttgcaaactgaaacgttcctttcatctcttacgttgagaagaataaaaaaaaacttggaactctttaccttatttttttttctcgtattatccaaaactacagggggtaatatgctactgtattaatttgccacggataatgcctgagaattctcgcgcgaagaaagacggggctgcctacggctcggacgcccaatgattcggagaaaaatcgggcgctgacgtccgcgcctgatttacgtgcaaaaattactttaaactgatttttttcttaaattacttatccaaatcatgatccgattgcaccattaaatttgttgcaattaaatcttcaaaacaagaccacacatagatatattccggcgacaacttttttaagcttattattgaattatttttaaatgttgtacgatgttccaccagatatatcggaattgtttcgctaagtagatcgaaaatgtttcactcgtttaaattgggtgttgtttcaccgtatataaaaataatgtttcagcaaatagcgaaagattgtttcagttcattgcaacatttgatccatacatagtaaaacattataaatgcactaggcgaaacattttttggtggaacaacaaataaaacgaattctcttaataggggtttctaaaatatgtgggttttttttgttgcaatggaatatttcaattcactgcaacgttacatctatacatagtgaaacattatgagtacactagatggaatatttttggtggaacaaaaaataaaccaaattttccttactagagggtttttaaaatatgtggttgatttgttagaggtggaggcaggtattgtggtgggaccagcgacatcagcgtgcgcgcggggacagggttgggggtagcgaacgatttttcctcccccgcccggtcgcccaacgaccatcattatccaagaaagacttccaagtcttcgaccgcgacactccttacccgcacgcgcggccatgggaatgtgaatccgacgtatggccatggaaaaactgatactccttggtctcggtaactatatgatgacatctttttaaataaaattaaactcgttaactttcgactaataatcatactaactatatatactatatactaagtattatacatactatataatatatcactagatttatattttaaaatatacttttatatgacactaattttatttttttaagaaatacaatatgtaataaattgatggtcaaaaggccctatttggatccaagggatattttttagtcctctcttaaatagcccaaaaagatccaaaagggtgagctatttgagggctatttgaaaataatccaccaaaaaactatcacatccaagaagtgctaattgaggatatttcgggtgaggtcctctgaaaaagtgtcttttctctctatctcttttcatgggaaggtacattaaagccaaatagctctcaaaataacacttgatccaaataacttagagctattttattaaagtgttattttcttgtgataaaaaatagctctcagagtaactcttggctaatttaggaacggagaagcacgtgcgtaagctcttacgcacactgtgcagcgacgcttgcagtgagttgtatggtactagcattaacccctatatatgtgagtggccagagcccacgtagcatcaccaccggaatcgcgcgcgcggcggagagaaattaatcgatcgatcgatcgatccgattccggccggccatggcagctgctgctccggcgacggcggcggtgcggcgcatgaagctgggctcgcagggtctggaggtctcggcgcaggggctgggctgcatgggcatgtccgccttctacgggccacccaagccggaggccgacatggttgcgctcatccaccacgccgtcgccgccggcgtcacccacctcgacacctccgacatgtacggcccccacaccaacgagctcctcctcggcaaggtcagttataataagtttcttcgtgcacgcttcggttgtttttttgggtactgggatacgcgctgaaggtgctcgacggaatgctcatgtgcgccaatatgcatgcaggctctgcagggcggcgtgagggagaaggtggaggtggccacgaagttcgccgtctcgttcgccgacgggaaggtggagatccgcggcgacccggcgtacgtgcgggcggcgtgcgagggcagcctccggcggctcggcgtcgattgcgtagacctttactaccagcaccgtgtcgacaagaaggtgcccatcgaggtcacggtgagtgcccccccttccctctctcctgtctttcagttcctttctgcttttttttttactttttttctttttactactttctccgtcacagaaaaaatatcacttatatggcctaaattaaataagggctgtttgtgaacaaggttataagggtaaaaaacaattgaatgattggtgactaataagataaatataatattataaaattgttacttattttgaatagattttaaatggaaagtggtttgattttttttacggaggaaatatctttttttttttggatgaaaggcatacatgtgtaagtgacggctgatgaatccgaaagggaaagtaggtagtgatgtgttgatttgtcaatgggttggtgtcaagattatacataaccagatgcgtggtagtggggaaagtttgcatgataatgatagaaataaggtttgtaaataagatgtaagatgggtttgttttttagctggactgaatatttgatcgatcatgttaaaaaagttataaataattcagatgatatggtttgtgataatttaaatcttatataaattgaccatttaaagtaaaactaaagttacgtaacttcatgagagaagaaaaacaagggaaataatatagatggatcatccaaagacaaaactgcggtgttgtggattcatcggagaagaaaaaagaggaagacgatttcgcctatagattaatcatccgtgggttataaaaatttgaggtgatgtggtatatactccctccgttccaaaatataactgtgtgtccagattcatagccaaaagttgttacattttagaacggaggtagtagtattattgggacaactgccagaaaaatggacatctttctatcaatgaaaaaaaaggcatttagtttgttttctagatctcgtagataattaatttcatattcattagtaaaactagaatggagagaggattaggaagttactgaaaaaaaatgtaagagagaattttgatcaaaggaaaacttgaacccggcttgaagcacacttaaattcttaagtttgtttagctgattatattatacatttgacatcctttctttcgttcgcagcaacttggtctcttaattctgaaaggataagttattaggttttgttgtaatagcaacatgaagcataaatttctttttcttttttctcgagaagaatttggaaccatacatttgtaaagatatgaaccatacatttgtaaagatatgtagcacaaaattatttgcattaagatctggactgtgtgccataaatcataattgcgtggaaaaccttacatgaatatctttcactgtcgatgacatgtgactggacggttacattactccatatttggtctcgatggttttctataattgataaatgttttattttcatttatatagtacatttatcttagatacagaggagggcttgttttattagacaatagctgtgggattttgaaggtgaagacgtaaagacaagactgagccaataattaattttcaccgacatgcatgtctcactcggcagttgcaacatacaatgctgttcttgtattagctgagatgttaaccacaaaccaaaccaacatttcaaagtttaacaattttaagatccaatgcagcaatacataaccaaaataaatagatatgagaggactgaaattggtgcaaatatctttgccgaagaggacttgttttcttgcagaaaatgtgagaatccaaaataggacctacagaacgtctaactacaaactatcaatacgagcacatgaactactgtgtttctgaaagcggatactagcacctgaactactattacttatgatatttccaaaccgttggatggaattattgtgtacaaataaagtgtactacctttcattgtatttttgtctgccttttaagtaatgacctttatttcttcccaatattatctagttgatgtttaccttttcattattagattggtgaactcaagaaactagttgaagaaggaaagataaaatatattggtctatcggaagcatctgcatcaacaatcagaagggctcatgctgtacaccctatcactgcagttcagctcgagtggtcattatggtctagagacgtggaagaagatataattccaaattagtttatccattgaaaaaaatcacatgccccattttaactatttttcttatttccatttcagagaacttggaattggaatagtagcttacagcccacttggtagagggttcttttctggtggagctaaactagtggagtctatctgttcaggatgttcgcaaggtaaattcttatggatactactcattcagttttccctaagaatggggatgaaggaggtaatgaaaataggtatcatgcctcttattttgaaacattgtaatttaattatattccttatatatagtttgaatattgggagtttccactaaataccttcgtgtgtactctcattttccaaactttgtgatgtatattaacgcctcgtctatttatttatacttttgcagcatcttcctagatttcaaccagcgaatctcgagaagaatgctgaaatatttgagcgtgttaacgcaatggcagccagaaaaggatgcacaccgtcacaactcgcattggcctgggtccatcatcagggaagcgacgtatgccccatacctgggacaacaaaaatcgagaatttcaatcaaaatgtagcagctctatctgtgaagctcacccctggggaaatgactgaacttgagtcctatgccagcacagatgttgttcaaggtgaccgctatgctcagacggccggcacttggaaggattctgagacccctccattgtcgtcttggaaagcagagtaaacgttttcatatgttcaaatacaaaatcccggttcaaatttagctcaaatggcagagcacacaccagattttgtataagtgttcattgtatcagacgcgttgctcgctcttgttaaaccatcgcttatgcttgtttgtgtctaaaacctagctagtggtgttgtaaagtgtggttttattagtttgtgcgcagtacgtgtgcgaataataaataaagttctgaggtcacattttttttttgttgccgacatgtttgttcaaaatttgaaattaagcagtgtcatgtctaaatctatattcatgtggtctgctgactggcttcacagccttgtttgtttattaccttcacctaacaataaatcgactgcattatatttggttgtgaactgtgtgatcggtgggaagattatattaaacggtgcgtgttttgaaaaaaaaaatctatagaaaaattgctttaaaaatcatattaatctatttttgaagttttttaaactaataattagttaatcatgtattaattcattactctgttttccgtgtcaaaagtgagggttcctgaccctcaagccttacctaagaacacagccttaaggcatccacaatatggtgtaaaagtagtccataagcaatagaatattccatccaaccacctataaccattgtgcaactagtccatatagaaaaaataacaaaaggtatccatatacatatggactacccatatggaataaattatattatctatctctactcatctctcttctcctaatgatacattgtatccatatatattgtggagattgtcataggtaaaaactatttatataggtcccatctatatggatcactttgccatatacattggtgatgctcttaggacacagactgtgtcacatcgacttgagaaacatatattactagaatatcaatgcgccaaaaggcacactaagtaatttaacccgtgtataattatttttatgaagcatgtatttaagaaaacggtattttttaatggaattagtttaacaatcataaattgtctataagcatcatacaatttaaagcatactttaatttttttaatggaattattagttgtttagttttaaagtataccgagaagaatcaaattaagacgggtagtaattaatgataccaacaaacaggtgaataagttattgtaatgacaaaaaaagtattttatgaatattttatcgtacttttgtacatttaaatctattacaatttgtaaaattagcagaatatttttttcatttttcatttgtatttgtttatactcgctattgtaaatttacttttactcgctatttttgatagtcatatttcatcttggaacacagaccaaggataagtaattctacttatcatccatttaaaatgctactagtcatttctcgtaaacaagcaattcattaatatttacatttctcgatgtccatatagctgatcttgcgtggaagaatgaaaagtcatgcattaaatccgagaaagttattaagatgatatgttgttgaattgaaatatgcctatcaaaaataaatttttcaaatttggaaatattactatcaaaagtagatggagggagtactatttaaataattggttttcgtttaagaaatcgcgtgcgtaattatattttaaaatggtattattgttaaatctgataatagttgcttttataatactatatctttaataactactaaaataataggaatctaaacactatttatttgtcacagagatttttatatgtataccaactaatagatgcatagatgtatgcatgtggccggtttagcccaaagcacacgcatgtacatgcgctggcttgggcgaactgtgcacgtattgccatgggccggttagtgtggatttggatcgtctgacttcaccctgcaaaggcatgggcgtgcagtcatcatttttccactgttcatgcaatcaacgactcacgcgtcacgtgcacttaacttttgttaaaacaatccatggcagccaacaagacaaattgataaggcaatccgatgaggtctcgtcgtcgctgccgccgccaccgccgtcgatgtcatcgatggcggtgactagctagcttagagcttgtttgccggtacgcacgtgtcgtcaccagccatcgcctcggcccaactatttttttttgttgttcttcatttttttggccaaagtatcaaatttgctaagttaatttctttgttcaactgttgatggtactaaagacatattttagctatggagactgtagtttctagtgtgttgcttttgttttgtcaatccttttttatttacgatctctattcactatctgttttgatttatgatgtggcttactcttcattgtactccacttagtaatgaatggtgttgtttgaaacttatgaattgcctgatgggatgcaatgatttatgctttgcttgctgagtagttgaatcgaatgcattctttgctctgctctgctcattgtaatcatgttccataatccaaattccaagtagcaagcatgctgcatcactgccgattgatacatccaatcctagcaggaagatggaatggcaaagcttccatatgatgcctaagacagcggcggtggcagcacgtagcgaaagacgagctccaggctattcgtcggcggcggcagcgatggcgggactacacgtctaccaaactgaccctgaagtctggaaaacgtgcctcttgttgggcggccataggtttgtgtggacaggagccgttgcattgcatggacggtggataagtgatgactacacgttcgtgccttcacagggtgaagtcagacgatccaaatccggttaatgtggctcagccgtggatgattagatgggtatttagcaaaggcgcatacggcgtgcggaggaactcggaaattctatcgttattaggggtgtaagtggataactcgtgaaacccatttatagactaaaataagttgcgaacctacttattttaacctataagtgggtgtgcagctgacccacttacactcctgatcgttgcgcacaacactctttctcacattgctccacgtgtcgctagattatagggacatctggaccaatcgaatctggaccgaatgaccggctttagaaatatagatggtgtaaggagcgatatatattaaaaatagtttgttccactgaataagatgagtgactagtgacaacctgacaaaagtacgaacatgtcaggtgtaaagatgtcgacgcattttttgaaaattaggaaagttattctcaattattatgcttgtcctgacaatattgcatttatgcatttctttgattactctaaagatatgcacgcgagcatggtacactatacttacacacctacgaatgcgtccatagcatactctcaaaaaaatggagacatatggtaaattcctgaactcattaaaatcatgttaaaagcgaatctatgtgcgattttacatgagaagaaactacagaggaaggctgaaaacttgaattctctagcggagttgccaattcatattggcatctattttgtcaacatggacccacctaaagatttacgatgttaatggagtcatgagcccccttaatttagaaaaactcttgacttcgatgggtttacaaaagattaaaaccggttagcgaagccaatttagagatgaaaccaacactagtagaaatgtgcccatctacgaaaacattattgtcatggtagatactgaatttgtcattaagaaatttctatgatgaatttgtgtgctcttaaaaaatggagcgtcacattagtttctttatgacgaatcaacaaatttcgtaatagaacttgtgtacatccatcaatattcaccttatgaggaacccgctttctgccacttgcatcttcctatatagattcaaagcaatttgggcatgcatcaaatttccccacaagtaatgggaggcactctccaatctgaaaaatagactctcgctgctggtgggccaacgcaggttgccggcggggaaattgatggccgagacatggcggagaaaccctagtactagggccaggggtgtgccacagttgtgatacctgtgcagtgaaggcgccctcatagtggaaaggtcagctggaggtgagagaggttttggcaaggtggatctccttgtgtctggaatctttggggcagcggcgagtgaggttgtaggggtgcttgaatgaaatatgaattgctagtcaagattagttatatgaacgtgaggctgtaaaaatgctaacatagtaaagatgcatgcttggaggaacttggacaatactgtgcgatcaccagacaaactaccaggtaaacgttctgaaatcagatttgtacgcacatgatatataacttatttgtaagacaaatgaacagtctctaagtactgatgtggatagttgtcctatcttctgataggtttgatttggtgaggtgaagatgttcacgcattgaggcctgcgatcagccgatcgtcacctcacaaccgctacagccacacgtatagtcgttatcaatcacgctctcatgcaatcaacctttctagaaggattattgctcctgcaaacaatcgaagaagttcaggcttccgcctccctcaaggagaaggttgcggaggaggtcactgctgtttcctccgtccctgctgccgcgggaggcagcgggatcaagaggataccctgggcctgggcgagcggcactgccagatatcggcagaaattcagctgctctgaggacccatcattctcatcttgtcggacttttcttcttcgcgggataatggaatgaggtcgtaatttactatcttactcaggacacgagcggtctccctcctcgtccgaagaggagactactgaagagggccaccgacaagtaagtgaaatctttgaccccctttgttgtcatgtctacaagtttattgagggtgtttttgatgtcagcaggaaggcctcaacgatctccgcccaaagcggtgacgaggtggcgactagcgggactcccgctgtcgtcctagatttttcacaatttggttcttttgaaaaacttattttgcaaatagatccctagaaaaacttattttgcaaatagacccctagaaaaacttatcccataaatggtcctatttgaggcgccagagtgcctggcgccgtcgtccaatgggacagcgctagcctctctggcgccgtcctcttgccgacattgcggggtggtgctgaggtggcagggggagcatgatgacatttttaaatactaaatgatttcaactgaaaaagtcatccacaacaaagttctggctcggacgcggcgacgatgacctcggcgacaacgactgcagcgggcggcggcggcgaggttgggcgcggcggatccggcacggtggtgaaacctatcccgccgccgtcactgtcatcgtctctccctcaccctcactcaccctctcctgccgccgccgctgctgccacgcactgcctccggcgcctcgcgctgtctcctccatcgtgccgtcatcatcatcatcaccgttgccacgtgctgccccctccgcctccacctctaccgccgccgccgtcatgtcgccgtctccgagcgattccgcctctgcctcctcgtcgcgccgttgccgtcgccaagcgcgggcttcaaggcggacgcggagaaagcggggaggtgagtgctcctctcctcttcccctctcgtctcccctatgcctacgaggaccggtgccttgtcgccgttgtcactgtcgtcccgctggttggcgtcgccctttcccctctccccatggtgtcatcctctccgatgccgcgccttcctcctcttcatcggatggggtgaggtgctcagcggcggcaacgagctcgacctcggcaggctgggcaacaacgtagacctcggtatcagcacggattgagctggaagaagggggcttgctcaattcgatttcccgggagggtgatggggaggttgccagatgagtgggggtgtgtgagtggcactgcgacgaagcttgtgcctagctatgatcgagtaaaaatttatattagttgaacccagttttttgggttaatactttctctggtagtacaagcattaagattcgatggaaatatcaggtgctgattcagatttcacctttgcatgcaatctatttctaatttcgtacttctgtgttagtaaaacttatataagtgatattaccatttacttgcaacaatctatcagtgtcagacctgaaattgttcaagcttggctcttcagttccagctgcacaattttttttgtatgggctttactgatgatgtactcaggtgacacaattgtacgatggttaaaaaaaggcctaggttatgatgttagacagttcataataagataagggaatttggtaggagtacaatttactctgcaagaaacagagaatttatgcttgttaatccctgtagatcattgagccatcactttcttttacagcagtagcttcgctcaagaaaatgtttgccttttactgaaaatttttttgtcctcgcagtgcgaccatcatcactgtcgacatgccctgtgggcgcatggctgaggccatctgcatatgctgcatgaactcaagctccgtctgtctctagtacgggatggatgttgctggtcaaggtagggctgatggtaagggaggttggagccgactgaggtaagtgccagttcacacatatcttgaacttggttttgaaatgaaaaattggatctgaatgctgatatttgggtggttggtttagtaatctaccttgcccatcgttgtcttctacagtcccataagattctattataaagtttaattataagagtgttgaaccagaggtctttccctcgtgataaagtagttgtataacctttaagtttagcaggaaagttgtctacagcctacggatttcatctctaggttctataggctgcgtttagttcagcgcaaagtttggattttagttgaaattggagatgatgtgactgaaaagttgtgtgtgtatgacaggttgatgtgataaaaaatgacggaagtttggatccaaactttggatctaaacacagccataatcattgttgccagttgttaagagcaactctggtctcgtggatagctttcaatggaaatatgtgtttcctatattatagagctgttacgctggcactagagttaagtaatggaaatatgatatgtgcaaaataggagacttaattcatacacttaaatgatacaagcacacagtttttttttatctcaagctttgcatgtatgttcttgccgtgtgttactaattatcttttggtgcatagctgcatataattcctatttggataccgtacctgatggtgctccttcgattaattcacacaagttacttgacatcgaccactgctgcattgatccttacgatctaaacatatgccacaaaaataactccattaacctatatttattcacatttagaaaaagaagattaggagggaggactaatattgttgagttgtttagtgacttaatattgttgactcccagtattgacactaaaattgtatttttgcagctatgtataagatgtagcaaaaaaaatccatttgcacatcaacaagaaggccttgctgtaattcaatcctctatttgctatgagtggaggacgagaagcaaggagtgattccattgaatgtttgaaagatttgttttggttttctgttttcagatttcctgtaactaggttgaatctaggatgaactattgtttgaattctgttgtattcttattgtatatgttattagttaaatctgcgatggtatctgtaattaggtttgaatctgaaatggtatgagaaattggattgaatttggtaggctcaaatttaatgggtctgtttagtgggctttgatttgatagttggttgacaaaatgggccagttctgaaatgggcctagctttgaaatgggcctattttaaaatgggccagtttaaaaaaattaatgggccgctgttaaaaaattaatgggccgttaaaaaaataatggggccatataaaaaaatttgctgacgtcagctgccacgtcatcacacacgtgtcaacgaccacgtcacctgccatgttggccgccacgcggcaaccatctatgacgttaaatttcgtcacaaaggttgggcctgggctagactacacgagcccaaaagcgtttaatgacggttaaaaaatgtcatagattgtgctgatccatgacgatttcggagaaaacgtcggcagatttaatctgtgatgctcaatagatgacgataagtagaatcgtcacagacaaattcctgtgacgaattttctgtgatccatgacgaatttttttgtcatagattaaatagattcttgtagtgcaatgatggcgttgtacgcgttgtcgaattctgcgacaccaaaggtgatatgctctgttcggaagttattggcctatccaaaggtgacgggtaacgtgacgttacccaacggtttagacgatcattctggagtgattacatggaagggctgatatgtgggcgtcagctcgcttcgaggtatccccataacgtccaaagtgctggcgaagagcaagttgattggactcccgccatcaatgagaacctgtgccaccttgatattccgaatagtgggttcgactacgatcggatatctacctggtgtggttgcgatcttggggtggtctgccttcgtgaactcgatcttatgctgagaccatttcatcttggcagtagccgcctgcgatgtggaccagacttcgtgttctacctttttgtactccctctttgaggtgtacgatgtagaaccgccgaagatatgagagacatggaggtcgtactctgggaaagcggagtcagagtcaagagtggcggcttccttagccgtttcgacgacacgaactggcttccctctctagatcgctagttgtctcgcgagctccattttgaaaacataacaatcctccgtggcgtgattgttagtcttgtgtatcgggcaccattacttgcgtgagtcgtcgttctgggggtttgggcgcctgggtgggtccgtttgctcagcagcgaggacctctcccgagagtttgcgcttcccacttttgcgacttctctttttgctcgactctggtgcgtctcttttggttgacttcttctcctcacccaccttgctctttccctccttttctcttaaagcatcatctgcatgggcacatctgtcgataatctcgaacaacttccgagcagatatgattcgtcgcgtcgccaactcctaggtggtgttatcgatctcggacgcctgacttgaatgcgcggataacagaagcatcggtgatctcgaggatcgtattcctgcactcattgaatcgccgaatgtagtccctcaatgattctcctaggttctgagttagggcatgtaggacatccttaatcgcgtggcgcttgtaagttccctagaagttagcaacgaactgctgccacaagtcttcccatgaggagattgtgcgggacgggatgtggaatagccatgagcgagcagatccttttaatgcagctggtaaataatttgccagtgcattgtcgtctgcaccagcagcgtagagaattgtggagtagacttgcaaaaatttttctgggtttgtacttccatcatatttctcgatttctcttggtcggaacttctcgggccatcgcacatttcggagtgagggtgtgaatgctctacacctgcctcctgggacggaaggcggcccatggttatgacgtcgtaggggaggtatatctgatgaagaaaatgacgaagacgaggatgaggggtcgcttggtttaggagcccggcttctcgaacaatgattgtgtccccgatctcgactaggcgcgggagattgcgaattgtgatctcgttggtcgttgccgtctcgctcctgatcttgggcatcgtcctgaactcagcgattggcccccctgatcttgctggttgttgtagttggtgtcattgcggcggtcgctgtgggcccgccggccttggtcttcgttaggtccacctcctcggtcgtcgttccttcctcgttcgcgaaggagagcagtgacgatgtcgtcaatgaacaatattctctccgcggcgagaaggggaatggtgtcgatgacgatcattattgttccgatctcttctgtctctccgtcagtcatccaagtgttcgcggagatcgcgattctcgcgatgcggttcaataggttcacgtgtcgcccgaggtgatcgattaccggagggatgttctctgttggcgttttttgcctccgcattctcggcggttggctcgccgttccctcagggctgatctcgtggtgatggctcattggccgacgtctggatttgttacgggatcaaagggactttccctcaatatcgcatctaggtttcacaactgttgacaggcgttctcgctgctgcggacggacttgtctcgatgttgtcgaccacgttcacatcccgtggtgactccgaagagaattcatagtcttccagcaggtgtaacacatatggctcgtttggattagtgccaacatatcctacaaaccgatctggagccggctccacatctcgttccttggcaacacacagagcttgaactcgtggctgttggacacgatgatgcggcactttgaaggtcctgaggaagatcttgcagcttgtgagatcgtgagatctggatttgtgaattggacagtagatggcgcccgttggtgaagtgcgttgaattccacgttcccaacaagcgtagagtttagccttcacatggactatcagtgggtagtcctcgagagtatgtttggatgtcttatgaacaggacaccaagatctcggtttttgtgttgtcatccttgtcggctctgatctcttgtatagagaacataattcggccgcttgaggattcctcccaggtgttggggccctcgatgttccgttctccacttgcatgggaggaatcgtcggcggggtgtcgtttctcggagtcgtagccgtgcctttctcgttcccggtaatgattgggccattcgagattggcgtaatggtatagatcggaaacacaatagatccgacttgagtccacaccaacgatgtcgaggtagaggctccttgattgacactggtgttggtactgctgtcgtgaaggcttgaagtcatactggcagaaccttaagcaccaagtccctctacctggcacgccactatcgacgagtaatactcgtggaccgaatgagctgaatattggggtacgttggaacgagggtctacgtagtacgacatcaagcagacaaaagacaaggattatacgggttcaggccccttgtcaggtaatagccctagtccagtttatatgagattgatgatgaggaatcacatattacaaaggaagtagacgaaacagacggtaccgacgagatcgtagttgatgaatccgatgagatctcccggcgactaggctccacgtactctggcttcgtaactatggtgtgtgtgttggcgatgaaatttgatgccttgcacccctccctgggggtcccttttctaccgtggatcatcttgacccttaagtaaggcctgttaatatctgatctggtacggtataacagaaactctacccttccgagtaggactttagaaatcacttgactcgtagagatattttccgtaattttgaacgaattccaaacggtatacatgggaacgatccgtgtgcgtaaaggtataccttattagtgtattccataagtcgtagggtaggaggtatgctttatccataaccctgacaataagtgaataaaatgagggagttaatttggaccatatattaatcatctaatgactaaaagtaattaaggtgacatggcttaattagaaaaaagagaaataacattaaacctataggacggactttatttatatataggatatattggatttcacctgttatcctgttcttttgttgattatttttctcactcgcatcctgtatgtataacgaaaatcaagctttaattagtagtataatggagaggcagcgtggcagcgctggctttgttccctgccatcatgctataaactaataatatataagcgtgtcacatcaatgaaaacataatgttgtacgaagtattcactactctactatacgagcaactagtaccaagatgaatctcgatgagatattatgttcctttttttttaaaaaaaaaacactgtaccagctattagtaccatgaagccatgcatgaatcaagggcaaaatgtacttatctactctctctgttcgaaagaaaaaaaagacaaaccctaaattttcgtatctaacgtttgactgtccgtcttatatgaattttttttataattagtatttttattattgttagataataaaacatgattaatactttatacctgacttgtctttttttttcataattttttcaaataaaacggacggtcaaacgttggacatgtaaattcagggtttgcctttttttttatgagggagtacgtaagtatcgtgcttcctaattattggtgatattactcaaacacgcgattcaggcatggaaagtttaatcgatcgagcatattctccgtgttaatcattaaattaatttagtgtgttcaaccctgacaaagttggatccgatcaccgctgttgagcccatatcgttacctctgacaggtttgatcctcatcaggtaacagtggttagtcatgattgcacctcatctctaatcggtggaagccctttagtgatgattaacatctttaatgagccatgtagtctagtggttacagtgacctgagtaatactctaaggttttgagtttaaatcttttatagagcgaattttagattgggttgtttacggggttaagtaccttatttcaatggtcgtatatatccggttagatatagaggctgatacttttttttaaaaaaaaaatctctaatgggccattttgaaatatcccgttgcaggtgagattcacctgtatgacatatggctctttcttgcctgtcacagatgacagattgtcattcatcaactgtcataggtgtgaaaattaaaaaaaaaaagcctcgcccccctagctcacgatatggaggaaaaactgtaggataaatatcaagatgcacgacacatcaactttctattttaatggcagatccaataacatcagagaaaaattaatggtttttgccaaattaactaatttgggcaacatatcctaattactcccttagtacctttcaaacacagtcactatccaactttgaacatccgtcctaattaaatttttttaaattagtatttttattgttcttaaatggtaaaacacgaatagtattttatgcgtgatctgtgtttttttaatttattaaataaaatggacgatcaaagtttgagacgaaaactgcaaaactacacttaaaatgagatagagggagtattatccttgcatggctagctagctactcccttcgtcctaaaatattagagattttggacggatgagacacttcctagcacagcggatggctctctagattcgttgtgctaggaagtatcccatccgtttaaaatctcttatattttagaacggagaaagtagctagcagaagtagtatgtccattgctctatatataggatgggtggcagcagggtggttaacttaactggctataagcattaattagcagaagctagctagatgatatactcgatctatatgtactactacaccagatcgatgcatatggatcaccgcttagcatgtgctttcaccatttcgcagccaccgccgcctgcatgtgcctgcatgtgcctgcaggtttcgcacaacgccaccaccactgctgcagctaggaataatagaagcactatcatcgtgtgcagcccaaacgcaagcagcaagcatcacagcagcagcaagcgtttacgatcatcgcgtgtggtgtcttgtcatgcagcaccatcgtctgctccagctgctgcccaggctcccggtttcgagccctcggtgtggggtgattttttcgtccaccatgaacctcggccaacgcaggaaagtttatactgtattatccgtacctcagtgtgtgtgaaattttctcaaccacagacaatatactccctctgtccaaaaagataattcttaggttttcgtgtccaacgtttgaccgtccgtcttatatgaatttttttataattagtgttttcattattgttagatgataaaacatgaacaatactttatacacgacttatctttttaatttttttcataattttttcaaataagacggacggtcaaatgttaaacacggaaacccaggaatcgagtcattttggggcggagggagtactacataaatatatatcattgtcatgcatgcatggatcgagttatgcattgagtgtcggttcaagttttacagaggttaataattttaaccgattaccatcgaatttgcattcctgcatgaaggttactacctctgtactcacttgactagagaacattttaattttttgtattgtagaaaaatcagcaaaatacacattttttctcgttcaatttttttaatattttctttaataaatattaaattagtatgctttaaaacataaaaatatattttatacataagagctctgtatggcaaattaacctatacaactgaaatatatttttcaatgtaaacttattctattgaaatattaaccattagattaatttgcatctagattggatctagaaaaagccttaaaaattggcatattggtcaacaacttagctagcgtgaacatttaggatccatatgtcacacatgagtcttttagccatggaagctggccatctcaacaaaggtctgcaggttttgcttttgattgctagttttcatcgttgcatccaggctagcatgtgcaaggaaagaaaccacagtgctacactccataacaatatattaaatgttatcgtctctcgacaatgcagttttgtcatgattcatatctccagtccttgcctaagtctcgtgattcacaacttattgttttaagactgagaacatgcaaactaacataatttccaaccaattcgactcctcaaacatatcttctatctccaataatgaacactgcaaaatacaaaacaatctagctgatatgtttagaatgcagaaaaagaaaacagaatgaatcatcagtaacactatctttgacaaacgcgggtgattgccatgtccatgtaccggcatgcttatttttcaagttgttgtactagatgaccactgcctactatattcttgtactgagggtataatttactcaaattgttatgtttctctttgtcatatatagcttctaaactattgctactgcttttgacgaatctcttcaagtctatctttttttttcctgcaatccaaactaacaaatcagtacattcatgcagcaatcgacagaatggatgagggatagggccgacaaattgaaagaggatgtatgcacactatttacacccactaaggacatcttaaggaggatgtacttagtagatgaaatagtgcatctaggaatcgatcacctctttgaaaaagagattgaaactgcattaaaagacatacatgaaaccgaattcactagctctaaccttcacgaggttgctctacggtttcgtttgcttagggagcgtgggttttgggtatctccaggtatttctctacttagttaatggattgtgcatagttattttggaactgttcattactacgacgattgaggaccatatatatataaatgttcaaaagagattgcgaataacgtgcctagctaaaccttggaacttcacaaacatttttatatcaaatctcacatgcagatatattcaacaaattcaaaggagatgatggtaatttcttaaatgaatttgctgaagacccaaggagcctactatctttatacaacgcagcccacctcttcatacatggtgagccagaactcgaggaagctatttcttttgcaaggaaccatctcgaatcaatgagttcgcatagtgttttgaaggcccctttagctgatcaagtgaagcggcatcttcgcttgccactgccaaggactcacaagagagtggagatgctacattatatgtttgagtatgaccaagagaatgagcacaatccggttcttcttgaactagcaaagttggatttcaacctactgcagcaggttcacttgaaagagctcaaggaaatttctaggtactaatatgaatgctaactttaatttgttattttgaataaaataaaatcaaaggctaagacaattcatggtgtacgaaattaatgaaagaaatatgcaataattaaaatcaataaaaatggtaatctataatatagtctagaacaaaagatttgatgaccattactgcaaatagctataactgtcagttgatttagaaaagacatactccttaattactacttacgtgcaccgtatagagtgtgttgcagtttttatagaataaatgatctaataacacaagcataagtttcgcggaacatgaattatgttttctatatagaaaaagaaaataacctgaacattaatataacttttattatatgatacatgtaccgtgctatgctacgacctttaactgtttgtgtgtatatatttaagaacctgaaagtaataactagtattaatttttttctcaggtggtggaaagatgttttggcatatatgggtctagaccatatccgagaccgtgtgatcgagtgctacacctggtcctatgctgtataccacgagaaagacttggcacttgcacgaatgatctttgctaagctagtcgcgctaacttccgtattggatgacacatacgatgtccatgcgtatacctccatcgaagagtgccggatgctaaacgtagccattcaagggttggacacttcattaatttttatgcatccaattaatcttaagttttggataattaattaaatttcccctgacgtaactgctagattatttaatcctgccctgactaataatgttataccgttccagatgggatgacagcgctgccttgcttgtaccagagtacctgagaaagttttatgaaataatcttgaggacctttagggagtttgaggatcaaataccaagaaatcagaggtaccttgctgctttctccaaggcagaggtatgactcactccctctttacttctgacccagaaaaaaacttagaccgtccttgtttatttactctcacctttgatgaccaatattttaactttgaccgttactccctccatcccataatataagggattttgggtggatgtgaggacagatggagtaattaataaccttcaaacaatcaatatatgattaatcaaaattaatcatatattttaatttgatgaatgacgtatcgtagggtggtgtatactttaggaaaaagtatgaattaccccgtgaacaatcgtggtagaccgaattataccctgaactcgaaaattggacattcgataccctcaactattgttttgaatggttttgacttgaaattacacacgtggcaccaacgtggcagcccagtcagcaaaacaaaaaaaactgggcccacttgtcatacttctccctcaatcccctcaacccagtcccttcacattcccccctgctctctcttgccacgtgctcggttggccggtggtggaggagaaccacgcccgagcgggtggaggaggcggaccgggcagccggcgacggatgcggacctcgcctgggcagtgggcaactaaggtggagctcgcccgggcagctggtggcggaggcggacccgacgaccgacagtgaatgcggatcaggctattgacgacggaggcggactaggcagccagcggcggaggtgtagctcagctggtgccttagatccagagcccgccgtgggccggtgggggacgagggtgacggcgatgaggtcagtgctggcataggaggaagcagagccctgggaatcaaggcgacggtcctgacagcaatgacgagtgggctcaagctcctcctctcaagccatggcactaccgagctcctcctcctcgagttccctcccttggttgtgagctccacaactctcctcgctaagctcgagctccgcctagtgcgagtccacgtgcacgtggctccggcaacaagcacccccttctccgagcgacggcaaaccaccaccatggcaccaagccacccctctccttcttcctgcctccactcaggcatgaatcccatccccttttgttgagctcagagaagacggggtcagcagcgagcttgatgtaaccggggcggcatccaactccatggcagcatcgaatcaaagcaatccccttgctgaggtcaaggaagatggagtcgtcggggtggcctcatgcccatgacgagctccacggagacggatccgcataggttgccattggtagagcgccggcggcagcagcaatagctagccgagctcgtggagccccttcctccccctccctgttggattggccctggccaccggtgctctctcctctgctcaccgagagagagaggctgagaaggagggaaaaaaaagagacgctgacaagtgggccccattgttttttatttgttttctgactgtatcgcgacgtgtgtgccatataggctgaaaatcgtatcgaatagagttacaatggtaatttgtccggttttaagagtttggggtgtcaaatgttctgtattgtagtttagggagtaaatcgtactatttcaatatttcgggagataaattatggggtatatatacaatacagtacatatgtccgcgatagaagaagtatttgaaagtgttttaaaccagagggagtagcataaaacctgctgcatatatatactaatttttattgtatattttgtagtaatgaatagtattggagcaattgatatcaattagtagtacgtactatatatttacatatctatctatgcagttagttttgtttcgtgaatacatttgaatccttaatttactagcttgcatgtgtgcatgccagttccaaaagctgaccagtaattacctggaagcagcggaatggtaccaccggaatcacaagccgagcttcaacgatcaggtggctctgggaaccgcaaccacaggcacaagatcgcttgctgccggcctaatgcttggcatgggtgatgctgcaacaacaaaacaagcattccagtgggctgttactagcactgacgccatcatctcctgtggaaaaattgggcgtttaatgaatgacatttctggattcaaggtaacagagagagttgaattaatttaatttactgctggagtagtattttactagttaccaagtaattaattaatctcaatttagaactccatgtcaacgagagagctagcatcaggtttgacagaattttccacttaacataacgctcggagatatcttaggctagtgtgtaaggacatgcatgtttgacacggctagcttcgaatccaatttttttaaaagctagatattttgattgctatctagctctagaaatccatagagctttaactatgtcgatagcatttgaattaattatcctttttcttgccattttcaaatccggtccttattgagaaatatatatagctttcaaaacatggtgtatttgtttctgaaataaaaaaacgcaagtactccctccgtcccaaaatataacaacttttagctctcaagatttgtcccaaaatataacaacttctccactaatccctaaccaatcacaaccccccaccattcaatttttccacttaactccactactcaaccaataataactctccaccattcacttatatatactttcttaataactgtgccaaactctaaaaatacttataatatgggacggagggagtataagggaaggacctaatattaaataaataaaaggggagaggcttcgaacccaggccgtaccaccttatgagaactctggccgtttctctatttctttctgaaatataactgtttaattattaatcactattcatttatacggatgcgcatatgcagcttgggtcgcagaacaaagctgacatggcatgcgcagtcgaggcctacatcgaggagcacaaggtcacagccgacgtcgccatcgccaggataaacgaggtgttggaggacgaatggaaaacaaccaaccaggctcgcgtcgaccaccgggctgttcttcctgtggtgcagcgtatgatcaacatcacgctgggcatccagttgttctacggcaacgactgtgatgctttcacgttcggcaaacagcttcaggaggttcttgaggatctctatgtcaagcccatgtccttattatagaggctgaaactaggtgaaaccccgcgcactgctgcgggaatttagtataaagatatacattgaaacattatgtgagttatgttggatgataatttaacatgtttgtgtttgaaaagctcttaaattataaaaactatgaagatatagcatgtttgcatgatgtttaaatgtgatgattgttagtggatgatgatgtggcatcttgttaattagtgaatgatgatgtggcatctttgcatgaagatatacattaaaacattatgtgaattatgttggatgataatttaacatgtttgtatttgaaaaactcttaaattataaaaactataaagatatagcatgtttgcatgatgtttaaatgtgatgattgttagtggatgatgatgtgacatcttgttaattagtggatgatgatgtggcatcttgttagtggatgatgatgtggcatcttttaatgttaagcttaaggagttagtggggataactttacagtaagataggattagttattgcatgcatgggaatgattaatgccaaatatatccatctgtctcgtagtttgctcaatcagtaccatatatatatttttttatctaattcacatgatgatcgatgtacgtgtccatgaactttttttgggcagcaactttcctctatttatctatatggacaaataatgctagtgttagctgctaatcacccgatcgaacactttgtgcgcacaaggcacacgtccggcacggcaacagacgagaagactgaagaatgctaggagaaattcagaacagataaacagagtatttcagagtttcagagaatcatgggagagagagaatttgtggggtaattttctggtttcttccattcaactgaattgtaaaaacttacaaatggaaaacttagctactgctacttatactccaataacagaaaaaaggaatccaagcctacaattgcgccatcccacgatccagaactcctggatccaatgccgtgcaaaactcacgcccacaacgcacgcctgacgcggtcgtcgactcctgcagcgcaccacatctctcgtgcacgcataacaaactcaaacctgaattattcatccagccgttgcaactgccacagtctggaacaccttggggccatagctgaaataacagtcaacaaattcccccttaattctgctatgacccaaaatcacgaacacctagcaggtgccgtgctgtcgccaatctcgctgttggcaacccagttaacacatccgcccactgctcctcagtccggacgaactcaatctaaatcttcccactttcaacacactcccgaatgaaatggtagcgggtgtctatgtgcttacttctcccatgaaacacaggatttttcatgagtgcaattgctgatttgttatcaacatacaacttcaccggcctagcgtctgcaccaatcatctcaatcatcaatcccctgagccacaaagcgtgacaagctgctgcagtggctgcctcagcctcacaggacgaaagtgccaccgttttctgcttttgtgaacacgaaatcagactattgttgagataaaatgccatatcgctagtactccgacgatcatcactgtcaccagccagatcactatctgtgaatccgatgatctccactgcacctttaccaccagcaaacgtgagccaacagttgattgtacccttgaggtacctgagaattttcttcatcgccttgaaatgcatcacagtccgatgctcgatgaacctgctcactacacccacagcataggacaaatccgaccgtgtatgcaacaagtaacatttttttgaacagtttaaatttgaatttaaaaatatgacaacttcaaacaacattttcaaatactaaatgatttcaattgaaaatgtcatcaacaacaaagttgaataactcatcaagatctaaaacttttatttttgttatttattcatccgatgaaatgttagtaatattattcataaattttacatatatgtgttatagtttataaaaccagataagagatatgtcaattttgtgaacaatgttactatcactttgtcgtatgaagaaatgaccaaaataaaagttgtagatcttgatgagttattcaactttgtttttgatgactttttcagttgatatcatttagtattcgaaaatgttgtttgaagttgtcatattttcaaattcaaatttaaactcaaaaaatgttatatagaaaaatgaccaaaataaaagttatagatttttatgagttatataactttgttgttgatgactttttcagttgaagtcgttcactgatctaaaattctatttgaacttttcaaactttgaatttcaaatttcaaattgtttaaatagagtcaaatggagaaatgaccaaaataaaaattttgcacctcgatgagttctacaactttggttttggtgacttttccatttgaaatcatttagtaaccctaatttgatatcttggcctagggcataataggattaatagaatactcataccaacatgttacaactactttttcggaagccaatcttcaaagaactttgatgtcaagcgtgcttggtctggagcaatttcagaatgggtgaccgatcaggaagttcccgcgtgggtgcacacgagtgagggctagccaaaaaataaaatttttatttttggattatactcatctgtgacgggcattcacccatgctatagctaatgcccgtcacagataagggtcatctgtgacgggtgctagttgtggcccgattgagataggtaatctgtgacgggctatagtttgactggtcgtctggatcaaagttatcggtgacgggctttacttagggcccgattgagatagaatcatccgtgatggccgtttgtccgattgagataactcttcacatcagtgacttctagcctgtgacggacgccatgcccgattgagatggggcttaccgtccgattgagatgagggtatccattctagtggtggtccatacaagtactaaactgaactttcaacttatgtgtgtatgccgacaaccatcaatcataaatgtttggttcgtatgcggaatccattttcgtttatcattgacaagaattaacagtgcttttccccatagactggttgcaatattatgaatgaaatagccaaatcaactttaaagtctgactgcaacaacttgtaaaaacttatttcattacttccttgaggaatatttcatcacaatatgatgcttgttaatgttaaaaataaaagatataattaatttattcatgggtttggtttagttctagacgttctttctctcctctccaattctcaacttatactttgtaggtcgatctgaccaataggtgatggtgagagcatatgagaatggagctggcctaggtgagacctgtgcaattcattcctcaatccaaaacttcttatgttgcttttcttaatcctattcacatgaacggcatatagcatttttatccattaaagggtaaatttaagtatagtagttagcagtcattttgttatacgatttaaagtcagttttgtggttttgttatgcagaagagtacttagcagttctttattaaagttgactgttatgcatagtattaaagtataattgatatatggatggattttgtttgaagttagtaacaaaattagtaaagttcaggggataagagggttgttgacactgaaaaagttgtgtgatgtgcaactaaataggtgtccatttaaattgaaatttatattctgcatactggggcttaattcctcaaattatttttgtctcacagatgcctaggaggactacattcaggttgctgcggagtattttggtttgctgatttcgacattcattttggtgagttacttgtggctcgacatagtgtggacttggccagtgaacctagtttcctcttgtggttgcatttggtcagttaacataggaccttattttgctatctaggatatggtggaattgctaaaaccaaacctagtttgcaattgtagctggatttggtgaagatgtactaaacatgttattattttgctatggtctgtactgatatgaggtcagtgatcacctgtatatgtgaatgggctttgattgtaagtactggtttgataaatggacttgtgctatattgaatgttaattgggcttatatatactctgttaaatggttgttatatctcaagcttatgcaagcttttgtaatgggcttatgagctaaaatagtgtttaaatagctgtcttatatgggtcattccaatatcttattggacctataattgggcttaacacataaacatattgcctcgtacatggaccataaataacaataaataacagcccacaagaaatttcatcacgattaatatcgtcacaattaacatgccatgtcagatgggacattgtactacaattttatgatgtttcttgtcctacatggcaactgcaagcctagtgatttgtgacattttctaggcttcgtaatgacgaacatgagcatcataaagcaatggtgaaagaaggatcgtttctaggttaataacaaattaaatacgttttcgttacaaaacatgattagagaggcatgataggtgacgatcgacttttcgtcacgcgatcatcacaaagtttgaaacgtgacacaattttcattctttgtgacacaaatgaaacgtcacctagctatcataagatctcttgtagtgtgggtgatagtgctcggtaaaaatgtgagccccagttttctaataggtgccctttttttaaaaaaaaatcggcacttatacttattttaaaagaatcgtcacctataatacaagtatatgtgtcggttctatttaaaaaccgggagtattgatgccggtttttctttagaattgacacatatattgcttaaaggtgtcggttctactttttttcatcgtgctgaggtgagaaaatgctatatttgccggttttaaatgaatcggcacctataaggccggtccctatgtgggttttttaagtagccttaacttctataaggcacacaaccataggtttgttcaatgaataaaaacatacggtgatgatggaacaaaccctcaactccatcttatttattaagtagccctaaatcacatagatttagctagcaattttaagagtatagcgccaataaatacagtaatattatttggcgcacatagataaaaaatagagcaacccaccatgataatcattatgagaaagatggatttgcattacccccatttgggcatgcagtaactaattttggcctctatatgggcatgggcttgacatagagattctcaagaatctcccgaagttgctcgccgaaagtgaaagcatcactgtcatagccgtagaacatcgggatggccatcgttaagttgataaggcgctgcgccactggaagaacagcctggttgtcgatccgagcccggttagttgttttccactcatcttccaccagctcatttatcttggcgatggcaacgtcgaccgtgaccttgtgctcgttgatgtaagtctccaccgcgcatggcatatcggctttgttctgcgacccgatcgagctgcaagcaattcatatgcacgcatccgcgatatgtaagaggctataattaatttagaggagggatataacaaaagtaaacttcagagaggaaaaacgcacaccatgttttttgttttgtttgaaatagaaacagagaggaaatctatatagttttagtttctagagctagaaacagacaatcctaagaaatcttagatctgaacctatggtaaaatatggtccagtgaagattaattttgtcaaacctattgcatggttatatatgttacattattactctcaaaacatgcatggtgatttctgaaatttacttcctaactaaaatactacaggtgaatcaattcgagcctatgcatcgatcgattaattaccttatatccggaaatgtcattcatgaaacgcccgatttttgcacacgaaatgatggcgtcggtgctagtgacagcctactcgaaagcctctcttgttgttgctgcatcgctcatgccgagcattacacccgcagctagtaatcgcgcgcctgtggtctcggtcgcgagagccacctgctcactgaagcttggcttgtaattccggtgggaccattccgctgcctccagataataactagacaacttttggaactatgcatatgcatatatgcacagaacatattaaattaattaacgatcggaatgtagctatccatgaaacaaatgaactccctcagttttaggttataagatgttttgactttggtcaaagtcaagatgctttaactttgaccaagtttatagtgaaaagtactaacattttcaacccaaaacaaatttattatgaaaatatattcaattattaatttaatgaaactaatttaatattataaatattattatatttgtctataaacttagtcaaacttaaaatagtttgactttgaccaaagttaaaatgtcttataacctgaaacggagggagtactagctagctagtaattgatattgttccaatatatactatatattaattacgccaaatatacaacaaaatatagtgtgtgtgtatatatatataggtaggtaggttttatgcgtttacctctgccttgttgaaagcaactaggtacctcttattgcttagcatttgatcctcaaactccctaaaggtgctcaacattatttcataaaactttctcaggtattctggtacaagggagacagcgctgtcatcccatctgcatgatattatatatattagtcagaacggtattaattataagttaatctgtgtggattatattttcaaatgtaaacttaacaaataagttcaaacaaatggtctaggtaatacaatactagaagaattttcttgtagaaaatatgtttcttgaagctagcgtggaataaaccattacacaataacatatactgcgaataagttaaattgaagaatagaacatatgcccttaattaactagcgcgaggtgttaaccagttaatacatatccatgctcaaatatcatacaataatgagtatattaagattatattgagatcgatgtgagacgtagaaataccccacccttgaatggctgcgtttagtgtccggcactcctcgatggaggtaaacgcatagacatcatatgtgtcatctaatagggtaattatcacaactatcttagcaaagagcatccgtgcaaacgacaattcttcctcatggtacactgcgtaggaccaggtgtagcactcgatcacacggtctcggatgtggtttagacccatatatccagaaacatctttccaccacctgaaaaatagttattccaagttttcttatatacataattaagctgacgaactaattaaataggacgataattaacaacatatatatagggaatctatctagcttggacaataattgcaaactaaaacctttattaattgttgtcatcataatttactaagcggtcagtatgatatatagcacggtacatacatgtatcccataatgcttaaaaaatatatttgtcatatcagatcgatttctataaaatgtgcaacacattctctccatagtgcgattattttctatatctttccgactattctggagctacctatgatctatcgatgatatacatatttgaatccattggcagttgtaacaatttataataaaagattgtcatttgtattgattttattgcatatttctttgagttttgtacagctagccatgaactgtcattacctatccttagatattatccttatacaaaataacaaagttattatgcatattagtacctagaaatttccttaagctctttcaagtgaacatgttgcaggaggttgaaatccaactttgctagttcaagaagaaccggattgtgcccattgtcttggtcatactcaaacatataatgtaacatttccactctcttgagagtccttggcagtggcaagcgaatcgcatgcttcacttgatcagctaaagggcccttcaaaacactatcccaaatcattgattcgagatggttccttgcaaaagaaatagtttcctcgaattctgctcaccatgtatgaagagatgggctgcgttgtataacgagattagaccccttgggtcatcagctaattcatttaagaaattaccatcatctcccttgaatttctggaatacatctgcatgtgagatttgatataaaagtgtttgtgaagttccaacatttagcttggcatgttatgctcaatctctttaatttgaacatttttatatatatggtccttgtgattgtaatcaacagttccaaaacaactatactcaatccattaactaagtagagaaatacctggagatacccaaaaaccacgctccctgagcaaacgaaaccgaagagcaacctcgtggaggttagagctagcgaattcgctttcatggatgtcttttagtgcagtttcaatctctttttcaaagaggtgatcgattcccagatgcactatttcatccactaagtacatccttcttaacatgtccttagagggtgtaaatagtgtgcatacctcctctttcaatttgttggtcctctccctcatccattccgccgattgctgcatgaatgtgtattgatttgttagtttggattgcaggacaaaaaaaaagatagacttgaagattcatcaaaagcagtaacaatagtttagatgcaatatatgaacaagggaaacataacaattagagtaaattgtattctcgtacaagaacttagcaggcagttgtcatatagtacaacaacttgaaaaataagcatgctagtacatggacttggcaatcacgcgcgtttgtcaaaaataatgttaccgacgattcattctgttttctttttctatattctaaacatatcagctagattgtttgtattttgcagtgttcattcttaagatatctttgaggagttgaattacttggaaattatgttagtttgcatgttctgagtcttaaaacaatagtaagttgtgaatcatgacttaggcaactggactggagatatgaatcaatgaatcatgagaaaactgcattgtcgatacgataaaatttaatatattgttatgcaggagtgtagcacgctgtgctttctttccttgcacatgctagcctcgttgcaatgatgaacactaccaatcaaaagcaaaagctgcagaccttcgtcgacatggcgtgcttccatggctaaaagactcttatgtgtgacatatcgatcctaaatgttcgtgctagctcagttgctgaccaatatgctaatttttaaagttttcactggatcgcatcatatccaccaatcaagttcatgtaatctagatgcaaattactctaatggttaatattgcatgcaataggataagtttacattgaaaaatatatttcagttgtgtaagttaattaatttgccatacagagctcttatgtatgatactcaacgtattgttatactcatctctgtttcatttaggtcataacatgttcctaaaattctgttccatgccatcttatctgttaattagcgcttcattgttttcgaaaatgatgaaattggtaatatcttgcacaccgataaaatggaacatgccacacatttttcgtagtgttaaccacgagatgctactttgatcacaatatatttattagagaagtttaaaaaatgattcaattttacgagagtaatttgcatttatgtatgacaaatttattagaaaagtttagaacatttatgcattcatttgtaatatataaatgcatttgaaacatacaaatggtgtatacatttgaaagattttttaaacttttataacaaaaaataagaatggtgtgtattgtgtatgtacatcacgtacacaagataaatgtatatatatatacgtacacaccatttttatgtttaaagcatactaatttatattaaagcaaatattaaaattattgaacgagaaaaaatgagtcttttgctgatttgcctacaatacaaaaaatgaaaatgttctctagtcaagtgagtactccctccatcccaaaatataagcatttttggctatgaatctggacaactgtgtatctatattcatagctaaaagttgttatattttaggacggagatagtatatatgtatataggtagtaatctagattactacctattcaatggtaattggttacttcctccgtttcatattataagactttctagttttgcccacattcatatagatattaatgaatctagacatatatgtgtgcctcgattcattaacatctatactaatgtgggcaatgctagaaagtttttataaccttaacggaggttgtggagattatgcatttcttctcaacagtttgatggattattgtcactgacatcatcaccagcacccctacttcatcggccctgacgtctccgccgttgctaaggggtgactacatcctcgctgtcggttgcttttgtcatcatagactttcatcgctgacttgttatttcgtcttcatggttggcctactacgcaactgccgatgggagacctcatcgttatcattgactgctacactgctattgactgaatcaatgatatgatcatcttcatcaacatcctaccatgcctatttgcctatgcctactctgctgctgttgatggtcaacttcgtcatcacagccggctatcttggttgccgccaattgtcattatcgccgattgcatttgccatcgccaattgttttcttcttttgcatgattgatggatttcgccattgctattgatgagcgtctacgtcttcaccaccggcttgcctctgccaccgcccatggtgtcatcgctttcaccgctggcttattatgcctctactgatgggcgtcttcgtcttcttcaccgggcacctcgtctgttatctactgtttatttcactgccatggctgcataactctgtcgccgttgctgggcgccttcgtcttcactgctggctgacttgactgttgccaactggtttcttcgtctccatggcaatgtgacttcatcacctttgattggtgtcattgtctttaccaccaccaacatcattgtcagctttgatgggtgatatcatctttgtcgacgggtggtaccgcgactagggtatttggatagtttggggatcgttggtaccagggtatatgcgagattaaggtaaaaaacatggggacgaggatttttatacaggttcgggcccctgaattgtcaggtaataaccctactcctgttggccgaagtcggtcgttgctcttattcactataatcacactagtacaatatttggggtagcctatctaactgttgtcgacttggcggtctgaagtgctgactcgtagtcgacaacagggtagccttcctcctcgaatctgcatccgacgagatcaaagataacgctatgtctctcctgacagtatccgtagacaccgtaggggactagccatgcttatctctgaaatcgatatccgccgtcttgtcttggcgcatgtttgcttgtatgttgatcttgtgtcttgatctattgttccgtgtcccctctcctcctagggggccttgtatttatacccataggtgtccccttgtcgaagtagaactagggaaaccaatatggatacaatccgagtagtccttgtcgtttccatgtagaactctattcatccttccttatgcgaaactcctcctatatccgaaagttgtttccgtataagacatggtatgtggtgggtcttattgagatttagtcaactaatattaggtatgtggtatccataaccctgacagtagccctcgacttcaatgcaaatgaatgagttcatattctccatccgaagacctcggaataactgttatcgatctcacgtgacctttctcggtgagttcagagataacgttagacttcccttatcatccttgtgcgggcaccgtatagggtttgtctgagtcaatctctgacgtcaactaggaatgtacagagcatacgactaagtctcccgtcttgctgtaatcgagaatttggattgaagtcaagaaattttatctcggcggatacaccatctcttcattccgtattccttgtcgagatccaccaaccattctcgagtgatcgatgttggtatttcttaacgacgttactagaaatataattctcagcaatgacgtagaaatactccaggtatattatggtcacagagtttatccgcaagcgcacggatataccattgtagcatttcacccgagagtattccaagggtattgtatttattttatcccgtgggaagatcatgtagagagaactcaattaataatttatatattacttgtgatatttatattctaagcaggggttaagataatcaaagggtagagtgacacacaagcattactactcattctcataatatattatctgagttaagtggaaagaaaagagaaagaaaatctattcctatacttctaatatacatagtatacatacattctagttaactgatatactagctaataccctctatccgatgccctcctagtacttcgagaagccacccctgactgccgagttacttacgacagcccgtcatgaccatacaaccggggctaaatatggaggaataccctccccagggaattaactttggattataaaccggcgtggaggaatatccgtacagagctgtcaccatcagcggcccacctctcatccgcaatatataaccctaaataatgatatcccgtaatctagacaccacgtctaaactaccagatactactctaatatcatagtcatgacatagagtaattgcataagcaaacattatacccacaccaaagcatctcccagataagctagccatatattcagtataacatgaacataatgtaaagtaggtactcatatacttggaaagtatttcaataccataaatgtatttagaagagtattctaataaaagtacaaatcttacaaaagagaaaagaaaagctactagagccatacccgaattcttccgaaggcttccggactcctgatttctactctattcctattccaccagctagatactactaaactaaacttgagagaaatgagagagctattgcttgaggtgtgtgagtgaagtgagaaggtgaagtccttttatagctgaactatgacggttgtgacggttggaatggtcggtaataccctccaaccgtcattggggcttcatctcaaccgtccagccaaaacctggatccaacagaggcgaggaaggttcggccgaaccaccaggttcggccgaacctggtgctggcccgatccagcccaatttcggctggtggccttctccgttgttcttctccgcagacttgtgaattttggcccaatttgttgtgtcaattctgagttcttggcccattcatacataagtctggttttcgacatcgtccgattgatttatcgtttgagttgatgtcgattctcctccactttattgtcattctctgcaaaaggttagtatacctaatactagtggaatattattattctaacaaacatatgcattgcaagcatcactagttctcctctattttggtaatattaacggtcgaaactgatcgataacgaccgtcaacaatcgagaaggggcagagtctgcgacggagccttgtcaacatttgtcgtactcgccttagtcgatcttggtatagaaccatagagacatggagtctttgacaatgtcgaatagaattttcctgaaatcaattcttagaaaagaatattagatagaaatagcccccgagtgaacgctcaaagggtgacatgttataatatgtatggaaaactgaaaatgaattaaatttacagaccaatgttttgtatatgagcgtcttctcttttaccgacttcgataagtcagtttgttgagtcatacactctccctagcccccagccttgtcatcagagataagttctcgaaggataaggctcttggacccttgaccggccttggttgaaaaagcgcttaccctagcccccagccgtgaagttggaaaacccaatttccgattaatggcttggttaatacgcacggtgagaactcttacatgaccagatcttacatggtcattcgtctctgcattacctgacaaggccttatccgctctgggcgtccccagtcgaagttcccttaggttcctcggagtccttgctagggcggcgtaaagggacagtaggattggtttcaactctaggtgttgtcgtggtaagggatctctgggtaaaacacttggcgatattgtgtacctgatatcaactttgttggagtagaggtaatgggaggatcgctacaccgctggttgaaaaccagttgtagccccaactcgaccacttgaagtaaaggtagtgggagaatcgctataccactggtcgaggaccatgtagtagttgtaactcaaccactagaagtcgatgtagtgggaggaattgctacaccgctggtggagaaccaggtgtagccttaactcgaccacgagaagtaaagctagtgggagtatcgctacaccgcttggtcgaaaaccagatgtagccttaactcgaccacgagaagtaaagctagtgggagtatcgctacaccgcttggtcggaaactaggtgtagccttaactcgaccacgagaagtaaagctagtgggagtatccctacatagctggtcgaaaaccaggtgtagccttaactcgaccactagaagtagaggtgcgagagatcgctacagcctactggtccgagaaccaggagtagcctcatccgtttgccgattgatgtcgaggtacgagagatcgctacggcctactggtctgagaaccaggagtagccttatttctcgaccaattgaagtggtgcgaggaccactacgctactggtcgaagaccactcatagtcgtacctcgaccatctgaagtcgtggtgcgaggaccgctacgctattgccgtagtcgtacctcgaccatctgaagttaaggtgcgagagattgctatgatttactggttcgagaaccagcgagtagaattatctctcgaacaccaatgggggcactagagttggtttattacatgtgcatctcatgtggccagcatgactcacatacccaacttgtagcatatccggatgtccgtccgcaatcatgtcgggtgatcaagccgacatcgttcgcgagcaattatccgttaacaacccttttctcaaatagcccagccatagccggtgctatgagatagatcattggtcttcgttggtaggttgggtgcgacaactctgcatttgtcgagaacgttctcgataatggggtgtgctcgaccacaaactactcgagtgctcaattgttcctgaaaaatattgtctagaagacaagatatatagcaaaaaatatcgagtatgtactcaaaagactgcatgaatcttctagtattatcagggtataacgagcagattaaatattagacattatgtaaaccgtaaaaaagcatgatttatacagaagaaaatagaatgagcccccagcattaaaccgtagtcggcctaatatagggaatgcccacataatagatattgtataaagaacatgttctaggtaaacataataaattattgatctgataatattgtatgatctcgaaaataggtacgataaaatgtaaataaaatattgcgtacctttttagatatatgccggatatatctacggaattagtaaattaatttaaaaaatcaatttagtaaatacctatgtatttatatggtggcttggtggacagctgtatcagtagaactccattgtggcctcgtgtattgcctctgtccatgtctcggaacgcctgctagttggggagtaccaatgcatcaatgcatctgggcttgctggtagtcttgccggggtctgttggtaacaatggacggacaggaccaggcaaacgtagcagaatccaactcccatgaaactaacatgcgtagtcggatggctctactcatgaactgataccacgtcacatactttgtgatcgggcattgggatatgcttttatccgattggtcgaagagattgctggcctggtatgtttgcattaacccagatgaaaacatgcatggttaaggctccgcgcacggctccccgatgaccacaagcacatcatcattgcttctctgcggcgtcggcatcttgaattttgttgatctccataggtcaaattattgacggcgatagctccgatcttgttggaagacatactccggttgggttagatctccccacaaccgaagtcgtcgagtagcttgttgttggagaattcatctcttaaacccatctcgtcgtaaccttgaagcaccaagaccccctacctagcgcgccactgtcgacgcgtggtaccgcgactagggtatttggatagtatggggatcgttggtaccagggtatatgcgagattaaggtaaaaaagatggggacgaggatttttatacaggttcgggccactgaattgtcagataataaccctactcctgttggccgaagccggtcgttgctcttattcaccataatacaccagtacaatatttggggtagcctatctaactgttgtcgacttggcggtctgaagtgctgactcgtagtcgacaacagggtagcgttcctcctcgaatccgcatctggcgagatcaaagacagcgctatgtctctccagactatatccgtagacattgtaggggactagccatgcttatgtctgaaatcgatatccggcgtcttgtcttggcgcatgttggcttgtatgttgatcttgtgtcttgatctattgtttcgtgtcccctctcctcctagagggccttgtatttatacccataggtgtctccttgtccaagtagaactagggaaaacaatatggatacaatccgagtagtccttgtcgtttccatgtagaactctattcatccttccttctgcagaactcctcctatattcgaaggttatttctatataagacatggtatgtggtgggtcctaccgagatttagtcaactacaattaggcatgtggtatccataaccctgaccatcttcatgttggtcatttcgtctccatgccgactgcgtcagctaacatcaatggacaattgtgactacaatagaaggataagctacatgcttaggggcacatcaacacaagcgcgaggattatatcttcaatttggacttgttccagatacattcaacatggattcatggtcatgagtcgatttctcatgctcaaacgattagactattcattattccccacgagggacatcagctgagtgcttgcactagtcgggattcaattatcacatctactttggtattcttcatgagggataattacgcgatctacatcacccaggatatttatcacttgggatcatattaattggtgtgttctatacgtcatattttaagggtatcggtagatatattttaggtctaggcctaatatgtctgcagcccatattttcaggtgtggcctgtcacgtttttttagggactaaggcatttttttgcttaggcaaaagtgcgcgtgattaagtgcccaataccttaaaatccttttataccgcagttactcaactttttagaagttggtacaatgcattttaaaaggtgccgaacagtgaagctttatatagctaccccgctgactttttatatagtcaaggcattgtttggttttataaagcaattgattggatacaatatcgttggtttttcgccacgtaagtgtgtatttttattaaccaatattatggcttaggctgattatatattatggtcattttccaggcggttggtaaatcctttatgagtttatttactcggatttttcaccacatgtgccatacatttccaggtgtggtaaaaccatgtgtcttttagggacttaagcacatcttttaaagcagtgtgcgtatggtgtgtgcccgatactttggaaatttctttattcacaacatacaagcttctttatagctgttctgctatgtgaatcttcaatgatgaagtcaactttagcttgcacgcatcatattttacaaagcagtcggtatatcacttgtatcatgttattcggggattcacactacatatgccatatattaatatcaagtcacttggttgactataattatcgaaaaccactcagttggttggattatttactccttaaatatatgttcagtttgttcaactaaccacatagtcgggggctacacctattaggtgcatctaatcgatgcacctaagattacatttaattatttctcagccctccacagtcttcagatttggtaaaagtacttgggagatcttggcggagatgattgaagcactcggctttggagtaatctagtttgagagaagattatcttttcaacagtaaaggtctcaggggtactgtggagattatgggtaccccatacacatacggcatggttatccgactggttataggagataacttatatctatgaaatatgtaacggatcatgacttgggtattatgttttcttgtatattatggaatggcctaaagtcctggtttgataatattgtaaagtagatttaggaaaccgataccgtattggttaaggtttctatcttgtaatcttgccccccatcttatataaggtggacaggaggccctctagagtgcatgtgacataaacagttcatcagatcaatatacacccagcggattcaaatccccaaacaggagtagggtattacctctcatcgagagggcttgaacctgtctaaatgcttgtctccgcatccatccacttttaggtctcgtgcgctaccccttttattattgccgaattcttgtttcggcagttggcgcgccaggtgggggtgcgtcgagtttaccgtcgacgagtgcgatggaacaaatctcagaagttgtcggcctcatcgttgctttaggccgggaagatcaatcccgacgggttcgatgaatgcaatctctctcgctgccgagttctttccttgatcagtttccatgaagagcactgcagcgatcagcatccagtttaatttgtctggcgagatcaaactatcaagcaacagatccattcccaagaatcggcgtcttttctcatcaacatcaaaactcctggcgatatccaatttttagcgtgtttgcttgaatcggagtcgacgtggaatcagccgacccaattgattgagcaattatcttgaagtgttgcactgtcccgtatgcatgtatggctcgtgcatgtacatgtatgcatactcgccaagaagtcatcaccgagcaacaggagcgctcaaacaaatatgcatgcattggttgatatgctacaagagtaataatataatcgtgcaacgatgcatgagctggatactacgaactattccgaatagctaagtcgctttattttctcattaattttatattctcatctgagttatattttatatgctcttgtctttttgacaagattattctacttattgctttctttggcatgtaagtatacgacaatcaagatcaatcggtcatccgtggctaggcgagatggtcgttaacctactgtcatgcacatgtatcacctacgtgggattcacagtagcatgtatggatcaacacacatgatcatccatgccgtcaggatttttgcatgaatttgtcaagggctgtgtgctgccaccatcgctattgatgggtgtcctcatcgtcaccaccggctcgcctcgtccgtaaccgattggtgttctcgccatcacggttgaatggtcacaccaccgttgataggtgtcatcatcttcaccgaccggccatctcgtccggtgtcaactggtgtgtttgcctatacggttggttggtcacaccgccattcatgggcgtccacgtcttcaccgaccggcttgccttcgccgccaccgactgctgtctccatctacatggctggcctattatgccgtcgttgttgggcgtctacgacttcaccgccggcctgcctccgtcgccgccgactggtgtcctcgtctatacggttggttggtcacaccaccgttcatgggcgttcacgtcttcaccgaccggcttgccttcgctgccgccgactggtgtctccgtctacacggctggcgtattatgccgccgttgttgggcgtctatgacttcatcgccggcctgcctctatcaccgccgactggtgtcctcgcctatacggttggttggtcacaccatcgtccatgggcgtccacgtcttctgcaaccggcttgccttcgttgccgccgattggtatctccacctatacggttggcctattatactgccgttgttgggcgtctacgacttcaccaccagcttgccttcgccgccgtcgactggtgtcctcgcctacacagttggttggtcacaccaccgttgatgggcatttatttacctacatcgctggttgcctcagccgcttacacggttggtgctttcattgccattgatggacgactttgttctcacatcgactacctccgccgtcaccagcgggaatactaaaaagctaagtctttgttagttctattctttatatgtattttccttttcctctgcctcactacatcaactggttcgccttgactagtgagtcgggggctaaagatgttatatcatattttttctacaattttcatatatctatcttgattgcttgcgacataatctgagtaaaataaagtgcctatcgagttatggagctctttttccctatgctttccgttttgtttgtcgatggatagttgcctttggaccgattcctagcacccggggctcgttggatggacgaagtaacgcaaggtgctaagtattaatcggaagaaatcaaaagcatagagataagataatttattttctggtcttaacaattgcaaaagtatccaagtagtaaattctgatccgtgaaactttgttccattaatgacgaactcatgtcactcatttgcatgtctgggaagtgcctccgccgactcccgatgcgtgggagcaatgactagtcgggcaaagtgtttaaacgtaaggagtcatcggttcggggagatcaaaattgacaagagaagaaatacatatttataaacattttaaaattcttgaattttaaacattttaaaattcttgaatttttctcgagtattatatttacatcagatactactcatcctatatgtttgttctgtaggatccagatccagatatacataaaagggattcatggctttaagcttatctcctacgctctaggaatggatcagtcagaatcaccaccggcttgccgtcgtcgccgccgactggtgtcctcacctatacggttgggtggtcacaccgccattgttgggcgtcgttgtcttcactgaccggccgctgactggtgtcttcgcctatacggttggttggtcacaccactgttgttgagcgtctacttcttcaccgccggcttgccttctccatcgccgactagtgtctctgcctacagggctggcctattatgccgccgttgttgggcgtccacgccttcaccgaccggccgcctcgtccgtcgccgactggtgttttcgcctatacgattggttggtcacaccaccgttattaagcgtctacgtcttcaccactggcttgccttcgccgccgccgactggtgtcttcgcctgcacggctggcctattatgccgccgttgttgggtgtctacgtcttcaccaccggtttgccttcgccaccgccggctggtgtgctcgccttcacggttggttggtcacaccactgttgttgggtgtctatgtcttcaccattggcttgcctttgtcgccaccgactggcgtctctgcctgcacgcctggcctatcatgccaccgttgttggacgtttacatcttcaccgaccggccgcctcgtatgatgccaactggtgctatcgtcttcacggctggccacgtcgccgccaccgctaataggcgtgatcatcttcaacacaagctatctatttcttctgccgacgagtttcttcacttaaatggctgcatgattctgccagtgttgattggccttatcgtcttcaccgccggtcgtctcatctgctgctgactagtgccctcgcctctacggctggtttataccgctaccataactgatggacgtcatcgtcttctttgctggccgccttatctgacgccgactagcttgttcgcctccacggttgcacgtcttcgtcaccattgactagcgtcatcgtcatcgccggtttgccttcgccgccgcccatggtgtcttccctttcatggctggcctattttgccgccattcaaggacgtcttcgttttcgtcatcattctacttcttccatcgccgactggttatgccgccgtcgactggtgtttttatcttcacaactacgcgtcttcactaccggtttgcttatcttaccgccgacttgtattcacttcatcacggctatgcaactttgtcaccatggtggagcgacttcatctttattatcttcggcaccggcaaactctattgcctctacttcgcaagctttgctacttcaccatccacgacatctacaggagcttcgacatcttggcatgcatcaccaaatatgatgccgtgttattttattacaacaagtggtgttttaatcttcaatatttctactcggacatcttcaacatgcatcttcactcaagcaatgactactcgacgacaagaagctacagttctcgactctatgttcagttgtttcccaactaatcaaagagtcgggggctacacaaatacaagactttcaaaattcgacaaattttatgtcaagacaaaacaatcgactaatcagccaacgagttctatgcaatctacttcgggaatcaaaagttttgctccagagcaggctttccacttcagcaactccaattatttcactggcaattttggcttctccaaagtttctcaagtatcaagtccaagatttaatctacatgacctgtcagggagtttggagttatcgaccaatcagctcagtttcaacgagttggacaacagtttctactttcttccaagtgaagcatctgcaatagctacaacactaatttttactgctacctttataaatcaagaggcgttgcatcaatcttcgtcacgcacatgccaacattaagaaaatacttgagcatggttttcttctcaacagtttgatggattattatcactgacatcatcatcagcacctctacttcatcggccctggcgtcttgctaaggggtgactacgtcctcgtcgtcggttgcttttatcatcatagactttcatcgccgacttgttatttcgtcttcatggttggcctactatgcaactgtcgatgggacacctcattgttatcattgactgctacactactattcactggatcaacgatatcatcaacttcatcaacatcctaccttgcctctttgcctatgcctactctgctactgttgatggtcaacttcgtcatcatagctggctatctttattgctgccaatggtcattatcgccgattgcatttgccatcgccaattgttttcttcttttgcatgattgatggatttcgctattgctattgatgagcgtctacgtcttcaccaccggcttgcgtccaccgccgcccatggtttcttcgctttcacggctggcttattatgcctctactgatgggcatcttcgtcttcttcaccgggcgcctcgtctgttatcgactgattatttcgctgccatggctgcacaactctatcgccgttgctgggcgccttcgtcttcactactggctgacatgactgctgccaactagtttcttcgcctccatggctatgtgacttcatcacctttgattggtgtcattatctttaccaccaccatcatctttgtcagctttgatgggtgatatcatgttcatgttggtcatttcgtctccatactgactgcgtcaactaccatcaatggacaattgtgactacaacagaagaataagctacatgcttaggggcgatcaacacaagcgcgaggattatatcttcaatttggacttgttccagatacattcaacatggattcatggtcatgagtcgatttctcatgctcaaacgactggacaattcattattccccacgagggacatcagctgagtgtttgcgccagtcgggattcaattatcacatctactttggtattctttatgagggataattacgcttgatctacatcatgcatgatattcatcacttggagtcatattaattggtgtgttctatacgtcatattttaagggtatcggtatacataatttaggtctaggcctaatacgtctgcagctcatattttcaggtgtggcctgtcacgttcttttagggacttaggcatttttttttgcttaggcaaaggtgcgggagattaagtgcccaataccttaaaatccttttataccgcagttactcaactttttaggagttggtacaatgcattttaaaaggtgtcgaacagtgaagctttatatagctgccccgttgactttttattagtcaaggcactgtttggttttataaagcaattgattggatacaatatcgttgttttttttgccatgtaagtgtgcatttttattgaccaatattatggcttaggctgattatatattatggtacgtcattttccaggcggttggtaaatcctttatgagtttatttagtcggatttttcatcacatgtgccatacatttccagtggtaaaaccatgtgtcttttaagttcttaagtacatctgttaaagcagtgtgcgcatggtgtgtgtgcccgatactctggaaatttctttattcacaacatacaagcttctttatagctgttctgctatttgaatcttcaatgatgaagtcaactttaggttgcacgcatcatattttacaaagcagtcggtatatcacttggatcatgttattcggagattcacactgcatatgctatatattaatatcaagccacttggttgactataattatcaaaaaccactcagttggttgcattatttactccttgactatatgttcagtttgttcaactaaccacataatcgggggctacacctattaggtgcatctagtcgatgcacctaagattacatttaattatttctcagccctccacagtcttcagatttgataaaagtactcgggagatcttggcaaagatgattgaagcactcggctttggagtaatctagtttgagagaagattattttttcgactgtaaaggtctcaggggctactgtggagattatgggtaccccgtacacatacgacatggttatccgactggttataggggataacttatatctatgaaatatgtaacggatcatggtttgggtattacgtttccttgtatattatggaacggtctaaagtcctgatttgataatattgtaaagtagatttaggaaaccgatactgtattggttaaggtttctatcttgtaatcctgcccccatcttatataaggtgagcagaaggccctctagagggcatgtgacacaaccagatcgtcagatcaatatacacccggcggattcaaatcctccaacaagagtaggatattacctctcatcaagagagcctgaatctgtctaaaaccttgtctccgtatctatccacttttaggtctcgtgcgctattctcttttattatttgccgaattcttgtttcgacagaggtagtaattattaacctccataaaacttaaccgactcaatgcatgacaattatctataaatatttaagcagtacgttgtttgtggttgagaaaaattcacacacacacacatacggtatagataatataaactttcctgcgttggccgaggttcataatggacgaaaaaatcaccccacacggagggcttgaaactgggagcctgggcagcagccggggcagatgacggtgctgcatgacaagacaccacacgcttgctgctgctgcgatgcttaatgcacgcgatgttgttatttccagctgccgcggtagtgctggtggtgttcatccgcacgcaggcagatgcaggcggcggtggctgcgaaatggtgaaagcacacgctaagcggtgagccataatatcggtcgagtatatgatctagatagctctgctaattaatgcttatagcaagttaagttaaccaccctgccacccagcctatatatatagagcaattaatggacatactacttctgctagctagctagctatgcaaggataatactccctctccgtcccatttgaagtagttttcgtatctaattttaatcgtttgtattatttaaaattgttttaaaaaaatgagacactttaagtcacacataaagtaatattcatgttttatgatctaataataataaaagtattaatcataaaatagtttaaaataagacgggcgatcaaagttgacatcgaaacttatgactgcgcttaaaatttgacgaagggagtgattagaatatgttgcccaatttagttaattcggcatagaaacattaatttttgtggtctcaagccggttacgtacgttacgtctcattttttttgtggggtttgaaattaaattctagtcgtaattagcacatagtacttaacctgcagtacgattgcatgcattttacacaactttcctttgtttttctcttcacgtgtttgattttttagcggtcgtacgctgccgtaagttagccctgcaactgcaaacatgcgatgaaccaccaaatcgcagcatgcgtgccaaacctttcgaagttatccaattattgatctttctagtacagcatttggtcagtgatcattgatctggttttacttcagcagagataatttgcgaggacagatagaaaacgtgttaataaacaaatggcaagatatatacaaacacagcacgacaagagtttgtaattggcgtacgtacgtacgttgttgaaccggcaccactgcagaaaccacctttgtcggtgtcggccaaatcccacgatagccccgattttttaataaaccaggacgactaaaaagcacttttattcccggtttataagtgcaacggaactatatgatatttagtcgcggttcacctcatgtcagaggatattaggccgcctgggatctttagtcctggttagtattaccaaccgacactgaatgtacgttggcacaccgactcagcctcccatccgcagtggcacggcatttagcgccagttgacgtggtgttaaggtgtctaagtttagcgccatacgatttgaccctgaacaaaagggtcatttctgaaataagttttggccatggttcgtttgtaaaattattttttgcaaagggtcaaatcatcaaaatttgtgtagaaccggcaccttttaggtttgccgaataaaaaaaaaagccggctcgatgcgtcagctcgatcgagccgagcagtccctccaaccacatccgcaagaaaagaatgaacacatcacacaatcacaaaatttggcaacattcatgcatcacacaatcaaatattcatcaacaagtttacatcactgaatcaaacatcaaacatcattggatcatcaaatcaaacatcaacaatgaaggagacgattgggggtgctcacctgtggcagaagagacaagggagcccgtggggagcccgatgtcgtcgttgccgctgcctgccccctaccggatctggtggcggagagggctccgctgccgccgctgcctcccctcccgccggatatagcggaggggaggttgccgccgccgcggcccgtgagccacgccacttactactgctgcccctcctgccgccgagccgtcaccgactccactcctggccagatctagcggagcggaggcgctacctcccctcccgctggatctattggaggggagggcgtcgccgccgccttccctctggcggccgggccgccgcgggctcccctccagcagccgggccgcagtgggctcccctccagcagtcgggccgccgcgggctcccctccagctccccgctgccacttcccctccagccgccgccgtcagccctctcaccggatctagcggagggaaaggcgcggtcgccgctgccgcctccgccggccagcagctggcagcgctcgggagagaagggagggagagagagagaagatcgtcatggtggggcccatcggtcggctcatccgatgctggctcggctcgatttctacaggtgtcggtgttttaaaaaaaaaacggcacctataatatattataggtgtcggtttttaattaaccggcacctataatatactataggtgtcgtttttaaaaaaccaacacaaaatataataggtgtcagtttttatttagaaccgacacctatacttagttaaaggagccggttttttacgatttcaacccgcaaaggtgggaaaaggcctataggtgccggttttagcactaccggcacctatagtggcaacacctatttgatattttgtagtagtgtgtcacgtctagaaattcatgaaccagaatttttaagctaaatgtgcattaaaacccctttccaggaccaaccagggtacacaaacgataatttttgacgtacagatccacgacttacaaaaatataaaagattataaatgcagcggaaaagataaaggcgagataaacttgaaagcttgactcctgcaacgggtcgactccactctacaggcaatccttgacggcagtgacgataccaacttctctgagaaggctccaactgagaaggactctagctctggtgtggggaagagagagcaagactgagtactacccactgtactcagcaagtcataccgggagagaaggcacgatgcaagatatatccaaagaaggctaaaggctcatttgcataaagcaggcatttaaaagcagtagttgaaagcagtaaaactgttgtagtaaattaagcaatactgatcatcacagtccaacactacaccacattgcaacaggcccaaccaaccacctgaactacaccagtccattaagccaattattaaggatgagactagtcacggtgaatctggttgatcgcccataaccgcgggcacggctattcgaatagttttactctggccagaggtgtacaactgtacccataagacatgattccacacatgtcgtcatgccccaaagtaccaccatggcactgcaaatggtggaatcatgacaagaccctttgcataaccctcctctaaccatccacaccacgctaaggtttcacccccacccctcaacaggcagtgggcagccccctcgtgcgccgcggtgaacccagcagttggacaaccggacacccagccgacctaactccatcatgccctcccttgccaccggtgcctaggaaagggtcgagctatattacaagtcaaacagttacccactcccgcttatggtaataagcacgataagtctcctagggtttcccgtgaaccggtccttaattgccatgggtgcgaccagcaaagccatgcatccacagcccaccattcaatcgcattttaattggataattacggccaatgaaacatggccggatgtctcgagcacgcagctcgtcatgaagctaaatgtctaataatataattatctaattatgtgagctagtggatctaagcatggctaagcattttctaaaccaacatcttatccgattaatacccaaattatcaatggcataaggtgaacaacatatggctgagtaataggacccatcccatatgatattgtaaaataatataacatttaatagaaaacggaacatttgtaaattgagtacatcatgatcatttgtaatgcatgacttgccttgctctcgcactgataggacctcagcaacgtcttcgaagaaccgcagatcgacgaaacggccgaaatctatgcgactaacattggacaataccatgcgatcgccagacaactaccaggtaaacgttctgaaatccggtttgtacgcacaagatatcatattaaatccttagttttcataacccactaccagtgaaccacagcgcagctatcctttgctgcagggtcacagtaccagcgtatgcatgcaccgtgcgatctcgccatctcggttccatccgaccatccatcagcacgttgtggctccgaaagattctctctcccattccccatttccccacccatgctactctcaaatccccaatccccatcccaaaatcctcaccacctccgccccaagaatcctcgctgccgaccggcgccgccgtcttctcgcagagcaagcagtgagcgctacaaccgccgtgttgccgagccagccagcattgtcgccttcttgccttacttgccagcgacccggtgccgcttcgtcatcgtcgagccagcggtgccgctcccttcccttggagccactattctgcgccacctccctgtggagccgactgccgctgtcgtcttctcgtggagccaatataatggtcagcactgccaccaaccatctcgtccatggccatctcctcgcttcttgtggctgctgctcatcggctcctccacacctctccaattggtactgccatcctctactactttgtatacactgatgcttattaggttcattttgttttcctcatattgttgatctatatacctattcctttctgtagtaggtattttactgctcagattagctttgctttgctctctatacaggtatgattcctactaatccataaatatttcttctgatatgcttgctacccgtacaattggcctaaagtgcaaacaacaatcaagttttcctatttctttcaaaatacatgattccccattgtttcagggatgcatgatagttttatatatcttgctgggattccatttgtttagcagccatttgttgttatagcacatattttcattttttacacacagcaaaatatcatgtacaaagagatattggcctgattttttccctatataattgtacgatgtgaccatatgcctatggttagtgcaggatgccacaaaacaatgcaccatgaaaggtcaacctataaaaaaatcagtgtgctacttgtccgcttgcacatgttctatttgtgcatgcacaggaataattagttactgctttggtgtacataagatgattgttttttgctacctccttcagtgttcctaattggcttcatggcgatacaaatgagaagaataaagtgttgattcaagctggaagataatttattatttcatagataatattgatgtttagtacaaaaggcacacaattcaacttgatcgcaaccgcttgctgcagtatgatgccatgattgcttacattacgaggcctatgtatggactgtcaggttcatggtcttcaatcagtgatatatttgttgaactgcatgtgtaacacctagcttttataggttccatggctttgcatatgcttttgtagcatttatgggatgatgagggccttcatttgagtgaatacacataagttgatggcatttcttcattttgtatagtacaaactctgctgttatgtgcaaatgaggccatatgaacagttcatcaccatgaggcttcaattcataataaccatcaaggtaataataaaatttgttctaacatttctgcattttctttcagtaaccgatgtttatgaccaagggagtaaactaccacaagtcttccaggttcttctctctgaagaaaataacacatttatctgtggtaacaccatttgtaattatgagcacaaattatattcaaagtattttagcaatcgtttaatttctttgggatagctcagttattaattttgaaaaaggatgaatgtcatgtgtgcatcctcgccatttatccagtggttggtcataatgcatatgttgactgtgcagaaagatccttaacactgttattggcgctcatcattatttagattcctgcagtcttaatagttccctttgtcaggctatagagtatagtattattctaatttacatatactcatttagttgcaagcgtacaatacgttttgtgtaccaactattctattggatttgtagagctacttttgaaatagaggatttctacagctacatatgcacattctcctatactcttgcagattgatttcaaccgtttctagaaacaaattgccgcaatctaaccattttaggtcagtttggtttcctcaaagttaaaacaaaaaggcagcttagttaaacaccgtgttagcctatgggctactccataccataactatacatgtaaatatcacttacaagatagtcaagattatgttaatattttacaattagttgtcaatccttcacaatcaagtgcatatggaagtaacaaaagttccatatcggtggtggcctttggttaagaaactttcagcctcatctatggatggttttcagaaggccaatttgtatgcaaaatagctttgtttggtttatccgctggccaattgataacaaaatggtttggggtggattgaccagagccttcaacacggttgtatgtggttgtaaatggcgtaacgggcatatgtgtgctacagagcttgtggttgcaaatgatataatcgtttaaaagtttggtaaattaactatggccaaaatctttgtgatggcattcaatgatgttattcggtataagtttgatggaaatattttgaaagcttgaagcttaatatgaatcgtgggaaccttctcctcttacctcacagttttaaatatatatatatttgttatgcccgcggcaacccgcggggtcccggctagtatagcttatttgtaggacaaatgagcagtctctgagtacagatgcggataggtgtccgatgtcactagctgccgacttccgaaaaaaaaaaaaaggtcactagctgcctgcctaatttctctcaggtgaccttgaccggccgtttgactagtaggtagcagaattgtatactagtaaaacctttggtacctaatatactaattactccctcaatttcgaaatgtataacgctattaatttttcgtacaatattttaccattcgtcttattaaaaaatttatataaatatcatttatttcattataacttgttttatcatcaaataaaatataatgttaacttttacttttgcatattatactaattttttaataaaacgaatgattaattattatgtgaaaagttaacgatgtcatacattttaaaacggataaaatactatctattttgtttggtaccaccaataccttctaaaattatccttcactatcagtagaacgtgcagagaacgtccaaggaaatgaaatgtgtgtgggaggcaagcagccgtcgctccatcccggtgagctccagtttgtcccatttccatctgtccactccaattagggactatactccttcggtcctaaaatataataaattttaaatggatgggatattttctagtacaacaaatcatgtactaagaaatgccccatctgtccaagaaatatctacatactgtgttagttaccaatatcaatatttaacctttctctgcctaatatatacggcgtactacatattgagttccaaagtcactctcattactgctagaaagttagaaaagtctaaatctagagtatctcatagtcgtgctgttaagccacataaaattatacaaaaacaaacaaaaaaagttataaatttaatttttatttctctattatttgaggcttaaaaacaggtcacgaagatgataagaaagcggcaagatatttatcttagaaagtaattaaaacagtaagagtaggtacaataagttgcaataacagacattaggagctccacttacggttttggatgacccagaggagagagaagggaatagcgaaaatgagtgggcgacaaattagtcgaccggctcgccccacgcgtggcctgaggttgtgggcctaccatggcaatagtgcacctgcgctagccgcgtcgcaagccatcgtcaccgcggccattgcatgccatcatcgcctgcgtgagccatgcctacctccctcctccactgtggccgccgccgtcacctacatatgtcagaccttttccctcatgctcgttcacgcggctggtgcgatcacttgtgtctgccttgcccacgaccgttatccgcctgcgaccacactcattgcccttgtctatctcggctactccttgttcgccgtagcttcttccatcatcaccatcgcttgcatctgcctcggctgttgctgttgtgcgcctcgccctgtctacctcgtccaccttggctaccgctacactggtggagaaactatctttggtcggtcgaccagatttcacaatagttccggtcgtattaaaaaccgggactaaaaacatctttagtcccggtttaaaagctccagggcacttttcaatctttagttaccaaccgatactaaagatctatttgtagtcccggttgataacatcaaccgggataaaagatcgccatacgctttactcacggttaccaaccgagactaaagatctatttatagtcccggttggtaacaccaaccgggaaaaaagatcgacgtggagatcagagaggcgtgcgcgatcggatcgaggtatctcctcctctcctcctctccttttaactcctctcctcaaccttatctattcctctccttctcctcctactgccaggccgaaggccaggccggcgcgacgacggcggggcgcggtgggccggccggccggcgtggctgtggcgcggcgcgcggtgaggcggcggcctacggcggcggccagcacgagggcggcagggcacggagggctgcgtggcggcggggcgcggagggccagcgggccggcgcggcggcggctggtggcctcgcggcgggcggggcggcgcgcggcgagggagcggcctgcggcggcggtttttttctttttttttttgagaatctgagattgttgtgcgatgtatttgattggatctgagattgttgtgtgatgtatttgatttgtgtgtgatgcgaatatgtgatgaattttgtagaagttgtgatgtaatttttttaatattttgtgatgtatctgagtatttgagatgatcgatttgtggatttagaggcaatttgaggatgattgatttgggattttggggatgggatgggggtgaaatcaatttattaaaaacaatgaagaaaagaaaagaataaagagcaaccggatctggcctctttagtaccgggactaaagatgctttatctttagtcccagttggtaacaactccaaatgggcccaactatcatgccaatgggctgagggcctcaaaattagtgtccacgatgaaaaacgggccaaatggagccgtcccgggttcggccgaaccattttggtggccgttgatcgccaaatttcatgtggatggtcctgatcacatcctaatggcggttccggggtagtttggtcatttcgcataggctgtaaccgtcatacctgcctataaaaggaggagctcactctcattttcaatacacaactttgagctgaattacaagagactgtattgtatcttttgtacattagaataaggtagagagctctggaggagtgcccagaagtttggcgctcatccgacttctacctcgacgagtgtagcttcctaggaggaattctagaggagtactggagctgtcggtacaatctgctccgggttcggagaaacttcttctattaagtaagcattcgtgtttctttcttatgttatttaattactttgtttaagtaagatatgtttccatctttgcggattaattgtttagtatttatactaagtactctagtactaggactccggatagagaaggaagttcttgcgcaagtattagagtagtaattaataacttagacgtggtgtctaagttagagattacctttgtttgttgtgtatgccacggatttgtcagaggtaggcggcatgtggtgacagccctgaatcccgtcctagtaatcctccacgttcggatacatcaaagagctatagcaggaaccacgctggtagaccagcgggggtcggttcccgaagcaacagatagggaattacctttgcttagcttagataattaaaccacatagaaagtcctctctagcctagtctacctatcatcagttgttgtccttggatcgtcttacgcttaggtagattacatacgttccctgagtttgatatccttttggggtcaaccgaagatgaagtgctacagcggtattccgtgcgcttgcggatttctctgtggtcgtaagaaataccaacaccacccgccgccggtcatcccctccgccttcgtcttagccttcgactcagccgccgtgctagtgagatggtgagcggagggatttgagagagagggggggttgagatagaggagagagatagagaggggtggggaactgacagtgggtcccactaatttttttaataaaattactgactggactgccacgcatatgccacgtaggaccaaaaccaccgcggattgagccgggggggttatttgtcctgtttcaatagttggggggtgtagaatgtccggttttcgagttcgggggtgtaatttggtcgacctcgatagttcaggggggtaattcgtactttttctgaaactttatatgtgaattgtagatagtgtccatattcaattttgtagtgtaacgttttttcattccagattgtttatgtggctataaattcgttacaaactttcactattttgataaaatgaatttttgaatttttaaaatgagctcaaatggagacatgctctgtagagctcgacgctgcaagtttatagttgataactttttaatttgatggcccttggagtaaaaaatatatgttacaagttttatgaaggatgaagtcaaatgaatagcatctatgggatagtcaccaaagatcctgggttggaattctatgccatagtaacgaaagctatatgccatagtcccgtgttggaattctatgccatagtaaggaaagctatgccatatatacagtccatgggttggaatattctatgccatgcatagtcgtccccggtcatagtcctttcgttagtgactatggcatagcaaggaaactatggcactgagtgagaggccctgggttcgaattctatataccgcccgtgcgcatatttcacatctaaaattatgtacttgtgattaaaaaaaataaaaaactggaaatcccgtgtaatagaaaatttttcacacgcccaaggttgcgggtgggatcgtaaaatacctatgtaaatgggttatggaccatccgcaaaaatattaatttgctgtagtagcgtcggagatatatttaattcactacaaaatacaaaattgttaaaatttttagtgtgcaatgggagtgttgtaattggatgttaaaataactagctgaatatataccccaccgcgttgctgcgggaaattaaattatgtaatgtgtacaaataagatgcaatataattattaaaacccaaacaaattaatacttataaattttgagccaaaaataattcagattgcatggtgttatgagagaagaaagaatagacaatttgaaccatagatctattatctaaaagctataaataattaggatgatatggtttgatgagagaagagagaaataacattaaccgacacttggtggacgaaggatctcggagcccatgcatcgctatatatagtacacctgctgtagtacttggcaactggagactggagtagtagctattgctagtgcgtacagcacatcgtacggacatggaggacaaggtggtgctcgccatgggcgcatccatcctgttggttgtcgtcgtctccaagctgatgatatcatttgcggcaaagccgaggctcaacctgccgccggggccatggacgctgccgctgatcggcagcatccaccacgtcgtgtcctccagggagagcgtccacagcgcgatgcggaggctggcccggaggcacggcgccccgctgatgcagctctggttcggcgaggtgggcacggtggtcgcgtcgtcgccggaggcggcgcgggaggtcctccggagccacgacctcgcgttcgccgaccgccacctgaccgccgccgccgcggcgttcagcttcggcggccgggacgtcgtgctgtccccgtacggcgagcggtggcgccagctccgcaagctgctcacccaggagctcctcaccgcgtcgcgggtgcgctcgttccgccgcgtccgcgaggaggaggtggcgcggctcatgcgcgacctgtccgccgccgccaccgccggcgccgccgtcaacctcagcgagatggtcaccaggatggtcaacgacaccgtgctccggtgctccgtggggagccggtgcgagcacagcggcgagtacctcgccgcgctgcacgccgtggtgcgcctcacgtcggggctcagcgtcgccgacctgttcccgtcgtcgaggctcgcggcgatggtgtccgcggcgccgcgcgccgcgatcgccaaccgcgacaagatggtgcgcatcatagagcagatcatccgagaacgcaaggcccaaatcgaggcggatgatcgcgcggccgacagcaagtcatgcgcatgctctctggacgacctgctcaggctccagaaggaaggcggctcgccgatcccaatcacaaatgaggttatagtcgtgcttttgatggtaagcaagcctcacaacactgtctttatgttctacttacctccgtttttctaattattcgtcttatttaatttttttgtgcaaatataaaatatttgtgtcatgcttaaacaatatttgatgataaatcaagttacagtaaaatagatgtataattacataatttcgaatgagacgaatggtcaaatatatcttaaaaaatcaatggcgttatacgttaaacaaacaacaaacggagggagtagttacacggacgacgtaccaaagtaccgacaaaaacatctttaatttttataatagtagagatgaagatagacacaaaacctaccatataaacaaattataataatattttttctctcacaaggaacatgattacatcctaattaacctctatacctagctaggatatatacactactacaaacaaaatttttcatgcgggtaatgcgtgcaggtgcacacacccaggggtctgcgaaaattggattttcacgtgcggacgcttatgttgcccgcacgggaaaaaaactgaaaaaaaaaaaccttgaatcggcggcgccgcctcctcctccccgtcgtcggcggcggcctccgcgcaagctcgcctccgcgcagcccacctaccgctggcctccgcgccgcccgcctccacaccgcccgccttccgctggcctccacgccgccggccgccggatccgcgctcccctccggtcagaccaccgccgacgcccctcctctccgccggatcaggggaggggaggggagtggttcccgcgtggggggagggcggccggccgctggatccgtgcggacggctgccgccgccggtccgtgtggggacggccactgcccgccggatcctgcgccttcaccgccgtggagctgagttcgccgcacgccaacgccgactgccgccgtcagcgaagcgcggacccgcaaagtcgttggagagaagagaggcatgagagagagagagagaggggtgaggcgtgggagagaagagaggtctcgcagataaagataagaaaaagagaggagggaggggtgaggagagaaagaggggaaattttgaagtgggtgagagggaaagagggagtactattttcgcatgcggctctcttaataggcctgcacgggaaaactgacttattttcgcgtgcggtccatttaagattttcccatgcggtccttttaaatagaccgcacgtgaaaatgagccgattttcccatgcaggctgagttaccacccgcacgcaatctaaaagtgtccctgtctaggaaaatcattcatatagtagtgatacccaatcatcataaagttttagttcaagaaaacagtctatatatgtagttttagttaagtattctcgaacaaatggcatacttcttagtaatgaattaagtttaggctatatatgtaggcacgtattatgtgcattaggtggtatggataaaaaaattattcaggatgattagtaattgattaaaaaatcattattccaggatatgtttgcggggggcaccgatacatcgtcaacaacactaatatgggccatggcagagctgatccgttccccaagagtaatggcaaaggtgcaatcagagatgcggcaaatcttcgatggaaaaaacaccatcactgaagatgaccttgtccaactgagctatctcaagatggtaataaaggagaccttgagactgcattgtccattgcccctcttagcccctcgcaaatgccgtgagacatgtaagattatgggctatgatgtacccaagggtacatctgcattcgtgaatgtgtgggcaatatgcagggatagtaagtattgggaggatgccgaagaattcaagccagagaggtttgaaaacaacgatatagaattcaaagggagcaactttgagtttctccctttcggctctggccgcagagtatgccctggaataaatcttgggctagctaacatggagtttgccttggctaaccttctctaccattttgattggaagctgcccaatggaatgttgcacaaggatcttgacatgagggaggcacctggactactggtttataaacacactagcctaaatgtgtgtccggtcactcacattgcttccagctgtgcgtaaataccagtgtaacagataatgcatcttccaaaagaccataacagcacaaggtaaaatatgtgctgtcagagacatgtggtcttcgtgatttcaaaataacttatgtgcctgagcagaaaagcatagtgaacctacttatgtactcatgcgtaatatttttttctgccaaagaaattataagtgtgtatttttgtgcccataaatactaggtgcaccatgaaattacatcctatagtaattaaagagctcattgtacttgtatatttgtcgtcctcccagaaatatagttaagcgtgtacgtatatattttcacggacaacatatgctttctttcctatatatcattcattttggtccagctccgaatacatgcgaactccaaggcgcctacgcacgtacggctttcgtttgattgatcactccaagtttctactccgtatcagattgttggtacggactatgtgttatatcgatcactggcctgttgctgaagttaattttgcaccggctatttaattcatatgtatccggccatcaccatcagtttctgtgttctccacggaaggggcggagctagaatgaaatggagggtgatgccacttaaattattttactttagatcgaatttaaactgacgcgggtgcctaagtttgtattgagggggtgcatacatggtgaaaatagatgagtatagcttaaaaaattttcttgaccgggttcctgggcaccccctagtatactctagctccgcccctgctccacagctggcgcctatgctaatgctaccgcgtctcttgctcggcctactctggtttcaagactgtgggatcctcctccatattggccacagatacaccaatattggtggtctcatgtacggttccttattggaggtctttttttttcctctttaagaaggggaagctttgccactcttgtattaacagagaaggagtaaattaagccacaacaagtaatatttacagagcctatctcgaaaacaatagacccgcacagaacaaagcgagacgctactctcctgagggggatgatctctggaagtcttgtggctccatatatgttcgcgcttcctccttaaacttggcagcgatcgtggtaggcatggtggctatatgccggaaaattctagcatttcgctcacactagggcaccaggccacaagagtgatcacagattttaatgctcatgaggacatcactagttataatatgaccgtggctaccttatatatttataaaacaaaagtgtaggcttctatgtaagatttacatttatatatttgaacaaacattattgcaatatgtaatagacccaaaaatgtaaaacctggaatacatgatatcattagtgaaatgggttcccttctatcttttgagattattttgctcctttttggatttttcatgcatccgtcatttcattcatatgcattgaaactaggttggaataattttcgtaattgatctatgtgtgcaaaaatcctggaaaaatcacacaactactatacattatgaaataccctcagctaatttggcattattttataaactcatttgatacctcaaattattcagtcaaactagccataatctagaattaaaacgtatcacctagccctcttctaaactttacagtgaactttaccactgtaaaaccataactcttctacttgtgcctttgtaccagagtgttcatcatcactagctctgcacacagtaatttttaccaattttttactccaatttggcagacaaaggcaccaagtgattcaaatttaggacttcaactctctcattttggtgctttctcttcaactcctctcactttcagtgggccttggcacctcatgccccacctgaaagccttatatatccacccaggaaaaactcagccttctcgccttttcctcttctctcccactccttgtagactttttgtcgaacacgtggcgtgcgtcttcttttggagtagagaacaacaccatacagctttccaagccgagccttctccacgaagcctagctaatagcagtcgctgctggtgggcctagacaccgtgtctccgtacccatcgtccacctcacaccattctccccaatcgttgcacgagtatggctccgctgcgagcctgcgagtagacgaagccgttctgtccaaatctccgtgcccagactaaatcatctcctccattactctttctggacaggaagcaaagcccctgacatgtccagtcatcccgttccatcggcgtgctgcccgagaatggagagacagaggcaaggccatagaccgagctaacgagcaccgtgtccaaactccaccattcggccaagtactataatgcttgatgtgttgccccttaaaatgccacataggatcggaaagagaaggtcagtcacctctcatgcaaggggcaacctccacacaaactctaagaaaaaaggagatgaaagaaagaggatattggacaaacaaataaaataaaattatttcgatcagtatgctagagaggtggtgtttgaatcttctgaagatgaagatgaagataaagattaagtgtttcatgcaaaactaggtggtaataacatgtgattaatttagttttaattattacaaacttgaaaaatggattaatctgatattttagcgcaactttcatagagaaagctttcgcatgaaatgttccgttcagcagtttgaaaagcgtgttacgagaatccaaaattttatcctacccttacagaagaaacgaacggggcctagtgtagatgtgatcgcaactagtgtgctcacaacacgctcccacgcgtcgcccacgcacaggcgacaagtggggcgaaccctactgccaccacggccacaaccctctcacccctccccctacctcgctgccgccggcaaagtcgattggtgagctgggatggcggtgatggggccttctccatggcggcgcttcctctttggcgcgggggaggtggcgtttgccggtgtcggtgagtggttgcggcgaggtctcctggctaggtggcggcagatccggcaccgccgtcgccggatctggcaaggcccttcggttttaggcggtgtccagtgtgcgcgtgggtggcgaagacggcgtgcgcgtggtgtcgtcaacagagacgagatgggttgcattgcggaccaaacaggcaaaggtgtagggtctcgcatgggctgatgatgcaccacagcatcatgcgcagggtagcagaaacgggttgggggcaggttcttttacctgaaacgatatcaggattgcatcgaataatttgtaatgacccgtcgattctaaaattcggtaataagaaaaggggtagagcacgagatctaaagtggatgatgtcgacgtttgatgtctcgagtacggtatttggatagtatggggatcgtcggtgctaggatatatgcgagactgaggtaaaacagatggagacaaggatttttatacaggttcgggtccctaagttgtcaggtaataaccctacatcctattggccgaagccggtattgctcttattcaccataatcacaccagtacaatatgtgggcagcctatctaactgttttcgacatgtcggtctgatggtctgactcgtagtcgacaacagggtagtcttcctcctcaagtccgtgcccggcgagatcagagatagcgctttcgtatctcctgatagtattcggagacaccgtaggggaatagccatgcctatccctgaagtcgatatccggcggcgtgtctcggcgtatgttggcttgtatgttgtggcttctagtgggtgtatgttaattgtcatgggtgtcttccatggtctcctctcagggtggttccccctctcctcctcgggggccttatatttatacccataggtgtccccttgtccaagtagaactagggaaaccaatatggatacaatccgagtagttcttgtcgtttccatgttgaactctggttgtctttccttatccggaactccctccatatctgaagttagtttccgtataggacatggtatgtggtggatcctgccgagatttagtcaactactattaggtatgtggtatccataaccatgacagtagctcccgacttcaatgcaaatgaacgaattcatattctcaaccgcgcgcagacattggagtaactgttatcgagctcatctgaccgttctcggtgagtttagagataacgttagacttcatttgtcagcctcatgcgggcacccaaagggtttgtctgagtcaatctccgatgtcaaccaaggaagtacatagagtacgactaagtcttccatcttgccgtaatcgagaatttggattgaagtcaagaaattttatctcggcgggtacaccatctcttcatttcgtattccttgtcgagatccagcaactgttctcgagcgatcgagaaggcgtagagtctgcgacggagccttgtcaacattggtcatactcgccttagtcgatcttggtgtagaaccatagagacatggagtcttccacaatgtcgaatagaatttttctgaaatcaatactcagaaaagaatattagatagaaatagcccccgagcgaatgctcaaagggtgacatgttataatatgtatggtaaactgaaaatgaatcaaatttaccgaccaatgttttgtgtaagagtgtcttctcagttcacgactttggtcagtcgtttgagttgtacactctccctagcccccagccttgtcgtcggagaatcgttctcggaggagaaggctcttggacccttgacctgccttggttgaataagcattgatcctagcccctagccgtgaagttggaaagcttagtttccgattacacggcttggttaatgcgcacggcgagaactcttacacgaccagatcttacatgttctttcgtctctgaaggatccgacaaggccttatcggctctgggcgtccccagccgaagatcccttaggttcctcggaggccttgtcaagactgcgtaaagggacagtaggataggtttcaacgctaggtgtcgtcgtgataagggatctctgggtaaaacacttggcgattttgtgtacatgctaccaactttgttgaagtagaggtaatgggagaatcgctacatcgctggtcgaggaccaggcagtagtcgtaactcgaccactagaagtggaaatagtgagagaaacgctgtatcgctggtcgagaaccaggcagtagtcgtaactcgaccacttgaagtggaagtggtgggagaaacgctacgtcgctggtcgagaaccaggcagtagtcgtaactcgaccacttgaagtggaagtggtgggagagacgctacgtcgctggtcgatcactggtcgagaaccaggcagtagtcgtaactcgaccacttgaagtggaagtggtgggagaaatgctacgtcgctggtcgaggaccaggtagtagtcgtaactcgaccacttgaagttaaggtgcgagagattgctatgtactggtgcaagaaccagtgagcgagcagaattatctctcgaacaccaatggaagttgcggtgtgagagattgctgcgtactggtgcgagaaccagtgagcgagcggaattatctctcgaacaccaatagaagttgcggtgtgagagattgctgcgtactgatgcgagaaccagtgagcgagcggaattatctctcgaacaccaatggaagttgcggtgtgagagattgctgcgtactggtgcgagaaccagtgagcgagcggaattatctctcgaacaccaatagaagttgcggtgtgagagattgctgcgtactggtgcgagaaccagtgagcgagcggaatcatctctcaaacaccaatggacgttgcggtgtgatagattgctgcgtactggtgcgagaaccagtgagcgagcggaatgatctctcgaacaccaatggacgttgcggtgtgggagattgctgcgtactggtgcgagaaccagtgagcgagcggaatcttctctcgaacaccaatggaagtgctagagttggtttattgcaagtgtatctcatgtggccagcatgactcacgtacccaacttatagcatatccggatgtccgttcgcaatcatgtcgggtgatcaagccgacgacgttagcgaggaattatccgttaacaaccttttctcgagtagtccagccatggctggtgctatgagataggtcgtcggtctttgttggtaggttgggtgcgataactccgcatttgtcgagaatattctcgataatggagtgtactcgaccacaacctactcgagtgctcaattgttcctgaaaaatattttttagaaagcaagatatatagcagatgatatcgagtatgtactcaaaaactgcgtggatcttctagtattatcaggatataacgagcagattaattaaatatcaggcattatgtaaaccgtaaacaagcatgatttatacggaaaaaaatagagcgagcccccagcattaaaccgtagtcgatttaacatcggggacactcgcgcaatagatattgtataaaaaacatgctctagataaatataatataaatctgacaatgctgtatgatctgaaaagtaggtacggtaaattgtatataaaatactgcgtacctttgtagatacatgccggatgtatctgcgtacctttaaattaatcttgctaaatacctttgttgatttgtttgaatattatgcagtcgtgctgtgtagacatgtgttgatgtgcatataccgaataggttttggaaaccgatcagcatatgtacgtacgtcaacatgtaggcctgtggatggatatctcctgagtcctgattggtcggcacggttgtcatgcatgcacgtattccgtttgccaaattccagtcctaaccggacacaagaacgaagcaaatacagattgatctgccaccaagtcgggcttggcattccttggatgggcgtcgcactcgtgtcagcagctgcacggccgggtggaggtcggcgtctccttctcggcggcgatggtcccgatctcgtcgggggatatattccggtcggattagacctccccacagccgaagtcgtcgagtagcttgttgttggagaatccatctcttaaacccatctcgtcgaaatccaagaagcaccaaaatccccctacctggcgcgccactgtcgacgtttgatatcgcaattctggtatttgtacagtatggggatcgttgatgctaggatatatgcgagactgaggtaaaagagatggagacagggatttttatacaggttcgggtccctgagcggtcaggtaatagccctacatcctgttggccagagccgatgttgctttttattcaccataatcacaccaatacaatatgtgggcagcctatctaactgttgtcgacatgtcggtctgaaggtctgactcgtagtcgacaactgggtagtcttcctcctcgagtccgtacccggcgagatcaaagatagcgctttcgtatctcctgacggtatccggagacaccgtaggggaatagccatgcctatctgtgaagtcgatatccggcggcgtgtcttggcgtatgttggcttgtatgttgtggcttctggtgggtgtatgttgataatcatgggtgtcttccatggtctcctctcagggtggttccccctctcctcctcgggggccttatatttatacccataggtgtccctttgtccaagtagaactagggaaaccaatatggatacaatccgagtagtccttgtcgtttccatgtagaactctggttgtctttccttatccggaactccctccatatctgaagttagtttccgtataggacatggtatgtggtggatcctgccgagatttagtcaactactattaggtatgtggtatgcataaccatgacagatgagtaaagaggataaggtttagacaggttcaaaacttctcaatgagaactaatatcttactcctgttttgaggactagatccgccgagtattgtattgatgacacgatcaagttgtgattatgcctttgagaggcccctgccctccttatatgtgcgaggggtagggttacaaagataggaatccaaccggacacggtatatgtttccttatctattacataattgtacttatctaagattcatgagattttaccctaaaaaacaaggcaattaacagtcacaagctctaatctcttacataatccctcactcggtctacctcctatctctagtcggatatccaggccacgtgagtatgagtgtccataatatccattgaagccccgagaccttcacaatcgaggaaaatcttctcccaagctatatcaatcaaaatcgaagtgcttcaacatcctcatctgtgatgaattttgtaaatattatgtgatgtgttgatggattatgtgactccgttcatcctatggatttttgttggctatttgtttcattattttagggattttaattgtgggctccttgtctcgagctagcctcgatgattttttttgcctcccggagggtcctttttgccggttgtcaagactgcctttgtttcatcacgaggtgaattattagcatgcaattaattatgtattaattatttcaagtttataaaacatattaatatgattttttaaactaactttttcatagaacattttaaaatacagaccaattaatagttcgggaaatgtgcgaaaagtttgaaaatcttctctcttgcttgtaggatcaaatgcagacaagatccaatacaaaatcactactacagaaaagggttttagtgccggttggaaaacccccttcggtgccggttttcccaaccggcacaggggaggcgacactgatttgaaaataaaaaggtgtcggttccgtataaccagcaccttttaggtcgagaatgctctgtattggtcgacaggggggagggggggtgtgggaaa

SEQ ID NO: 80070 - DNA, 1920 bp, Oryza sativa
caaatcttttagtttaaccaagtttatagaaaatttagaaatatccacagcaccaaattagtttcattgaatatattttgatagtatgtctcttttgtgttgaaatgttgatacatctttttataaacttaaaatgtttgactagaaaaaagtcaaagcatcttataacactcttttgtgtcgaaaatgttgctgaatcttttataaacttaaaatgtttgactagaaaaaaatcaaagcgtcttataacatgaaacggaaagaaatacataccccaaaagcccatgtatgtaaaaaaggaaaaaaactcttgggaaacgggggaaaaacattattaatatatcatgatgcgcgtttgatcagttttatatttctatggaatatcgtcttgttatatttgtggtatttaaaaaaattatgtaagttggttacccatatctaaaatcctcgatattccactagacttcattccattttccctatgatttaggatgtgttcgttccacctcgttgggaacatatctcttgcgcacgtaaaacggaaacggagcagtacattagcacgtgattaatttagcattagtttttttttgaaaactagatcagtatgatttgttaaagcaactttcgtatagaattttttttgcaaaaacacaccgtttagctgtttgaaaagcgtgcgcgcgaaaaacgagggagatgagttgagaaagttttggaaagaactcagcttagtctcatttcagttagtagttctttagtttgtaagcccagctcaacagaaagtaattagaatgtttagtctttcagggactagttgatttagaatttttcagccaatcgtagttggttattttgcacgcagattaagggagactataagcccaaaaaagctgatgaagtttgcagcgcaaaacctctgccccagctcttcttgttctgctttcatctttcgtcaagtactgtagctgttcgacaacattcacaacagagctatggtagaaagagtgagttcaggatttaggtggtgtttggatccaaggacttaactttagtccctatatttagacactaatttaaagtattaaatatagactacttacaaaactaattatataaatgaaaactaattcgcgagacaaattttttaatcctagttaatccataattagagaatgtttactgtagcatcacatagactaataataaattaattaggctcaatagattcgtcttgcgaattagtctaatattatagatgggttttattaatagtctacgtttaatatttataattagtgcccaaacatccgatgagataggaatttaaaaagttttagtcccctctaaacagggtctaaagtctgaagggcgatttcggacacactacacaactgcaccagtacaaacatatatatatatatatatatatatatatatatatatatatatatatatatatatatatatatatatatatatacacacacacaccaacgtggatctatgcatcatatgcatttagggtacttgctctaataagctccatacttgacaaaaaatagcaagagtgcgagtggatggactccagatgcacaatatatcttaatagaaactctttgcatttagcaaaagatgtttaacctgagtgacctatagaaaaggggggacaagaattaagcgaaaagcaacgtgtttcgatctagatccataagggcactgggcccgggaactggaaaggccaaatgaagcttcaaggacaaccctgtttatgagggcgaaaataccggacaatttttttgcactgggagaaaaaggctcttcatggaggattaggcacgcctaatctataaaactctggaggagaagctgaaaactcctcgcttgaaaagtatggcagcttccgcttggttaaaaaat

SEQ ID NO: 80071 - DNA, 788 bp, Oryza sativa
  unsure (1)..(788): unsure at all n locations
catgcttcaagaagacanccacatgggcaagggcatcttgttaggcacaaatgncagaggaaagncgaagacacttcacaccaatagcagaaaggttgtggnaggtttgtttttngtcggttatatcgcaagcctggtaccaattctatgtttcatgcctcactatcagacggctcataacatggcagaattatccaatgctgttgttatgactaagagtatattatagttttaaactcggttcatgtcactgctgcgaaactgaagctactagccactgtatacacatcaatttgactttgcatatcactgttgtgactcgtgagagatctggctagcacgtacttatgttcagccaaattcttcaaactggatgcaattgaagcacctggtgtttataagaaactttttgtgctattagcatcaataccctcttattctttactttaaaatttattatcacaaaatattcgttggcaggcacggtgcttcctcaacttagcaaccttacaaagctgcagttccttgacccctctggctgtcatctgatgaaatccgaatcaggaatggcatggctgttcatcttctgatttctctctttatgaatagttaatctaaaagttaatttctcacattcatatatagctttagtttatgctatgtggtggaggcttaaagctcaagagatagtacagaaattgttgggcaggttcatgggtttacccaaaccccaatattatttgatatatacgcgggcaggagtgtggtctggcgagcaacaactaatg

SEQ ID NO: 80072 - DNA, 709 bp, Oryza sativa
aaattggggtcttgttcctggatggatgctagaaaattgggatcttattcctctatttcttgtttcatttctttctttcatcgagaaaagctcccaactaagctactgctgcctccacacgtgagcgtggctcgtgctgctagctgttgctgatttccgtcccagtctccaggatgcagccgcagtctcgactcacttgacgagaaatacgaatacacgacacaatttccgttccctgagcaatgaaagaatgagtgattgaactgtagagtagatccgattaaccatcgaagaaaaaaaaaggaaaagtagagtactaagaaaaataaatagtgcatgcctccatgtctatacactgccatatgcattcgtaaatagctagcctagcactcctggagaaaattaaatgtcatacatttttttgatagattgatgactagcacggcaaattggaaatataatctagatcgtaaaaaaaactaacatacatgcacctaaaaaatatcaaacccggctcctgtataccgcataggagcttatcagttttgctatgatgtctaaacctttaagaaattaccacgttaattagagaaaaataaaaaaaaatatcaactgtttgattggagtatgtctaatgcgcaatcaaccgcacatgacatccatgcagtccacacctgccccttactgagtatattatcaaacgaaatct

SEQ ID NO: 80073 - DNA, 602 bp, Oryza sativa
cgccttgcccaccccttacgaagggggcgtccggtggctttgtggttgaccggtggagttgggctcgcctcaacggggagtaggaaaccggcgagtttccgaacctcggtgaaaaatctcttgtctccttgtctcatttgattgtcgcatttacatttgtacaatttacatttctagagagatacttgagatcatatcaccctatgattgctaaacattgacataggagtgtgatttactttcctagagatatatttgagccactatcaccctacgtttgcaaaacataacttagttgcttagagttgatcctcacgtgcctagcaacttaggttagttttgattaggtgtcatttagttttatatcgcctattcaccccccttctagttgacatctcgatcctacaccggtttgcccgtcttgccgcctgccgcgatagcagctggctgaactcagcgaccgacacgtcgccgatcaactttcgggcttcggtgtcggcctgagcaagagtcaacactacgaaaacaagaagtgtcaccacatcaggcgtcgaacggggaaaaagagcgaaacatagatgcacataggaaaagcatagact

SEQ ID NO: 80074 - DNA, 7976 bp, Oryza sativa
acccaacagcccaactcccacgccgtcatcacgcggcttccttagccacttctgtctcttgaaacgtaaaaagatgaaaaaaaaaagaaaaaggaaaaagaaaaaaggaaaatcttcaccgaaggcaatggcggcggcggcggaggcggaggaggaggtgcggcaggaggtggaggcggtggcgtcggtgtacggcgacgactgccgcgtggtgcgcggcttccctccccacctcgtcgtccacgtccgcccccgcaccgccgacgactcctcgcagcaggttagtgctcgccgtcctagctccacgggcgagccgcttcgcagcatccggatccctcccgatttcggtgttccgttcgtggattcggtcgatcggtcggtcggagacggtggcggcggtgctctgctgcctcctaaccctagctcccagataggaggaggaaggaggggattagtgtggttacctgagcctttgtgtttcgtggttgatgtagtttattactccctccatccacaaaagttagatatatttcacatttaactttttccaaataagttgttcctatttgtagtctttatgcatctaagacttaaataaagagataaattaaatgtttgatgagagcccaaggagtcatctaaatactcattggttgcatgcttgcattcactccttgattttgtaacatccaagatgatttaatttcttcttggtcttggtgacaaaagtaatatgtgcaacttttgtggatggagggagtagtatggctagtaccaattgcgttactgattgattatcccatgatgaaggcatcaattctgggccttgaaggaatcaattgtggggggcttttccttggagcccatcggggcggagcggcgcttcagttcagtagtagaggagtcaatttggtaacataccttttcatttatgagtacaggtatttttttggggatggagaccactgttaaggtgatcagtgaaggggatattagataaggaggcagaatgggagagataagggtaagtgggatattaaagatgtgagaggaggatgggtacttcggggaggcagtgggcattgtgtggtggtgaagggaataagaaggtgggaatgtggtgtaaggaatggcaacttcaaaggacggtacataaattggtggtaaccaagactgtttcttttctgttccatccgatcaagagtgaggcattccacattgcctcccaacatataggtatcccttggtctgtccataataaaatggtagctagtaactgccgacatgaccatgagcaagattgagcatgttagttaaaaggtccttgggtggtatgctctctcagtgacccttgaggtggttgtaattgtcgcatttcctgagtgtgtttcatgtgaccagaagtgtggaaaagaagatataattgtcctttattatcaacttttccatgttttacgtatgattacattattcaagggatccatgtatttttgtaagccaatattgctcttaatttcagttgcttatgttgaaggagttttatcatcatgcatttagatttgctaatgaccattttcacttttgcagttcgtggagctatttcttggaattaaagcatcttctcaggtatgaattacaaacttctacctcctttctagattcagttctatgcatttatttttcatggtgacttgttgttggaaacaatttgtttaactgatcggcttgaaatatctttttacctggttcttacatatggttatttgttttgtttgtgtcttttagaactcctgtcggtttttatctcactgttgatcatgagttcctatattgttattcattatgaacatggaaatacttttacatatacctgaccatcatgttaaagaacatgacaggttaatcataagacataactgtctttgtagtttgtacacttaggctcactctttattcatttacacaactgcagttcttcatggtacatgcctataacttgtattgaaaacttactttgttttgggatgatgtaaattatagctctttgttgggctggctctcaattgtaatgtcttcgaagcagtaatgcagtttcactgcattgaggcaactctctaatatctgtgatatcataaattcggaacaacacaaatttattgtggaggacaagaggcacctctttttgcagcaacccagcagacaacttgtgaatcattttttttttaattcatggccagcctaaatttcacaaccaactctatgctgtaacttacaaacctttccaatttcaatatttgtattaggactggtgctggtttgtaactttactatccttcaccattctgtatgcttctgtcattcacctttgcttacacaccttgattagagcactttatagctggttatgttctagctcagtgttaatgcattagattttttattcttcgaattgcagtatccaaaagcacctcctcatgtttatgccgtggaaagtaagggccttgatgagaatcgacaggtgtatcttattagcagcatccagaacaaggcaagagaactttcctgctacccgatgcttgtgacgctgtgtgaggtactattccattcattgtcttcttatagagtacagagcaaaacttgcttcgtctagtaatgtcttgaggattatgcatacttactacatgtaaattgaaactatctgtgaattgcatagtctatggcagtttttagaagcggtactcaatttacattattgtctaattggcattcatttgggagtgaagggaaattggatagtgccaacaattgacactgactgctgctattcgaactataacagtgtctttgggaagtattagatggtttttttctctgtttgagaaattcttatagatgactccagaaattcaaaattttgtaagacactactatggatttattgcataccacgatcagatccactttatctgtaggtgttatggaattctgtaacaaaaaaaatgctcatatgcattgtagcagtttgctgtctaagagggtggattttgatttacatgaaacctatctgacttctcatgcaggaagctgtggagatgctctcaaatatgaatcatccagctggggattgcccactttgtctatatcctttagtcaaagagaatgatggttctgctttgccatttatgaagttgatgtcgtgctaccactgcttccacaggttgacttctgccacatactgatatgtgcaattgcaagaaatactctgtagtagtgtcttattattttggaatttcagtgactgcattatgagatggtgggaatggctacagaatgatgatactgactcgaagaagagtagtacagcagcaactactgaaggtgctagaaatatttcattttgcctttttttttttcacttctgtaaaatgtgttttttaatccttttcaactgcctacaattatttcatgcacttttgggtcaaagatgcttacaaatacaaacataatttaggttgattgacagttatttatgttaaagatgcttgtatgctgtccctttttaatttccccaaggttccagtctgtgcgaaggaaacaaggatagtcacattctggtagaatcatgtataaacttgctgtcgtaatgaagctagtaaaatagcagcttacctgtttaaaacttctggtgtcaatttactttcttaatagcctcatgttggcaacatgattaccattgtttcacatagatattgccttatgttctttgatgactttcacatctaaatttccatcctaacaaatgaaagcgtctgaagtccttatcgaccagcctctgcccttaagagtaatgagcttcaatcttgtattttgtttttgaaccttaagagtatgaatttaagcttttgtgtgcatcagtgcttgacattatgctgattttattttttttcattaaacatatattttaaaggatgcaagtgcagtttatatcatcagtataccaattatcgacaatgtaaatatgatcgtttatgtagttaacatttttgttggttggtgtgttaatcagtgttaatcttgactactgctactagttattcatgcttctgaaggattggatttgtccagctcagctaagcatcacaatgtaagtcagcacaaaggactatgtccagtttgccgcaaagtgtttgatgagaaggatattgagcatgttcgtgatctgctaggtgcaaatacttctcaactggtatgtatcagtacaagttaacagctttcaactttttcatgcactgtcagttttgatatgcctgtaccgtattcattggttcacaattatcttctatcatcactggtgttcggttttcctcacaaacttttatagagttatttaaagtacaattacatcctcgtacgtttttcagttcacattatatatttcaagtaaagcctgtcagagatattgtactctgaaaacagctataattgatatttacccttccacctataggcatctttatcgattgatctggacgaagatgaaaaagaagtacttcattctgagtcagagaagatccgtcaagaaaagttcgcatcgctgttcaatctacaacaagaacgaaatggcctgattgaaccaaagaaagacctttccatacagcctggaatgtacatccctcgtcctcccagcgcgcctactgcttccgaaggagacaccgttgatgattcttgtgaagacaccacaacttcaacctcaggaacggagccactcaaccagacaaacagcactggtggtaccaccaagcacaacagcagttcaggtcatcgaaggagacatcgatctcatgcttcaagaagacaaccacatgggcaagggcaacctgctaggcaacaatggcagaggaaaggcggagacacttcacaccaatagcaggaaaggttgtgggaggtttgttttttgtcggttataatcgcaagcctggtaccaattctatgtttcatgcctcactatcagacggctcataacatggcagaattatccaatgctgttgttatgactaagagtatattatagttttaaactcggttcatgtcactgctgcgaaactgaagctactagccactgtatacacatcaatttgactttgcatatcactgttgtgactcgtgagagatctggctagcacgtacttatgttcagccaaattcttcaaactggatgcaattgaagcacctggtgtttataagaaactttttgtgctattagcatcaataccctcttattctttactttaaaatttattatcacaaaatattcgttggcaggcacggtgcttcctcaacttaacaaccttacaaagctgcagttccttgacccctctggctgtcatctgatgaaatccgaatcaggaatggcatggctgttcatcttctgatttctctctttatgaatagttaatctaaaagttaatttctcacattcatatatagctttagtttatgctatgtggtggaggcttaaagctcaagagatagtacagaaattgttgggcaggttcatgggtttacccaaaccccaatattatttgatatatacgcgggcaggagtgtggtctggcgagcaacaactaatgtgctatcaccttgggtttgttccaagtcaaatttccttgtgcttgaccgacgcatttaaaaccggtgtataccaaaacaaattagtatactacggaaatatgttaatggtccatttaataaaactaattttgtgtcatagacattatgtttttttttacgaacttgatcaaatttaaaagagcaacgtgcgtttgacttaggacaaatccaaaaatgaccgatggaacggacacgcagcgcggatagccacgacccatcctatttgcacccttaagtgcagtacagtacatataatttactctatactctctccgtactcatgaaagaagtcgttttggacagcgacacggtctccaaaatacaactttgactttttgtttctttaaaaatatttattgaaaagtgatatatgtatacttttatgaaagtatttttcaagacaaatctattcgtataatttttatattttcaaacttaacaacttaagagttattcatgatttatattcctaaggtttgacttaaacattgtcctaaatgactttctttacgagtacggagggagtatacggagggagtatgcattgacgggaatgccgctcacgcccatatacctgctgagtacgaagctctaaaagtctctgtgtgtgccgaattgtcaattaaattcacagtcacgtaacgttggtccgactaatcgtgtccatatacgtacgtaacacaagatcagcattaacaatcctcgccgaattaacgtctcgactctggagtacgtagcgacacgatccccgtccatcgtccacacacaagacgcccgggcgcagtgaaatggtgatgtgttgctgctgatgaattccatggaagacacggcacatacgaaattaattagaggctgcaatatatatattagcggatcgatcagcacacactgagcagtgaaattaattaggtcgacttgcccaacgagacaaatataatccagaaacacccggtagctttgctagaatctacataaccttgccgagtagctagcgctccccacggaggtctcggagacggcaaaatccaacgaatcgcatatccggcgcatatgatatggcttgcccactacttacaggtatcgttttctttgtctattttcacttgtacaggcaacattttagagaacaaacacaaacgcacaaacatttactactaggtcatattaagaatgttgtcttgtccaattagcagtataccctcgccatatttatacccggcctagaaatattctgactaggagctgctcgagcctgcttctcatgcagtcctgcctctgaccctagtaccaaatctcaatttctatcctcatatagtttttttgcagattgatgcatgctttcaactcaatttacttgcaattagggagagaatatataagaagatgaccaacttaggacattcataggattttatggttgactaaaatttggatatctgatgtgggagtggatccacatttccaaatgaacttcttgcgatgaatatgttcagaactatagtgttgatgggtcgttaacatatagacacggtaatcgaaagatgaaactaccttttgtaattgcaattttatcttcttgttatgaaatttacttagtattaactttgtttttttatcaacatatttaatatatgattatgtaaatatcttttcctataggcttgaaaggagtaaacccaattttaaaatgtattttacttctatgtcatagtgtgattagttttatgtcttacttttagtcctgcctattgtgatctggggtagacaagcttggatatcggataaatcctgggtctgccacagtttgttatcctgaggtggcctaaaccattttagcaggcgtttacttttttttttcccttttggtcgattgtggaaaagaaagccaaaattctacgaaaatcatttttgtagtagtgatctttttctcagaaaatagtatgtaccactgcttcttgtgttaattacggccttgcaggaaagaagttattatcatcactgctagttgtggtgtcgaccaccctgaccttgaagcataccgctgccagcaccagcagcctagctttcgcggcgttgcccggctgcccagacaagtgcggcaatgtcagcatgccgtatccttttggcaccatagatggctgcttccggggaccacccttccgcgtctactgcgaagacgaccatgcggtttatctccaggagcacaagaagttgaaggtcttgcgattcgagctggcccagggcgaggttctcatccagaagcgcatagcaacaagctgcggcgtcaacctcaccggtaaagccgt

SEQ ID NO: 80075 - DNA, 1116 bp, Oryza sativa
cattgagctcgggctttgtttttcattttcacaggtaggctctcgggcttagtcgtcgtcgttggcggcggcggcgggggtggggggctaggctggggcacgtggagacggtcggcgggtccaaaaaacaagggagaaaaaaagggagaaaaaattccatgtcatcgtccatgtggcgtgccacgtagacaagctcacggtcaaacgcggttttggaccgggatgataccataaaccaagtttagggacctcgacgtgcactttggaagttcgtggacttaagtgaaacctcccgacaagtttaaggaccgctggtgtattttactctttgaagtataatgctagagagcatgtaaaaaagctaatacatcttatatattagaatggagggagtatatatgtatgtggctggaatatttcccctttatgatctatgcattatgtggcaaatgtcattataattgattgttagttttgattcccagccaagggtatgtcatacttcttctgtccttaacaatacacaggctcttaacatggtctgctgctgggtggaagatccaaattcagattcattcaagcggcatcttgcaaggatacctgatttcctgtggctttcagaagatggcatgaaggcacaggttattattaacttttgcatcttttatgcataattaagggactaattccgtgtggaagtgaggctaacatgatcaatctgtttcctgctggtactactctaagttggaaaaatatgtttcatctagaaaaattaaattgtcctataatcctattactccctctagtaaataataattgacattgggagtactaatcctaatactgccaatgtcaaatattttagcggctaaagtacaatctagtgttgttatctatctatctatctattatatactaaaagaaaaagtacgaattacccccccgaactatcacggtcgtccgaattacccccctaaccacaaaaccggacattcttcacccctagctatacaaactggacgaattacccccctcgatccaattcgtggtggttttggtctacgtggcgtacgcgtggcagtccagtcagcatttttatttttaaaacatagtggg

SEQ ID NO: 80076 - DNA, 11070 bp, Oryza sativa
aacgaacgcgaacgaaacgtgtatgaacgcgaacgaacgtgaacgaacgcgaacgaacgtgactgaaacgcgaacgaaacgtgaacgaacgcgaacgaacgcgaatgaacgtgaacgaacgtgactgaaacgtgaatgaatgcgaacgaacgtgaatgaaacgcgaacgaacgtgattgaaacgtgaacgaatgtgaatgcacttttactaaaagtgtgagaacgagcgcgagcgaaacgtgtacgaacgagataattaaactattggtgaacttagcatatatatatatatatatgattatatatacttgaaaacgtgaaatacaatatatgttcctttgcgtttagactaatacattttttttgcatgttgcagagaagacgtcgtcgtcgtcgtccctcaagccgaagtggtagctagccctcgaaggaattcgcgcaggcaagtgatgtaaagatgtgattgttagagatataatataagattgttagatttctaatataagattattagattatcagagttagcatatgtgagtgttagagattatcagattattagacttagcatatttgagtgttagagattgttagagatttaatataagattattagaggtttaatatacgaaacttaattagacttagcatatgcgagtgttagagattgttagagatttaatataagattattagaggtttaatatacgaaacttaattagacttagcatatgtgagtgttagagattgttagagatttaatataagattattagaggtttaatatacgaaacttaattagacttagcatatatgattatctagggttctaatacacgacacttagacttagcatatatgattatttgagttttaatacaagattagtagagttttaatattacgcttagcaaatatttcttctatgaacagttggctgatcgcgatgaggaacagatattgtacgatacaatcgtagagggaagcagccagtactggaatgaagaagaggggaacgaggatccaaaccagtacttgaacgaggaggggaacatggagagggatgcggaggggaacgtggagagggatgcggaggggaacgaggaggaggctagtggaagtcatccctccgctggacagaagagggcacgcggacaacgaggtgccgcgaagaagatagagggtcggcacatcataactgaggtggacacagacggctaacatagtgccccggcagaaagcagccaagaattttgtacgccacagcggttgggttgtgagggataacgtgcctgtcagcaaggtgtactggcacagaacaagggctctcggggataatgacagctttgtcccggaatcaaagaaagagatgctgtggaccacaatgctcgagacattcacgctccctgcgggtacggagaacgtagtgaaaccctggactcgtaagaaaatggccaaacagttccagagcttcaagggagatctgtacaagaaatacatcctgaagggactaacaccgaacttcgacgtattcccaaagctaagggatcattgggacgagttcgttgcttacaagacagggcaacaagggcaagcgatgatggtcaaaaacaaggaaaacgccgccaagaagaagtaccatcaccacttagggtcaagtggttatagaaccggccaccgctaaatggccggatcgatcgaagttctggtactatgctcacggtggaacgcttaacccagttgatggctccctggtcttcagcgatcagatacgcgaagctgccagtcgactaatggacgcagtggaagcctcttctcagggcacgttccgacccgacagagagaaggacgagctgtcactcgccctacagactcccgagcattcaggacgaacacgagggaaatgcatgattccctggaagattggattcaaggaggacatccacacgtacaggagttggatgaggagcaagagagataccgaggcgaagattgcaaatcttgagtacagggtatcgagctacgagctcagcatgcaagaggaggtggcaaggaaggtggatgaatgcatggcagcacatcggtcccaggatccccagccgtacatacctcctccaatggtcagcccatcaggcaatcgtagcagctgcgcctcaacggggcaggtaggatcatagagcatggacgccatgcaaacccaagacaaaaccacctgcccgttgatgagatcactagtggacaccatgtgagctgcatattcccttcaagaacttatcaatcaaggtatgctcgtagttttatgatttttgacttgtacgttccgcaagttgctgcttaggttgattactaatagataacctctcatcacgtgaaggtggcgtcgggaatggccatcccaacggacattttagggacttaccactgcaggccaattctagcaggatactcgagggtcgaagttgagctggtggaagccgcgtacgaggacctcgagttggactacccaggaggagacggtgagacgcatctacgagacataagccacgccattatactatggcgcaagcgctacatcatcctccctgggcgacaagcggcgtctcgtgcaccatctctgccggctccgccgtctcctcctgcaccatctcctccagctcctccgcctcctccacctccacctccaccgtgtccgcctgcacctcccaagacaaggtctcgctaagctccacctcctgccagcacaagggcaatgaagaaggccaaagttgacgccaccaaaaacaaggagccgccatacgattgcagtcaagaggagcttgacgcttatgtggcaggagaagtgaagaggcaactcaagcctcggagtcctgaaaagaagatacctattgacccgagcatgaagaagttcttcaagggaatgttcaccacaaacaaggaggccttaaagctatcggactatgaccgaacacttaggaaagcctattacaagaagtccaaaccagttcctcaacttggagaacaaccaaaccaagaggtcaagccattggtgaccggcgaagactttggcataacggatttcatttcggacaccggtctaactgtggttcagttggttggaggcgcaccaatcccgaaggcggaagtggcatacaagtttgaactcggtaaaccgcttgtcaggcctgagcagctgcagtccctaccgacacaaatgtacaaattccgtgaacggcacatggaaatgagcgccaagggtagagagatgttcggagcgaggatcagaaaccccgacttcttgcaaggagaagatgttctatggatccatttcaaggatgtcttcgatctgtaccatctggatgccctcgatgtctctcttctgagcacatggattttgtaagtatctttgagttcgatttgtttcgttcaataattagctcctggcatatatgtaagcaataataatttcctttcatcgttgtagaatggagattcaaagggcccgacggcggggggtttacgatactgggttcatcgaccctcggaaaatcaacaccgaaatgatcgacaagtacgagaaagacacaaaggacaatctcgtccatctcctaacgcagcagcatttcaagacgttcatactactgccgtgcaacacagagtgagtttttattgtcattcgaacaaatttcattcccatatatataacatgtacattctgatatttatctcatctcacgcatattccagattccactgggtcctattatttttcgacttggacgcatgcagagtcactgtgtacgactcaatgaataaagaggagaaggtttttgacaaggtcttccaactgatagacaggtaatataatgccatctattccaaagtcgcgggactctgttgctattatgttgatcttgggtaataattaattaatcatagcttgcaactgcacatgtagggcttgggatcggttccatcaattggtccgcgggacttggaaagaaaaacttgacggaggttttattttccagtgagtacatgcatgatccaaaattatattgaattgaatctataattatagttaatataaagagtatattaaatctctcatcgtttctcatgtagtgtgcaaagcaggaccagggaactaacttatgcggctactacgtatgcgagtatgcccactgcctatcaaaccaaatatacaccacacgagagctcgatgtacgtatacataaaccattcaaaatttcattgtgtatcgatttgttaagttgtttattaatttcatatattgatatgtcattatttttcgaatgatagcgtattcacatgagggaaaatctcccacacaaggattttatcacgactgttcaagaacaactaatggggttcatcaacgaagaagtctttaatcccgatggtgaattctactacgacggatcgacaattcataacgtcggtccttcctcttctgacgtaacgccggcgtcgaagtcgtagctatagctagtgagaaaatgaattgtacatatatatatttatatatgtacgtacatttactttagtgttaatatatattttggtaacatatatgcacataaaatgttaagtgctttaaattataaatatgtgtgtaatatatgtatttatacatatacacatacgcacatacatatatatatatatatatatatatatatgtattctatatatatgcataatatatatattacaatgcatatatatgtattggaatatatatatatatatatataatcaaccatgcagcaaacagggccatgcaaataaaaaaaatggtacacagatctttagtcccggttggtaacaccaaccggaactaaagatggatcagccggccacgtggctgaccgatctttagtcccggttctgttactaaccgggactaaatatcgatctttagtcccggttatttcacccgagactaaagatcgctatctttaatcccgaattcgtagtcccggttggacaactaggactaaaggggggttacgaaccgggactacaaacggtttctccaccagtgtcagtattctaaattcacaaacaaagagacctgttcagacacaaggacaccaacagtctgatcaaacggcctggcaagctcctggatttaacatttcacagcagcagcaaccttcataaggtttggagcagcatgacggttgtacttatatttatgtaaatgctatatccaggaatttttccacttgttagaggcaacccttgttaaaaaaccagccccgaaatcgacatcgatagctaaacatggaagaaaacgccataggagatccaaaacaatgacgacaccgagacacgatatttggtaacggagttcagtcgtagcctacatctccggagcactgattacgggcgctcctccccgatccagcatatacagcgtatcagagttacaacgactcacggccggtcgccgccggcagccgctccctctcgctatgctaagttgccatgcggttacaacaggcacgtccctctatttatgagagaacctaggatagagtctgactcatactctagtcctaatacctattacaactccaagtcctaaactgtaaccaactacgtacacatattcgatacaatctctaacaaactccaccttggcgaatatgtcatgccaatttgaatctgttacttgcttgaacctccgtgtaccaggacttgagttggttcttccgccgctcacgccgagccgcccgatgagcctacgctaggctcgccgccttcaggattgtgcatagcaataccagcatacccatcttccatgactccacctgcaacagcactctcttgtaacttgtacaaacatgagcttgtcctctcaccagtcataatagtcttgtcgtccttcatgatattcatgatcttcctattagaatccacctgatacaaccaacctgtctcatgtaggctcccaagcgtaatcaaactcttccttagtcccggcacgtgtctcacatttgaaagtagcacttcgtttccatcatacatcttgaacttgacatcacccactccaacaacacgataactcgtgtcattgcccaagtaaacaacaccaaaatcaccagatttgtatgaagagaaccactcccgctttgatgtcacatgataggaactagctgagtccaacatccacgcttctccagacttctcgttagacactgtgagaatctcatgactgttgctatctgaatcattaccatgagctgctaaacttgcaatgccacctttcctcttctttagtaacgggcaattcctccttatgtgtccaaactcatgacacttatagcaccgtgccccttctccttgctcttcggcaccctcgtttcatgatcatgctttgccttgactagcaaactctcagcctgagaagcctccgttgcctcatttttctttgatcttctcaagtctcgtgcaagcaacgacgaaattatctcctcagttttgacagtacccttgccgtgtgtcagggtagtcaccacatgttcataagacggtggaagcgagcacagaagaattatggccttgtctttatcatccagtttcacatctaacttgcttagatccacaacccactgattgaagacatctacgtgcttcctaagatttgactcctcttgcctccgcaaaccatagtaccatacagctgttgtttgagatacaacttactcgtcagcgacttggacatatacaagcttgccaacttgtcccaaatttcctttggtgatttttcatccatgacctggtacatgacaaaatccgagagcctcaaacgtattgttgcagctgcctgcgccttcatctcatcccacttgtcatcatccatcttttccggcatcgtctcctcaagagccttggatatcccctgctgagccaacagatccttcagcctcatctgcgagagaacgaaattcctagtgccatcgaacttcaccacctcaaatttggaaaccaccgtcgccgccatcaacgataatcaacttgatcagctgtcgccctgattaaattgatctaccctgatttaattgacccactgactaaacttgcacagtcaccagccggacaaaaccaaccccttttttctccaaaaaaaccggttcggttttatttttggttgaaaaaaccagtcaaaccgagcggtcaaaggaatcagatcgatttctctccttccttcggccctctctcgctccccttctcccgatgcgccgccacctcctgctcctcatgccgccgctctgcgccaccggccccgcaagaaacaccgcctcctgcctcagaaaccgcctagggcgtcgccgcctcctgccgccgtcacctgcgccgaccccgtgaggagccgcctaagggtggacaaaaagctcgaaattcgtggctcggatcggctcgtagcaagctcggctcggatcgactcgaactcgtagtcttaatgagtcgagtcgagctagccttttagctcgtgagcttaacgagctagctcgcgagctgctcgtttagctcgttagtataaaatatcactaaattttcatgaacttagtatttattgactagtgcttagtcttttagttacatcaaaactattcatattcagtaagtattatattagttagtgtttattattatgttaatatataataaaatgttaaaattgaaattattaatacgatattaataagatatagctcgttaacgagcctaacgagcttaacgagccagctcgcgagccgagccgagctagccttatagctcattaacattaacgagccgagccgagctggctcgttaagataacgagctcaaacgagccgagccttaacgagacgagctggctcgttatccagccctagagccgccgcgtcgccaaagtccggcgccggttccacgccggtaaccgccgccgcaagcccctgctcgagctccgacggacgccgccgagtaccacgccgcctgcaatgatgcctctagccgcccgtgaactcgccgccccaaaccacgctgcccacgaaatcggaggtaagatctcgcccttgccttgtggtttgtttcgattactttgttgcaatcccgtggtgcttttattgggaaaacaacgtgtccgatttccagtccaaatcgaatccgtatcaaactccctcctgtgtcgaacgtggtatccatccagcttgtcttcggtcgtgtccatgccgtgaccgacacatagataactccatggccaagtcttcctctgcatcacgaaacaccaaaccttgcacgtcctggctcagcccgctccttctcggcatcaccctgatctccgccgccggctcggcttcgacgcaaaacgcgcacaccgccacgaccctgaccttctaggcttcttcgtatctccagcggaacctagcaccaccgccaaacaccacttgccgactacagcaatgactagtgccactgatctgttgtcatcgtgattttcttgatctgtgctagaaacagttgaactagacctgtctagggttggaaccagcaccagatgccagtctagacgccctaggcttagtcctgccatccaccgctaatacgccgcctttgaagtgcaaatacctcgtcaacacctccaaaacagcctataggatccaccccctccgacttccgattgaacgccatcaatctagtcacgagccaaagccgacaagtcgcatgtcgtcttccctgccgccgaatgacccgagcgctatgtctagccgtctccctgtcgaacgcaactcatcgaaaggcccgggccaccccgcccagagtgttcgaatccactgatcaagaacgccgatcgcctccagcttcaatcaatccgagcgtgcggccgcacatctccctgtcgagagtagctcatcggaaagtccggaccacccgcccgaagtgtccgacccaccgattggatcgccaatcgcttccgccgccatcaactcgagcaccacgtctagtcatctccctgttgaaagcagccatcgacggttctggccgccgccagaagtgttcaatccaccgatcaagactctgttgatcgccgccgtgctccaccttgcgccaatgcccctccctggacattacaagcaagctacgcagtgtggggcacctccatcgcgcctctaccatggacctcccgcaggctctgataccacttgttataaaaccaaccccaaaatcgacattggtagctaaacgcggaagaaaacaccataggagatccaaaacgatgacgacaccgagacacgatatttggtaacggagttcagccgtagcctacatctccggagcactgattatgggcgctcctcacagatccagcatatacagtatatcagatttacaacgactcacagccggttgacgccggcagccgctccctctcgctatgctaagtcaccatgcggttacaacaggcacgaccctctatttatgagaaatactaagatagagtccgactcatactctagtcataatacctattacaactccaagtcctaaactgtaaccgactacatacacatattcgacacaaactctaacatatacagcaatttttccacttattagtggcatccctcgctatgttttgctggcttgatatttgatgacttccatttctttttgttaaattttgacagccttgctcttgatgcagtatttgtagactccactgctcaaactggacgtccaggtacaggtgactggcaagaggatttatatcaaactgcactctgttggaactttccaatgttcatgttattttagaaacgtcttcctaaagttcattgaaaagatttatttttgaattccagtactcccattcatgtagccttttcgacagattttttttatatacatcaacagattaaaagattgaaggacaagcactttgcagaactcagtcatttgtgcaataaggtatcaatgaagctagaatatgtggatagccaaatgccgtttcaaatgcctatagaacagtatagaaagctgaagaaatttaaagaaattaaatgttggagcctccaggcattggacgtctcaatgaacttcttgtcagggtctttaccttaaaatttggttgtccttatcttataaaacactatgtggaaccccgcgcattgctgcgggaatttaatatgataacaaataaaaaaataacgtgtaagatagctagataacatcagattaagtaaattaatgtggtttatgataatttaaatttaaatagtatgtagaatggtgattcaaatgtaaaaagtaagatggtatgactttatggaagaagaaaagaagggagatagtttggaccgtagattaatcatctaaaggctaaaaacaattgatgtgatatgacttaattagagaaaaaaaaagaagaaagataatttagaccatagattaatcatttaaccactaactaagtgaggataaactatatatgtatataggatatcataaaacataataaagatatacattgaaacattatgtgaattatgttggatcataatttaacatgtttgtatttgaaaagctgttaaattataaaaactataaagatataacatgtttgcatgatgtttaaatgtgataattgttagtggatgatgatgtgtcatcttgttaattagtggattagtggatgatgatgtggcatcttattagtggatgatgatatggtatctttgtatgctaagcttaaggagttagtgaggataactttatagtagtaagataggatttcttgtcagggctcctttgaacctgctcatgatgttgttgttttccctaaaaaagaacccagctgtaatgcacgcaatattactggataatttgtaataatcagccgtgatcagagctagcatatattgttttcttgttccagataaggttatcctcttgatttgttttttctgagcttcatgaactaaaggcaagaggctaacagtgtatattaccataagtctagaagagctctgtgctcatatagtcatatatacatttatt

SEQ ID NO: 80077 - DNA, 11986 bp, Oryza sativa
  unsure (1)..(11986): unsure at all n locations
ctatattggttggggaggagcgcccataatcagagcctcgaggatataggcttcggctgaacctcgttaacaaatatcgtgtattcctgtgtcgtcatctggcatgtcttgggtgatcaatgactgaagcgatcgagaaggttagtcgtcgtttcgctatatcgactaacttttataacatatacgaaagggactctgcagtgcgtgccaccactccttgtgacgtgtgccatcccccacgtcgaagtttaggcacgcacactagtacactacttctacagactcgctagatcactggaacacgacgcccacatcgcgcgcaggcgagtgtgcacgacagactcgacaaaagagaataaacggtgtgcgagaaaagaaatgaaacgctacagatagcttcctaggataactttgagacaccggcactggattacttcaagtctaacagtcgaggctgaacacaccgaggagcttcaccttctcggagagctagctcctccaagaactcgtcacggctctcgaacctctccccaatcatgatgcgtgcgtaccatgcagatagagacgactgctgcgatccgctcggtgaaagaaattgacgtaccgcatccctggatgaagcgacagtggcgagcgcgcccctcctcctccctgacgcggcgtgccctgagcagctcgacaacgcagatctttccgacctgccgccacgctcgtcgtacggcacgacccttgctgccgatcgttcgttcagaggcgccccatcaatatcggttggtcttcacaaagccgttcggcgctaagtaccagcatcagatccttcagctgattctacaccaagccatcggctatcgtctatcggctggtacatgcttttggcacacttgagactcgagcctgcaatcgtcatcaacgtccgggtctccaattctccaacagccgattggttaacctatcggttaatcgctgctacatcgatatcttgtcagttacagtatcagactgactggcacacacgcacttcatcaaaatttaagacatgcactaagctaagcatatttccgcctttatgttgtttatcacgtcaacagacttctaataggaaaaaacatgcatttgaatcattaggaaaacctgcgtatacagaactgctggtgtttctaaaacttattttgagcttttatacgtcacagccggtagccattagcgatgaaaaaaaaaagctcagagatctagaaatgtgtaacatcctcaaattttaaattaaaatttgactgcagcatgctggcttttgattaatttagtgtgttttaaaaatttatttgattttttaattggttcaagtattacttccttagagccctactaatttaccataattattccctttattccaaactttagtgaatttgaacaaattctctcaaatctcaaactatagaatattttcttagtttactccaatattagtgaggatttgctatacttcaaaccctagtgaaactcttccaaattcatagattaaattcattcttttctaggaaaatattcaaaaattcctgaaaacactgttcattgcactgaaggtgctcgacaaaatgcccagcccagctagagcagcccaattaccacccaatcttgtgcaaagtctatgttggatccttggggaccacatcccactcaaaaaccgtggtttagttgaccttctcctccccttgcgcgcgccgccctggcgtccgacttcgccgcgcgccgagccgccgcgcgtcagcctcggggccgcttgcgcgtgcccgatcgtcttggcgcgccgtcacccgtccaacgccttcaagtcgccgttgccacaccaatcttgacgacgacaaagccgggacgacctccgccgcaaggaatcgacactcgacgccgtgcgctcccatccaagccgccgccgagtgcgattttgtttctatccggggtgaatcgcgccaatttttgccgcacggttgaattgaagatagacggtggtttcccctctcacaattcaaaccattcacccctgagccagccattttcaccctcgccgccgccgcgcgtcgcgcctggattggcgccaacacgtcgccagccaatttcaaccgcggtcaagccaatccttcgccggtaagtattcgaacgtggcctcccgccactcaaattgatcttgcccaccctctcacagcctctaccgccccagccgtatccaaagtttgagctcatccatggcgatgacggtgtccgagctcatccgctcctcctagccctataaataggaccccaatcccttccttgtccatcatcgatcatcaacaaccataaccccacaactccgaagctctgcttcgccaatcaatcccatcaaccaccatcgcccgtcggtcgaacactttgtgcgcgatcgactccacacctctccacccattctccgccctaaataccccttagaacaccttatatcaaccatgttctagcatagtgagccctaatcgaagccctgcgtcgagttttacctcgccgcaccaagccgagcaccgccgcccccgcgttgctctgttctttgccgccgcgaagtttttccggccgcaatccgccgtttcaaccgatctcggtgagttcttccgtttcaaccatctacatactacctagagtctatttttgcaatcggtttgcactatcatgccaccctctgggcttccgacgtgagcacggccgccgccaatggaggcgcttgtcggcaagtattctccgcgccttgccaaaggtcggcaagctgttggaatccatctaggcacctcatagatgctctagaatccctcccctaaccatgtctaactctcgtcacctcgatcaccatcacggcctaactgtgccaccgccgccctagccgctaggccgtccacgcatcaaattagctcctccgccgccgctcgccatcgccagagatccctagctccctctagcgccactgcaatcccaaaccctaacgccgccgaccgattttggggaacggccggaggttgaagaagagaagagagagagagagactgacaggtgggacccacacacagtgccatttcacttttatttgattttcaaaatatagatccaattccagtgaaacttggaccaatattcttctaaaatcattctctatctattgagcccctttttgctatttttgtattttattttattttctccatttttggattttatttgaattccttttgaatttgaattttatatgtttaaccctaggtcttgaggattcttctgactcactaaataatattaatcaatctcaagacatcgagcaaggcaagttactatataccttttgatcatttaagcctatattttataaattatttatttatagccttctattcaatattctattttatatgcataattcaatcatagaaacccagataatttagtattgcttattttgcttacaatctggttaaaataccttatacttaggttgggacagtacgtaagatttggttgatttccgggtggctagtactgtctcgatcgatataagttttactaggtacttatgtcgaacgaacgggtacgaccgcagtttctagaatggggacagacctagttattatgttaattagcaatatggcacctctgtatagtggttcttatttttaagtcctcgcgcaggaggcaactatagccgcgaagggcaacttttaaccattaccatgtacaggtaaatggtttgtgatactcgagtataaactatatggtataattctaaaccctgatcgagatgacgtggtgtcatacgatcagtttccccttaaatacctcgggaacgccacaactcctcttgctgctattaacattacgttcagggcatatgaggatacaagttcatggaacaggtgccacaattgttaataacttaatactgggccttgactaaagccgatgattatcagcaagtcgtggactgcaggtaaagcgtacatctgctgcagtagaatatctttgaaactattcgaatagccgtactcatggagttgagtaccaggactcatatggtaccctggttagaaatctaaaatctatatgattataaattcttgctataactcttccagaatatttattattgctttttgcaaagaaccctgctatatgctaatgcataacatatttccatgataacttgctgagtattgtgaatactcattcttgctctcataaccccttttaagatttgggtcaagaggaggacccctatgactattactacgatgaccacgataatttagagaatccctaaaggttttacctccctagtcagaatgtataaaaacttccgctgtatattaattctagttaatcaaataggtgagtacctattattgtaaaacccttagtattataaaactttaacgtatgcaatgaagaactagttatattgtatgtatcaacatctactgatccagggattgatacattaattttagtcggatcaagttgttagttttggacttcgacaaaatgatatccacggtatattcttctgtttatagaaataagtgatcaagcatacatgtgttgtttctttgttttgctgttttattagagtttcactaactcgacccacaagtatctttcagagcacggcagcacatgtgtggccatttttttttcaaagtttagcatcagtatttttatgatgcctagactgaatttatgaagacagtacatgtagatttgttgtgaaaagtacttcatctattataaatttagtaattatctttcagatcgtaaccataattcaattaacaatcattggggtaccattcaagagtaagttcacaagttctatgggtattatgagcaaattcttaatagaccttaaagtagaataacggttcaagattatgtaatcatttaattgagttagcgtctagctttcttaaagaatattgtttttaagattatgtgaattaagagaagtggcacacaaaacgggaccaaccaaaatatgtagattaattgcataccttcattggaataagactgggttgtacgtaggatgctccgagatgtagttgtggtgcagcctatcatatggcccgctcgacgatcacgacgaacaacctgactaccaggaacagcaaaaccatgtcgtggagcattcgaatgctcatattcatcttgtgtaactattgctgctgcagcgatgagttcatcgtcagatgacgatgactcatccaacagaagatgtcttaaaattaaaatgaagctcattgattgatggaagaaggattcacaacaatgtgaatggagaaaaagacagcaagcaatgtagcggtatatgtagggctgaaattttacatgttgcatggtcgttggacacaattttaatgagctagccgttggaaagctagctgttgaacacatcaaattgaaataaaaatatttcattcattgcaaatatatcaattaaaaaactactaattaaaaatatatctgttaaaatttacttattttgaaatattaacgcaataaataacaccattaaaaatttagtcgttcaaaatatagtccttacaaaataatataaatgtatggttagttgaaagatattactgaaatatagaagggtgtgatatggatgatctgtttaataagtgaaaatggatacgaaggagtaatccttttaaacggccatctatttgtgcatatggatgatcaaatttggatgaactgttggggtgctctaatacatatccgggaccgttggacacaaccacctcaatacttgctataattaataccggtagtccaatcactagatatattgtgtctttttattagtgtcacgtctgaaattcacaatcactaggactacatgtctgggaccgttggacacaaccacctcaatatatagtagtacgaagtatttgctagtaattaataccgatagtccaactgctagagatagagatattagtgtacaccacgctgacatgtcaacgtgttgtgccacgttagttaaagtggcagaaaaaaatttaagaaatagtcttatctctcccgtctgctaaatatgtaacaacaaatccaaaagtgttatttgaagagtggcacagtttggtattgtaataaatactgtagttaagccccccacagtagctctaataaaaaggcagccagtatatatactggatatagctggtcgtcgtctttgcattgtctccttgtccggtacgttggttggctctagcttagctggtgctcgatcgcgaacatcatgtggaggctgaaggtggcccagggcggcggcgctttgttgcggtcgacgaacggcttcgccgggcgagcggtgtgggagttcgaccccgaccacggcacgccggaggaccgagccaacgtcgagagggtgcgccgcgacttcaccgaccaccgcctccgccgcccggagtccgccgatctcctcatgcgcatgcaggtatgtgttgtgtgctcctccggcttgataataattgtcgctttggagaaggacacggtcatctacagaaaacaattttgaccaaataattcgcattataatatgtataaaagtgttaacaaatatatgattttatgattttattaaagtacttttcaccgtacttggaaaataaatattttaaaaatgatttataatcaaatattttaaagtttgatctcactctgttttaaaacgataagtattatcagcccggagggagtatatagttaatagtgttaatttgaactgaaatttatgtaatttgaaacaggatcactgttagctagcttcatttgatcgattcgatgttagtttgaccatctgagatatgatcttgttgcagtttgcaagagaaaacaatcaccaacgccgtggtgatcgtattccaccggccgtcaataagcttggcgagaaggagcaggtgactgaagaaactgtgatggcttccttgaggcgagctctcgatgagttctcctctctgcaagcagatgatggccactggcctggcgacctcagtggtgctatattcatcatgcctgtcttggtattaatttgatttttttggctaattaatattaatattcatgttcaattatttcgagattaatttctagtgacctagtttctgtatgcagatattttctttgtatgccactggatcactggacactgtcatatcatcagaacaccggagggagatatgtcgctacatctataaccatcaggtttttatttatttatatatataggtccatcatcttaaaaaaaaatgctatatatatataggcggactcagaaatatacccatgcgcatgccttcatggctttaatagatttttattagaaaagatagttctagctccctccatccagatattgctatagtttggaacgacagttatacttaatttacttaattctacacatgcagaaagtgctaattgatcaactcacgaataatttgctcaaacaaaacaatatgcacatatagttttgatgtacccctctaggcataaatgtttgacgcataggacaagtttcgatcaaaaacttttgaaacttaatttgactaccagttttatgttaaaatgagtttataaaatataataaatttatgatattgtggtataattttctaggtcaatctactcatataattttttttaaactaagtatttgagaaattattgtagtcagttcgaccagatcttattaatattaaatatttataattggaaggagtaataattaaatattgttgtacagaaacattgcattttttatatttacatgtgcagaacgaggacgggggatggggcatgctaatcttgggatcaagcacgatgtttgccacatgcttaaactatgtcaccctgagacttatcggcgaggagccaagcaatgagcaattagctagaggacacgcctggatcatatcacatggtggcgccacccttgttccgcaatggggaaagatatgtctgtcggtatgtatgttagattaattatcagtacatcttgccaaccaattaaggttcttatcgtttgcctatataaaattagccgccgttaaaattcaaattttaaaactagattttgaaattgattttgaagtttttttattaatttttatttttagatatacttttacatcactaatgacatatatataaaagttttacctataaattattaattttttagctaatacgctatacggcttattatatatcagtattggtacctaatatttaacaaaactttcagggcatgctaaggcacagttcgatccagcattttgattggagctgttcgtggattggaaaacgggacagattattaacgcatgattaattatgtattaactattataaatttaaaatttagatttatttgatttagaaaattctatatagaaattttaacataaaacatatcatttaactcttcggaaagcatattaacgaaaaatgaggaagttgatgaaaagaagtaagccaaagtcagttgggtgccagcatagctctacaactatttactacagttgcgtagcacggcggtagccagttcaaaccgttcagagcattatatatatagaaaccgtggcatcttctgagtatgtagtagtaagaagttaaattaattttgatcaacttaagtttggattcatcgcagataattggagtgtatgagtggtcaggaaacaaccccatcttccccgagttatggcttgctccacaattccttccgtttcatccaggcatgtattgcacagttgtactacatttatttttaaatatataacgttaacaacttttaaatataatatttaatctttaaatatgatatttaaccattcatatttttgaaaactatatgtattatttactttgttggaatttagtttatcattagaggtactctaagcatgacctattttttttatatttacacaatttttaagaagtgaataattaaatattatattaaaggtgagcaacgtcatattttaaaaaattgaaggaagcactataccaaacacagcagtatatacaacaatttaatgtcaacatgggactgaaactttaatataatatttcgttatttttgttatgaatctaaagacttgttcactttgctactatttttaaccttaccaagttttagcattactaaattttagtaaggttgtcaaaattttagcaaggttgtcaaattttggtaagattttatatgtacttattaaaatttggcaacaaattaaatgtagccattttttttaactttgtaaaaaaaattagataaggttaaaaatgatagcaaaattaacgagccataattatttatctgcaggcaaattctggggcccgacccgcgtggtgtacgtgccgatggcctatctgtacggcaagaagttcgtggggcccatcacgccaaccatactggcgctgcgagaggagatatacacggacccctaccacaccattgactgggcccaagcctgcaacgcatgctccaaggtaacaaataaatattggccttttttttttttggaagttgagggagtaaatcggactcgggctatagttgaagaatgtaatcagacactcgaacgaggaaaatgaaatgatcccttcaaaagaattgaacctgactttagaaaattttttgggtgtcacatcgaacgtttaactagatatcgaaagaggttttcggacacgaatgaaaaaactagtttcatatctcgtctggaaaccgcgagacgaatttattaagactaattaatccatcattagtacacgtgggttactgtaacacttatagctaatcatggtctaattaggctcaatagattcgtttcacgatttccatgcaaactgtgtaattagtttttcattttatctaaatttaatgctccatatgtccaaagattcaatgtaacgtttttgggaaaaaaaaatttgagaactgaacaaggccttaacaactcatccaaatttgatcctccatatgcctatatagatggccatccaaaaaagattcctcctttatattcctcctcactccaacggatcatttatattacgttctctatatcatatcatcctatattttattatcctatattttattagtatctttcaactaccatccatttatattattttttctttttttcacctttctcttacttctctctttctctttcttctccagtcctctcgagctctcctctttctctcttctccagtcctctcttctccagcggcggagcaacgcgagcggaggggcgaggggcgccgccagcggtcgggggtggagggcggtgggtacaaaaggcggtgggggcggagggcggcgcgggctgcggggcgatgcgagccgccgcgcggaggagaggcgagcagcgcaagcggctggccgacggcgggagcggaggggcggcgcgagcagcggagcgacaggagcggctggatctggccggagcgcggttcgccggcgacgacggcatggcgtgcagcgctgcgcatattctctaccttcgctcctccatgccttgatccggattggggcgggagaaccagatggatgcggcggttacgggatggcgttaggagagagaaactccaaatctgccgattctttctccggaatagcgcatgcgttatctttggaggctcggatggcgcatctactggagcctgattttctcctcccatgtgctatatttgagatggaagattggatagagcatctgctggggatgctcttagtctgtaactaggccttgctttattgggtttcttctctctctgtgtgtctgcctgttgaagtgtgtatactacactattggtgatggcaggaggatttggtctgcccgcgcacgctgctgcagaatgtggtgtggacttcgctctacaagtgggtggagccggtgctaggcagcaggccgatgaacaagctgagggagagagctttggatagactcatggagcatatccattacgaagatgaaaactcacagtacctctgcctatgtcctgtcaacaaggtaaatttgaaatataggcgaccgaccttgctttcagggcaaaaaaaaaaaaaaacaaaaaaaacaacattagaaaattctgactaatgattgaactaacaaaattatgtgtttttaagtattatgcatgtaatatcactatattcttcgtatttgaaaaatactttcatatatatgatgttaattttgtagttttttataatatattatgaaagaaatcaatgatatttaaagtagagtaaaatacaacagcggtccttaaacttattgtcaagttacacttaggtccacgaacttataaaacgcacatcgaggtctctaaacttggtttattgtatcatctcggtccaaagtctcgtttgaccgtggtcttgcctacgtggcacgccacgtggatgatgacatgaaattttttatttttttctccctccttccttctttttctctctcttcttcttttttctcccttctttttttttctctctggcggccgctgtaccgtgagctccacagccacgcctccatctccttctccatcagcctccgctccactcgccgagccgccgtgccggaggcgagcgcacaacgggagggaggacagcggcgctgacgggagggagggggacggcggcgacttggggaggatagtggcgctgacgggagggagggggaccacggcgcatagatgtcctcctcgatctccttcggggtgagcgccaccaagaacggcgcgcgcttccggcgttggtacgaggacggcacgggcaccgccgccgcccatgatatggaggcggttgggcaccgccgcgtccgttgccgcaggttccacggcctcgctgtacagttgcattcggctataagggcagctaganggatcagtaaca

SEQ ID NO: 80078 - DNA, 19205 bp, Oryza sativa
tgtctgtccgtatttgtctagcggagtctttttgtttatctgcggaaactacaaaacaaccatttttgtcggtccttcctttgtttcatctgtatgaaatttgacttatgaagcatagcatattatggtattgcctatgaataaaatgtgccccgataatagtgtgtttgaaaaaaagcataactataatataatgtcattaaccaaagtctgtgattcagagaacaatactactatacatactgctatcatcctttggttgaaggatgaattgtatcaaatattgtcgtagtgttagcacgggcatattactagtgttactaattagataacatattattacgaatatagattaaatatggcaaaatataactgaagtagctaacatattattccagatgtagatgaggttgtgtctagttgtagtattaagttgctacatttttggacgaatttattatattttgggatgaagtgggatggagagtacaccaccgtccccaaataacttaagttctatgaacttggacaaacaattatatacattcgaagcaaggattggttttttgatgtagaagtaaaagtttgtggttggatcaaacatctagggccgggaactgtcctgcccctctcctctcaccgctgcatcagcattttggggcacataaatgagaggattggacttgtgaatgcctcagcatttccaaatgcaatccttttcgagccatcgtggctctcgaaaatactgatcctccgaggaaaagatttgaataatccagaaaccagtttgcacctcaccaacttgcatcaacttgcatgatgatagtgctgaatcttcattcatcagagtgtggctcggatctttctgtattgatgttagattgcaaattgtaaatatattactgaattcaagttaatagaagctattgggatcgtgtaggctacgatagcataaatcaaaattttctatcacgtaaaccaggaaccatgcaagtattagatcatagatcgttaccactcgacgcgctgtgcagtggaagaagacgctgagaagtcgaaggaactctcgcgaagtagcgcgcgtcgatgtagaggaagtagtagatcgcaccggctcgaccttctcctcctcgtgtgttctcctcgccgtactcccacggcgatcagcaccgcaaaccagcggcgcctctaccggtatccacatgtacagggacggaacgccacacgcagatgtgctagcacccgcgcgcggctagggttttgctcggggagggaagtgacggctagggttactcacgtgatgcaatacctccgccggtcacacccctcacgaatatataggatccatcactcgggcctccaagacccgtaggactcctattcggatccttatccgaattaagctcatattggatctctatccaatccccttattccggcccattaagcgtgcgaccctgtaggttcatatatactcggctgtaacccgaaaactccttttcggtccacgcgtcaacagcggcccctagcagaacgtattgacccaccgggcatacataaagatcatatcggctgaacctctagtgtatacttgtatgaacccctttgcctcatgatatcgattaagctcaaggctagatatgtgccatcctctaatagctcaatcattcactcgaacctgttgatagattatataacttgtgattgactcctcaatcacctttggcatggccatgcacttccataatctacaacatcgaggggcccagagatatctctccataggaggggcaaatcccatcttgattattcatatcccactacatgtttcatagcatacccgaaaactatttttataactacccaattacggagtaatgtttagtagtccctaagtaagctactacacatgttgagaaccatgataatctcaggtttaaggattcaacaccaacactcaatgagatcactgatgacacaacacatatggctcttgcagtatctcatgttgggtctatccaacaacatgttcaccaacatgtgtccacattattaatttggtatctctataccatgatccatgagacatgatcatcaattaatacatgtgctgatcatataaacatatttgttccacatatgatatttgatcagggatcctttagaaatagtaacaaacaacataaagagtatcatgaaagaatcacatattcattaaccaataatgagttatctatttcaaggaacaatgtcggataaatatgtaaacatagtatgtgatacaatcatctctatgattgtctttagggcatatcactaacagaaacttatagtatttttttttctaaaatccactgcaattcaagattgctgttatccttttgtggagcgagccccatcgtttctcctacatgtggttataagccataactcttattagtcataaaataatttgtgcgtgaaacttttctatgagcgacttaaaaatcaatttcagaaaataaactatgatgaagaaaacattaaaattaactccaaaattaagttttaaaatctaaaatttggttgtagccttgtaggtgataacttaaaaaacatcgaaatccttccctatgacctgataacttgaaaaatgctggcttcctagttcctactcatgcacagcacaaccacagcctgaccacgagaaagacagaaaggaccttttcaagttttcttcacttcttcgaagtagccacaaggctagaaacatgaacatgccgtcactgacacctctcactttcaagtgattgcaactggggaaaataataaaaaagaagtcaataaatccgtactacatttgactgtgcttttggtaccaataattctgaaaagggagaagagattaggaggattcatgggaaccagcagctgcacatgcagctaaggtttgactggtgtgagtgtgtgcatgaattcatgatccaaatggtttgaatattatttccggatccggttcaattcgtcatttgcttggctggtgtcgctcatacgtagcacgctactagctggctattcgtttcaacaaaggcttggcaatattcaaattaattacaaataatttgtgccaagatgagaatatatatatggactgctacattgacaaaatcagcattgctatatatgtaggagtatatagtactagtctttctcatcatgaatactggaaaggaatttgtaatttgaacgcaagttttggtgaagcatacgtgggaggacgcagtcatgatcaaacaaattaaacgagacaacgcatgtgctgccccttgcataccgcgcacatgccatactagttaaataaccacgagtctactcgcttgattcatgtatgcattatatctaaaacattttttatttaaaaaacattttacgttccattgtcattttaagggatttatttgttattttcattccttggctccggaggtagtgaaaagtcgacctgaaattactttcaataaacggtctttataactaaatattttgggtttatactccgtggtccatagctaatataagtgacaaacatactattcgatcccgtccataataattatcgttttacacataattgaggttaaactttttagaactttgactatgtttaaaaatatttgctttacaaaaatagcagttacattacatgtatagattaatcttaaaatataaatattctttatatatctcataataaaaaataatagtaaagtttttttatttaaagcgataattattatgaaactatagggagtaccattttcttccagcatggaacatacaccaatttatttttgagaaacagaaaacctacaccacggcatcccgtggagacgggatctcctctactactcctctccctccaaatcatccggatcccctcctcatacctcactctcctcccccaaatcacacggcactgtagccctccccgtcacctcctcctacctcactctcctcccccaaatcaggcggcactgcagccctccccatcgtcgtcgcccaccgctcgccagagctggcggccaccgccgcgggggaggtggcgacggtgaggagctcggcggcgggcgcggtgagcgagagggagagtgggagcgaggcgcagtggagccggaacggggtacggttgcggcaacatcctccatggccgtgcctcctcgacgccatccctcccccacgtcttctcctctttttgatgataccctctgataccccacaagtattaggcttgataccttggtcccaaggtctgatacctaggtaccacctggtatcttaggtaccgggtatcaggtatcggtcgatacctagtcggtaccaaaggtatcaggtaccaggtaccaggggagcatatgtccctcacctcgccgtgcctcctcgacgccatccttcgccgttgtggccctccctcccccacgtctcctcttttttgacgctaccctctgataccccacaagtatcaggcttgataccttagtaccaaggtctgatacctaggtaccacccgataccttgggtatcgggcatcaggtatcggtcgatacctagtcggtatcaaaggtaccaggtaccaaccgatacctaaggtaccaggtatcaagtaccaggtactaggggagtacacgtggacagaagaaaggaaaagagaaagtcacttaaaatatcccgttgcaacggtatcccgttgtgtagctgccctctttgagaaaagcatcaacagtgtggtggtggagcatgactccactcatcagggtttaaattctggtatccataaatattacgtatatataagtgagatcttaaaataaatttggcgatattaggtatataccgttgattttccgtcttttcaagcatgtgttacgggccgatcatattcatatgtgtgtaagtgtggtattgcgggtgtagagatgttgtgcgttcgtacgtctaccatcacagtgaagtcgcaagaacacagacagggaaaaccggaaaaggatagaggaggcagcgagccagccacaacctatttttgtcacgaggagaagaaagcccagccctccttgaccgttcccaaaagctgaccgttgccttcctcccctcgctgaccagtcaaaccacctcctccacttgtcacttccactcatcacctcgaacctcgagccgtgggccccacatgtcattggaacagcgtgtgtctcctcttgtcgcatttggaatagtcgtcgttggtttcttgccgccttgaccccaaccaccagcgtcgtatataaatcccccctgcacaggaaagctttcgtcacgaaacaaccttgcgttgagcttagctttagctgatcgaatcgagaagagacgtaaattaagcaagcgatcgatcgaactgatctcgtcggccgatcgattgatcggatttggttccatggagaggggttgcaacggcaatggcggcggcggcggcggcgtgaaggtgaccttcatcgagacgcagttcgtcacctccgacgccgcgggcttcaagtcgctcgtgcagcgcctcaccggcaacgacgcagccgtgccggcggcgccgccacagaggccgcggccgtgccgtgcagacgggtggaggggagccggcggcgcgagcgcgacggtggtgaagcgggaagccgtgccgccgccggtggcgccgtgggtggatgagatgatgatgctgtacgagacgtgcgacctcgccgagatgttgcgcgtcgacgtcgtcggcgcgagcggcggaggacggtgccacggcggcggcggatacggtggttttccatgctgatcgacggccggcgatgagctcagtccatcttcagttttggatgctctctgcatgttgttccattcttttttaactgagattatctgtatattgctccatgccttgttgtaccctgttttatatgtttggttgcgaccaggccatgtaattccggttctaatcatgaaactgaaaaaaaaaacaaattgatagagccgatgaatcaaaggattttggagtcacaacagggtttatactttccgaaaaggccgaaattttggtaatttcagtgggcaccaacatttcatcgatttcgaaactttttcacaaaattatggaaaagaataggaataactatagttagccatatgggccgctcggcacggcacggcctaagcctggtcaaacccagaccaagatttgtcaggcctatacatatcttacatatggttgaaaagtctatttcacatccctgaagttcgtgctgtgccgaggcataggcccaggcacagcccaacaaccatgtcgtgccggcacgggcccgacatcgatcaggccatgtcatgcttgggccaggccaaaatcccgtgccttggcccgggcctcgaccttatggccaactataggaataacaatatccatgcaatacggactagcgattagtgtagattaacaaatcctccaaacattttattgagaaaactctaaatactagtaaatacgaaagggagatgggtcctctccctcatcacctccagctataatgtggagcctggaggtgaaggcaggttttacctttccgtatttaatattaaaaccatccttgaccggtttattgtataccgacctaaaaccgataaaaactaatagctttcagtcaacatcgtaaaaataccaactaaaattgacactactggtttcgtgaaaatcgatcaatttttgtgaaaaccgctcggtggagaaggatcagacagaaactgagaccgaagtctgaagataacttttttatcaaatttttttcaagactaatgcttggtagcaggagcaggtggtcttctttcccgcatcctcttcgccacttatattgttcgactcttgctaacaagacaagaaaaaaatgtacttacaattataataaatgaaattgcacaaaggattatagtaatcggtagctgagccaagcacaggaaattctcttttccgtttctttaataagcgacggtctttgacttttcgacatatgtctgattattcattataagttgttttatcattaaaaacaattcaatcgtatttataacttatatatttatacaataattttaaataaggtaaacagttatacatacctataaaaattactccatccgtttcaggttttaagacgtttttactttggtcaaaagtcaaactgttttaaatttggttaaatttgtagaaaaaaatagtatcattttataaatttattattatatttacctataaatttagtcaaataactaaaacggaggagtaacgacattaattaccgttgctcttaccggatcggtgcgaagccgccgagaacgcagagaagaataggataaggatacagtgaacctcctcctcgcacgaggcagggagtgagccttgaccgttcccagaaaggttgaccgttgtccgtcactgaccaccaacccagtcactcactggatacgaccagtcaaaccttgtcgctaatgctaaagcttcaacccaccagtcacacatccagcgaaaaacccacaccctcacctccacgtgggccccacctaacctggaccccacatgtcattcggatagtgcaggcatctgtgccgtatgtattgcattcgcgccgccgccgccgcgcgctctgtataaaaaccccatcggcacgggaagatttcgtcaccagcaaccttgagttgagagagcttttcgtcgattcgaatcgaatcgagaagaaaaggggaaagggtcgcaactgatcgagctgatctcatcggtcgatcggattcgattccatggagaggggttgcaatggcaatggcggcgtgaaggtgaccttcatcgagacgcagttcgtcacctccgacgccgccgggttcaagtcgctcgtgcagcgcctcaccggcaacgacgcagccgttgcgaccgcgccgtcgctcgagaggccgcggccgtgccggcggggggtcgacgggtggaggggagccgaggcgacggtgggggtggggctgccggcggcgccggcgccgtggatggatgagattgagatgatgatgctgtacgagacttgcgacctcgccgatatgctgtgcgtcgatgtcgccgcgggcggaggagggtgccacggcggcggcggccggcgatgagctaagccgttagttttggatgctctctctctctctctctctctttcctgaaattctctgtatattgctccatgcctcgttgtaccctatgtttggttgcaatcaggccatgtaattcccgttcaatcatgaatatgaatattgtagccgatgagtcagaggattatggagctagatataaactgagatacgcgagattttctctattttagtgcagtggtaagaggtgtgtgatttcaacccttaagttccgtgatcaatcctaaatacactcataatttctttataaaaaatatttgaagggacgtctcttcctccaaatctcgtttttgaaattagaaagatctccaaatctcgttcttaaagtgataaaatgggatacaggtcattaagtagccaatcaagtttactaacgagccaactcacgagccgagccgagctatcttatcaagataatgaactcaaatgagtcgagccttaatgagcccagctgacttattgccttttgaaattctatgtatatttcttcgtttcatgtgtaggccacacaattttggagtcgcagacacgtgcacttctttcatttgagatttatagaaaatgagatttagctactcaggacaatctgtttttcacaattacatgaaaaacagacaggcgcatacaccaccacacacgcaccaccgcctcaatatcctcagatatgttcttgtcacctttgacaagaggttctgctcttcccttaaatcacatgcaagtgtttgcaatcgtaatgcagtgtgaagttcgtttacttcagaaatgtaaagaaaatttcttgcctgatatgttcccattattttcatcaagatgatgcaactaaggaaacactgaatctgaatggtgcggactgcaaagacttacatttagtagacagcaaaacttactaccagagtgcctatagaagcttcagaaggaaataataatgtttcctacagctgggtatgattgcgatgtcactgataatgaagttgaagttgagtcacccgactgatcacatctcacactgatcaatcttgctcttgaccagctggaaagctggattcacccaggctccgcagctgcactgcattcctgcccagtggaattgtcccaatcggctgttgcatttcctgcacgcgatcttccctgaaatatatccttccaccactgcaatgcataatacattttattagaagaaaatatatcagacgcacaacaccaaactagcagaaaatacgtttgtgagcagagtggttcattattagtcctaaaataatttgtgcgtgttctgagcgacttaaaaaccaatgttgataaataaactatgatgaagaaaaaacattaaaattaactctaaaatatatcagacacacacaacaccaaaaaagaaagaaaaaaaaacattacagcatccaaggtaggtaactaaccaggttgcatccacttcaagggctccacaaagaggcaggtacattcgggttccttctcatccacatgatactttttgcgcgtcgcgaagcacttctcaccacgaccaactttgtgggtaacaacatagccttcagtagcgacgagtgtgcgacatcttttgcagcggtaagtagtgcctggatcagtggtttctaggtcaccataagttaccccatctgtgtactggtttgtttctgcagggtttggattagccactggacttgtctccagctcagtttgtactgctggtttaatatcagtttccgcgactttgtcctggcttatttccgcaggcttttgatcctccatggatcctggcatctcatcaacctctggttctgactttttctgttcaactcccaattctagcgcctggatggtttccatctcctggttgatttgctcacccctgcattagtaacagttaagacacaagtggtgtttctacagtgcttggtaatgtgcaaacataaataaagtccaagctttgcaatgttgctgttgagatattcatttatgtgcaaacataaatagtgacttttcaattcaaaaagaaaataccgtttctataggttgcagtgaatagtaattactcataaatgaagaacacaactgtattcagtattggaaaggcaaacatgatcacaatgtgctcacttgttatggaccagcgctatgggagtagatacgggtggcgcacacgcgaagaagatgcagcacccagagtagcatagcccggttacaattagataaaagatatataattagtaccaattccctaattttggtgagtatcctagtttatctactgttgcctaaactatcaagattgcaccgtgattaaggattactattccattaagaaattcaggaaaggacaatctgccatcctatccagcagcaagatttcggcctgatattaaactcaatagctacaaggattataaactcaatgattggcgaaaaagtaaaacaaaatacgattaacgaagcagcacgaaaccaaatattagcagcagcagcagcagcaaaagattgacgtatataataataccttcacatcaggactaatagtagtaatccaaccaaattctggcccccagctaattaacacagaaacgattgcgggctgactattattatatacatatatacagaaaacaagggttcgtcccagagatgaagacgccaagaagatgaaatcggagcagggaaatccaggattcaaggtacataccctagatgttagatccgaccacccaagcggccgcaagcggagggctccttcgtcgacaccgcggcgcggcagcggcggcgacggctacggcgacggcggcggcggaatcgggagcgctgcgcctacgtctccacggcggtggttcttcttcttcagttccgcttcagcaggggacgaaatattagtgaaaacccaagtatatggacacgcagcaacgcaccttaactcctaatcggaagcagaaacggcccaagcccgtgcgatagttggccggcccattaacgtcggtgcaccttttactcagagtaagtctgtttttcctccctcatctctaactcaagggtataacgcttttcccatctttgaaaacccttctgaccatgttcacttaatcccaccaacaaggggattgagaggatgggaggggaataattccacacctattcaggtatggaattaatcccttttaatctcctccaatccctccttcacgctcggtggttttagaaagtggttttagaagcggtttctaccgatataacagtttgaccatgattgacccattgagtcagcagatgaaacccacgtggtaaagactttcttcgcttctcatcttcttccccgtctctcttccaggagcaaagagaaaagcgaggcatgatagagttattccttaattcgtttcatcctcggttggtcatgactcatgacgtggatccatagcaggataacattaccacatatgggcttgttggcctccatctcaatcagactaacatgatcatgggactcaacatatactggagctgaataaattatggacaagggcacatcagatgaattttaagaaaaaaacattggaacttcattgtgcagtctccactggaaagaaattccatggatttgacaagtgatatgcactagcatagtagcatacaagtacaagaacaatgtatcaggcaattatcaagaacatatactagcaacgttctataggctattttcactcagaatgttgccaactaaaagacggcactaacacatcggctcactcagccatatttcacaaggcctcatacatgccacaccccatattctcatgcgccctaccatttagtctacaacaccacgatcaaaactccagggaggctgctgcatcagtgaagcatcaattttgctcctgcaaggtacactgttactccaaattgaaagtccgaatgcaaacagcagcggttctgagttctgatccttgtgtttttccaccgtttactgtgaaccccttggaatatgaaaaggagtttctgatacactgaaaacaaaaagagagtttcagtgtggattgtagagtattttatcagtgaacgtaatagcaagagctggtatagtgtaaatatcagggaactaaattgtcgatacataattaaacaatggcgacagttagatgagactttcttttcttgctaacaaagaattataataaaccacattatagtttttaactcaatcttaaaatttgcacggagaggatggtcaagtaagcaattacctaacaaggatgaccatgattttcatgggctgaacttgtgaggtaaacaacagggaattctcagtttctcacatgttgcggacattgcgatggctggctatgcagtcttatctcacctacaaccagaagaaaatacacaatttgtcatagagcattctttgagacatcagttaaattttagagataatagtatatcacgttataattagaacaaataatctatattgtcaagtaccacccttgagttgtatataaaataaaatatccatccattttgagttgtatataaaataaactatccatccatttttaaagtttctactacatagggcatgcccacaatattttgtgggcatgtgttctctaataaggctgtaccatgtccattattatttcaacctaggattaaatccaaagtttaattcatagcattaggtttgactactcattgcattccacgtatgatcaaatcactcccttcattagtgcaatcaattttgaagaatctgttgaagagcacataccaccaaaacacacatttagtaattatacaaagtgccaaaaagttataccaaaaagatttaaatgaatagaattgccagtctacatgtataccaaatggatgaatggtgctcaaagagttcactaaaaccaaactgatggaaataaacaaaaaggagaagataaaaaaggacgtagacaaatttcctgccttttgcttttttttggaatgacagaaatgtcatcagcaagggaccaaatacaacatctggttccatagtgtagtggttagcactccagactttgaatctggcaacctgggttcgaatcccggtgggacctcttttttggtattgccatagtcctcaaatgggatctatatagccaattgcttgcagggcgaatacatgattcatgcgttgttatacatataatagttttgttcaccatgtttttgtttaatgcggtgcatcaacatgtggcatatctggccactttaatggtatcagaacctattgatcatttgatcttctcagtatctcaacttctccaaacagcaacctttagtgacaaaccttccatcaacaccattaccatcaccaataaatcagacattggtactcttggccttcaacaagctattttccagttaagagttgtggtttcatgctagatggtaatgacaattttggggtgaacataggcttttaaactcatgattgcagatggaggcaaagaaggatagggagaataagagaaattagtcaatacactataataccatggaagcagaaaaccatggctgacactaacacacagcatttgataaaatatcgcatggaatacataaaaacacagtctaagggcctgtttgggggagctttagattctgagaagcagctgtttggtagccagcttctgagaatctggaaaagctctgaaacccagcttctccagcttctgacttcttagttcatttttcagaatctataactacagattctcaaaagctgtggactgtttggagcagcttctagcagaagcagcttttgggaaaagctgcagctgggataagctcccccaaacagggcctaagagtttgttgaacaggcaaaacagaaacaaggaaaataggctggagcagcagagcttcctatacaatgaaaagacaagaaaatttcaggatgaagttgggagtattttatcagtgaacaagcattaaattgtcaaaagatagctcaacaatggcaagagttaaacaaggcatgtttctttcttttctttctaacaaagagttacaataagacacgatatatttttcacttaatcttaaaatttgcatggagaagattgccaagtaaacagttaaacatgttattgttgcgggtgaacttgtggagtaaaatactagaaattctcacatgcttgcaaacatggtgagggctagttttgtggcctacctcgcttgcaaccagaagaaaacacacaatgtgtcacacagcattatttcagacattaaatttcagcgagaataatatatcacaatatcaattagaacaagcaatcaatattgtcaggtacaacccttgagttgtatataaaacaaaatattcatccattttgaaaggagctacagtactacacaagggacatgcccacagtatacgtgctagcctcattagattgctctatattcacaattttgtcaacacatgattaaatccaaagtttaattatattagtatacgctgcattctactatgacataatcactctactcacaaacgtacatcaggtgcaatcaaacttcacaagatattaaggaaatcagtggtgaacattatctctcattctcttggaaaagcatacactgtcaaaaattacacttaataattatacaaagtgctaaaaagttctagtaagcgtttcaaatgaatattacgttttaccaaatgtatagtcttcacgtatgctaattggatgcatgctcaaagaaaacaatttcactgaaaccaaactgacaataacaaacaaaaaaaagctaaaaaggaaatagacaaaatttcctgctttttactgtgcttatggaatataagacagaaatgctatctgcaagcgaccgcatacaacatctggtcccatagtgtagtggttagcactccagactttgaatctggcaacctgggttcaaatccctgtgggaccttttttggggtattgcatagccaattgtttgcagggccaatacatgattcagctgtaatcaatataatatacgagtactgctactgtggtactccaaactgataggccaagtggtattgctctttttcctcaaaatacaagacaaatagaggtgggcattcggtctagaccgaaaattcggtctggttagttctttcaaaattggaaagcgaacacactagcatagatttctagaccgacagtttggttaaccgaaaattcggtctcggtcttcagtcggaccgagaagaccaatcctctctgtggcgtgcaggatggcatgcaggcagtcagtatcgatcgggaaaagaaaatcaagaagatcaatctaaagaaaatcctagcaagatgcaaagaaaaaccccataactagaactcacagatcaatacatcatctgctcctcattcttctggccaacagatcaagatgcggtacgtggtggcaagcagcaggcggcgacgggtggcttggtggcggcctgcaatgggcagcggcggcgggtggtggtggtggcggtcgggcgcacggggcaggcggccgcgcggcaggcagttccacagtgggacgacaaatgatggagacgagcgcaggtgaagctcatggaccatagatgacagctagggttgtggtagagtggggacttgacttttgattagaaattgattttgggctgacaagcttaggccatgaaaaatgggctattggactattgggtcactcggcctgaccctgtgcttttatggagttcagtcacatcgggtactcaagcaagataaacgaacaagtgaaaaaaaaagatcagtctttgcacttctctgaccgaactatgaaccgatgaccgacatttcgggtacttcggtctcggttttttatgcccacccctaaagacaaacaaaagtggtggtgggttttggtccttgtgtgtttttcaatgtctactgtttaaaggccagaggaggctttgaactttttttatatgaaagcagattctgatacaatgaaaagaaggacggaatttcaggatggagttgacagtattttcagtgaacataatagcaagagctggaacaggtagtgtaaatatcagggcactaaattgtcaatagataactaagcaatggtgacagttagatgacatgcttttttcttgctaacaaagaactaaaataaaccacattataatttttaatttaatcttaaaatttgcacgtgcaagatggtcaggtaagcagttacctgacaaggttaaacatggttttgttggggtgaatttgtgcagtaaacaactggggattcgcacatgtttgtggacatagtgatagctggatctgtggccttatctcacctacaaccagaagaaaaaacacaatttgtcacagagcattctgtgagacatcagttaaatttccaagataatagtatatcacgttataattagaagtaatctatattgctaggtacaacccttgagttgtatatataaaataaaatatccatcgaattttaaagtagccactgcatagggcatgcccacagtattttgtgagcatgtgttctctaattaggctgcgccaagttcacaattacttaaacctaagattaaatccaaagtttaattcatagcattagatttgactattcgttgcattcacatatgatataatcactctgttaattagtgcaatgaaacttctccgaagatttaactttgaagcatctgtaagatgattattacagaaatcaggggtgaatattatctgttggagtgcatgtaccatcagaagtcgcatttagtaattctacgaagtgccaaaaagttctacaaaaagatttaaatgaatagaacttcttaagaaatgtcagtctacgtgtatgccaaatggatgaatggttctcaaagaggagaacaatttcactgacaccaaactgatggaaacaaacaaaaaaagaaaagataaaaaaggacatagacaaatttcctgcctttaccttttttggaatataagatagaaatgtcatcagaaagggaccaaatacaacatctggttccatagtgtagtggttagcactccagactttgaatctggcaacctgggttcaaatcccggtggaacctcttttttggtattgccatagtcctcaaatggggtctacatagccaattgcttgcagggccaatacacgattcatgagttgctataaatataatagttttgttcaccatgttcttgtttaatactgtgcatcaacatgtggcatatctccctgctttaggggcatctgagcctattgatcatttaatcttctcactatctcaacatctccaaacagcaatctttagtgacaaaccatccatcaacactattaccatcaccaacataaaaaaaaatcaaaaatcatatacatagcactctttatattccagacaagacacttgtggtttcaagctagatggtaacgatatttctggtgtgaatgtaggctttcacactgatgattgcagatggagggaaaaaaaggataagagagaacaaaagaaattaaccaatgaattatctatgctacgtaaaatgttagtagtggtggtggttgttctgtcacaccacccctagcactgacattaaattttgaaatcacctatttgttcaataaggaaaatcataaaagcggtacttggactaaatatgtgcttaattgacttaataagctagaaaccttttattttccattgcaacacgtgggctcttggctagtaatactatgaagcagaaaaacatggcaaacactaacgcgttgtatttgataaaatatcccatggaatacattaaaaagcagtctaacagtctgttgaacagataaaacataaatgacgaaaataggctggagcttccaatacaatgagaagacaacaaaacttcaggataaagttgggagtattttatcagtgaacgagcactaaattgtcaaaagatagctaatggaaagagttagacaacgcatgtttctttttcttttcttgctaacaaacagttataagccacattatatttttcactcaaatcttataatttgcatggagaagcttgtcaagtagctacctaagaaggttaaacatgacatgcccacagtattttctgtgcatgtgttcacctcattagattatttcaacataccattagattactatgcactgcatcccactatgacataatccctctgctcacaaacatacatcagcgcaatcaaactttggaatatttaattttgcaaattctattagatgactctctctctctctctctctctgagcatacacagtcaaaaattacttttaataattatacggagtgctaaaatgttgtagcaaatgatccaacaaatatttaccttttaccaaatgttacatgtatgctaattggatgcatgctcaaaggaaacagtttcactgaaactaaactgatggaaacaaacaaaaagagttcaaaaggacatggacaaaatttccagcttttcactgtgtttatggaatataagacagaaatatcatctgcaagggaccacatacaacatccggttccatagtgtagtggttagcactccagactttgaatctggcaacctgggttcaaatcccggtggaaccttctttgtttttttttaggtattcccgtactcctcaaatgggatcgagatagtcaaatacttgcaggatcaatatatcaaacatgagctgttataaatataatataagagtacttctagtctgctactgtggatgttataagagtaccgagcagctgacagattgacctgtcagtagtagtgttattgctcttttttctcaaaatacaagataaacagcagtggttgtgagttttgatccttctgcttttttcatcgtttactgtttaaaggcaggaggaggctgtgagcttctttttttatatgaaagcagattctgaatttcaggatggacttgggagtattttatcattgagcatagttca

SEQ ID NO: 80079 - DNA, 13897 bp, Oryza sativa
  unsure (1)..(13897): unsure at all n locations
ttttccttttttacatacatgggcttttggggtatgtatttctttccgtttcatgttataagacgctttgatttttttctagtcaaacattttaagtttataaaagattcagcaacattttcgacacaaaagagtgttataagatgctttgacttttttctagtcaaacattttaagtttataaaaagatgtatcaacatttcaacacaaaagagacatactatcaaaatatattcaatgaaactaatttggtgctgtggatatttctaaattttctataaacttggttaaactaaaagatttgttactatggaaaaatgtcttatcgaagggagtactttgcaaaattatgagaagactggtcatctcccggagctaattcttttatattttagccctttaaaaaatttattttacaaataaatctctggaaaaacttaacaaacgacactagcatcgaggacccatatgtaactagaattctaaaaagggttaaaatgtaaatgttttataaaaataagcccccaacactagaggggagccctaatgggcgattgatcgcccgctaatgggggtagcgatcanattngntaccccccctcccccctccctccttggtttccttttttggcaccgtattacttttctattttagtaaatttatacacctcaagtttatacacctcaagtttacacatctgaagtttggagacccaaagtttataagtcaaaagtttatatatcgattcaaatttgaatttgaattcaaatatttttttatatatagtatttctatacatctaaagtttatacacctaaagttttatagacctaaagtttatagacctaaagtttataagttaaaagtttatatatccgattcaaatttcaatttgaattatatccgatttaaatttgaatttgaattcaaatatccgattcaaatttgaatttgaattatattcaaattcaaatttaaatttgaattcaaatattatatatatatatatatatatatatatatatatatatatatatatatatagtatttctatacatctaaagtttatacacctaaagtttatagatccaaagtttataagtcaaaagtttacatgcccaattcaaatttgaatttgaattcaaattttttatatatagtatttctatacatagatttttctaacttttgttttttaaaaaattttgtgtggtgtactgtagtagaaagagaagaaggggaggaggaaggggggagaggagggaggagtatatactataggagaggggaagggggtgatcgatgggagcgatcacccgcccaacaggatttccaaacactagagtcatgggcggaaaaaaaattccattcttgaaataagtttttttaggtaagtttttaaaaaggattaaaatgtaaaaaaaatccagcctcacgcaggatacgttggtgcagcccattggatcaacatcactgaacttacaagccactagcctttccggccgccatctagcatttttaatggaaaagacaggaaccaatacttgtatataataaaatagtagtatagtagcggagcgagaatcctaatgagcgattgctcgcgtgagggagtggatagcgatcggttggtgggcctctctttccagttcccacgttgctttctttttttttcaccgcattgcttttctattttagtaagtttatacattttaagtttacacatctaaagtttttactgttaaagtttatatatgtttatatatataaagtttatactatgaaaatttatatactcgatttaaatttgaattcaaattttaatatattttaagcgatcagttggtgggcctctcttcccagttcccacgttgctttcttttttttttgccaccgtattaatttcctattttagtaagtttatacattttaagtttacacatctaaaatttttgtgcggttaaagtttatactatgaaagtttatatactcgatttaaatttgaattcaaatttaaatatattttatataaaatatttatatacacatagtttatatgtacaaagttagcaatgtatatatgtgtgtgtgtgtgtatatatatatatatatatatatatatatatatatatatatatatatatatatatatatatatatatatatatatatatatatatatatatatatatatatatatatatatatatatatatatatataaagtctatgtacatgaatagtttttagtgtaatatattttttatttttttcacacttatttttaaattgattttaaatttacgaagaacccacgactaattgcgtaacgcagcgttgcttttttttacacgaggaaaccgcgtgcgggcgtgatttctgatcgctggcctccggcgccagcgatcggtcgcgcagcagccacccctgtagcggagcccactggatgtgtttaaaattttcaggggggaagggagggagggacgacccccctcccctgttatcccatcatcatctcccttgttgggttctttagagttcttccttccttccttcatgctccgaactccgaaggaggtgccccagagagttcatccaatctgaccaaatcacgtaagcaatcgatccgggagcgaagttgcacgcatagaaaactacggacggcggctccggcgacttggctccagtccggtatgtggtatccactcctccaagttcttcttctgttcttcatcatcccctccctcttctcactttttctggattaaaaaaaaaatcatggagaactcgcctagtgaatttggtggtggtttcccaacctccatcattcccttgttttccttttttttagaaatgttctatagaaaaagttacggtaaaaaaccatattaactcatttttcaagttttttaagttatatttaattaaccatgctttaatttgttactccgttttgcgtgtggagggttccaacccaaatagcctttgtgtctcatcgatcgcccattcagccaccatctagggaaaaaaaaccgtcaccaagctcgactcgtatctggagctctgtttttttctcttctcaaaaattcattttttttaaaaaaaattactagtgaactgtgacaatggtttacgtgatatagtaccaagttattaactaggaaaccaatccacctataagtttatttcattaagtacaattacaatttctaatcgttttcttttgtattatactactaagtttggttatttactactccctccgtcccaaaatataactacttttagtcctcaagatttgtcccaaaatataacaacttctccaccaatattctattcccaaccaatcacaaccctccaccattcacctttcccaactacctccaccgcctgcttggttggagggagtttttaggagggattgggagtttagagggatgaggctattaactgttttatttggttgggggatatgggaattttggtgggatggggatgggaaattgagaaatgaactccctcctttttaatacctgggtaggggcaggtaattgggaggcaattcctcatttacttcgcctaaacaaatctcagccatccattttcattaatgacctaatctccaactaaactccctatcaattttcaccacctctaccaaataagatactgggatgaaaaatcaaattcccatcttaatctcaccatcaaatccctcgtgtaaactcccaatccccttccttgaagttgccaaacaagccgccactactcaaccaatcacaaccctccatcattcacttctatctacgttcttaataaccgtgtctaactctaaaaatacttatattctgggacagaggtagtataaatttctccaaactcattccaccttcgtcccttcccatgtaccataatataaggctattgtttttcaatgtttttttcgatgatcttttaattaccatgtatcataacgatgcttatgagctcttttctgctaatccaaattattggtcaccttaactagtatttgtctgaaaatgagtagttcacctcctaaattgcttccatatacctgcatttttttacctgttcagaaatggaatagctcacctctgcgtcaattttattggtagcatgatgcttgtagtgcttctctgtgcttgttacgatattcaaaaatagtgttccttcttgtccccgtgatattcaacatacatatggtattctatcttactataaagttatcccccactaactctttaaacttaacatgcaaagatgccacatcatcatccattaacaagatgtcacatcatcatccactaataatcatcacatttaaacatcatgcaaacatgctatatctttatagtttttataatttaagagcttttcaaatataaacatgttaaattatcatccaacataattcatataatgtttcaatgtatatctttattatgttttatgatatcctatatataagtacttatatagttcatcctcacttagttagttcttaaatgattaatctagggtccaaattatctttctcctttttttctctaattaagtcatatcacatcaattgtttttagcctttagatattaatctatggtccaaactatctctctacttttcttcttccataaagtcataccaccttactctttacgtttgaatcaccattctacatactatttaaatttaaattatcataaaccacattaatttacttaatctgatgttatctagctattttacgtgttattttttttattgttatcatactaaattcctgcagcaatgcacggggtttcacctagtattttcagaagcagtaccttggacaccctttaccaggcattaatcaagaacagtcattagctatcctctttatgtctcggtaactcactcagcagctatcctagtcattccagtcattcctagtctctgtcagagcttgcctggtgtcagccagagatatctgtggtactgaacatgtgcaattcttgggttttctttatggcaactaaggacgaaacttttcaacgctttcgtggtttgtttcttcgatcggatcttgaatttcctggttctttgaaaagaattcgaagtgataatggtggtgaatttaaaaatgcttcttttaaacaattttgcaatgaaagaggtcttgaacatgaattttcttctcctcgtgttcctcaacaaaacggtgttgttgaaaggaaaaaccgtgttttggttgagatagctagaacgatgttggatgaatataaaactcctagaaaattttgggctgaggctattaacactgcatgttatatttcaaatcgagttttcttgcgatctaaacttggaaaaacttcttatgaacttcgatttggtcatcaacccaaagtttaacatttgcgtgtttttggttgcaaatgctttgtcttgaaatctggaaatttggataagtttgaggcacgttctaccgacggatttgttcttggttaccccgcacatactcgtggctatcgtgtacttattttggatactaacaaaatcgttgagacttgcgaagtttcttttgatgaggctagtccaggcactagacccgatattgcaggtacactgtcacaggttcagggggaggatggtcgtatttttgaagacgagagcgacgacgacaacgacgacggcgacgaggttggctcggccggtcagaccgggcgccaggccggtcagaccgccggcacacctccggtcagactggcgcaggacgtgcggtcagaccggccagggtcgtcggctgagggttctgttgatgctgatcgagatggtcctccggagattactacttcgaccagtactggtacagaacgtggatcaacttcagaagtcactgctcctttgcacattcaacgacgacatccaccagaacaaatcattggtaatataggtgagcggactacaaggtctaaggtaacgactcatgatgtttatgcaaattccgcatttgttgcttcttttgaacccaaagatgtttcacatgcattaactgatgaatcgtggattaatgccatgcatgaagaacttgaaaattttgagagaaacaaagtttggactttagttgaaccaccttctggacataatattattggaaccaagtgggttttcaaaaataaacaaaatgaggatggtttgattgtgagaaataaagctagacttgttgctcaaggttttactcaggtggagggtttggattttgatgaaacttttgctcctattgctagaattgaggcaattagacttttgttggctcttgctgcttcaaaaggttttaaattgtatcaaatggatgttaaaagtgcttttctaaattgttttatacaggaggaagtttatgccaaagaaccaccaggttttaaaaatcctgattttcccaaccatgtttttaaattgtctaaagctttgtatggtttgaaacaagctcctagggcatggtatgataggcttaagaactttttgcttgcgaaaggttttataatgggaaaggttgacaaaacgctttttgttcttaagcatggtgataatcaactgttcgtttagatttatgtggatgatatcatctttggttgttcaactcacgctttagttgtagattttgctgagactatgtgtggggaatttgagatgagcatgatggatgagttatcgtactttttgggattgcaaattaagcaaacacctcaaggtacttttgtgcatcaaatgaagtatacgaaggatcttttgagacggtttaagatggagaattgcaagccaatttcaacaccaattggttctacagctgtgttggatccagatgaagatggtgaagctgttgatcaaaaggaatatagaagtatgattggatctttgttgtatctaactgcttctaggccaaacatacaatttgctgtgtgtttgtgcgcacgctttcaagcttctcctcgtgcttcacattgtcaagcggtcaaccgaataatgagtatttgaatcatacacttgagtttggaatttggtattctacttcatcttctatatgcttaagtggatattccgatgctgattttggtggttgtagaattgataggaaaagtactagtggaacatgttattttcttggtacatcattgattgcatggtcttctaggaaacaatctagtgttgctcaatcaactgctgaatttgaatgtgttgctgctgctagttgttgttcacagattctttggcttttatctactttgaaatattatggtcttacttttgagaaagtacctctctttttttataacacaagtgctactaacattgctaagaatcctgttcaacactcacgcacaaagcacattgatattcgctttcactttttgagagatcatgttgagaagggatatgttgaattgcagtttttggacacaaagttgcaacttgctgatattttcactaagcctttggattctaatcgctttgcttttcttcgtggtgaattgggcatagttcatccttttggcatggtttgagggggagtttgtacctcatggttttatcaagcgataatatgacaatgagaaaaattgagaaaatagagctttgtttatgcaaatggtattttcttgtgcatgctagcaatactttgaaggtttatttgtctctagcatagcttgtatgtattctagtcttttcatgagatttagattttgcttttaagggagatgatgcatgacacttaaattctatacttgaattaagaaaatatgcaatgttgatgctagcatatggtttgatttataaatgctctatatatatatgctttgttgaattgttattcctcaaatagctttaattgctcattgtgaaaagagaataaaaaaatatgaaaaaaatgaataccgaatccttggaaacagtcttgacgacaatgatgtattcgatgtgagcaaaataatggatgccgaatccctggaaacagtcttgatgacagggacgtacccggaataaaaaaaagagaaaaatatgagcaaaaaggctcaagaaaagaaaaggttcaaaaattctctttgtttttttgtgctaaaacgttatttgagaaagagtgataaatgcaataggtatatgtgtttagtgtttattcttcaacctatgtacttgttaagatgttgcattataaatcatataaaatcatgaattttgattgttgattcaagcttaattgtaaaatctttggttcatggttatactttaatgcatgcttgttatgttatagatgggttcatctcctttttattgcaacacatgacttgatatgcaatatgtatgctaagctcttatacattaatgaacataattcttatgcttgatgaaatcattgtcaaaagggggagaagagatgagttttggaggaagcaagatggatttttggagttgttgagaagagcatgttgtttttggttcaattgggaatttctttcttttaaaaagggggcgaagttttcttttggatttttgagcacgatgtgtacatttgtacgaagtgtgctttttatcacttttgtttatatttttccaaacatcaaaacattttaaaagggtttgccaatgtgttcatcaagggggagattgtaaaatcaaaggtgtttttgattattattttgtgatgaacaattgggcattggagattattggttttattgtttggaatttatttacgaagtggttttggagatgattggatttacaggtgaatcacaggtactgttatttcatgcgaccggtcagaccgggcagtgtgtgccggtcagaccggcgtgtatcgcgcggtcagaccggcgcagcccgtggtctgaccggccgacgctgtgtcagtttcggtttcgggttgtttatttggatatccgtgattatttcatgattatggcatctagatggatactatacgtatgtaatactgttgtttactactaatgaatcaagttggagatagcttggtctcggaatatggtttctttgattatttcatgtgtaggtgactcgatgtctcgggtgagtatttgcggtgatggaccgggagtcggcttggggataagacgacgtccgtggtggtcagagatcatgcgggatactaaggctagagttgatgcacgtggttgatggagattccataagacatatgatggagttattgtgtgcgtatgggatgcggagttgaatttggaaggagtccaaatttggtacgattgattatgtaaagtttctttcttgtactagagggtttcctaaggtgtttaggactcctagtatgagtttggttcgtggctttaggctgcctacctcgggtataaatagagggggagcgtgaggcttcccggtatcgcttttgagagcaattgagttgagttttgagttagggtttcgagtttagtcgaaatttttgtaaggagtgctgttggtgcactttgtaacacagagagaagtaataaagtcgtcatccactttaagagttcttcgatttgtgttttactgggtttcggtggtctaaccgacgacacaccggcggtcagactagcggcatcgcggcggtcagaccggcggcggcgacaggtgcggcagggattctagggcggtccaaccggaatatctataccggtcagaccggcagctacgctttggtcagaccggctaatctactacggtcagaccgatctccgtcgaagtcgacagtaacttttatttccgctaaaagtttttggtttttgggtataccaaccattcacccctcctctagttggtttagttcttgctattcgatccttcaaggcatgccacagaacactatgatcaatggcttcacacaagaagcttcacaaaatgcttatgctgcatcatggcgaatgacaggatcgcagcaacatccatcggcagcttccaccgcgacaggtttaggtgttcagccgatacagcagcccaacatttcattcaaacaggagcaacaagagttacttggccacaagccaaatgtacaagagtgtcagttaattggtcaacatgatgcttctgtgaacacactgtagagaattatgagacgcctcacgacacaacgtgggagggcgattgtatttatatatccaatacaatagagattacaacaaactcttaaataagagttatatacggatacaatcgatacaaatctaatctaactctaatacccgcccgcagtcaaagtgggaggaacatcacgaacgcaaagactggacctaaactcagtgaataactgaactggcaagcctttggtcatgatatctgcgaactgatgtgaggacggaacgtgtaaaacatgaacttgtcctaaagcaactttctctcgaacaaaatgaatatcaatctcaatatgcttcgtctgacgatgatgaacaggattagcggtcatgtagacggcgctaacattatcacaataaacggtagtggccgaagcaagtggaatatgtagttcaagaagaagttgtcgaagccagcaacattcggcaacagcatgtgctactgcacggtactcagcttcagcactagatcgagagacagtggtctgtcgcttggaggaccatgagaccaagttttcaccgaggaaaacacaataccctgatgtggaacgacgagaatcaggacaacccgcctagtcagcatcagaataagctatcaaagagtcaactggtgcagttccgatgtgaagaccaatgtgtagagtacccttgatgtaacgcaaaatccgtttaactagagcaagatgaggctcacgggaatcatgcataaacaagcatacctgctgaactgcataagctatctcaggccgtgtgagagtaaggtactgaagagccccagctagactcctgtactccgtaggatctgaaacgggagctccatctatagcagaaagtttacatcgagcatcaaccggtgttgcagtaggatgacactccgacataccagctcgccgcaataagtcaacagcatattgccgctgagaaagaaataaaccgtctgcagatcgagtgacagaaattcccaaaaagaagtgtaagtcaccaagatcagtcatagcaaactccgagtgtaggcgagcagtaatatgctgaagaagtgaagtggacgaggcagtcagcaggatgtcatcaacatacaaaagtaaatatgcaatattatctccatctttataaatgaagagagaagtgtcagatgctgaagatgtgaaacccaactgacaaatatatgttgcaaaccgttggtaccaagcacgaggagcctgcttcaaaccatagagcgatttttggagcaaacatacagcagtaggcgcagaaggatcaacaaaaccagatggttgctgacaatacactgtctcctctagattgccatggagaaatgcgttcttgacatcaagctgatggataggccaagaccgagaggcagcaatactgagaacaacacgaatagtagcaggtttaacaactggactaaaagtctcatcatagtcaatcccatgctgttgagaatagtcacgaacaacccatcgtgccttgtgtcgagcaagagtcccatcggaatgaaacttatgtcgaaagatccattttccggatacaacattagctccaggaggtcgaggaaccaaacgccaagtgttgttatcaacaagagccttgtactcatcagccatagctgcacgccagttagggtcagccaaagcactacgataattggaaggaactggcgaaacagaagtctgcatagcagtataattgaagcgatggacaggacgaagattgccggtctgagagcgagttaccatagcatgacgctgttgatcctgtgtatgttgtgcagctcgaaaagctctggtggtgcgtataggaccatgaaccgccacaggctgaatacgacgcacatacgtatggcgatatggagagatcagcggccgagcagaaggaacactatgcaaggcaggcggctgagcaatagaagaattcgatatagtttgcactggtgatgaagaagacatgctcccccccgtagtactagcatcggcaccagaggatgcactggaaggcgccaatatagctggttctagagcttgcgatgattgtagccttctattatggagaagaagccgatacatatcagggccggccaagtcatccggcggctcgacctcaggagagggagcgaccggtagagaaagcggatgctcgacgtccaaggaggacggagctaccgctttagaaacaccctatagaagaaaatcaaaagaagaagcagtttcgggaatagctgcaaacgggaatgtctgttcataaaaaaccacatgacgagagatgaaaacacgacgggtagaaatgtccaaacaacgatagcccttgtgagaagccgggtaaccaagaaaaacacaggcagcggattgaggagagagtttatgaggagtcgtggcactaagattaggataacagaggcaaccaaaaacccgaagattagaataatcaggaactttgtgatgcaggatttgaaacggaatagagttgtggacggaagttgagggtcttcgattgagtaagtatgtggctgtggctagagcttcggcccagtaagaaggaggcatggatgcttgtatgagtagggtgcgaatggaattgttgattgtgcgaagcatgcgttcagctttgccgttttgaggagaagtgtaaggacaggataagcgaagcaaggttccacggctagcgagaaacgaggtagtggcttggttaacaaattcggtaccattatccgcctggaaacacttaatggaagagccgaactgggtcgtaacataagcaacaaactcaacaatatgctggtgaacatcagacttatggcgaagaggaaaagtccaacagaagtgactaaaatcatccagcaccactaaataatacttaaagccagaagtactcaagacaggagaggtccacacatcacagtgaacaagctcaaaaggagaagatgtactagactgagaccgagaaaaaggtagacgcgtgtgtttctctaactgacacgcatgacagaaactatgatctatcttagtacatggaagaatagctaatttgtggagactctaaatagcagctgaactgggatgaccaagacgacgatgccacagggtagaggattgggccaggaagctgtgggcagcaatagtaggtgcagcagtaggtagagtgtagaggtcaccacgactattgcagcgaagaatcatgcgccgggtacggaggcccttaacagaaaaaccaaactcatcaaactcaatggaacagttattgtcacgagtgaattgacgaacggaaagtagattgcgaaccaaagagggggcgacaaggatgtttttaagatcaaatttagtggttcctataggtagaaaagaagtgccacgacaaataacaggaatagtatgagcattgccaacggtaatgaaggtatgggaattgggaagacgagtaacgagaataccgtcggtagaggacatgtgtgaagtggcttctgtgtcaagcacccaaggacttggactttgcacggacaactgattgagggcagcaatcagacctgcctgatcccaattgggctgagattgctgtattggtggcaagcccggcattggtggagagacatatgggcctgcaaatgtcgtgtgtgcttgaggatatgggcccaggaggccggcactgttgctgggacgccagggagactgctgctgctgcacagcccatggattgaaacagacccatgggccggtaggtcgtggcccagcctggtgctgctgctgctacaaattgttcccgaagttg

SEQ ID NO: 80080 - DNA, 13242 bp, Oryza sativa
caggcatcatttcttagtagttctttacttaaaggagatagacctttctccaattgttatgtaaccatattataaatgtctggatgtagtagggatgttacacacatctgtttaattgtttttactgccatacctccattcttccaactgcaaaaattcttctattaggcaaattcaaccaagtgaaaatggcttatacatagcactccacatgatggagagagaataaatccccgagttactatcttaaatcttaaaaaagaaggaagaaacaggtattgctcaatcccagtgccatagttgaaaaaagctggaccagacaagcagttttaactggaattggtgttgtgctcagtctgatctgctaagaccactcatgcatatggaacactttgaactggatagaccaggcagcttcactctgaaccaggcaacattccagaaaatgctggtggacctgaaaagcatggctatagcagagaatggggccaaagcaaggcctaacagaacatccaggcacacaacttgtatcaactatcaagcgaaaaaaggatgaaggggttcaagcatgggtcttcaaactgaaaacgtcaccactaccaccccaccaccatcaacttgcatttgaaatggaacatacactataattcaaattccgtgaactgcagttaaaccggaactggccatcagactaacttttcgtactatgcccagtgcaaagaaaatgtgtttccagttagcaggaactaagaattaaaagctttgtgacaaaagaagatttgaatggctaagacaaacatttcaatcattacataatatgtattcataaatgaggttaaaatagtttctcatgtagccatgtatgataagtgtcatgttttgttgtgttttgcaatgggtaggatccaatgatccataagaaagaatttgaaaaggaatgaatgagtctttggggaacaaatggcatctccaatttgaatcatggcatttgatctaggacaccaaaatatcgtggctttgctgagacaaactgcatttctgtaactgtgaccctccccatcctatcctaggtttaacaatgtagccaccatccacaaggtttttgagaatgtgtcgcacaagtgttcaagatggctatggcattcagctactacactgtaggagtacaatgaagcaattcatcctcatgagaatgtttagtgtcaaacaaaacaagattttcatgtatggtagaaagggttgtcgggaactgtttgcgcagagagcacaggctcatgcacataattgcacatgaagtgaattagaagtatgcactaaaacactcatggggatgtgcttgcgtgaattggtcgtattatcaaataccaatttgagatgaagttattattgaaaatactcacgaagagcaacaatcgagctagagctagacaagatttggatcagtggagatattttgaacctttctagctatgagttaaccgtcatcgactccaatgaccccaacgccttctgactcaggccaaactggacaaacatactctcttgtactaactaatgatagttgaagccttggaggcagcattctgaaaggcagacgcctagcctcctcatgccgaggtagcttgcagtgctgacaccttcaacttcaagccttactcacctagccgatttatccaatctatacggctgattaccaggcgccagtcctccaacagacacacctagggccttagtgaatactagttggatgtgatgacagatgtcacaaacattgttaagcgatgcaaagtgcattccaaatgggggaatgcttaccataatatagcgctgtgatattaaagagaaatgtgagcagactcatatccacctgcctctaggcataatatgaactgacagactggacaggtggtatctttgttgtgtccatgaaggaatattaaatactctttccatcccaaaatacaaagcacccttattgttagaacagtcaaatgtgtttttttactaataattaaagtatatttttattgccacgcatgtgatatcattagattcgtattagaatgtactttcatatgatattaatttcttagttgtcgataatgtattacaaaataaattaatggtaaaaaagattcaaagtatactcctggagactctgtaaaaggctaacacaccttatattttgggaagcagggagtatatttgaagtttcttttaaccacagcttaaccagtgttcctccggtcagactgtcagaacaacaaaccgagagtctgacctgatgaccagtctggcttttaatgctatggctccagaaaccataacacagatagaataccctaaccctgtttggacgtcagtaaacacaaggggccctgcatctagtccacaaacatgataatctcttgtttttctgcttagcttgacacactaaaaccatcaagtttgtagcgttgcctgaaatataattgaccccctgaacctaggagagaaacccacaagtacctcttgtaatgtgaaacaggataaggacccgataaaccaggatagggcactgactctgacccttgatttgtctactgggaggcgtactcttgctgtagacacaaggctctaaagcaatctagaagaacaagaggaaaatatgaaacttcttttctcagtgcatctttctgttaccattgctcattaatataaggatgccttcctatacagccatctgaacaattaatggatagaaacttttgaggaacccaataaatagaaattatcttttaggattaggaaaactaagtgttaacatatggaagcataacaaactggaactaatcccttcctaagaaactacaaattctatttctccaccttcccaaattccaaatcttgggctatacataacatgtcagcttgttaaccacaatttcactcccatcttatgagttacaaattatcagatgaatcctcgaccatctgagtttacagagaaaggaaacacaaagacttccccattgtatgcatctcgtaagattttttacatccattcagttgaactgtgctttcataaaatcatccagtttggcttacagctagatgtacatgccaagtagatgccctcccagagtcccagttctacgctagagggtggtaagtcttaaaatcagtcagcctgactatataatcaattaagagtgggtaattaactagttcagattaacatattttatgagttgagctttaccatggtatactcctggtacgcatgcttacgaatcaatatattcacattagcatgtcagataggaacattctaaatttctcctaaaacatacagagatgtgaatacatacgatttcacacggagtatagtataaatagtacttaactatattgatttcacagaaataaaaatgtctatgtttgcacaagaatggatttatttgaataaccaccagcaatattggagaaacagactgccatcaataggatcattgagacataaattaaaagtaggaactcaataataacagaaaaaccttaaattaactcactaggttagattatagtgaaacaaatacagcaataagaacacaaaaactacttaataaaacctacctacatttcaagatgaattggcggcatctgatccatctgaagaggagctatcactgtctgagtctgccaaaaagaatattaattgattacacactaactcaaatgtctacagctggtagatatatatactgtaaataccaaaatatgatgagcaaaaccaagggcagaaagaaatattaccactagaagaggatcctgtatcactgctggagctgctagagctgctcgatctacttgcattttgtccattattatcagcttgttctggcacagaagtagctaatttctcatccacaatcaaatctgctcatataagaaaataagtaaattatattgcttccataatccatagttcctggcaattgacttggacaattagatgaagtacaaaatagagcagatctaacttactttgctttggagattttacaccaatattaggctcttgactctgcaatccaagaaactgtaactttcagcaccaatcataaaattcaattaactatatagtgctacttatagaataggaataggaatgattgaatgcccatactggttgttgtggggcaacatgttgtgcatgcaactctgcatcctgccttgcaagcatggctcgctcagccttcctcttttgcttgctcaggttcttcttgtagttggccacaaatctatcaagttcccaaagtgtctcagtatccatgctatctatttcaacctcaatctcatcatcatgctgtctaacagacagattcttgttcttaatgatctgcacaacaacatcaagcttctccggtggcaaattctgaaggttgttactaagcttccgcttctcatctattgtcatatctctcttatccggatccttggcctttggtttcttcatcgatggagtcctggcactataagtgggagtatgacttaatggccttgacttggagtccaacaccatatggtgttttacagaatctgaccgatcaaggaagcgcacgtcaattggtggaggtggaaacttatttggcaatggcggacatgaggcaaggtactgaacctcagcctcaatttcgggccactgcgcctcaaagattcccaacaactgctcagccatgaaatgcacatcctgccccttgggattataggtcatggcattatggaacgtcagccgtacatcatcagcaaactccctcgggttcctgtactggccatgcgtgagtcgggtctttatcgtgccaagatccattgggtgcttgataatagcaaaataatcatgcaaaccaagcgcaacagcatctacaggcttgttaaacacccaaccaaatttgtgcttcattagcctagaaagcagcgacatagatttcttaaaagcatgagagtatagcctctgctcagcatcataaccagcaccatgagatgctaaggaacgatgcttcttcttgtggtgcttgggtttcttacgaccatgtgaatctgaaggcggaaacttatccttggcaagcaagaactctgaattttgatacaactgattcgcctttggtgtccgcttctccttctcgaaggactctgtgtgagtcactgacacggttagtggcccgcgctgcatcactgagcggaccggaacaatagcaccagcaacttgaccaggtatgggcgtcacaggatcagcgagtgcgaactgcgagtgcgcatacccaacaggaagctgaggcggcggcaccaccacaggcaaagcaagggccgctgcagactcagccgcgatggcctcagcggccgccttcagccgcttggaaagcccacgcacctggtcgagctccgacgcaagctgccgccgcagctcgctccgcgccctccgcttccgcgccttctcctcggcggccgcccggacgtctccatggccgttgggaacggccccgccgtcccgattaggccccgcggagacgtcgtcggaagcgggcgcggcgggctccccctgctgcgcgggggcaaccggggcgctcggcggagggggatggggggaggaagcgggcgcggcgggcggatcaggccgaggcgccgcaggcccatcctcggggcggcgaatcgacctccgaatcgaggctagggtttgcgcgagggggctggagctagggctagggttcggagggggtttagggtttttgcgtgggtacttgcgccggtacaccctgatctccggcgcccaccgcgacgtcaccggcccctcctccaccgcctccgccacggccggggccgcggggctcgccgcgggccgctcctccccgccggcgccggcgccaggaggggacgaggccatgcataaattaaaccctaaatccggtcccccccctcccgcgaggccccggatcgatgcaggcggccgccgcggcgagggattcgcgcctagccctgccggaatccgccggggtcgactcggattggagctcccgcggcttggctatggctatggcggtggaggtgggggtgagctgctgcgacgggggtgggtggtggcggcgtcgggtcgggggggtcgtgtgcgcgatctttttttttttttcttttcgtcgtttttatttttgttggtttgggttggggggtgaggtgacgaagagagggggggaggcggtggcgcacgtgtaatcgtggccgttggaatccgatggatggatattacggcacggcaagcgaccccttgggccttggaagctggaaaaagcaaggggccgtgacgtcatcgtcacatactaacagtcacatgcgtctgaagctgctgctgctcagcttgggttcgttctcaaactctttctgcctcgtattttccctttttcgctcgtctagatatgggatctatctcataaatacgggatctaagatattaaatcttttatttaattccatatatttattattcaatatcctacttttataccttttcataaattaaatcgtataatctaaacggagaggcctctccgtttagcgctatcgcgcgacgcgcgtggcagccgtcgatcggcgcgcgggcgacgtggccttcatccggcacgcgtgcgcgtcctgaccgcgggtcggcttgtcccgaccgcgagtcgcactttttccgaccgagagagagagagttggcactgttcaaaaattcctgtggcgctcgagagagagagcggcggagagagggagagagcggaggcggcgagaatctccggccaaatccctgccggagacgtcgccgcggcggcggtttgggaggggggaaggttacggctgtttcgtcctgtcgcgccagcggtggaatcaacggcggaggcggcggaatccgcggtagaggcgacgttttcgtctcatcgtgccggtagttgtgggggagggggggagggaagcagaggctgcggtttcctctccaccaaatccggcggtaagctgcggcgtgcagaggtggttgtggttttttgcgccggagagagaggagcgatccatttttgtgtgtgatttttatgccagcagaggtggaggggggagcgattattgtgtgtgttttttgccggtagaggtggagaggtggagcgatttgtgtgcgttttttgtgccgggagaggtggagagatttgggcattttaactgcgcaaatcagtgtgcgattggggcatttgttttttctctagctctatcccctcatttccccctctctcttcctcatccaggggctagtgctggtggtggatctcgggctctcttttgctgcgccctctctgcatcctctcagagagcacaagtggtggtggatctcttgctcaatttgaaggtatttctattttttttctctattttggcatttgcacatttgcttgcacaggccatgagtcagatttcatgttgtagcctcagcataatgaaaacttggtgccattatactaggatttctttgtgcccctttgatagcttttttagggttccatgcttcatttacaatgtaaacccagtgtgatttttcttcagttaccatgttgctaattgtagatgctaatattcagttatgttatttgtgtacattcagagaacagaggttttttgtgtacttgtgctgccatttttttaccaggggttttgtgtgccctttgatagctctaggtttccatgctttcatacacagtgtaaatatgggtagctacataggtttcaagtcgtaacaaccaacatggattgaatagatcaacatcgatctgcagagatcgacgtacattcagagaacagaggctgcagatagggggggagcatgtatgtgcatgcatgtatatgcagcatgtaattcaataaatcaaatgttccttaagcaacacatttgatttattgaattgcatctagtctagttaaaacttactttttcctatggcatgagtaatatttttagaacaatgaaattaagtttgcatttttttcttcctactagttaagttacttctaaaatgtactgacttacttctaaacacataaatattacttcctactagttgttaagttgtaattggttagtttttgttgaaactaatatttaaaatgattttccagtgatggctaggaagaaatcccatgcaacgaaaggcacgtaacgaatcagagtcaagtcagaaaaaaggggtgtatcacaacgtgggaagaagagagatcacggtggagatgatgcaacacaacctcctccaaaaaggagtagaacaaaggtattgaaacaaccgtctatctttctacccttgaacctgtgtttttgctttttttatttactgcactacactttttttatgctgctgcactagacttttatctgtatttttctagaagtaacttaactagttttagaagtaacttaatattccataaaaagtaacttaacacttactttttttgaaacggtatttttgatgttgaatatggacttggacatgtgtactacctatagttataaccggatggttagtaaatcagaatgatccagtattgaataaaatttggttaactaattcctgtcacattatgtgagattgcatgtctatccttgttctatgtacccataatcctttttatggtagaagtatgaaatgcaaccagtttttcgaaatcaatccagatttatgatgttgcaatccagtattgaatgaagttttggtttgcttcagaaggagtatgactatgtccccatacaattgcactacatgttagaaaacttgtaaaatccaagtggaagtgtttttgcctttttttaatgcactagactttttttttgctaaaggattgaatcatatgacttttatctgtattttcctagaagtaacttaacatgttctagaagtaacttcatctgttgtcaaaaataacttagcatgttctagaagtaacttacagtacaataccttttttttggaagtaagtcagtgtagtttgggagtaagtcagtgtagtttgggagtaagtcagtgtaattttggaattaagtcagtgcattttggaaagtaagtcagtgcaatttttggaagtaagtcaatttttggaagtaagtcagtgcagttttggaagtaaataccatgaaataggacagtaactttttagacatttacagttacatgcctataggaagcaattttttctcaatttgacatcagtggctatagttatgttttttttcacaattttgttttgatgcagtactagaagagaaagcgaggaggcaactagggggaacgcatcatgttgggtgcacatacaaggtacaaaatgaattaagaaggtgtaactcttagtgaagtgttagaagtaggggtgaaaacggtaacggtaattaccggccgaccggcgttcgttttcgactttctaccggccgagccatatggaaatgataatcgaccgaaacaaaaatggaaatggtaaaaaatatggaaatgaaaacggaaatggttttgctgttataccgatcgtttccgtatttaccgtattcttgtggaaattaccgtttcttataatatggtaattaccatattctaaatatgtcgatatttatagagcatgtctatacttgacccgcagcttacatattgactgactcttcaatcaaatctctaacttttgtacatggctaaaatgaagttaatttataatttatatagtataagcttgaatttatgtatacatataacatacttatgtaaagttaaatatatgtttttatagtttaatgtatccgtatttgttacctgtttccgatctgtaccgacatgtttccgtccgtattgttccgtttcaggttttccgatatttccgatatcgttttcgtttccaaatttaccgtttccgatttcatttccgagaaaaatatggttacggaaatggttgagactgttttccgatcgtttccgaccgttttcatccctagttagaagtaagtttctgttaaaattgctctgagagcctactatggaatgtgaattcaactttatgtgaaagtaacttgcaagttcctaggaagtaatttactgaagtgttagaagtaagtttctgttaaaattgctctgagatttttgaaacatcactactcatgccttttgctccaactttttttcctagcagcacatacaaaggaaatttggaggtatgagggaggacattaatcaagatggaagacaggaaacaacattacaactcatttcttacaaaattgcagcacagtttcatagaatatgtttatcagagaagacagaaaagatctcaaagattctaggttagtttctatgatttttttggatggatctcaaaaaaacagaggatgaacttcatgtgtacctgtgatatatttttttggatctactttactttcttctcctcctccgagttgatggtttcgtcctcctccccttgttcgtgctttttttctgatttttttccgccatggcggctgcgtggggattgacgctgccagttgtccggacttgatgggttggaggggggaaggaggcgcgcagcgctctgtcctagctgggcccacgccagctataccacgcgaagcgagagccgtgcaaccgtggtgcacgcgcgggctttccttttttggcaggggcgcgcgttcacgtggttgctttttctggcaggggcgcatgtcgcgtgataggactatcgcgagaccggtctcggtctagtcgcgtccaaattaaatggctttgcagtttcaatattgaccaatgcatcccatctttccatacttccaatcaatcgtcgactatgatgttacattatatttgacattatgatatttacaatccgagttatttttctctataggcatgtcttcgtttcggataattatttttcttatcttaattgtatttaagaccagcaataaattcaataaagattggggattagagttgacgttcgtaaagtttaggtgtttgggctttgagtaagaactataattggattatgcttattgactcgaaattggatcgggtgtcaagtacacctattcgaatgttccctctacttaaagttacttttgttttaagccaaatatttcttatctttgatcattgatatatacaaatccatatagtataacatgtgaattacatattatgaaagtattttgcatgataaattaaaaatataaatcttatgatgataagctatatgaatttatagaaatcgatggtcaaagatttcagatgtctgactcgaacgaacttcgaatgataagaaatttgaaatgaaaggagtataacgtaagcatggaaaagcgctgaagtttaatctggcccatctcgacaacaactttgactaagggtgtgtttagttcacgctaaaattgaaagtttggttgaaattagaacgatgtgatggaaaagttggaagtttgtgtgtgtaggaaagttttgatgtgataaaaaagttggaagtttgtgtgtaggaaagttttgatgtgatgaaaaagttgaaagtttgaataaaaagtttggaactaaactcggcctaagccacagcccgttgtagacctgacaaagtgacagtgatcaaaattacagaaagaagaggcactcaaaaaggaaaaaaaatcccattagttgggatttgggttgaatagtggtgactggtgtagcaaattagagtgtgttcttagcgtgtgtttagttcatgtcaaaattgaaagtttggttgaaattggaacgatgtgatggaaaagttggaagtttatgtgtgcgggaaaattttgatgtgatggaaaagttggaagtttgaagaaaaaatttgaaactaaacaaggccttaagtctaagttcccaacctcactatctcatttaccgcgcgcacgcttttcaaactgctaaacggtgcgtgtgttgtaaaaattttctatagaaaagttactttaaaaaaatcatattaattcattttaaagatttttaagctaatagttaattaatcacgtattaatccattgctctgttttctgtatcgaaggtgagggttcccaaccatcactaagaacacagcctcaattaggggacagtgcttggcccattgatggtaaacaagcatttgtttggaattgtgaacaagaaaaaactgaaacgaacttgtcccttcacatgaagcctagctagttgagtgaaactgaatttcgacccatccatttgtaacaacgcatgattaagtggtttgtgtcgacgtttgatgtcgcgattctggtatttgcatagtatgggtatcgttggtgctaggatatatgcgacattgtagtaaaagagatggggacgaggatttttatacaggttcgggcccctgaattatcatgtaataaccctactcctgttggccgaagccggtattgctcttattcaccataatcacaccagtacagtatttggggtagcctatctaactgttgtcgatttggcgatctgtagtattgactcgtagtcgacaacagggtagccttcctcctcgaatccgcatccggcgagatcagagacagcgctatgtctctcctgatggtagccataggcaccataggggactagccatgcctatctctgaagtcaatatctggcgtcttgtcttagcgtatgttggcttgtatgttgatcttctgtcttgatctattgttccgtgtcccctctcctcctagggggtcttgaatttatacccataggtgtccccttgtccaagtagaactaggaaaaccaatatggatacaatctgagtagtccttgtcgtttccatgtagaactctattcatccttccttatgcggaattcctcctgtatccgaaggttgtttccgtataatacatggtatgtggtgggtcctgccgagatttagtcaactactattaagtatgtggtatccataaccctgacagtagcccccccgacttcaatgcaaatgaacgaattcatattctcaaccgcagaccttggagtaactgttatcgagctcacgcgaccgttctcggtgagtttagagataacgttagacttcccttatcagcctcgtgcgggcacctatagggtttgtctgagtcaatctcctgatgtcaaccaagaaagtacagagcatacgactaagtctcctgtcttgctgtaatcgagaatttggattgaa

SEQ ID NO: 80081 - DNA, 7297 bp, Oryza sativa
  unsure (1)..(7297): unsure at all n locations
cgttttctctttttccgacttcgatcagtcagtttgttgagtcatacactcttcctagcccccagccttgtcgtcggagaatcgttctcggaggataaggctcttggacccttgacctcccttggttgaaaaagcactgaccatagcccccagccgtgaagttggaaaactcaatttccgattacacggcttggttaatacgcacggcgagaactcttacatgaccagatcttacatggtcgtttgtctctacatgatccgacaaggccttatccgctctgggtgtccccagccgaagttcccttaggttcctcagaggccttgtcaggacggcataaagggacatgaggataggtttcaactttaggtgccgtcgtggtaagggatctctggataaaacacttggcgatattgtgtacctgatatcaactttgtcaggagagaggtaatgggagaatcgctacacctctggtcgaggaccaggtagtagtcgtaactcgaccacttaaagtagaggtagtgggagaatcgctagaccactggtcgaggaccaggtagtagtcgtaactcgaccacttgaagttaaggcgcgaaagattgctacgatttactggtttgagaacccgcgggtagaattatctctcgaacgccaaaggaagctgcggtgcgagagattgctatgatttactggttcgagaaccagcgagcgagtagacttatctctcgaacaccaacggaagctgcggtgcgagagattgctaccttttactggttcgagaaccagcgagcgagtagacttatctttcaaacactaatggaagctacggtgcgagagattgctacggtttactggttcgagaaccagcgagcgggtagaattatctcttgaacaccaatggaagctgcggtgcgagagattgctacggtttacaggttcgagaaccagcgagcgagtagaattatctctcgaacgccaatggaagctgtggtgcgagagattgctacggtttactggttcgagaaccagcgagcgagtagaattatctctcaaacaccaatggaggtgctagagttggtttattacatgtgcatctcatgtggccagcatgactcacatacccaacttatagcatatctggatgtccgttcgcaatcatgtcgggtgatcaagccgatgacgttcgtgaggaattatccgttaacaaccttttctcgaatagtccagccatggccggtgctatgagataggtcgtcggtctttgttggcaggttgggcgtgacgactctgtatttgtcgagatcgttctcgataatggggtgtactcgaccacaacctactcgagtgctcaattgttcctgaaaaatattttctagaaggcaagacatatagcagataatatcgagtatgtactcaaaaaaaatgcatggatcttctagtattatcaggatataacgagcagattaaatatcaagcattatgtaaaccgtaaacaagcatgatttatacagaagaaaatagagcgagcccccagcattaaaccgtagtcggtttaacatcaggaacactcgcacaacagatattgtataaaaaacatgctctaggtaaacataaaaaattattgatctgacaatgttgtacaatctagaaataggcatgacaaattgcatataaaatattgcgtacctttgtagatacatgccggatgtatctacgaaattagtagattaatttaaaaaatcaatctcctaattatcttgttgcgtactcgttcgatatcatgtgatctgacatcttttggtacgccgcggagcttgaggcttgaatgatctcgataggccaagttgttgacgacgatggttccgatcttgtcgaggcacgtactctggtcaagttagatcctccatagccgaagttatcgagtagtatgctgtcagagaatccatctcttaaacccatctcgtcgaaaccttgaagcaccaaaagatcccttacctggcgcgccactgtcgacgtttgatgttgtgattccggtatttgcatagtatggggatcgttggtgctaggatatatgcaatattgtagtaaaagagatggggacgaggatttttatataggttcgggcccctgaattgtcaggtaataactctactcctgttggccgaagccggtattgctcttattcaccataatcacaccagtacaatatttggggtagcctatctaactgttgtcgatttggcgatctgtagtattgactcgtagtcgacaacagggtagccttcctcctcgaatccgcatccggcgagatcaaagacagtgctatatctctcctgatggtagccataggcaccgtaggggactagccatgcctatatctgaagtcgatatctgacgtcttgtcttagcgtatgttggcttgtatgttgattttttgtcttgatctattgttccgtgtcccctctcctcctaggggttcttgtatttatacccataggtgttcccttgtccaagtagaattagggaaaccaatatggatacaatccgagtagtccttgtcgttttcatgtagaactttattcatccttccttatacggaatttctcctgtatccgaaggttgtttctgtataagacatggtatgtggtgggtcctgccgagatttagtcaattactattaggtatgtggtatccataacctgacagtttagatctagtctagtcactgtaacacactaaaaagaaatgtgtttatatcagggctaacttaggatgccatcgtttggccaattatggataataaaccaaacgtcgtattagtgataaaaaataatttatgaataaaaactaatgatttaaacgtcaatgttaaaagagaaactattataaaaaaacttaaaatcaactttaaaaaatttaaaatttttggtatcagcatatacgttacaggaaaaaaagatgtggcccttaaattcaacacgttgataccaattgttggaacatttattaatgcgtcggtcttacaaacagcagtgcatatacacacagaatccccatgctgcacgctctttcctctatgaaccagcttttagggtattgaaaagcaaaagctagcacaaaatacatatagtactatactagttatcattatttttttgaaagatcaaaacatttactgtaattaactgagcagatggaactcacttcagggagactaaaacaagtagccgacagatataaattaagaaagaagcctattaatcactctataaactcgtatgcttttgatattgtttcccgaatctgatatgcagatgctgctagctggccctcatcgtcgacgacgaactgatcatagctcagtgatgctgagggttgggccccccggggctgagcctcttggacccctcgtaaaccgtctcgtcaatctcttctccatcatctcgctgccgcggcaatactgtttcgaccgccgtgccgctagtcctcgccgcggccggcgcagctggcggcggcggccgcggcgggggttgactgacgacggcggcggcgaccatgtcgtgaagccggcgatggtgatggagcactgggcagcggtcgccggagacggagacggagacgggagaggacgagccggtgacgaggaggaggaggaggcagaggcagagacacgagagggttattagtttcatctgtccggcgctggtaattagtgatggtgttgatacatgtttatgtagaggtttaagctggcctggaaacgtctatttatagtccaaacggcagtgctgcttgacttgtcaattacgtactggtttcatttttttgattcacaagtatatattttttttaaaaaatgtgttcatcctgtagtatatactacaaaaagagcccaaattatactgtttttattcacaagcagaagtattacgtgcaggcaccatacggagcatatacaatgttctttcttcttttcccctttggcagatttacaagctgacctaactctcaacattttacagcggagcatttagagtttggtgtgttgatgtactgatcgatgtatgtgtatgtgtgtcttttagttttaggagtataattgaaaagagaaaacgtttgaagtttattttgttgttgtttcagaagttaaaattgctttcctaaaaaaaaagagagttaaaattgcttgcatgtatatatgatctcttcatggttctaactcaatcaggtaagacatgggagtgtatgttgagagtgcatcacttcaagttaaaacgcttcaatttcaattacaaaaaaaggttaaaacgcatcaagtagtgtcaattaatttcttgttctatcataacattccactaattccctgcgctcgctggataaggccggttaaggccgtctgtcctttccctttttgacatacacattacctttgaactataatgaaagtgttctttttgacaaaatgtttgacaacgctaaagatcaaagggccaaagcaaaaaaagcaagcaacttttcttgtcacttgtcatggacaggacaaaatgtcataccaatgggccggtttgtttttttatgggatttgatactgaacactcaggtgctttttcatgcgaaaattagtttatagcataagaagatttgacgcgctcttttagctatagcatcaaagttcatgggcatattttaaaaaccaagtcaaagtccattgtggaaaccagccaaatcaaatcacgccctataaaaatcaacccagggaatatatatatttcgggattaatgtaggattttagagtatttttaatttttgaaaataattaagaacccggatctacatccaaactatacatagccgatttagagtattttgtgggagctaaattaattcatatgaaaattctataaaatcaaggtacaaagccactctatgatggaaatgcttattacattaactaggtgaaaccccgcgcattgttgcgagaatttagtatgataacaataaaaaaaataatgtgtaaaatagctagaaaacatcagattaagtaaattaatgtggtttatgataatttaaatttaattagtatgtacaatggtgatgcaaacgtaaaaagtaaggtgttatgactttatgaaagaagaaaagtagggagataatttggaccgtagattaatcatctaaaggataaaacaattgatgtgatataacttaattagagaaaaaaaggagaaatataatttggaccatagattaatcatttaatcactaagtgaaaatgaactatataagtatataggatatcataaaacataaaaagatatacattgaaacattatgtgaattatgttggatgataatttcacatgtttgtattggaaaagctcttaaattataaaaactataaaagatatagcatgtttgcataatgtttaaatgtgatgattattagtggatgatgatgttgcaccttgttaattaatggatgatgatgtggcatcttgttagtggatgatgatatggcatctttgcatgttaagcttaagaagttagtgggggataactttatagtaagataggattccatcacggtgcgcttgttttgatcaaaattaagggcaatttgctatgcatgatctatagatctagttgattgccagacaatccgacatacctgccataaccgacgtgaaacctaacaatgaaataggccaattatctcagcaggaatcgcatgatcatgctcacattacaatgtgtgctatgctgtattgtaagcactacccgattcggtattgcaattgcatgtcatcttgcattatggcttaatgtgtctcatccaaaagaagaggaatattttgcatcaattacttgtcggttgtcctgttctggcggcaacaatttttcatgggtcaccaaaattttaggagattcgccagttattaaacaagcacctcctctcttttaactttttagggttaagtccgatttacccctcaactgtcctgaaaattcaatttaaaccataaagtgctctaatgcgagatgttttacacctctgagcttttaaaacagtatgaactagactcccacacgctttactgtagaaatttgtgtatgtaagatatgtgataaatttgtacagtgatgaaaatataaaataatttagcaagcaaatgaaagatgcaaagccgagaatggaacaggtcgattatcaggtttttcccctacttatcgatctatttctaaaacccccgttaactctggtataagaaattttttttgacgtagggtataagtacatcgactaactaagggagcattcgttccggtgagttaggatgagaaagcacattgtagtccgcgcgtatgcttcccaaactactaaacggtgcatttttggcaaaaaaattctataggaaagttgctttaaaaaatcatattaatccattttttaaaatttaaaatagtttatactcaattaatcatgcgctaatagctcacttcgttttacgtatcttcccaatcttctcaatctcctatctctcaaactcaccctaagtactcctacctatcaacttgataagataagtcgtctgacaacagcaggcagtggtaacttgatcaattgagcaacaggtgcaaaaattcctgaaaatacatacaaatactccatctggtttcattttaattgatgttttggacaatgacacggtctacaagatacatctttgaccttatttttctattataatatatataataaataaatatatgtttacttttattatagtactttaaaagacaaatctatatatgttgttctagttcctttaaactanatatttttaaagttatcgatagtctaagttataaaaatttgacctcaaacttgtccaaaacgtcaattaatatggaactggaggggtatctgcaaactgtaaagcaatgacaaaaaaaaaacgttgatatactacaatatatagtgaatggtttgtactttcagaaaagaaggtgtaattcaatgaccgttaccattcgaaaaccatccattttaccttacacggtaatatatatatatatatatatatatatatagtacacactattaggtgtattatatatttataccttaacagagcttacctttttatgaactaaagaaatatgcaaaatgcaactttgatgctgtgaaacagtaaagggaaggaattaatatccaacagcataaatagttcataagatactcaaggacagcaacaatactaaaagttggttaacacaagttctcgaaaggctttaat

SEQ ID NO: 80082 - DNA, 6319 bp, Oryza sativa
actagttgactgttcaaaagaattgagcaatgccttgaaacaaaacacttccttctgagatgcttaaaaaagaaccaaagtatcatctgcatactgaatcactgggaaaccctttccattttgttcatttattggcttggacaacagacccagagagcatgctctgttaatcacactctgtaacaactcagcaccaagaacaaaaagcatggggaatgagaatccccctgtcaaacccctctcctacatttgaaagaatttccaggaacaccattaagcagaacagaggtatgtgctgaagtaaaaatcatgtgaacccactgcaaccatttgtcactaaaacccatgctttgcatgatagaaataagggcataatgctcaatagaatcaaaagatttttcaaagtccagcttcaacagaattatctctctctttgattgatggcattggtggatgtactcaaaagaccatgccaaacaatcctggattgttttgcctttgataaatccatattgattttcttgaacaaccttgagcattacaccctgcagatgatctgccattaatttgtttagcactttcaaactgatacccatcagagagataggcttgaaatcattaacagtttctggagagggctttttgggtactaaggttataaatgagctattaagcggttgcagatcagtatagcacacatgaaagtgtgctgacaacctataaaaatcctgagaaatgatgggccaacatttcttaagaaaaaacccattataaccatttgggccaggagctttgtctggtggaattatcttaattaagctgtcaacttcttgggtagagaagtaatccaccaaacaatccaaaattacagggttaggaaaaagctccatcagattaaagctcattgaaggagagagagaaatccccattctgctctcaaagctttgaaaaaacatattagccttctggtcatgcaaagtaaccacttgaccagagtgatcataaatttgagagatggaattcaatctgaatctctctgtggcaattgattgaaaaaacttagtattctcctctcccaacagcatccatctattcatgcatctttttttttccaatagagctttttaaactcaagaagtttaatagtttgcagcttgataatttctttgaaattccactcataaatacccaaaggcctatgttcttctattaagtcaagaaagttgagcacaacattacagttaaccaggagagcagttaaccttgataaattcttactccatttcagcaaactcttcctcaactttcagcttaaaactgatacacttagctgggtcctcatagccaggatccatagaccaaaccctgctgacaagataaaaaaaaccctccatttcaagccagtagttttcaaatctaaaaattggggacttcgggatttctgtatgtatcgattttaactacacaaggaacatgatcagaaatattgcgagctagaggaagcacaatggtgttggggaaggccaaggtccaagaggggcttgtgaaaacccaatcgagtctctccaacaggggattattctacatattactccaagtgaaatttctacccttcaaggggattttcaacagaccccgagaactaataatgtcattgaagatgataatgtcattcataccagctcctggcctatttctgtcatcaacagatgtatagaaattaaaatcacccagtaaaagtctgttttcagtcggcccaaaagattttaagccaagaacaaagagggaacattctgggccattgcatgggccataaatgcaagtcagggtccaagcatcagaagattgccttgatacaaaatttactgtgaccgaaaagctgtttatatcacctggagttcctaaaaagactttggaaacccaaaccactaagattccaccagaagcacctctagatggtgagaaagcaatcaatttactcgatgccattatacatcattagaatgaaaagaagtgatgctgaaaaaagacattggaaaaaaatagagtggatccttaaaatgttatgaaaccagcatctcattaattaatttatacaaaggccaacataattctcattcgaaacaaagaaatcaaattggtagataaaaaatttgggatcataatcttccttgccattagagaaaagatatgtgccttgagaatttgaaagataagaatgtatgagctagaaaaaaaagaggctgacctcccaaaagtcaccagagcttcaatcactggaaaatgttgaacctcttcaatcactggtgaaataaaggtcaatctgagccaaccaacgatcaaaacaaagaatgaataaatatgaaaaattaaattacctacctcaaatcaagaaggcaataaagcttatgtccagtgctagcacggattgacttaatctaacgataaggcagctgaagttctcaaacgaatacagcagttatcgaggacatgagtaatcaatttcaaccgtcattccgtagaaaggatgactcccaaaacaaccaaactctcccactccaaggctaacattggggaagcctttgaatggctctaggagtccaacatcgattaaaaggcatggagtttgtgtggattttagatgcgtttcaccggtaataagtaaaggacgatgatgattttggcacgacgttacaggcgcacagagttaatgtcttcatggcagccacgaaaactacttgttggtgggtgtcgacggtttccaggaggtgtggcaacaaagggagaggaagaggagtgaggcggcactccagaccgtcgcttccctagctgacgtgcggtggggattgtgtggtagagccatgggagtactgctgcacacaatcgcatgggagccatgggagaatcaaagggatgacgtggcttaacaatcgctcaggaaattgctaataactacactaagtggggatcacttgtatagtattataggattacccctctaacaatgtattagtaatggttttagtcctcggtgtcatacacttatatgtggtttaacaattggcattctaatagcttggtgggctgcacccatcatcctctaccaacactatatttgaaggcaacggggctcgggaggctctgttgaggctgcggaggcgcttagcaaaagtggcgaagatgttgaggtggcatcatgcctgaggggctgaaaggggtagaatccgagctccgtcaagggatgtaggtggaggcggaatggtcgatgtgttggtccgtggtgtggcagaggagcacaggtcaccgctgctaaagactactcgccgagcttcgtcaaggtccacggatttgatgggatcttgctctcctccctgaccttctcgcttcttcctcttctccccaagctcatatgctcacacttccatcctccccaagatcggcagttgccatgcaactcctccttgacctttgatgcgaggaggttgtagagtctgacaaagtggatgcagagctcgaggtccacaggaccgtgcgcctcgcatctcctccatgtcctactcatcaaccgcatcatccgccattgtctcgttgatctcgagcactgcctatgcctctagttccacttctgcctttgctaagctccacatctgccactgctgcctcatcgaggtcaagctccacgctcgccgccgccgtgcctccccaagcaccaccaccactaccgcaagttactctccttcttgagggtcatagccgacggatggcctcccgagtgtcatcgctgccgcaagttccgctcctccttgagtgttgccgctccccgagagcttcctcctcaagttttctctcctccgctgctcgagctcggcgctctccatctcctcttgcctcgcccctagatcaagccagcaaagtgatgaggaaaaaaatggaggtcaatgacaagtgggctgtaccaatatcttaccacatcattcgccatattggagtgccagatgggacaagtgggaccgaaaccaccttaaaacaggaggatggggataatgtgtccggattaaataattgaatggtgtaatttctcttgatgagctggtacatcacaacactaaactcatatgatgatcagtgcagcatagaaacctatagagcatgcccagagaatcccaaaatgaaatccaatatgtcggtgatatggtaacaagggttccccgtattgtggacaaggggtagcttggcaccacaccatctgtttcccagctccagagggtggccgcaattcacctcaaatgtcacgtgccaaccctagccttgtgttaacagtgaaatttggtaagcccggagtagtcatcggctgagagtcagcatcggcttcgaagtcctgagattagccgatgagaattgtcaagtcgtcagttgccggattcttgctatattcggttaaggaaattgatctactaaaagaagcttatccagagactgagttcaaagagaatgcggcatggcaagttatctattaattaggaatagtttgttagtttccttttatctttaggaaagtgtgtttagtgtcctataaggactttatcttttccttttatctttaggaaagtttctttcttgtccgacaaggacttgtatcaacccatgggtataaatatgtacacccggggtctatgtaatctattgctacgatcaatacaattcggcgcatcgccacccttttacttctacttttgtttttatgttccggcaaaacttggcacccgacgcagggctgcatcgtcttcgatctccggcgaagggataagtccaatgttccgccggtccaggcaattgtatcgtctacgttggcgtcgttcaaggctgcatcaggacattcgacctcttggattgctctggtttggatgatatatttgcctacctatttatcatatgtctctgttaatctagtcttagcatatcaatttagctctatcggctgcttctcgttttagggtttctgccggtatcggctaaatcgcgttgctagattagattagcttagacatctaccaccctgaaaactcagtcaacggcttggtcgtctagatattatgtttcttttcatatttagtactgcatcagttaagtttgatctactaagtcgtacttagaaccataatctctagcctgctctttgactcctaataagggtttcatcggggtttcagccagtgagttatctggacgttgcatcggctcataaggattgcatatacatataagttggatttagccgatgacaacaaaggtttcactgtttaatctaatcttgtggatttcatgacatcagacctccgaccgatgtatgctttaaccttcggatcagtgcttattatatcatatcaatgctagccgattggtttatactagactatattatagttatattttattatcaacagccaattgcctttatatcatatctacattggacatatagccgattgcttaaaccctatcgctatcggctggtatcagcattggctattatcggctatcggcaggaactactccatcggcttgtcagccgattggctgttttgatctactatttgcatatcttgttagttgcaggatcaaactgactggcacgcccgcatctcactaagatttggacctgcacaggagctaagcagatctcccaggccggtatgttcgattttttcatcaacaccttgggagaaagtttgatttggagttgggtgcttagggtcccaagcatgtcagggtttagggtttagggtttaattcctactagtcacatcaactagaatatatgtaaaagaggaaagggtgaactctaatggattaatatgaaaatacatataattagaggtagtagtttatccttgggataaatatgatacaccagcatactccggggtgaagtgctgcttgcaaaaccttatttgtaagggcattagcaataccaatactagtgcatcgcatgagaaaatcatacacactaatttgtcacttttattttgaaacaactgaacatattacatatacattaatcatatttcgttttacatgcacatgtttctgaaactgctaaacgatacattttctataaaagtttcaatagaaaagttgctttagaaatcatactaatatatttttcaagtttgaaataattaatactcaattaatcatgcgctaatagctcaccttgttgtgcgtatcttctcaatgttcttatttcccctcctcccaaacacaaccttagccattggatcaacaaggcaaacggcttatatattggtgtaccttgaca

SEQ ID NO: 80083 - DNA, 9784 bp, Oryza sativa
gaagacgagtaacgagaataccgtcggtagaggacatgtgtgaagtggcttctgtgtcaagcacccaaggacttggactttgcacggacaactgattgagggcagcaatcagacctgcctgatcccaattgggctgagattgctgtattggtggcaagcccggcattggtggagagacatatgggcctgcaaatgtcgtgtgtgcttgaggatatgggcccaggaggccggcactgttgctgggacgccagggagactgctgctgctgcacagcccatggattgaaacagacccatgggccggtaggtcgtggcccagcctggtgctgctgctgctggaaattgttcccgaagttgccatagccgccgccgttgctgttgttctgtcgtccgccattgccgccaccactgctgttgttctggccaccattgtagcgtcgctggttgcggcgaccaccgttgttggagccaccgccacgagactatgatgaagaagaggacgcacaggtgccggaagtgcaggcattggcagaggagacagccaccaccatggttgtctcagcctggaccttgtgtgcattggcaactcgcagctctttgagcaacaaggtgttgcgcgccgaggtgaaggagggcagaacaggggcgctggtgatgttgtcggcggtgctcgaaaaacgagagttgaggccactcagcaagttgaggacaagctgagattcggtgacggggtggccgacgtcgcggagggcatcggcagcagtcttcaccttctgacaataaatggcaatgggcatgtcaccttgcgtcattgagtggaactcgtgactgagatagatggcgcggggttccttgtttgcttgaaagagatcgtcgatggcgagccataggtcgcgggcggtctggtcgggttccataacgacgtcgaggatagcatcggaaacggagccgaacagccagccccgaacacaacaatcggcttgtgcacaagtcgagtcgtcgggacgagggggtgcagtgccatcaatgtgaggaaggagcccaaacatgcaacacatagaagtgaagaaggtcttccacttgttgaaattggggtgcttgagctccagggtaattggtatgtgagtcttgacgttgacggtggcatacgggttgacgaagatcgagccggtagaatccccggtgctggcagcagaagatggagtagagccggatgatgtagatgccattgttcccgaggttgtggaagaggaggtggactcggtagacatggcagagaggcagaataatcacgacgcggcgaagatagaaggcggcgcagcatgagcagagcagggcagggcgcggcgtggcgcgatgggggcagagcgcggaggcagggcgcggcgcggaacgagcgagggcgcggcgcggtgcgtcgtggcgcggtggggacgcggaaggcgcggtggggctggggcgcggcgagatcgtgaggggaaatcgctggggcgcggcgcggtggtggggacgcggaagtcgcgtgggcagtggaagagaagcgaacgcggaaaaagcgaaggccagaggaagcggcgaattagggtagaaggaaaccggtatctgataccatgtagagaattatgagacgcctcacgacccaacgtgggagggcgattgtatttatatatccaatacaatagagattacaacaaactcttaaataagattccatggttcagtcaaatggttccatgtccctgcatcagtcacaacaattggactcccagggttatcttattatgacaactctacagcagcagcttcttgaaactgtgccaattgtttctgacattccacggatgcatatgcgaaaacaagtaaagatggaggaggttcagcacccactgcatgatcaccagcaatggatgggtttgatgcaacctcagtctcagcacaaccagcaacatcaatcacagcggcatattatggcagcgttccagtctcagtcgaatcaactgcagcaagaattggggatggaacagaagccttcagtgcaacaaagctttcaaacttcagccgggatgttcttgcaacaaaataacattgatgaacaaatgcaatatactcaggcacagtgcggccttcaagaagttccattcagtagtaagttgatctgtgcctacgtttcatcaaacgtgctttcgaatttcgatccgtgtaaagtcgcagtaattttgtaaaggctactctgcataacttttgcaatctgacctttagttcattgttgtggttttagtttttcgatagcaggcacaaaaaagtccacatgctaccggcatccattctatgttgtactagcctgctattgatgccttcttttttttcatcaaagtatcttgtttcaggttttgacaatctttttctttttatgcagcaactatgcacattactactcaaactgatcatccaggtcaatgttatttgcaagatgagatatatgacatggtaaggtatgttataatcccttaagcactctgaagctttcaattcacatggatctagattgttgatagaagaactagagaatgttaagtattcttttttcaaaaaaaaaaaacttcctgtttcccctcatttacttttcccttcctttccttttgatctgtttgccacctaactctacgctttttgtttaattttgcatgtaaagttggaactgaaaatttgtacaaatttatgtgtgtttctctttatttatccacagattaagagcttgaaggaccaatactttactgaactcactgatttatgcaatgagatgagatgtttcaaaagctacagagacacatgccacctcagattccaatagatcattatgaagagatgaaaaaatttaaattattcttggagcgcgcattgcatttcctggaaattaaaaaggagaacattcagcctactatttgggaaaaaaatcccagaatacgagaggcaaattatcaatgccataagttcacaaagaaggcagcctgtgcgcaaacaagaacaacagtttcaccaatcatctacgcaaattactaactcgaacattccacagcaaccgcaggcctctccaggtgtgcagtaaattttttgcaatctttcctttggtcacttctctctgtaattttttccagttataagcatgagcagatttcactcgccgatgccatcccttttcatgccgtttgtagcttgctacttcctctggattgataatacttgtcattttggataatggtgaggtcaaagtttaaaatctttgactatgaataatttctaaaatatgattacttttaaaaaatatttcaattgttgatatttttatatatgacgacaagtactatcgaccccgaagggagtatttgataacatcgccactaatgtatctttttgtgtgctgacaaccttgacatttatgtgccatctacgtactccactactcaaacaacacattcaggttcaggtgattggcaagagtagttgtatcaaatggtaaggcatgctaaaatcactttggctctcccaagcttctaattcatcatgacttctctagagttcataataaacaagctccaaaataaagaagctgagatcatcctgatctagattaaaagaaaacgaaacaagacataaacttgagctttcttttcctcgaatatgaaggagcgtacacaatatctaaaatatcaaatatactaacactaaacactcgcaccacaaacttaataaacagcctaagcatggtgaaaactaaggcaacaactatttggcacgattttgagttttagaatagttttactcgttttccaatccccattgtccctcggttcctttttccttcctttttcttttttggtcgtttctccaccaactcctgtgttttcttgttatagaaacaaataaagttgtatcgaatttttggtacattgatgcactactagtatgacatgtagatgtgctgtactctagcagtatttaagatatagatggggaatctctatgtgcggggactggagcacatggtataaaatttcttttgcagcattttccttgatcattaaactaattaaattgaacgaatataccatgattcatttaacaaatgtcgatttatttttgaatcctatgtatgtactacctctgtcctaaaatacagcaacctaaggaccggatgtgacatatcctagtactatgagtcacatccgatcctaggttgctatattttgtgacggatggggtaattgctaatgagaaatcttatcactgtcatatttctcaacttaacgataacgaaaatactgctgctcgggcgaccggcgcaggggggggggggatcgggcgatttaaacaacgcccgatttaaacgattgaaacattttcgatctacttagtgaaacaatttcaatatacttggtggaacatcgtgcaacatttaaaaataattcaataataagctaaaaaaaattttcgtcgaaatatatccatgtgttgtcttgttttaaagatttaattacaacgaatttaatggtgcaatcgaatcatgatttggataaataatttaagagaaaacgtagtttaaagtggttttgccgacatacgtcatgctgacgtcaacgctcgatttttccccctccctatcgggcgcccgattctaagtcgttccctaaggatacataattcatcgattattttccttttctgtgttcatgtccatataagcttcgaataaatttgttgatgttatgttttatgcactggcaggtgaggaacttgaaggaccagcactttacagaactctatcatctgtacaataagatatctaggaagcaagaatatgtggatagccaaatgccatctcaaatgcctatagaacagtatggaaagatgaagaaatttaaagaaatgttggagcgcatactgcggttcctgcaaatttacaagggcgacattctgcctgctctcgcagaaaaaatccctaaatacaagaggcagattatcacactagtggagaaaccatctttcgtcggtcgggctattttcacaatagtcccggttgcaataaaaaccgggactaaagatctttagtcctggttaaaaagggtaacaggcatatttgatctttagtcccggttggtctttagtcccggttcaaatactgtcagggcttatcagcccccccccgggataccaaccgggactaaagatcccgtcgatctttagccccggttggtaacaccaaccgggactaaagtcccacccctttatatatgtcttcttcctcctccagcccgagcaagcttcaaaatttcttcaaaaaagagaggaggtcatgccaaaatttctagtgaatttactttggtgattatatacaaatcggaggtgcctaaaaggttagcaacttcatcctccaatgtttttttggtcatattacatctggagctatgttttgcacacttttttgtctccaaaattttgttgtaagttgatgagagagaaaatttgtgtgggaaaagaaagaatatatagaaattttgtttatttgataaagaaggttttataaaatagttgagtaggaaaatatagtgaaagttaatcttaaataaaagaaaacaaactaaattgaaaattaaaagaatttaaaacttcaaaaaaataaataagaattatttggtggactattttataatttttgtatgaataatgatatgtcattattgtatgactattgaaagagtttgtgattattttatcattattgtatgactgtcattattgtacgaatgattatttgtgtatgattttttttcatttcatgtagatgaatcggcaatggatgtacgttgaccggcggtccaaagagtttattgacggcgtgcattattttttgagagtggccgaagctaacaagcataagggttttatttgttgtccatgcaataagtgtaagaatcagaaggagtattctgcaataagggtattcatttccacttgtttgagtcggggttcatgctaagctataattgttggacatcccacagagagcaaggggttgaaatggaagaagatgaagtggaagaggacaatattccagactttgctcagtacgctggatttgaaggaaatcaaacaggcgaggaggacagagatgctgattataacgacgttgcggaagatcttggtcagatgttgcaggattccaaggaggactacgaaagtgaaaagggggcctataaattggacaagatgttagaggaccatagaacgtcgttgtacccaggttgcgagcaggggcacaaaaagttggataccactctggagttcttgcaatggaaggcaaaaaatggtgttagtgacaaggcatttggcgatttattgaaactcgtcaagaacattcttccggaggaaaacaaattgcccgagacaacgtacgaggctaagaagatagtctgccctctaggactggaagttcagaagattcacgcatgtccgaatgattgtatcctatatcgcggtgaggagtacgagaacctagaagcatgccctatttgtaaagcactacgatacaacattagacgatatgatccaggtgaggttgacgggcagctaacgaagaagagaattcctgctaaggtgatgtggtatttccctataataacacggctaaggcgtttgttcaggaataaggggaatgctagaatgatgcgttggcacgctgaagaacgtcaacaggacgggatgctgagacaccccgccgatggttcgcagtggcgaaacatcgacagaaaatttaaagactttggaaaggacgcacgaaccatacggtttggtttaagtacggatggcatgaatccttttggagagatgagcagcggccatagcgcttggcccgttacgatgtgtatctacaacctcctcccttggctatgcatgaagaggaagtacataatgatgccgattattattcaaggccccaagcaacctggtaacgacatcaatgtgttcctacgaccactggtcgaagatcttaaactgttgtggaagaaggaaggtgtccccgtgtgggacgaggacaaacaggaggagtttaacctacgagcgctgctgttcataaccatcaacgattggcctgcacttagcaacctatccggacagtccaacaaggggtacaaggcttgcactcactgtatggatgaaacagaaagtacgtatcttaagcactgtaggaaggttgtgtacatgggttatcgtcgatttcttgctgcaaaccacccaatacggaagaaaggcaagcactttgaacataaggcggaccaccgtacaaagcctaaacatcgcagcgggaaaacaatgtttgctatggtgaaagatcttaaagtagtgtttggaaaggggcctggcagccagcctatagagagcgaagatggtcacgcgacgatgtggaaaaaaactccatattttgggagttaccctattgggaattcttggacgtccgccacgcaatcgacgtgatgcacctcactaagaacctttgcgtaaaccttcttggcttcctaggtgtatatggaaagtcgaaagatacactggaagcacgtaatgatctgaagcatatggaacaacgcggcgaccttcacccggaaccaaagaagaaaggcagccattacttgagtctagccagctacactcttagcaaggcagagaagaaaattatgtttcaatgcttggagagcatcaacataccatctggatactccacgaatataaagcgaataataagcacgaaggagaaaaagttcacaaacctaaagtctcataactgtcacgtgttgatgacacaactgctaccagttataataaggggtatcctcccagacaatgtccaggcaacaataacaaagctatgttctttcttgaatgcaatttcgcagaaggtcatcgatccggataggttagaagccctttagaatgatgtggtgcaatgtcttgtcagctttgagttgatattttcaccttcattttttaatataatgacgcatctgctttgtcaccttgtcaaagagatcggtattctgggcctgtgttcctacacaacatgtttcctttcgagaggtacatgggcgttctgaagaagtatgttcgtaaccgtgctcgtccagaggcaagcatcgcgaaggggtatggaacagaggaggtcattgaattcagcatagaatttattgaatatcttcacccaatcagggtacctgaatcacgccatgaagggagactacggggaaaggggactctcggaaggaaagcaataatgacggtagacaacaatttatttcgtaaagcccatttcacggttctgcaacaatcttcattggtggctccttacatcgaggagcacttggctctagttcacgccagaaacatcggtaagtccgatgcatggattacacggcatcacattgatactttccccgcgtggctgcgacaacatctcatgggtaacgagacgattaaccaacaactggccttcctggcgagggatccatctggttcgattgcgacattccagggatatgatatcaatgggtacacattctacacaagagcccaagacatgaagagcacgaactagaacagtgttgttcgtatcgatgccatgggacacgatggtaccactggtacgtattacggtgccatcgaggagatatgggaacttgactatggacctctcaaggtccctctgttccggtgccaatgggttaggttgactggtggaggcgtaatgattgatgacagtgggatgacaacggttgaccttaacaaggttggatactcagacgaaccttttgtccttgccaatgatgtaacgcaagttttttacgtgaaggacatgtctagcaaaggaaagaagggcaaagggcctgacgagccgaagcgccacgtggttctcccaggcaaaagaaaaatcgtcggagtagatgacaagactgacgaggattacgatcagtttgatgggcaatcccctttcacggtgacgattgactctagtatcctcctatcaaatgaagacaccccttacacatgtagcgatcacaaggaaggaacaatagtgaggagaaagtacatgcggacaaccgtcaccgccgatgtattgccgtaattgttttgtacacgatgtaaactattttggatgtattgaatatgctagttatatatgattattaacaaatttaaatcatgcatatgctaggtatatatgattattagaatttttaaaagttttaaatcatgcatgtggtatttacatatgttaattagaatttttaacaatataatatcatgcatatgctaattatatatgattattagaatttttaaaagttttaaatcatgcatgtgggatttacatatgttaattagaatttttaataatttaatatcatgcatatgctaattatatatgattattagaatttttattaattttaaatcatgcatgtggtatttacatatgtttattagaatttttaacaatttaatatcatgcatatgctaattatatatgattattagaatttttaacaattttaaatcattcacgtgcttattatatattatccacttaatttactatagacaacgataatttttcgaaggttttgtcattaatttttcgactttaaataattttaatgcattatttactattttagaaacacatatgcaacgaaattcaatattcagtgctattatctttagtcccggttcttaaccct

SEQ ID NO: 80084 - DNA, 21552 bp, Oryza sativa
  unsure (1)..(21552): unsure at all n locations
gtttactttatttacttaccatttactttgattttctaactttattcaaattaatccaaaaacttgcgctattaattggataaatgtcttgactccctcctttcacttgtctttagatgccgcgctacaagcctgagtacttgtttggtgttgagggttttgtccaggagttgcgtacgatgtcctttgtcattggatttgggactgcccctttttatgcccagattcctcatgatcgtcatgaagagaagtgccgagtcaaagtcaccttgaacagtaatagtgaagatatcccctcagtgatgttcgaagctggaggaagaaactgcatccatgcatgtcaggaggtggcaaggattgccataggagagctccgcgatcgctacagtgatcagttggccgacactgagtatcgctatcatcctcgtcaaccccagggaagtgaccgtggcaactatcttgagactgaaggaattgagaatgatgctaccacaaggcatttggttgagatgctgtgggctatggatgaaagtcgtgcggagactgtgttagcggctcaagatcatgaagatcggaatcgtggtaagatttgcaagttagaggacaaggtggatcgtttggaaaaggagttagctgcgttgaagggagaagcaccgctgcagaaggccaggattcgtctcaccgcaaggaagagagctctatttgtccctcgctatcaattggcgccaaaggtccgtgtggtggagaaagaagttgccccaaccctagcagatcctccggtcatcatcataagtgaggatgaagaagaagaatccaagcgcaaccattccaaggttgagtgggtagcaactcaagatgatgaagacgagccgaatgagccttcaatcgacctccgatgctcggaagaactagagtgacttgttaagtcgttgtcttagatcgttgtgttagtttgcttgctttaagtttgcttgtgtgtgtctcgcatgtgatttacatcagtggtgggaggtaagtgcatgcgtttgtttgcttttgagtgttaggaagttggtgagtttagtggtgtgagagttttcagtttgtaataatgaaactcagttaagatcaataaaagttcaagtaattctctgtcctaagtagtttcccccggtttctcttcttgtgccctgtccatgccagatggtgaacactcgcagcaacgggaatggcccaagtaaccataacaatgaaggaaacccaacccttgctcaagttcttgctcaacagactcagcttatgaacatgatgatgcaacaacttcagaatcagcagaaccagggaaataaccatgcacctccccagaacaagttagcagaatttcttcatgtgaggccgcctattttctctagtaccactaatcctgttgaagctggtgattggctgcatgccatagagaagaagttggatttgcttcagtgcactgatcaggagaaggtctcatttgcatcacatcagttgcatggccctgcctctgaatggtgggatcacttccgtttgaataggactaccgctgaacctatcacttggcttgagttcaccgctgcttttcggaagacgcatatatcatcgggagtggtgtctctcaagaagaaggaattcaggtcgctcacccagggatctcgctctgttacggagtacctgcacgagttcaatcgtctggctcgttatgctccggaagatgtgcgcaatgttgaagagcgccaagagaagttcttggaaggacttaatgaggagctttcttacccactcatgactggagattattctgatttccagaagttggtggataaggctattcgtcaggaagacaagtacaatcgcatggagcagaagaaacgtcggattgctcaattcaagacacaacaggggaataatcagaagccgcgtcttactttaggaccccagtccatgccacatggaggttcttcgtctgttgttcgtccgcagcgtcagttcttcaacaacaatgctggcaacaacatccgtaatcaagctccacgtccagttgcagctccagcacagcaacaacctgccaagagggagcaaggcagcaagcccgtggtgtgtttcaactgtggagatccaggacattacgctgacaagtgtccgaagccccgacgcgtgaaggttgtccctgctcagagcaacnnnnnnnnnnnnnnnnnnnnnnnnnnnnnnnnnnatgttgctgctgcagaagctcaagatgctccagatgtgattttgggtacgttccttgttaacttagttcctgcaacagtgcttttcgattcaggtgctacacattcattcttatctatgagttttgcgggaaatcatgggatggaagtagaagatcttagacgtcctttgatggttagtactccaagtaatcaagcactctctttgcaacgtagcccctctgtcagaatagaaattcaaggggtaccatttctggccaatcttatcctgttagaatccaaagaccttgatgtcatcctagggatggactggttagccagacataaaggtgtgatagactgtgccaacagaaaagtaactctcaccagcaatgatggtcgagttgtaactgttcatgcattgtcttctgcgtctttaaggtcaagactgaaccaaataactttggaagagattcctatagtccgggagtatcccgatgtgttcccagatgatttacctggtatgccgcctaaaagggatatagaattcagaatagatttggcaccaggaacaactccgatccataagagaccttatcgaatggcagccaatgagttggcagaagttaagaggcaagtagatgatttgcttcagaaaggatacatcagaccgagttcatcaccatggggagctccggttatttttgtggaaaagaaagaccatacccagaggatgtgtgtggactatcgtgcactaaatgatgtgactatcaaaaataagtatccgctacccagaattgatgatttgtttgatcagcttaaaggtgctactgttttctccaagatagatcttcgatcaggatatcaccagttgaggatcaaagaggaagatatacctaagacagtttttaccactaggtatgggttgttcgaatgtactgttatgtcttttggacttaccaatgcccctgctttcttcatgaacttgatgaataaggtgtttatggaatacctagacaagttcgtggtggtctttattgatgatattcttatctactcccgaaccaaagaggagcatgaagaacatcttcgccttgcattagagaagctacgagaacatcaactgtatgctaagtttagcaagtgtgaattttggttgtctgaagtgaagttccttggtcacgtcatctcagccggaggagttgccgttgatcctagtaatgtggaatccgtaaccaactggaagcaaccgaagacagttttagagatccgcagtttcttaggcctcgcaggttattatcggaggtttatagagaatttttccaagattgctaagcccatgacacgactgcttcagaaagatgtgaagtacaagtggtcggaagaatgtgagcagagttttcaagagttgaagaatcgcttgatatcagctcctattttgattttacctgaaccaaagaagggtttccaagtgtattgcgatgcatccaaacttgggttaggttgtgtactgatgcaagatgggaagatggttgcctatgcatctcgtcagttacgtccgcatgagaagaactaccctactcatgatcttgaattagctgcagtagttcatgcgttgaaaatttggcgtcattatcttttcggtactcgtacagaggtgtacaccgatcacaagagtttaaagtatatctttactcagccggatctaaacatgagacaacggagatggttggaattaattaaggattatgacatgggaattcattatcacccaggaaaggctaatgttgtagcagacgctcttagcagaaaaggctattgcaatgctacggaaggacgacagttgccattggaattatgcaaggaatttgaaagattaaatttgggaattgtcagtagaggttttgttgcagccttagaagcgaagcccactctaattgatcaagttagagaagcccaaattaatgatcctgatattcaagaaatcaagaagaatatgagaagaggaaaagctattggtttcttggaggatgagcacggaactgtatggttgggtgagagaatctgtgtccccgacaacaaagatttaaaagatgcaattctgaaagaagctcatgacaccttatattccattcaccctggtagtaccaagatgtaccaggatctcaaggaaagattttggtgggcaagtatgaagcgtgaaatcgcagaatacgtagcagtatgtgatgtttgtcagcgagtcaaggtagaacatcagaaacctgccggtttgttgcgattcctgaatggaaatgggaagaaatcggtttggattttatcactggtttacccagaacgtcatcaggccatgattctatttgggtgatagtcgacagacttaccaaagtggctcattttattccggtaaaaacaacctattccggaagtcgcttagcggaattgtatatggcaaggattgtgtgtttgcacggtgtccctaagaaaatagtgtctgatcaaggcagtcaatttacctcaaatttttggaagaagcttcaggaagagatgggttctaagctgaactttagtactgcttatcatccgcagacagacggacaaaccgaaagggtgaataagattttggaagacatgttgagagcttgtgctttagatttcggtggaagttgggataagaatctaccttatgcagaattttcgtacaacaacagttgtcaagctagtcttcaaatggctccttacgaagcactgtatggtcgaaagtgccgtactccgcttttgtgggatcaaacaggagaacatcaggttttcgggacggatatcctaagggaagcagaagaaaaggtgaaaatcattcaagaaagattgcgtgtggcccagtcgcgtcataagagttatgccgacaatcgcctagagatttgagttttgaagaaggagattatgtgtatcttcgtgtcacgccgtttcgaggagttcatcgttttcataccaaaggaaaattggcaccgcgttttgtgggaccttataagattgtcagtagaagaggagaggttgcttatcagttggagttacctcaatctttggcaggagtccataatgtgttccatgtgtcgcaattgaagaagtgtttaagggtacctaccgaagaagctaatcttgaacagatagaggtccaagaggatctgacctatgttgagaaaccaatccgtatcttggaaatagatgagagaagaaccagaaatcgagttatccgtttttgcaaagtccagtggagtaatcactcggaagaagagtcaacttgggaacgagaagatgaattgaagtcagctcatccgcatctgttcgccagttcttccgaatctcgaggacgagattttgtttaaggggggtaggtttgtcacaccctgacaatcctaaatatataaattgttgtttaattggaatttttagaattgattttaaaagcctagaagtgaagatctaattttaattaataaattccaatataaaatgggaccagataaaatttcattaaatactttgcttaattctataattcctagatttttctgggatttatttgagctaaggaagtatttttaataaatggaattgcatttaagaaataatttaaattgaaaaaggttttaaaaagtctcttttggctttgggccgaaagtcggcccaaaaccgctctctctctcctcggcccaagttggcccagtccgccgccgcgcgcgcgcgcgtccgcccgctgacaggtggggcccacctgtcaggcccgtcgtctacctccggccgccgccgcccgaaaccctagtttcgcgccgccgccgttcccttccaaatccggccgttcctttccttctccggccgaatcaaaagaggggaaatgatctccgggatctcctctaccttttctcttttggaatcatcggccaaatcggcttggaaagtgtttgattcgaggtcgaatcggatcggcttttctctctccgagcccgacctttccttctcgtcgccggtcgtcgtgggccttcgccgccgcctccgagcccctttaaaagcttccccggtgtctcctctacccgccgccaccctcgccttcgcctttcgtcgccggaagagccctagcgccgtgtgccctagcgccgccgtcgccgccgtcgctccagccgtgcgccgccgccgttccaaacgtcgccgtcgctcgggaagaccgccgtcgtggtcgccaagtcaccgccgtcctcgtccgccccttcgccgtcgccgaagatcaccggagcaccgtcgccgccgtcgacccgatctccgccgccgtttcaatctcgtcgccgtcgccgtccgttcctcttccgccgtcgctttggtcaccggtgagttcgccgcgtcgcgctctacccgatggtgccttccgttcgcgccgccgtgccgtcgttcgccggcgagcatgcaagcccgagccgcccgagccgccgccgccggtgatgacgtcaccgctgacgtcatcgtcgccctctcccgtgagccggtcgtggaccgatcgatctcggccgtccgttttggatggattgatctcggccgtccgttcgcgtgaaccgccgccgtgcgcccggtccaccgaaaccctagcccgctgacgcaataatccttcttttccttttcaaaaataattcattattgcgtcataattcaattaaaatcaatataagtgttttaatccgatttaatcttcaaaaattcataactaattcatcttagctccgatttagttggttcaagtctctaaatttttctaaaattgagatctacatgttaaaaatatccacatatactgttcatgcttgtttatgtgctgttttggtgtttttgcttcttttcgtttagattccgtcgtttccggagagtccgttttcgccggagaagagtttgaagagttccaaggccagcaaggcaagtcacacagatcccaaacaaccctttgagcatgttgatcctatttaaagctattgtttcttttcaactattgcatttattttcgaatgtcattgggtggaattaacctattgtttgttatagcccttttgttcttgattactttattccttgataccttgggttattataatttgactagttgagctttatgtatattggttcaactagatattagatataattgcttagccctgcttagaaacattagctcactattgggattacttatgactcactattatttaatgatggcttaatgatagttcacgatggtcaatcgtgattagttaattaattaatgtgccaactaaaacctgataatggtgggttgtgagcacatggttttgagagtcgtgctcatgacaattaaggaccggttcacgagtttcagttgtgaaacattaaccgtgccagccacaagccagcgtgggcaacgactttatcttttgtatagcatggttcattgcggggcaccagactgagaagtggcggagataagcccacgggggtcgctggggagtccatgccttgtttttaagggggtgattatgatccaggaaggtgcactgcagtggattgtgttatgcaaggggtattgtcacaactcctttccgagataccgtggtggtattgaggcacatggtgacatgatgtggggttgtgtcttgtgggtacagtggtacacctctgatcagagtaaaactattcgaatagccatgcccgcggttatgggcgggtcgaacaatgtctttcgtgattagtctcacacttctcaccatagtaaatgatgctataattggtaataatttgattagctcctggtttggaatggtacattcctggtttggagatagaactgtgcagccgggatggttgttcagaatggttgggcctatacaacagggtatgttgtatagcgttggattaatattgtttaattacttaactgtttttttaaattctaaaatatttgctaaatgctgcttttgcaaatgaaaccctactatgccatcctttggtatccttgtgcacttgcatatttgctgcgtggcttgctgagtatgtcatatactcaccttgcaatcattcatcagaggaagagttctacagtgaagctgatggtgtggaggattaggtgtagccttggtcaagctgcctgtggagtggagccgtctgcgccgtttatcttattttccgctgcttagatctttattgattgagaggaactatctacctctgtaatgacattttatacgcttattaattagagtaataattgtactctattatcaatttgttattgtgtgcctcggctgattcctggacgagggttcacacacatgtaagcgtttggaattttggatagaaattccgggcgtgacagatacggactagcatacagcaaggctgaaccgtagatgggtgagactttgcatcgaggagacatcacagagtttaaatactgtgcaaaagtttatgagtcagacttgatgtcgaaacaagatttcggcaatactaaaaggggtggctatcaagctgaaaaagtagattggttcagagacaaggaattttatacaggttcaggccttcttaaccaagaagtaataccctactcctgtccggggattgatccgccgagtgtattattgatcgtatgatctgggagaaaaatcgtgtccctaaaggcacccggaccccttcccatcttaaccaagaagtaataccctactcctgtccggggattgatccgccgagtgtattattgatcgtatgatctgggagaaaaatcgtgtccctaaaggcacccggacccctccttatataggggaaggggttcgtattacaaagtacagaccatatccctaacggaataggtaattacagataaaatacaatcgtaaccgactaggatcctgggtgtttccttgacatacaagtttggtacttaacccgagtcctcttaaagatattctatccatacatggcaccccatacccagtcggactatacatgccgtgtaggtatagggtatccataatctccacagtagcccctgagacctttatagtcgacgaaacagccttctctcggaacgtaaagtgataatccgagtgcttcaatttctttcgtactgatctcccgagtaccaaaatcaaagactgtgaagggctgaaagtaaataattaggtgcatcgactagatgcacctaattaggtgtagcctccgactatgtgagtagctaaaagctaaacatattgtcaaagtacatcaaaacgtccattcgagtggtttttaaccaaatatcccaaggccaagcatatgcagcatctgataaacctcccgccgactgctttaatgtgccaaagaaatataaagaaaaacccgagtgagaagcactccaaaggtttataaatcaacacaggtgataaaagtccaagtaaaaactttcaaaagacctatcaaatgtggcataaaatttgataaaagacgagtcaaaatagcctaggctatgactcatcccataatcaaaatatgcatataacatgccgagtggatgactgtattaaaaccagtcatctcaagaaaacccaaacaacctttgcagcctaaaaaggcctacaaaattagcatcaatctcccattcattcccagctgcagttcagaccaaaatacataatccagttcacatccatggcggaagagagagaaagctttgagagccagtgggcgccctccgatgttatggaggagaacctgaaggagatggtggcgcacggcgttattccggcgaaagaaatcatcgggtggcgtccagcattcggcgaagcatttccaacccccgacacacatgaggtcgtagtattctctcatttcttctatggcgggttttcccttccgacctcaagcttcttccgaggaattttggatttctatgggatcagtttgcaccacctaaaccccaattccatagtccacatcaccaattttatccacgcttgcgaagctttcctagggattaggccatatttcgctctattccgtcgcatcttcttcctcaagccccagccaaacaaaagcaaaccatgtgtagttgggggagccggatttcaactgagggggaccttgagccaaaaatacttctccatgccattcaagacctcgaacaaaggttggcacgcaaactggttctatgtgcaaaaccctgagccagcacttctcggatactcctgtcttcccccaatatatcgcgacacctggaactcaatgcctatgggagaagaggccgcccaagcactcaacttgttggatcgcatgctaaagctaaaagaacagggtctgtagggggcgcaaatcacccggcatttcatcaagagccgactggcaccaatcaaagaaagatccagaacagcctttgagtttgatagagcatgacctgaatcgtgaagatccagactctcttgattttaaggttatgaaggagagaatgtacaaaatcttctcgaatgccatcgtggtcagctattcacacttactgccagttgtgccatacaatgccttcaacccccctccaccggtaagcgttatacaactcagcttttctcaatgcatgcttttatcttctgtaaagttgactgaaaacttggaataccatgcccaggagtttgctttgatgaagtccgatactccaattgctcaacgccgctcacctcgccggcacacctgccaagccagtggagggccgaagattcagtcggatgtccaacccaacgcttcaagaacaactaaccagccagattctcgtaagagggaatcggtgctgaccgacgatgagggccatgacgccaaaaaacccagcaaccaaaaggaaggagccgagagacagccaaagcaagctaacttaaggaagaaaacatccagtcgtccaacactaaaaataaggaagtcagccaggtatgtgtcatatcacagttgccgtcatccatcattcttcattgtagcagagctgagaacatatatcgaatttgcagaaagccatctgacatagatccttctggaaaagaacccacgctgactggctcggagactggtccttcagcggaaactgggcagctgccgaagactgcccagataataatcaaccggcgaccggcaatgtagataccagcaatgagcccctgactggaaaccagtcggcggaagctgaagccggcgctgatgaggaacctccgactagaaaccagtcgggtgcagaacataatgaagatattcctaaagtagaagctcaagctgacagccctcctaaaaaggatgcaagcgtcgatccagggaccagctctcctgttaaagtacaagggcccgctcatccccgaccggaaataatcataggtaaacacatcctccgaactcatcttgatctgacagacttttttcaattgtttcacttttattcataaatgcctaaggcccaatgatcggcgatgaagaagaagtcctccggatacagtcagctgagaattctcgcccacccattttagtcaagtggtggaatcacgacatgcaacctcaaggaatcgtgataaacaagcaaaaagaagatgaggaagtatgcttgctgaaaaaggcactcagccaggctacttgcatcgtgaatgtaagtctccttattcacagcttcaactatcctgtttcccactttgctcaaatgccgacaaattcgcattgcagagaatccatctcaggaacgaggcgaagaccgcgactcttgagaagttagttcctcatcttggaacccttgaagccaccagaaaccagctgcacgaggcaaaggagcttgccaggaaaactgagtatgatctgagggatcggatcgccgagcttcaagaatccagctttgaactgagcggttcgtcaaaaggtaaatacaatctctgtctaacttacttatgctgccatccttgtaatttcaattaacaagaagcaatacagtgcaagccgccaagatatctgaactagaaaagcagatccaaactctggagaacgacaaggctgaattggcgagacagaggaactcggctctgaaagatgttgaaggtactggtgactaatacctcttatctttatgaccactcgttgatataaatctatttatgcagatcgcaaaatcaagtctcaggctcaattcgatatcttggtcaataaaatcaaaaggcttgaaggggctagggatgaagtcgccaacactgctaccccactcgtccaagccatgttcttcaataataatggtccgagtacatttgatgcctccgaaatcttcgacaagctgaggatcgctccggacacatactttaagaatatcaaggacgctggaaatatgggagcaagcctggcgttggcaatgtccaagcctttatacccgaagattgacattgacgccattgatggatttgcagacgggacgagcgaagaagccgcccttgacctcatcaacgatgcgcagaaagcagccgataagatagccgttgatgtagttgagagattccaggacaacgacctccggccgactggatctaataattccgatgatgagaaaactgatactgattgatgttatattgtaacaataactctgatggtgatgatgatggaggcacaatttgtacaatactgatgaatttatgctgtgcttgatatttcaaacttagctcctgatttcttaaaagtttttgtcaaacctttttgagcctaaaagccgcaaaagttattaaaaaactttcagtcctcattgactaagccagaaaataaaacaaggcaatgataaatcaagtaagcaaattgaattgataaaaatcacactccattattattatagtagcccctgactgataactcaaggaaaagtttgatgttagcagtcaaagaggaagatacaaaagtaatgcctaagcataaaaacgacgaagatgttcaatattccaagagttgtcgatagtaataccgtcttcacgtttgagtcggtaagaacctggccgagtgacttcaaaaattatgaattgtccttcccacaagggagataacttgtgccgatcccatgtagtttgaatttttctcagaaccaggtcgccgactaaaaaggctcgtgatcgaacgttgcgattatgataacgacgcaacccttgcaagtaccgagccgactgaattaaggctgcttcgcgagcttcttccagtcggttaagatcatctactcggttgtctccgtagcgctccttgttgaagttacgaaaacgtaaagattcaaattccacctcactgggcaacattgcttctgctccatagactaggaaaaacggcgactggcccgtagcccgactgggagtagtgcgcaaggaccaaagtacagacggtagctgctctacccacttgccggcatagggattcagtcggtcgaaaactcgtgcttttattccttgaagtaccataccattggcatgttcgacctgtccattgctcacggggtgcgctacggaggcataacaaattttaatgccgaagtccccacaaaaactttaaatactccgcctgtgaattgagtgccgttatcagtgatgatccgattgggtacgccgaaccggtgtacaatgttgatgaagaaatctctagccttgtatgtcgtgatcgtaatgaccggtttagcttcaatttacttggaaaatttgtcaacagccacaaagaggtgagtataaccaccgactgcctttttgaacgggccgaccatgtcaagcccccaaaccgcaaacggccaagacaacaggatggtttgcaactcctgagctggtagatgagtttgtcgggtgaaaaattgacaaccctcacatgttcgcacaattttgtcggcgtcggacacagctgtgggctagaaaaaaccctgtcgataagccttgccaacgatggttcgtgcagcagcgtgattaccatagatgcctgaatgtatatcttttagcaattgccttccctcctccatagacacacagcgttgcaggattcccgatggacttttcttgtacaactcggtctcatgaataacagagtttgctgcgcctggaaatccgctcggcttcatctttatcttgagggagttctagtttggtcaaaaatcttatgaggggctctctccagtcggcttcaatcatgcttacgtcttgggtgtccgtggcttcaattgtttctttccttggcacggttggttcgtaaagatgttcaacgaacacgtcggaaggagctgcttctcgttttgaacaaaaattagccagtctgtcggctgcctcattattgtgtcgaaggacatgggtgagttcaaatccatcgaatttgtcttccaacttgcgtacctcctgccgataagcagtcatgttatcatcaaggcaggaccactctttcatgacttgattaacaaccaactgagaatctccacgaacgatcagacgccgaatgcctaaggagatcgcaatccttaatccgtgaagcagcgcctcatattctgccacgttatgggatgcagaaaaatgtatccgcaatacgtagctcaatctttctccagtcggggagagtaaaacaaccccggctccagtgcctgaaagcctcttcgacccgtcaaaatgcatggtccaatactccatcttttcctcgggcatgtcttcttggcactcagtccactcggcgacaaagtcagctaaagcttgggacttgatcgaagttcgcggcttgaaggatatatccaaggacatcaattctaaggcccactttgcgattcgtccatttgcttcgtgattatgaagtatgtccccgagtggaaacgatatgaccaccgtgaccgagtgaccttggaagtagtgagatagtttcctgacggtaattaaaacaccatataatagattttgaacctgaggatatcttgtcttggaatcagccaaaacctcgctaacgaagtagattggtcattggactttttgaacatggccttcttcttcacgctcaacaaccaggactgtgcttacaacctgggaagtcgccgacacgtataacaatagcggctcttgcggatgtggtgaagctaggactggtagagtagtgagaagttttttgaagtcttcaaaggctttctgtgctttgggtccctactggaaattgtctgttttcttcaacagcctgaagaagggcatccctgctcgccgagtcgcgaaacaaaccggctgagcgccgccatgcaaccagtctgcttttggacatctttctgggagctcggcggtttcatgttgaggatggcgttgactttctccgggttggcctgtatgcctctatgggacaccataaatccaagcagcttccctgacggtactccgaagatgcacttttcagggtttagtttcatcctgaaggtgaggatgcttgcaaagatctcttttagatccgtaatcaaatcatccttctgcttggtcttgacaactacatcatccacataagcttcaacattgcggccgatctgagttgaaaacatctctggatcatgcgttgataagttgctcctgcgttcttcaatccaaagggcatggtgatgtagcagtaggccccgaagggcgtaatgaatgcagtcttcaagcagtcggattcttttagtcggatctgatgatatcctgagtagcaatccaaaaaactgagtagctcgcagccggctgttgagtcaactacctggtcaatgcgaggtaacccaaagggatctttgggacaagatttgtttaggtcgatgtaatcaacacacatgcgccattgtcccgtcttcttccgaactaggactgggttagccagccagtcgagatggaggacttccttgataaagcctgctgctaacagcttggtcaattcctccttgatcgcatccttcctatcctgtgcaaagcggcagagtcgttgcttgcttggtttagcgtcttccttaacatgtaaagagtgctcaatcacctctctaggaataccaggcatatcagatggtttccacgtaaaaatatctttattattttgaagaaaggtgatgagcgtgttttcctattcacaatctaactcagcacctattacagcagtcttagtaggatcagagggatctagaggaattttcttggtcttggcgtcgctttctccgctctttggcatcttggttgcaggcacttctccttcgcttgctgtggacgtggccagtcggacttcttctcgggcgagggtgatctcgtgggtctgggccatctcgcagctttccttgtcgcatgtgacggcttgtttgatgtcgctccgcagggatatgactcctcgaggaccaggcatcttcatcatcatgtaggtatagtgcgggacagccataaacttggctaacgccgggcgtccgagtatagcatgatatggtgtctcgaaatcagcaacttcgaagcaaacgttttctatgcggaaattctcccgagtgccgaaagtgaccggaagagtgatctggccgagtggtgtagcagatagccttgggatgactctgtgaaagggcgtattactcggttttaattccgtgcgagggatctgcatgtcgtcaagagtcttggcgaaaaggatgttgagtgcactgccaccatcgatgagggatctgcgaagcttgacgttacgaaccattgggtctagtaccagggggtaccgccccgggtggaccactcggtcaggatgatccgagcggtcaaacttgattgttgtctctgaccaccaaagatattggggcatatcgggctggacagcattgatctcccgttcagtcagcttttgctttctcttggatattcataagccaggggtccgccaaagatgtggttgagttccttgcgatggtcttgaaaaccagtcgagtcatcatcttcgtcatccttcttctttgacgtgcattgatctccgtcagtgttcttgcgtgcgttcttggcgtattgttctgcaaactatttgtagacgaagcaatctttggccgcgtgactggaatttggatgatgcggacattgggagttcatgatcttgtcaaaagtgttgacgcgggaacgtttgtcgggaggatagtgtagtagttgccacaagttcctcgggcttacgcttgcgatccttgtgattggtacttccactccccctgtagtcggcgtatctttctttggcttccaagtggtgcccgactgcttggacgcggtaatagcatcttcggctttggcatactcattggctttttcgaatatctgcttgaccatcctgggaggcttgcgcccgaacttgccgactaggtcttcgtggcaaatgcccttggtgaaggcggcgatgatgacgtcgtcggtgatgtcggagattttgttgcgttgctcagaaaagcgtcggatgtaatctcggagggattctccgggcttcttgataacgttgtagagttcaaactgggtgccaagacgttcaaaggtgccttgaaagttggtgatgaagtgttcgcgtagttccgcccatgatccgattgtgccacggggtacctgtgaagccaggaccaggcagaatccgctagggccacgggcagatagtttaccatggccttgctgtttcctcctactgtgcggatggcgagatcgtagacggtgagccaagactcagggttagtgctgccatcatatttctcgattccagtcggcttgaagccagccggccaatccactcgacgcaggtcacttgtgaaggcagctactccgtccacgtcatcgtcgtagcggtctggtgaatggtggggagcatagcctcttgccgcgcggcgctggttgatagtatcgcaaagatcgacggggcgcctgcgatgtggggagcgaggtcgttcaactcgacgctccctgtgtcgttcgggaggcgaatggacagatcgctcaccgtgacccctgctcctgcgactggatcccgcgtcggcgatgctgaggcttggttggtgatagtcttgagatcgaagagggggaactcggctgccagtcggcgtgcgggtgcttgcggagttagccgggaccgaggcggcgatcatggtcttcgtttggttcaagattttgatgacgtgctgattgagcgcgtcttccttgaggaggctgtcgaggagggtgatcgctgcaaccgcgttctgttggggagggtgcgaaaaacagtcgtcccgtcgacgtcttgttgcccaatgaggtctcgtgctcgtcgcccagattccaaggcgcgctgtcgtcgatcctcaacctcctttgcagcccgttcgcgatcttgttgttcacgctgcagtcgttctcactcttgtcgttgttgttcttccttcagtcggcgacgttcagcttcttttcgtgtgcgctcttcttccgcttctcgggcttggcgctgttttgccgtctcattgtcggccatgaatacgccgaaaaagagaggcgtgtagtcgtcctcatagctgtcgtcgaagtcgttgaagttaccataatcgtagcgatagccgaagtcatcgtactcaaggatctccgttggtcgagaactgacgtcgggagaactgaggtagccatccaattcttccgtcgagaccgtcccgagaggttggagtataacgccgacctctctagagctagattagattggagccgaagccggatcccgtctaggtcttcgggtgggagacgccttggtcgtgaagacagcagccagatcatcgggaagtctcatcaggattgggggataggacccgtcatcttgatctggtcgtgttggagtagattggatctcgtccgagtggtttgaagccaactcggtagagatgatcttggggtagacctccggccgagttcgggataccgaacggagcggagatctggcctcttcccgactggttcgaatccgagtcgaggagagaaatcttgccgaagtcgaggctgccaaaccggaacgcctgcctgggagggaatacgaagtcgtcgatgccggagacggaaccgatcgcactagtcggcgaagaacttgatgctacccctacctggtgcgccaactatcgaaacaagatttcggcaatactaaaaggggatggctatcaagctggaaaagtggatgggttcagagacaaggaattttatacaggttcaggccttcttaaccaagaagtaataccctactcctgtctggggattgatccgccgagtgtattattgatcgtatgatctgggagaaaaatcgtgtccctaaaggcacccgaacccctccttatataggggaagaggtccgtattacaaagtacagaccatatccctaacggaataggtaattacagataaaatacaatcgtaaccgactaggatcctgggtgtttccttgacatacaagtttggtacttaacccgagtcctcttaaagatattctatccatacatggcaccccatacccagtcggactatacatgccgtgtaggtatggggtatgcataatctccacacttgagttgggtgctgtttggagagggagtttgtaacagactcttcatcgtagtacacgatccgaggtgatgagggagaagtcggctgcatatatattcaattcggactttggacgtcgaaggatcaaaggaaacgagacagcgcacgaccgcaagggcactcaacgttggcatgcaggctaaaatcatagtgttggtcatcgagacagaaggcttggttgaagcgtgcaagagaggtgcgtgtaaatcggttaagtcgggccagcagggtgatcagatcgacggaccagttagactgcagagtttggacggttagaccgggttcaacggacgtgtggttcgttacaggaacttgttaacagatccaaaagaaggacaagaaggttctacagatggatagtttgcaagtgtgaaggacgagtagactggtggcgacaggctggtcaggtcgcatataaaaatatctggcggaaacaagatatatctaggattcgacgaggagttgagatatatggagttaagccagaactgaagaaaagtcccgggcaacagcgggtcaaatatcgttgatggggtcgacaatactgtttggcagtacaggatatatccaggatatgcaggtcggcatgatggggatatatggaaatctgcgtcactgaagaggaagagcgaaggctatcgtggtaattcttcaagtgattcaaggaaacggtaaattttctcaatttatcatggagctcagtctacggatgcggaaaagcgtggatgttggatttattagctcggttcataagtcgacaaggaagaaagggttctcttcaagtctggtgagtttgatttatttatttggtgatgacgtgggttatctggccatggattagatcgaatcaaatcaaagacggaagatggagttgaacatggtcttcgaggagtttatgatgtgacagctaaggaagaatccaatttcacttggcaagacgactgagatgataggtgagaaggtggagcactgttgcaggtggagtctaagaggaagaaattacagggatagcagagtatcttgaaggcggcgggtctggcgcagactcgcccggcagcttgcggtaaagctgcaaagaagataacccaagtctggaggacaggtggatcgacatggtgattctactacttctaggtggtgtatattcgccaaggtggagtttgttagaataggtgtcgaatatactagtcctatttggttacggttggacttagagttgtaataggtgttagggggtggagttagagtcgaactctgtaacccggcaactctcttaaatagagaggggggcaccacaatgtaaccatggtgactacaatgtagcgtagacacgcagggagaggatggtagcgaggccatggactcgtagcggctaggagctatattggttggggaggagcgcccataatcagagcctcgaggatataggcttcggctgaacctcgttaacaaatatcgtgtattcctgtgtcgtcatctggcatgtcttgggtgatcaatgactgaagcgatcgagaaggttagtcgtcgtttcgctatatcgactaacttttataacatatacgaaagggactctgcagtgcgtgccaccactccttgtgacgtgtgccatcccccacgtcgaagtttaggcacgcacactagtacactacttctacagactcgctagatcactggaacacgacgcccacatcgcgcgcaggcgagtgtgcacgacagactcgacaaaagagaataaacggtgtgcgagaaaagaaatgaaacgctacagatag

SEQ ID NO: 80085 - DNA, 19292 bp, Oryza sativa
tcatgatgcgcgtttgatcagttttatatttctatggaatatcgtcttgttatatttgtggtatttaaaaaaattatgtaagttggttacccatatctaaaatcctcgatattccactagacttcattccattttccctatgatttaggatgtgttcgttccacctcgttgggaacatatctcttgcgcacgtaaaacggaaacggagcagtacattagcacgtgattaatttagcattagtttttttttgaaaactagatcagtatgatttgttaaagcaactttcgtatagaattttttttgcaaaaacacaccgtttagctgtttgaaaagcgtgcgcgcgaaaaacgagggagatgagttgagaaagttttggaaagaactcagcttagtctcatttcagttagtagttctttagtttgtaagcccagctcaacagaaagtaattagaatgtttagtctttcagggactagttgatttagaatttttcagccaatcgtagttggttattttgcacgcagattaagggagactataagcccagaaaagctgatgaagtttgcagcgcaaaacctctgccccagctcttcttgttctgctttcatctttcgtcaggtactgtagctgttcgacaacattcacaacagagctatggtagaaagagtgagttcaggatttaggtggtgtttggatccagggacttaactttagtccctatatttagacactaatttaaagtattaaatatagactacttacaaaactaattatataaatgaaaactaattcgcgagacaaattttttaatcctagttaatccataattagagaatgtttactgtagcatcacatagactaataataaattaattaggctcaatagattcgtcttgcgaattagtctaagattatagatgggttttattaatagtctacgtttaatatttataattagtgcccaaacatccgatgagataggaatttaaaaagttttagtcccctctaaacagggtctaaagtctgaagggcgatttcggacacactacacaactgtaccagtacaaacatatatatatatatatatatatatatatatatatatatatatatatatatatatatatatatatatatatatatatatacacacacacaccaacgtggatctatgcatcatatgcatttagggtacttgctctaataagctccatacatgacaaaaaatagcaatagtgcgactggatggactccagatgcacaatatatcttaatagaaactctttgcatttagcataatagatgtcactgagtgacatctattatgctagtgacatctattatgctaaatgcaaagagtttctattaagatagagagactccagatgctcaagagcaagcaaggtaagatcaagctcgaggacgtggccggtttggttggtgcagaagtgcagatgacgcttttccaccggcagcagcagtctgattgcctggctgtaggttgccatcaagcgaagaagttacaagtgtcattgacgacggcttgcagagaagcaggccagggttgccatgagcagcaagaacttggcagctgtgctatggctgcgttatttggctctgtttaggggagctttagattctgagaagcagctatttggtagccagcttttaaaaatctggaaaaactctgaaacccagtttctccagcttctggtttcttagtttatttttcagaatctgtaactacagattctcagaagctgtggactgtttggggcagcttctagcagaagcagcttttgagaaaagctgcagctgggagaagctctcccaaacagggcatttgctggagttcctaactcctcaccctcgttttccgcgcgcacgctttttaaactactaaacggtatgttttttttaaaaaaaaatacgaaagttgcttaaaaaatgatgttgatctatttttttaaaaaatagctaatagtacttaatcaataacatgttaatgcgaacattgttttacgtgccgggaggaggaacacgacctatctatggtggtagtgagctagactaagatatccatactgttctttttttttctttcgtaggagggtaaaagctttgcctcatatatatctattattatatactaaaagtccataaaactttatacaaacactctcaagccgtcacgtggtacctctacaatcgcttctagaccgccacgtggcaatatctaatctcaccgttgattttcatttaaatcggtggacccgataatttagaccattatattagattagttgtattttgacaccctaataaatcagaaaaaatccttaaaaactaaactcccttcgcccaaccctcctggctgtccccacacgtgcctacgtacgtagcaggtacgtttgcctccatgtgcacaatccagttcctcccccattctctatttttttttctaattagatcaatatcataatttctattctattctttctactattattattattattattatataaaagtctattaaacttcctgcaaacgctcttataccgccacgtggcgctctaaaaacactctcaagctgccacatagcactgcaataaaatagataaaatcttagaaattctgagaaaaaaaacctaaccctcgatttttatttaagttggtagaccattagtttacaccgttagaatagatccattataaataaatagtaatctatcccttctaacttaccatgtaatacttacctaaaaaatattggcagaaataagccaagaaggcatacgtgcgtacagagttaaccactacaaacgagaaaagaagaaatgatatacagcataaaagaaaaaaaaacatactgcatatatacgtactacgtactactggaaaaaaaacattgtttttcaaactggattttcacttgctctgtattttttatgacggcgttaaatatttagttaaactaccgaaagaaaacaatgatttaaattagattttctattatactttctttggattttttttaattttagtgaaggtggtagtataagaaaaatatattacttcataaaacatgcacaccccaaaatagatctataatataatataaaatatcaaatgaacgtatcatctatactagcgtaaaaaaaggaggagttttgccttccaatcctacaggtgaaatcaaatccaacgacccgtgatcaccttacaatccaatggctcagatcactccccaacgtcccacgcggccacgcaacgtcccttgcgaactctagcgtcttcctctcaagcgccgccgcagtcgtgttgcctcctgatcatccgccgccagatcgccgtctttgctgtcctcttaggtgcagccgctgcgcacacccacggtgcgcacctcccttccccggttccccagcccagtgctgcccccctcccttcaccgtgcaaaaccctaagcgccgccactacaagcaggtacctttgccgccaggagatcgccctcatgtcacctcgctgccgtctcaccagatcatcgacgcaccgcctcgccataccggtccggcgtcgactctgcacacgcttcaggtctaccacgacaactctttcaaggtagtcccagcatattgaaggtagtaccattatgaactttctcatgccatggctaactatcggcctatcattgtagcattatatatatctatatatgttggtgttcacttacaatttcatgcctctttgataatcttggtaatattctggtcatatctccacctgcgcaaaatttccaaatcctgatggtcaattggttaccatgcactatatatgaatcgatatggaatgatgcatgctttattgttgcagttaatttcaacagagtaaaacggaaggagtgatggattctctacgccttgcaaagttgcaagtgcaatatgaaatgctggggatacgacatttcagattcatgcttcaagtgatcaccatatgctgataagctgagagtatgctcaaatgatcagccagaccttctcttagaggtaattcaatcatggatactttctatttttctctgcaagttcacttgcaatatattagtaagcaaattatatatattgcaaagtataggagccattgtcatttttgttatatatggcttccatcaccccattgattactggccaagacatggtatatgttttttccatgtagattgagagggaaaatacattgtgactcatgatgtttttaaggtccaaattaacatttcaaattatactgtggcttctgaccctgtagatcaaaattattgcagttgcattatgccattagatgatttcagaaattcctgaacattgcataattcactcaattgacttaacgttgcctctgctttagcttgtccatgccatgctttgtttggatagctccaaagatatatttgctattgatcagaatcaaaataaaactcacaaagtttagagcttgtatgatatatgggagtcctttgtttatatctctcgaatgttcactctgatataatcatgcaaattggagggtatgtgtgtaagcgccagttcgattattgtatttacccaaaaataatgattgctgtatacttgcatattaggttgtgcaatgcatactctttcagatgttgtactgcaactgcacaaatcttgatctttttttgtccctgtattttcaccaggtttcacttgatgaggaaatgagtttatagatgtgtagagaatctgaaaaagatatttgggaagagatggtaggtgcatttaaaacaatggcaaggagccaaggaggtaatttctgtcgtgcgttatgaattagaattagcgatctgtactactgtctacactgcaggcacgttttccatttcttgatgagaatgtgatcaaaacgactttattggaaataccaggttcagaggttgcttaacttgatgaacctattggaaagggtgacaaagatttcagcaggtttttacttgttttgagcttaatccatatgggaactgttacagtaaactgaaattcgcatttgtaattcacatgtaaaccattgtcatgacagtgaaactactggccattttgctggtatagtgatattagggccatacatgaattatagttcagtctttttttataaactttggcgatgaagtttagatctcttcctgttactgtattgaagctacaatcatttcaaaaattttggatctcaattctttttctgatggtagcagtatacatgtcattttgctggtttttttttcttttttttttttttgctttaaggggatcagggcaggacagaaggaacactatgaccatgtccccatggcccatgtccatgtacgcatcaagctcctaagtgataatctgattgcctgctgatcccaggcgccggtggaatcaaccttgacccatcaatgatggtcatcccccattgacgatcacatggtccacagagatcatggtgtcttggacaccatcattatttctgacggtttaagctttgtctccacaattttttatctctgtatttgcttctgatggtttatacttcagagttcggaactgaatgttcatactctagatgatcatgtacttgaaattttgcacatttggtactgaatctgcactaaagtgggtttcttgatttggttaggtacattgtataagctaggttcgcattttgtacaattgattaaagaatatggtttgtctatttgcgtagcttcaaatgaatgatgtttaacgctattctgtctgtaaatctacagagcaatatatttgattgaatttagtttagccttttcgtgcattgcacgtgcattgttactggccatccatggaattaaatgtgttgtagaaactggcaagtgtcaattcagagtgaccatttaggattccatggtgtgcatgctttcttgtggcatactggtcttaggagttcaaatagagttttagtgcatagattaaagtgagataaaagtttatgcctgaatatataatttggtcatcttaattcattttcaggaatgttaatatgtatttatgtttccttttttctcataaaataaaactcaccgcagagaatgtatggagcataaatatgttctttctaacagaagttttgagtacttatttttgtgcagctttcttaaactagctagccctagaatgatcctgtttgttgaatcggctgtaaagatggagggcatctaggtaaaagatgaaaaatttatcaaatgcatcgtctactctgattgtatattcgtaaactattgtcctttctagggagtaatttgggtaaattcagctgagggaataggaaaattctccatttccttcaaattattatgttttacggcaatgagaaaataagatcaattgttattctcctgtaagaaattaatttgttcttctgtaagaaaagaatgctccgatagttattctctttactacttactatatcacttctagctgacaatcatttaaatttagatcacaaatgtttgtttacggaagtagcagcagcgcaatgtatgaattttagttggcaatttcgtaccttttgcgaatattttttttacctttgttggtcagaaaattgtaattgaacacaagattttatagatttcactgaccaaattgtcatcttaggataacctataaaattttgttctccattcgtaattgtttgttagttatatattgccaacatgtgccttgcacgtgcacgataactagtttcacactacaattgttgagtatagatagattttatttgcatcaatgggcctacattgatagttcaagatgaaataatgagtaattaaaaaaattactcaggacatttgtcataaacacctataaaaaaatgtattgtttaaaaatatatcacatttttttctcgcaaaataaagtcaggattttagccgttaatgactcaatctatgcttttgatttgtacatattttttaagtgtataagtaataaatgtaaggttgatttctaaagtacttattggattggtctccgaaccattaaactgttggtgttttacaaatactttctatacatatatatatatatatatatatatatatatatatatatatatatatatatatatatatatatatatatgtttgtaatatttaatacttaattaatcttgcgttgatgacctacatcgtttttcatgccttgcctaagttcaaccaattagatcgaatgtagcctaagtaggagatagattagattatttactaaaaaatttaaaattaaagaatcaagttaactacattattaaaagattctgcctaagctcaaccaattagatcgaatgtagcctaagtaggagataaattagattatttactataaaatttaaaattaaagaatcaagttaacttcattattaaaagattcattactttggatcatatatattttacggactagcttttgttcactaattcatacatttttaagaaaaaagcaaataagttttgacgtctttctcgctatttcttagatattaaactaaaatagaaacaatcaataatattggatttttttttaagaaacacgacacgcgcacagcctgctcctttgagtacctctaaaagactgagccaacacattttgagaatgacgatgtcaccacaggcgtctcgctgttgacgggtacgccacctaccattgaaagaatatttagccgtaaatgcgagcacccgtatcaagtctaggacttaaaccaggtagacaagttacaccacaagaaacctaaccaattgatctgtgctcacttcacaataacattggataataaaacaaccataatttttaagctacataactggaatacttttatgccttttaaaccggtgaacaatttgttataactgttagatctatcttatataaaagttaagcatgtatttatggtacatgatatttccaaaatattactacgcaattatatttcgtcattatcatattcatattaggttgcatggagcctctcacccaccctacatgaaatgttcataaatggatcacctctcaaactatatcaatcatattagcttctataaacccatacatttagtggagcttcatgtctcacccaattcatctttaattgaactgttatagatatgtaattaaaaaacaccttactttacttttgttgacatgttttcaaaaaaaaaatatgtttaccttattttcaaatgataaagaagattataaataattgcttatagatattacttaaatatgatataatataaaactaataggttactaacttagcaattaatgctgatgaaaataatttatgtacaaatcatggcagatgttttccgtttaatatttcgctcttatacttatctcaaacttagcataggacgcatgcccgcgcattcgcgcgggctaccttcctagttgatagaacaaacatcgtcctcccatttttgcgtgcgggcatcttaagagcactacgcgcgaaaatactctcccttcttttaccctctcaacacttcaaaaatttcatcctcatatcctccctcaacctctctcacctccttatccttatcctcacctccaactgtctctcctctctcacgtggcagtaggcgggtggctcggcagcgggcgatggcgggaggagtggggccccgccgccgacaacgacgacgaggtgaccgggagcggcgccgttggccccgcgaatccgcgccgcccccgccgacgaggacgaggaggtggccggagcagaggcgaacggcggccatcgagctacagcggcaactagggtttcgattttttcgcaatttttattttcttttatggttttttattttcgcgtgcgggtgacataagcaccagcatgccaaaaaagaagtctgaatacctgatggataatttgcccgcaactataactattttctctcttgcccaggctttcattctttacacatagaacattatcgttgtgtcctactccgaactatgtcatgctcgtgcaacaacgagtcagaccagatgctacagtaaaatcgatctattaattgcgttgatccgctgtgctactcgcatgaacagtgactgatccgtgggttgccatgctgaaagctctatccagcttccaagcagccttgatatttttttcgttctaaaatttagctatttttggagttcaaatttattcaaaatataactattttctttacctgtttggctatttctttatctcaaccaatcacatcgttatttatttaattttttatctactttcttttttaaccgaccatggttttttaccagtcaattccacctatttttcagttcatctgaaaatctctaaaaacaaaatatttatattttgaaacagatgaagtaggatcattgttttgccaaaagcaagccgtatcaaggacacgcacactgtagtgcagcaatggccataaatagatatgccagcaaagcccatataccatcaaaagaaacattcatttgacatttcttagtacaacaatatgcaaatatcctgaacagtctccaaggcttagttctttcctccactttcccaacttctacctcttgattttcacacgcacgcttttaaaactaccaaacggtatgtttttttaaaaaaatattctataagaaaattgctttaaaaaatattaacttatttttcaatttttagctaatacttaactaatcatatccaaatccaccgctttgttttgcgtgttctcattggaccttacaagtgcaattctaaaagagcccaaaactcacaataacaaaggctgcaaccatctgtgcccaccttctgaaggcatatctccttttttttccccgataaatttatttaagagagttcatcttcatggacacaaatacaataacaataacatgtttaagttacactctcttcatatactttccctaaggaattatgattgccagtcttgacaatacaacatcaggttggattgcatacacacactatataagatattccagccatgccatcgcccatcgaccccttcatttatcaccatatgccatgctcatgcacgcctcgtggagtgaagatgacgacagtactctccaagagcccagatagggaataagttgcggtagttggggtaattaaagaagaggcatgcattgaaggctccaacatgttcctaattaagagcaggtacaatagcatgctataaactagttgcaaacatattttaaaaagataaataaggagagagatggacagcgggctacagatttgtagccagctgtagcacggactctaagacacagtgtgtgtatgacagatgggaccatgtattaatagtgtagtatgtaactattgaatgaatgagctattaaattagctatagatgaattggagctggtagttagctacactattaaacttgctctaacatcagcagcacaagcaacacaagagataaacctttaatggtcatataccaacattatctaaagttccaaacacatgtaacgctgaaacatcttagttcagagcaccctaggagtttggtgatttaattaggtacgttctttttcaagtctccagagcaaccacttgaacatgggattgtatgtcctaaaatccttgcacagaaggtaccatatggttgttcatttcctaactacagccaaacaaaataatctcatagaagccctatatttgtctaatgtgaatgtttgccaccctaatgtggctctgctcgctaatggaggttcccaatcggaacagtatgcacggaaaacggagcggtctattagcacgtgattaattaagttttagctattttttttcaaaaaggatcaatatgactttttttaagtaacttttgtagaaaaactttttttacaaaaaaacacaccgtttagcagtttaggaagcgtgcgcgcaaaaaacaaggcaaagagagttgggaatgagcacttacgaacagaggctatgtatggtggcttggggattcttagtttggaatatacgtgttgggctcttaggaggtgtttggatccagggactaaactttagtccctgtcatatctaatatttagccactaatttggtcagataaatggttgcagggtagggccacttcagagttcgcccctagcttgttcaagttgattgctaagaaggttgtaaaacgacatacagtggctcaagcattggatagtcaaacatggatcacatatataaaaggagttcattatgcaggtgattagggactatcttccgatctgggatttattgtgcttggggtaaacttgcaacaacatgatccactggatcagcaccgttggaggtcatcaggatttcgtttatactctagcaaatcagcatatgagattctctttgtcagggactatcagattaatttgctccatagaggaggatttggaaaagttgtcacccctgaagtgcaaacttcgtctgtggttcacggtaaacaatcgccgttggacgggcaatcgcctgtccaagcgaggattgccacacccggctgcctgccctttttgtgatcaagctgaggagattgtgcaacttattttgtcacttgcatttttagccagcgggtgtggtcattggtccttcacagattaggtttcattggcctcacggctcacgccaacccatgacacacgccatttctcaagctggtggtctatgccagtgaaagacacccacaaagaaagaaaaaaagaaagaaagaaagggctaaactcgcttataattttggtggcatgggaaatttgaaaacacaagaatggttgtgttttcaatggttcaattccaaatatgtcaaatgaggcttcaataagtagcatatgaaggcgctctttggtgcttagcaggagcttttaagctctaagaggtgttggctaggtcgatagcccttgcggctttaagtggacttgtttagtgtcttttagttttttaatgtgtgttagtgtttagggtcgggagtttccggactcccctccctgtgtgtaaattcttctttcttattaatgaaatgttgtgtatatcttccgtgtgttaaaaaaaaggtcctgctccagggagccctaatcagagaaaggggatgagagaacaaagaagatgggaaatatctatcagattcccaaaaccaaattgaatccctaactttaaatagctcgattgtacagagctggccaacctcctaacaaacaaaatttatctctaaacacaagtataatgtaaagtttgatcgatgtagccatcccatgtattgaccatagttaatatcagagaagggggatcatgttctgcgcgtacgcgccggcaaaggaggcggcacgcactttggaggccctaatagcgcttagcgctttgctaatggcgcttagcgtagttttttttctggtttttctttttggataaaaatttgccatgcatctgtttcttccctttgtttagttgactaaaacaaacttccaactcatatttattccggatttaaaaactttcaagtctagatttgaactcagattaaaaaattttcaagtcaagatttgaatattttcaacttaaaatttaaaattatcaatcagattttgaaactttcaaaatcatgatttgaaaattttcaagtcagatttgaaaaaattcaggtcaagatttgaaaactttcaactcgaatttaaaaactttcaactaaagattttgaaaactttcaactcagatttaaaaactttcatctcaaattcaaaaatattcaacttaaaatttgaaaactttcatctcaaatcttaaaaactttcaactatttaagtcaagatttgaaaactttcaagtcaaatttaaaactttcatctcagactaaaaaatgtttaactcaaatttgaaaactttcatctcaaaacttaaaaactttcaactcaaatcttaaaaattttcagctcaaattcaaaattttcagaaaaaaataaagatgaaagattcaatttctaaaataaaaaagagaaaaaatcggcacaaaatatttacggcctcccacgacggaaaaaaatagaaaaaggaaaaaaaaagggaagagatggctacgcgatggcgtgggtcttacatgggccaggaatgtgcgccgcttacgctaatagcgcgtacgtgctaattagcaatcgcgtcagagaagctgggtgaattaaaccccattcatgccatatgatacatcgtatatatatctttaaatttttattctgtccttcattccataaaattattgctcagactaaaatgaactcagttctccacgaacgatacaaaacataaccccagaatcccagcaaaacttaaatgcgaacttacttgttgggggaactctcctgtttccaactgcatattgattaattcttttgcagcacgatgcagtggtgctggatcccgctccatctgacatccaaatggttatagagatcattcgataaaaaggtcattcctatcagaattgaattgaaaataaacaaaacacacctgtcctgcacaaattaaagctaacattgcccaggcagtattcactgcatgagcttgatcatctttaatgtttacgtaaacctgtttggtatcataaaaaataaaaatcagtgacgaaatcttccaaatggatttataaaaatttgcaccagtccaacttcttccctcataagatttcttccaaatggaagcaactcttgttgcaaatgaaaaggaataactccaacatgcacaacagatcaaatggatgagcttgtctatgttcaagccccaaactcagcagggtgcttaggctatattcttcctcctcatttcccaactcacctctcttttttcacgcgcacatttttcaaactgctaaacggtgtatctttttgcaatagttttatatacgaaagttactttaaaaaatcatattaatctatttttttaaaaaaatagttaatatttaattaattatacgctaataagccactagggttgtgagtgttcgctccacaataccttccgtaaaggccaggagtactcctttaaaaaactatggtaatcaacccaccgctatgtatcctatatgccaattatcataaaacttgcaacaaaacgagcaatatatgtttattcaaccacaaaaattcaaaaggaatgatctagcgagctagagattaaaaaaaaaaaacctaccttagtaatattagagacataactttctccccacccaccagtatcgagctgctttgataatataaagtcgcatgctttcctgatggaagaactattctcatatgttcttccagcagcaattaacccttttactgaaagaaaggccccataggtgaaacacacaccccaagtgcctagcctgccaaataaccaagttattgtgttacaaattgttaaaatagaagagaaaaattatccaaagacagaaagtcagtatatgtggtgctcttgttacaaaccatgaaccatcttcgccttgtgtgctctcaataaacatcgctgcgtttctgacacatttttctatctctttaatacggtaactagggtgtagttgtttgaacagcaccagagcttgaagcacagaggaggtgcattctggaaatctgccaattcatatggtataaagtgatcagttacgccaggagttatttctacaaagggaaaagggtgttaattattaggattttctaagcacaatgatgcgctcagcacttacggataatcaaccactatgtttggaaaactctcacaaggactgagaacctaggttatataaaaaaaacatgtcaggactacaaatcgcatggccataagaaacatactggtgattgactagttcttcaatataagtgtactgaaacatacaagatgtgctgaataagtttcacaaatttgaagtgcatgaatcatgctggtgttattttaacatcataaattagattgatcgtgtcatgatgtaggcacaggcatggagttttcgtgatgttatttataaagttgttgctggtgttatttataaagcatatcaatcagggcattagtgtgcagaaactcacctctatccaagtataagttcttttacattcatatgtagaaagggtaccatctttgttctgcaaggagaaatgaacacattaaccagatgattttcacatattaaaaccatggcagcgagagagaagggaactatatgcatggcagagttacaatcaccatttttaggatttttgacattttggttacataaagttggcaacaagttgcgtaggttatgagcttggattttttttaaacggaaaacagcacgagaatgccttttcattgaatagagcaggagaaaatacaacccctaagggtaaagcgaaaaaagagagaggtcaccgtaagctatacaaaatgcgggacgaactcgcgcaatcgtttagcccctgctagagcccaaaggctagcctcttctttgattttcgttaggaggaagctcgttgccacctatttgtggtcgaaaatccgccgatttctctctttccaaattttccagacaattagcaggatgagggattgaagtcccttttttgggacattgggcatatttgctaggttctcctaccgctgttggactgactgggcttcctcccattgggccggctccatttgctgatagcccacccatctagcaacgaaatgccaaatcctcttggtgtatctacacgtggcgataagatacaaggccgtctcaacttcacaacggcagagagggcattggccgttgttttgccaacccctgatcgcaagccggttggatgtccagactctattctggatgatgagccaagtatggaatttgcatttccctggtgcccaaactttccaaatcaaggaattgagacttgggctaggcgccccacagcactgcacgcatggtaggccgaggaggccatgtaacgcccgttacttgtgaatttccaagcagtctggtccggttcttcattgtctaagtgcacattctgaaccgcttcccacagggtaactagctagtcaacgaggttgactatgataggtgagtttgcttcgagggtcagatcttgtacccaggcatcatcctccttttcttggcgtagggactttcctttgtttttggaaatcgcgtagaccagcggcatgaggtcttttggtctgcgcccatcgatccatgcagagtcctagaagcgtgtcgtgttctcatcaccgacagttatttttgttgatgcggcgaagagatccctgtcaatttcgttgcaaggcatctccaatcccacccacggttttgtcgggtctttccattcatgccacaatcatcgcagccttaatccccttgtgaatttggtttagaactcccaggctggtaaggtcaattggagcttggatttgggtttcacagctgcactcatactgagttccagaaaaggctattagcatatcacaccccattgtttggtgtgtaagattcttttaacctatcttcgcttagtacaactaataacagtaaacaaaaccataatttttcacataataatgaattggggctagtctgcaaggaaactacaagatcatgtttaatagctgtgcttaaataattccataccacgaaagataggaggcaatcaacagcatcatgcagcctttctatttcaattggatccccgaccacgttgctagagatcttttccagtaacagtacagcctggaaatgagattatgtaagatttcaagagtagacaaaataaaaatttatgcagaactggcaacagatcgtgatcaattttttgtataagcatgagcttcttgggtgtgctatcactgattaagactaggttaatacgatagtacaacctccgtcccaaaatataacaacttttaaccattaggatttgttctaaaatataacaacttctccaccaacattcttttcccaaccaatcacaacactccaccattcacttttcccacctatctccactattcatccaattacaaccctccaccattcacttctacctactttcttaataactgtgtccaactctaaaactttttatattctaggatggagggagtagtacttatttgaccgtttcaaggattaattaattatttgcctcccttgtttcaatggtgcattagtaaaaaaaaaaagaagaagaagaaagaacataatgaccttcagcgcttctgctgtagtgtcagacacagcccatccattgtctgctgacgaaagagtccatgaaccctttgatctatggcgatgccagtaactttggtcaccaggatgattcctcataatcttcaagaaagaacatgcaatttatgttggatcaccttatgcactagttaatttataaatttaaattattaaagtatagactctgaacctgtgaatttttcatgaactcgtgggctctcctaacagttgaaccatactcatttacaagatcagtagcacaaaacgcttgaattataaatgctgtttcccagctctggcaaccatcatatatctatcattcagataaaaatctgtcacagtttttttctgtttcctcattagataaaactaggaagctagcccacgcatctgtgcggacatgtatcaaatactgtgtctgtgtaggaaacatatatataatggcagaatatcaaccggataacacctacagcacttcaaaataattatttctccataaattttcttcatcaacattgctggtataaattgtcaagttgtttgttagctttaaactatccagtatttacttcatacctataagaaattaattataatatttttcattatcttgaaaggaggttgacttagtttgtttaaaacaaatgtctaacaaattaagtgcaaatttaaaataaggtgcttttccttttaagttgaatgtttagatgctctattttgtaacaaatcctaaaaaattattatcaataaatgtgttttatttataccatagagctgcccctccttctaattggttcatatactcacgtaatttttacatttatatatatatatatatatatatatgtgtgtgtgtgtgtgagtgaataaagaaaagagatcaacataccttgtttttttatatacttaatttgtagtttttatttaaagtcctaaaatataaatacaatagtaataaatataacttttaaattaaccaactacttattgtcttaatttggattatatatgtaataatatgtggagaaattcataatgcgacggtatatggtatagaatagattgaaggatattagtatgcaaacacttaaaaaatggtgatggctagaataggcaatgtttgttccaattaaagtgaaaagtaaaaactttttttatggtattttctccaattaggtaattgaccaaaaatgaaaaaaaaacacacacacttccacttccatccctgtcgccgacggtgatcaaagccattcaagccaccaccgttttgtctccaagtccagcagcaagaatgacgtcgttacgctgcagcagcgcacgtgtgctcactgtcacctccgagcgcaatggcggccatcgattgccgcccgccgccgtccaagcccatcattacgcgcctcggcaaggacgccgccacctctagggatgtaagcggggcggataagcggtttttttagcccgcttatctcacttctggtttattttttctttaagtttttttactaccatgtgaaaattgaactagcaagcgggttttatgcgggtagcgagactatccacttgcatccctagccacctcgctgtacaccatctcggtcagcggcggcagtgcgccgctcatcgtcaaccttgccggccagctgctctggtcgacgtgcctgtcagcgcaccgcatcatcccctacagctccaacgtatataaggtcgcggatcagaccggagccgggttttaatctcaaccaaatcaacggcttggaatattggatccactgagttaaataaaaattaagggatggattttattaacgccacatgtcagtttgagagtgttttgaggattgccacatggcagcgttatatcgttttaagaaagtttaatggacttttagtataggaaaatgtacgaattacccccgtatcaatcgcggtcgtccgaattacccccctgaaccacaaaaccggatgggtacggcacgtcatcaaaggtccac

SEQ ID NO: 80086 - DNA, 13284 bp, Oryza sativa
tttggatgccatccacgctgaaaccggcccacaccagcaaaaccgatgccggcgggaggagtccgagagatggagatggagcaggaccatccactgccttagtccctaaccaatggtgggaatggcagcggcggtggaaaatcgggcgatggggaggatgacgacagtggatccgagggtggggagggtggcggcggcgtatccagtggtggggagggagatggcggcagatccgacggtatatagggattgcgtcagcggcggatctggtggcggcgatgggaggtggggagggtgtcggtgacggcggggatgaaccccgagcacatgagatgccagcgtttcggatggatttttctttggatttattttgtcaatttttctttttagtcggagtacggcttaggcttaagcgttcacatacgaaaaatacaattctttgcatgggactatctaaataacaacagcaagtttttaagggaaaaactttcaaacctaattatagtataattgtaatataattttactataatatatgcaactttatatctaatttatatagggattacaatgtaggtacaataaaactatagtgtaattacattgcaattacacagttacctttgaaagttttttttgcctaaaaaacttgcgacagttttttaattagcaataccgtttttgcatatggttgctctacccgtatgcaaaaatattttttgacatctgggtgtaggcggaccacctatatatctccgtatggatccgcttgctaaattcgattttgacagtataaaaaatattttttaagtagtgtaggcgcgccataacacatcctagctatagccgatggagaatcgtcttccctgaacttgttgatgacggaagtggttagcggcagtagagctggaaggcagggagaggcatgaccacatggagaaaggggatgcctacattttttatcccgtgcagaccaatcaaatccactaatataataatataaggtcctattcagattatagccaaaataaatcttactaaattttagcgttgtcaaaatattggcaagatacaatattatcaaaattgtagaagtatttcttatgtatttaccaaatttggcaacaaactaaatatagatatttttttagcaactgtgccaaaaaaatggtatggttgaaaatggcgtcaaactgaaccggtcctaactttttggaagatttactttgtttctacaggacaatatcgatacacgtatagatgtttttattcacatataatatctatattttactagttaattattcaatttttatcgattacaataattttatttcgtaccttacttctttcttatcaacgatcaacattactctacttaatttgtaatacttccaagtacgttaacataccgtgaaagttctcatcaaatacatttgacttgagggagtagaaagtactataatttgtatagtacaatcatatcgtacgtcctcggcaagaaagaaagaaaagcctttatcgtacatttgaattagtgatgctgatgcgagattaattacgtactaattagacgcgcgcagagcacacaatccgatcgggctatgcgtcgtgcaaaagcaaacgcggcatcatcgatcatatcgttctatatgcaaacgcattgctgtgttgttgtgtgcttcgaaggccgtgcatgctccacgcgactaattaacgatctgctcattgatcaccttgatcttgcttacgccatatagtacataatgtaactgtatatatagagctagcttagctagggtttcgatctgctaattgttttttttctcattaacaattgctgcgcacacgcaattatcttgagaacaaagcaacatcctgttttttctcgtttagatggatgcgttgcatcgtgccatgcgatcgatgcatggaattaaaataacccttttattaatgaattcaaattcaatttaagtgatgtacgcagtgatcgatatatgtaagggagagtgatgatagataagggagagctgtgtagagatggtactctcccagttttgagtgatctccaatcaaaagtagcattgcatataggtcggttcttggcctgcagcatgcttggaatgcagaaatttgatagtgcaaaattaagaaggatgaaatccaattttagtcattatacggttgtttttcaacctcaattttcaaaaggaacagttttgatttactccctaaactttgagcgtagtccgatttcccatgaactacaacaacaaacattcgatatctgtgaactttaaaaccggacgaattatatctccttgctatctaatcaacaatataagaaagacaatttatataaaaagatctatctagacacacctatcattcattatatatatatatatatatatatatgtatattcttttctctttcgactctctcctccatctcttagggccaaccaaaggcccacaaccgaactcccctcactcgagcacacaccttattgtcatcggagtgtgtgatcatagatgcctcaagctacacctacgcaatctatagctattaaaaccggacaagactagtggttcaacccaaaaaaatcacaatagctcagtccagttcgatctagccctccactcatgatgtggccatgtgggtgaatcaagaatgcatgtttggcagtgatggtgatggcaaggtgccttctaagcagatgagaaagcagaaagtacatccaagcgagggagtggatgcctagggcagcatgtttgaaggaggaatcagagaggagagagaggatgaggtcaacaacaggtatgccagatctaactctattttgcgctgcatgacgtgttgggcaggggggattgcttgtagaggtggtgatggcaaggtgcttttgaggggcgatggtgaagtgcttttgaggcgcgggagaagtttggagtatttatatgtgggtagagataacttgtccaagtaaaccacgagcagcccttgtgagatacgggtagataagacactgtctttcttggatcaaagtccaacatcttctatttccgttgaagggttttccgttccgttcttatctactatacttttatatttactagaaaagatgctcgtgtgttgcaacgggtgaatgctattttaatcatgttattgttatacggtttatctaggatgaaattcactttaggaattcgcttggatatttttttaaaaaaaatcatgagctgcaattagaagtctgactttcatctcaagttagcatgcgagtttttctaaagagatttctcatacgactccttctgtagttttaaaagcaaacaaacttaaaatctgactcaaacacggatttttatttccaaaagcgaacaaaatttaaaacccgactcaaatacgaatgatgtaccaaaataccggtaaaaacattttcaatttttataacaatagagatagagatatctggtggctataatccaaatatagatccgtaagaccgataaaatccatcttctaccatatgtttagtgttttcctatgcgattttttttcgggaatgctacatacggggatcctgtcggcatgggatccttcgtccttcttgcctatccaaagagaagcgagagctgagcgcctgagccgtaaggaggaggttgctgtcgcctgtctgtgaggaccttcggcacggttggggaaaaagacctgctcggcgagaggaggacgcggccaccggcgacgagccctacacggtgagctcctgcgacgtcgaggacctcgtctgtgtcgtgtcgaggcagcggtgcgtcgcgtccgagccgccggtgggggatacatcaacgaagaaaggaggggcgtcgatcggtggccggagctagggaacggagtaactgcggtggccggagctaggaaggggaggggcagtggtggtggtagctgcatccggtggagcgagcggctgcggtggccggagccatgggagggaggggtggcagttgtcggagctaggggagggagaggcggcggcggcggtggtagccggagccgggaaaggagcagcggcggtggttagagccaggggagggagggcggtagcggtcgttggcgtcggcatcaggtatgtccagcttctgatacctagttgaaatcacatgatatcttgtaggtatcgcctgatacctcataggtatcgcctgatacctctaaagtatcactttctacgtggtaagaatcacatgatacataataggtatcacctgatatctcgcaagtattatcttttacgtgataagaatcacatgatacctaataggtatcacctgatatctcgcaagtatcacattctatgtggtaagaatcgtatgatacctgataggtatcacctgatacgtggtagaacagcatgatatttgataagtatcacctgataccggttaggtattagtctattaggacttgatatctaactggtatcatcctgtttttgaacggattccggtatatagcagcttttttttttcaatgcacggtatattcatcagctggttggttatttagccaagaataaaaagatagaaaaatgttcttcctaggcccgagggccgagagctgttcggtatggccgggtggacgcgttagcccttagcagcttattgggcctgaaaagccgaaacagtgaacgtcgtacggcccattaaagcccaggcccaaaagagcccacccacctcctctcttatctatgggagacgcgctctccctctcgcctcgcggtcgcctcgctttctccctcgccaactcgcctaccctccccacccccgcgtcggcggcggcggcagcggcagcggcagcgacggagcctcgccggcggcaagcgtactcacccggtaaccctggctcctccccccctccttctccgtacctcgtatgcgtgttcttctgcgctcgtgcgtgcggtgtctgccgccacagaaaaccctaggtccgcctgcggcgtgtcagcgagctcgcccgtcaccgcttagatccgcgcgggattcggcggtttcgcttgctggagatgccttgacgagcggtttaacgagatagggaatgttctatttgtttttaccccgtagctgcaaggtttctgaatctcagatcccctcctgccatgtcggggttgaaggctagggttgttgcttcagagttgtcgtgaattagtcatatatgcagtaaattcttggttggagctggatacgtgggtggttgggagtaattgctattttctagatcaacttaatatgctggatcttggtgttatatcgatgtattcatttgtttgttactgtgttctataccattatcgtatccttagatccaaaggataaaggaaagtcatagttcgaaatttgagctgcaattcaaaatttttggaacagtgtttacaactcagatttgttgactgatgtgaatagcgcatgaacttgcaaggtgcatgattcattgggctatgccaattttgatttggtagtttttaatcttaaatcctttttaacatgatgccatgcttgtgtttgaagacttctttccatgtacttgaagttacctatgggtttttttgttccctatacttttaaattacgctgtagtatattattcttaacaaaaaactatatctgtgctgacaagtttggcagttattctttggttgcatttgtcttcttatcgctaatgttcctgtatttacgtgtaattgcagacaaaacaatgaggaggtatagtccaccttatcgcagtccaccaaggaggggatatggtggcagaggaagaagtccccctaggaggggatatggaggacggaaggaacagggttctggcagtctcctggtccgcaacatccctttaagctgcaggtactggaactgtataaccgtagcacctttttccaatgactatattcttaatgaaataaataaatattccctctgtttctaaatatttgacaccgttgactttttagcacatgtttgaccgttcgtcttattcaaaaactttggtgaaatatgtaaaactatatgtatagataaaagtatatttaacaacaaatcaaatgataggaaaagaattaataattatttaaaatttttgaataagacgaacggtcaaacatgtttaaaaaagtcaacggcgtcaaatatttagaaacggagggagtataatatttcggaggttgcagatttattcaatttgactggctctcttaactctggcagagcggaggatcttagagttccttttgaaaggtttggacctgttcgagatgtttacctgccaaaggattattataccgggtaaagtgttgctaatgactctgttgattggtttgttgattggcaatcgccaaaaaaatgtttgttataatgttaggatagtaaatgtagatagtctgtatgcttctctgtattgtcgctgcaataagcttacaagcttttctaaagttattcaatagactggaaataaaaaaaatcacaacggaggtttggcgtgaacattttccagcttcagtgtggtatcaattactgcagtcaccttttcatttagctccattaattgaaatgcttgaatcatttttttaatctgatgatgtgtttagtaatttttttcatgtcactagagcatgtaattcactaatgtggtaacccatatttttgctttctttctcctacgcacttaatatcataagaagtttttccctgaaactattcccagggtcgtactggattgaagtaaatacgatgttgaagaatgcttttcaatattcctaacaattgatttgtttggcaagatagagtcttgtccgaatgaagaagttcttctatgaagacaagatttgactcattgagaaaattaatttcacgaagagaagataagagagttgtactgggtggtgcatgcgaagataaaagtgagagaagttgatttcaagttctatcttgacttttcgcacattcgggaacttgaagcgaatgcttctgtgaagatgctctttatgaggatcaccatacgtagtgttatacaagaaattcagataatagagcctggacatctaactgctttttgcaacacttgcttcccttttgctggaaatgttcgtaagtttttaactgtgcttcactgagaatcatagagggtacattgagttttgaactgtgatggtaacatggcagacacacactacacatgaacattttgcaccttcttatttgttagttttaccatcaattttcctcaaacaactgtctcataaaatatacatatacagggaaccgcgagggtttgcattcgtggagtttgttgacccttatgatgcttctgaggcccaatatcatatgaatcgtcaggtggtttttggccgggagataactgttgttcttgctgctgagtcacggaaaaggccagaagagatgcgcagtagagccagagtcaggtattgttcccattactgcttgaacgtgcggcttaatattctgttttgtgcttgtttacaatgactttgtgtggttgctttgcagagggtactctgaccatgaaggccgtcgttcatcccattacggtattctctcatttctcatcattcatgatcttgtgcatttctaaatgcacatctagaatcttgtgtgctctgtaattatgcttggaatacttgtcccttttgctgcacacataaccgtatgtttcagatttcagattagtactattggtcaatctcaagtttttgttaattttcttttcttaaatgcatgtaattttctaatttattttgttgccacaccgaattactgaggcatccatctgttcttacagggaggtctcgttcacgttcgcgttcccgctctccccgttatcgtggtcgtccacggtcaaggtagaccaattatagttcctgtttactttttgttgctatatgtgattcctaagccattatcttcattcatgattctctcacttacatgttttctttaaaggtcatactctcctgctccaagacgacgagatgactattccgcatccccacagagaaaagacacacatcgtgcaaaatctcctaggcgtcagccaaaagaacatgaagtagacaagaagcggagatcctattctcctgccaataaagatggggaccggcgtgatgctgataatggttatgaaaagtaagttcgagtgcttcttacttccattgctctttgcaatgcaaaagttctgcattggtttgcttttctcgcctcaaaaatggttgaaagtagcatacgatagacttttagtgtatgatattccagtaaagattgaatggctgttgtgccttgctgttggattaggggaaagcattcgaatattttccgcatactcatgtagtcattttggtcgtatgtgcgttacttatgggatatatataaaaatataccccctccgtcccagaataacttaatctagtacctgtccagattcatagtactaggatatgtcgcatccagtattagattaacttaattctgggatggaggtagtacctacctcatgaaatgccttcttgggtttctggtcatacactgaaagcatttatattcacaggaggtcgccgccagctgacagcgatggatcccctccgcaccggaggtcccccaggcaatcctcaggatcgcctccaggatcccgctccaggtctgccgacgggtctcctgcccgcagtgactaacagaagaacactgcgcacgctgtgctacatcctctctagcttcttgttggtcagaccggaccagtttaagtaaaaacccttttgggcttgttgtaaaacttgtaatgctagcatctgtcgtggtttggtagcggaggacttggatcgtcaccattgtgtgtgctcgcttctcagtggatggagacattttgagtcgtgtgtgatgaaaccttagacttgctgcatggcattgtattgtgttaaacttatccgtatgccttgtgtattcttgtgcttgccatgtgctcatgcgcttgaattgctgtgcacgcggagtcgaactatgccgtcgacttcttttggaactcttttcgccttaaaatatactacctccgtcctaaaacatagcaatagcaatttttagctatgaatctgtagctaaaaatgcttacattttgggacggagggagtagtaaaatattattgaattagataacatattatcatgaatatagatgaaatatagcaaaatcttctaccctataattcaatgaatgcttttactcattcatcatgtaacacattcaatggttcaaaatcttataatctaacgcctcagaatcccccacgtctcctcctcccctccccgcacccatctcctcacgccgctctcgctttcgctcctctctctcccgcgtctcccactgcccagcgccgtatctcctcctcgcgctctctcgccctctcgccgtcgtgcgccggatttttgaaagaatcgacgcgctcctcctccacagttcgcgccacgcgcccctccgtaccacgaaaaatcgccgcgccacgcctcccccacatcgccgcgccggcacccaccatcgtcaccgccgcccattgctctccaccacgcccccattgcgccgacgccctccctctctttcaggtcgccgcccccgctgattccctcgcgattcccaaccctaaccaccgctaccgccgcccctgccgctcaggatccccccgcctctcctcctccccgccgccgacgctgtccccccgcctttcctccttctgcccacctgccaccgacgccgccacccctggcagtgactcctccccgacgccaatgccgattcccccgccgtcgatgcctactcctatggcagtgcggaggactgctgcttccctgcccccatcaggtgtgtgcacgatttgtgtttgttaaaatgcttatgtgaaaaagctgggggtataaatgatatgctgcagattatcttttcctgttataggttgatcaataatggtttccctaattcaactttcatattgctgaatcttttggtctacattgatagctgatgcattgtttgtcagaaacctgttgaatgggaggcaccatcataattatatgatccagcattatgaagtaaccatcaactgatctgagcgtgggggtaatttctaaccctcacctctgatgtttgatgaatttcattttcttttttgaccagatttcctatacaaatataatttcaaatgcttgagtatatagcatattgttgattggaaatataattcctgacaattgttggtcatttaaaaaatataacaaatatgctcaaactatagcctataaaaggcacaacagaagaattgatgtagctggaagaaaaataaaatcaccctctgctgctttgtcacgagataaccagtaattaaccatgcagccaaaaaacattgcatcgataacttgtcatgtgagcatatttactgtataatttgcacaaaaaattcatgcttcatctattggaaaaagaaaacccattagcattgatatagttcattgtttgcatatttgtcaaagcacaatatttatgtacactatcacttggagttgatcaactgtacatttgtttggatttgattagttttaagacattttaagcgaaatttatattttcctatagcaactgattgcaatttttcctgtcacattttacaagttttgactacagcatcatcggtgattatccattcccgtatcactgtgaacagctgctactgtccttcacaatctcattctctgaaggtacaaccagtttcttcactattcccttcttaactttgctagctatgggatccgatgttcttagatttttttcataatggcgttcctatttggattgtcaagttttcagaattttttagaatgggattcctatatttaccatgtatttttgaataagtgacgatgtttcttaggttttataagtgtgagtttatcactggtgatgatgttagtcatatgagcactgcactgttaatctgttatatgtactgtaaattggaaaatataaatttgtatcactgttacatgttaatatttatataaaattcgacatttgatacgcttgatgaaaagcatgcgcagaagcctttgagtgcacaacccgaacgatacccaattgataaaaagcatgtgcaacctgcaattgttcctgataaactctctattgttcatgaaagttatataaatcggatcaagcatataagcttgctcttgtctgatggtcatttaaacaaaaaatctcttgacatgattttataattgaatagtatcgtataagtttgaatgtacacgctgactgaaatttcaaaaagtatgagaacattttttgtttcttctgacagatgtaagtttgtttggagaacgggacattacgcgctgcctcctccatcgatgctgtgctgttccactgcctcaagcgtcaccgccacagtatgccccatcttggtctgctctgccaaaaggtacacaaatcctccgcccccacccctctcccattctctttattcccaatccctgctatgtctcctctatccctattagtacccgctgattgttgacatggagaccctctcccatataagcaaggagaccatctctccccaatcctattcaactttattgttgacatgttagctaccttgataaatagagccaaaacacaagggcaagtagatggtctcattccgcatttgattgatgggggactgtctatattacaatatgccgatgacacagttctttttatgaatcatgaccttgagaaagctcagaatatgaagtcggtgcttctagcctttgagcaattgtcgggtctgaagatcaattttcatagaagtgaactatattgttttggcgaaacgcttgagtatagagatcagtatgcccaactcttcggttgctaggttggcaattttccttttcgatatcttggcattccgatccattgtaggaagttaagaaatgcggaatggaaagaagtggtcgaaagatttgaaaagaaattaagtagctggaaaggaaaacttctttcgttgggagggcgacttacactgattaactcagtacttagtagtctcccaatgtatatgatgtcgttccttgcaatacctagtggggtacttaaaaaacttgattaccttcgatctaggttctattggcaaggggatggccataagaaaaaataccggcttgctaagtgggacatcatctgtcgtcccaaagatcaaagggggctgggaattcatgacctcgaggtaaagaatatagcgttacttagcaagttgcttaccacagacggaatgtggcaacagttgatacgtaataaatatttgggatcacaacctttatctcaggcttattggaaagcaggagactcacatttttgggctagtcttatgaaggccaaacaagatttttttcggtttgggtcttttcgtattagggacggctctcaaataaggttttgggaagataagtggttgggtaatgcctcgttgagagatcaatatccttgtctctataacatagttaggcataaacaatcgacaatatcacaaatctttcaaacgaaccctccaagcttttcatggagacgagatttaattggagcaaaattagctgcttggaataatctattgccttgcatagctgatttggtgttgacgcaagagcaagatgaatttcgctggaatctcacccccaatggggtcttctcggtcaattcacattacatagctcttgttcatacgggcgtcccgaatattaatagacgtatttgaaagattaaagtaccgctaaaagtaaaagttttcctttggtacttacgtcggggagtaattctaacaaaggataacctagctaggcgaaattggaaaggtagtaaaaaatgctgcttttgtcataaggatgaaaccattcaacatttgttcttccaatttcatctatctcgtttggtatggtccgttattcatatggcctctaactttcaacctcctcgaaatgttactcatatgtttgggcgttggcttttatgtgttcctaaagaaatgagaaatctgcttttgatgggtgcagcagctctttgttggtccattcagaaacggggttatttttgataacaagttagtgtcttctcctttacaggttattactctagttacccagtggctgcgtacctgggctatcctccacaaaccgggattgcgggatactattgcg

SEQ ID NO: 80087 - DNA, 15154 bp, Oryza sativa
cttccagacaatgtccgggcaacaataacaaaactatgtgcattcatgaacgcaatttcgcagaaggtcatcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgagtaacgagtcgatcaaccaacaacttgccttcctggcgaggggaccgtctgggtcgatcgcgacattccagggatatgagatcaatgggtacacattctacacgagagcccaagacatgaagagcacgaaccaaaacatcgctgttcgtgtcgatgccatgggacacgatggaacaactgccacgtattacggtgccatcgaggacatatgggaacttgactatgatcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgatgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgttagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaattttatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatattactattcgaatttttaaaaggtttaaatcatgcatgtggcatttacatatgttaattagagtttttagcatttaatttaatataattcctacgctaagtacatatgatgattacaatttttattaattttaaatcatgcagtatgtacattaatatcttaattagagtttttaccaatataataatatcattcatatatatgctaagaatatatatatattggaatttttattaattataagtcatatatttgcttattacgatttatccacttaatttattacagacaaaaataatttttcgaagtaattgtcatcaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttgttgagaacaaccgggactaaagatcttttctttactcccggttgggtgcgccctcgtcttcttcaccaacacttaaacgttttcggccgatcgatctctctcggcctctctccttcgccgccactgcctagggcaaatccccgcgccgacgccgccgtatctcgccgtcgtctcgagctcgtcgtcctcgccgccgcctccgcctcctccgctgccgccgcatctctggggtgagagccgccgcatctcccttcatgcatctcgatctctccgatctcgatctctctccgtcgccttcgacgccgccgccttcgacgccgcgcaacgccgccgccgcatgccaacgccacgccgccgccgccgtcgccacgccgccgccgccttcgccgccgcgtgcgcaatgccgccgccgccacgccacgccgccgccgccacgccacgccacgccaccgccgccacgccacgccgccgccgccacggccccacaacgccacgccgccgccgccgtcgccacgctgccgcgccaaccgccgccccgatgccgccacaccgccgttaacgaacgagaacgagaacgatcgaacgaacgagagcgagaacgaacacgtgaacgtacgttgccgcgacaacgtgaacgagaacgagaacgatcgaacgaacgtgaacgagctagggaacgtgaacgagcgaacgaacgaggacgaacgttaacgtgaaatgcaatatatatatatatatatatacatgtatatatatatacatgtatatatatatatacatgtatatatatatatacatgtatatatatatatacatgtatatatatatatatatatatatgttacttcgcatttatcctaatacattttttttatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattaaacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttatataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggaaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcacggtggaacgctcaacccagctgatggctcactggtcttcggctatcagatacaagaggctgcgcgacgattaacagatgcagtggaagcctcctctcagggcacgttccgaccagacagagatagggacgagctgacactcgccctgcagactccagagcatccaggacgaactcgagggaaaggggtgattccttggaagattgctttcaaggaggacatccacacgtacaggagtcggatgaggagcaagagagataccgaggcgaagattgcagacctagagttcccggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttgaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactccaaggtcgaagttgagttggtcgaaggcgcgtacgaggacctcgagctggattaccctggaggagacggtgagacgcatctacgagacacatgccatgccattattctatggcgcaggcggtacatcatcctccctgggcgacaagcggcgtctcgtgcaccatctcctccggctccgccatctcctcctcaggatcctgcaccgtctcctcctcatgctccgccagcaccatctccacctcaggctccagcatcgactcctcaggatcctgcaccgactcctcctcgtgctcctacacctactcccccgcaagctcctcttccggcaccttcaaagtcaagggcccccccagctccaccgcttgcccacataagggcaacaaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcagggggtatgtctacatctgtcaaggaggccatcaagctatcggactatgagcgaacgctgaagaaagcatcttctggaaagtccaaaccagtccctcagcttggagagcaaccaaaccaggagatcgagccgttggtgaccagtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagttgtacatggagatgagcgccaccggtagagagatgatcggagcgaggattagggacacggacttcttgcaaggagatgacattctctggatcaatttcaggggaatctacgaactataccagctggacgccctcgacatctctattatgagttgctggattttgtaagtatatcgttcagttagatttcttactatacgtctcctttaattaattaggtccttgtatataagtagaccatagaaaataatatactcccttttatcgttgtaaaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaatttgtgcggctattacgtgtgcgagtattgccactgccttgcagaccaaatcatcaccacaagagagctcgatgtacgtacaaataaatttaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttgttcatatatatatctatatacatatgcatttgcataacatatatatgtataaatacatatatatatgtatgcatatatatgtattgaaacatatatatgcatatatatgtattgaaacatatgtatgcatatatatatgcatatatatattttttgcagcaacaggggcatgcaaaaaaaaaaaggtcagctctatctttagtcccggttggtaacaccaaccgggactaaagatggctcagccggccacgtggtgttaccaaccgggactaaagatcgatctttactcccggttatttcacccgggactaaagatagcgatctttagtcccggattggtactcccggtttggaaaccgggactaaaggggggttacgaaccgggactacaaagggtttctccaccagtgtttataggaatgaagtatatgaaaaacaaaggaaattttcatctactcaaatcacttgaagaaattcttatggattaacttgtgcatgtatttttattcctttatttttcttattcaaacaggttgatcttttttatgtttctatggattgaaattcctcccaatcgaacaagcccgaaatggatatcccaacccttaatcatcatactgatcgatctgatgcatgctcagaagttaagggtctcatcgattatcgaaaaacttattataagccgtaatgacttattagtgatcgaataataatttatgtaaaatttttatatatgtgttcctagcaagtaacgttaaaagctcatgtaaaaagaaactacgttaaaaatatcttaaaatcaactttagaattaaaattaagttttaaaattcaaatttcagctttagctttggctttttaggtaaccgatgagactctaaataccacacaagtatttatgtactctctctgtcttataaaatacaatatatatagtaggatgaatatccagatttacagtattaggatctattatgtcattggctatgatttatcatatttcgtattagatttgttttttataagatgaagaaaatatgttgctagcttgtcaaatactgcagcaggagcaccaaaacatatccggttccacacgtttgacctgccgggttattaaggcatgcatcgaagcgagtgcactagttagcgtgagcatccctctgcccagcaatcacagatccctatatttaagatttaaccgaatattaccactactagaagtacttgttttgaaaagctactacagtaaaaataatagtgagaatttgacatcatctataataataaatctgaataatctcatttctagtttcattatgttcgattatgttaaatcaccacgtagcttgtttgttttttatcagatgaagaaagtaactcagagtagcagtaatcatgcatggaacttttcgttccgtttcacgatcgccagtactcgaccaacacaggtattatataggtgcttgaatcttttgtagataaagattaaatgttttacacaaaaggaggtggtgataacgtgtaattaattaagttttaattattacaaacttgaaaaatagattaatatgatattttagagcaactttcatatagaaaattttggcacgaaacgtactgtttaaccgtttgaaaaacgtgtcacaattatccgaaattttattcaactctagttggataaaggagcgcagatgttacgtgtatgggtcggaagaaaacgatcgggaaatgatataatttctacataatactctccgtctatcgggaataattttacatatttattaatttaattatttagtggtgactttaatatgatgttgataaaaattagaaaaaatataagatttatatttggctagaattttgcgaaaatgattctcactaattaatatcgatcggtcgagaatttttgctaccattttcatccatgttactggctgtcccaatgcagggtagagccagaagtttttgaaaccctaggatcaaccaatataatttattacatctttaattattttcataattttcttaattaatttataagggattaaggagatatgcctagggctcaaatcctaattaatagccttaggctgcccttgtctcaatgtattatacatatttaatactctattatcaactatcaagcaaaaaagtatcggtcagaccgacggcaaccaggcggtcagaccgacaggacaacttcggttagaccgcgatccgtcgaattagagggaaacttttattttcgctaaaaattttcggtttttgggtataccaaccattcactcctctctggttggcttagttattgtgattcgatcctacaagaacctcaaatcttctcatgcactagccatggcttttttttcaacaaaataaacatcttgtgcacaatggcaaattgcatgtactccctccgtttcaggttataagacgttttaactttagttaaagtcaaactattttaagtttgactaattttgtagaaaaaagtagtaatatttttaacccaagactaatatattataaaattttattcaattatagatgtaatgaaactatgcttgtgttgtaaatattactacttttttatatagagttagtcaaacttagagtagtttgactttaattaaagtcaaaatgtcttataacctgaaatggagggagtatatatgatcgctacgtataaacaagcaacacgtaatctattgaatcttgaaattaatgtaggtctatttcaatcaacctttttttttcatgaatataggttatttagaacgtacagtcacattttatttcctttcttgtttgttatagccaagtaaattaaacaatatccaacataaaaatgactaccctttccaatacagaatataataaaaagaaacaaaagtcactgagctctttttttaattgttgcgcacatgtttaaaatgaagttatatatatatatatatatatatatatatatatatatatatatatatatatatatatatatatatatatatgaaggagtatatgtatacaaatatatatacttaataattacagaaaaataattttgagctgcttggaaagcatttttgcggttgtgcggctcatgactcatgagcggcggtccaaaaccgaaagccaagcttgcataacgaaagttatcgaagtctttttcaattaactctaaaaactaagttgcttcgaccactgacaaataagtgacattttagatacatgtagttaacatgtttaaactttgactacttatattataatatgagagactttgtccatatatacaactatatatgcatgagtgaaatcttatattttaggatagatacagtaatagaccttcgaataatttcaactcaacttctaaaattaatatggttatactcatatttgtttcaaaaaaagtacttgaaactaaaaaaattataattcttagatatgtttactggttttgtattagtaattaacaaccaaacaaggtgtgagcagtaattcataatgaattatccagcagcagtagtagtgtatataaataaaatagcataaatccctggaagtcaggtcccggccgggatagaagccgcagctagctgctgatgagcgcgcggcgcgcgcacgtgcacccgcgcaggccacctcccggactttgaggcctcctgccgcttcctcccatcgccatccaccgcgacaaatcgatctctctctctctcccgatcgacgtaatgtaatattcctacaaattaattcctcttcctcatatttgtctgaggaaattaatcttcctaccaattaattccttcttcctactaccttcgtcagaacaaaattaatctagtatggaatgtgatatttctaatacaacgattttagacaaacacatatgttcaaacttataatagtaggaaataccacattccatattagattaacttatttcgggacggaagaagtatttcttctatttttttaataaaaggaaaattagtcttccataaattaattaattccttcaacgtaccgcgtacacatcccgtgtaatgtccactgcacgtacacgctcaatacccatcttttccggtggccggccggccggccgcgggcgacggcggcggcggcggcatatgatcaatcgttatcgatgtcgaccaacggcgccggccgccgactgcatgccagcttgggaccagcgggccggccggtatggagcgacggtgtggcacgtcggcgccggcgatcgaagacatgtcgccgcacagccggagcacggccggaaaatacatagctggctacatgtgtatagagctagtggcatgcagcagaatatatacgtgagtttactcaatgaaccagactgatgatcatgcgtgcaagttggagagactaattggagatggtgccgagatcgacaagtattttacgtagagttaatttttcgcatttctacggagggagagagatcagtaacttagggtgtctagttcacgttaaaattgaaagtttggttgaaattgaaacgatgtagtgaaaaagttagaattttgtatgggtagaaaagttttgatgtgatagaaaagttgcaagtttaaagaaaaagtttggaagtaaactcggccttaattatattattgcgatcgatcgacttggtaactaatgcataagtcaacggctagcttaactcacaagcaagcttacgattcaatgctagctcgatcatccaaaagtgatagctgatcgatcgaacccatatgtttttaatttttttctgtaccgattgaaaatatacgtccaaatctaatttgattaaagttcattcaaacttttcaatctaatcaggaaattctattctaaacacagtcgaatagaaattttaggatgatttttattgattgttgaatgaatttacctagagttttcgttatttgttatctaataaaccatactaatattagcctcactacggtgctctctactagtagaaaacaatataaaccattgatcatttgatcgaagagtttaaatctatttatactaccatctagttagcggtagtagagacatggagggatattattgtaaaaaaaaaggtgtggggagatataattgtcatttagcagtgactaaacttttttttttcctttttttggctttttcgatgaaatacgagtgatgctagcgcaatggatgatatatcgatttagctaggaaaaaacataaatgacaaagtaattcttaatcattgtattagtaaattactaatttacccctaataatacgtactagtgatataatactataaatagagagcaccggagtataatatatagtactcctatgctaccccaactactggtatagtacgtacaatttataaatcaacaatcaattaagatcattttattctactatactagctactccatccgtctcaaatataagtattttagctataaatgctagacaactatgtgtctagattcataaataaaagttgttatattttgggacggaggtagtagtagttaggctaccataaaagctcttccaaagataaacttatagccaaaatatatagggaaagagtaccaagggtggtctctatgggtattatagctagtagaagtgacttcaacattcttactatatgtaaataaaaaagaaattctattaccaataattgagatgaaagtataattagatatgatccattagattagaaaagataaatggtatagatttatttctactaccactagagatcattgtaaaacacctcatatgagaaaatagttaatatctggcaacacaaaccaattaagcagtacacacttagttagaaaccgaatatgatgtgtggcatttgttggaattaagctagcttaatggctaggttaattttgaggtatcttcaaccaactcacgagggttcaaatgctaaatttttttccatgcattttgatgcctatgacaatattcaggcatgtgtagagaatcgatgtgtatgagtgtgtgtagtagctataatacggtgcatttatttacatatttatatgtatccaattgtacttaaaaaatcgatgtggcatttatcattcaacggatgacaaattaaaatgggtttttaattgtcacatgaccccccatttaattcacaagaagtcaaatatcaggtttgaatataatttcagatcgtatcacacgcgcgctaaccgcaatgtttgaaccatcacaagatctctacttgggataagtaaattattatgagtgataaccaatgcaaaagttgaatcctcacttgaaacaataacaaattactagtagcctttaggaatagataatgaacaacatgtagggaatagaagagagaatagaaatggaatatggaataatggaatgcagggcttaattccctgactcccacaaggctggtcaaaggatgatctaaagttgttttagtttatttatgaactatatataaaactttacacatgcatgcgcatggaccatcatatcatatagaacctaacgtcttctcctttcaaggaataaatccaaacctatttggctagctctctgtcagttgtcacgcacaataaaacaaattaagcttcaagaaaatatatactacattgcacgtagcaattaatgatctctagagagggcatatatgcaaaaaaagatcatcactatttgcagatggagacatgtcattgctccttatgaggccatttttgtggccggtgcgtcccctggtccaaagacaacgctcctcctttcctttagtccttccaaaaccggccatgaccaatgcaaacacactgtcactgactgaccatgcacaaatcaaatcattattcacaacagctaatctccatcactctccctacatgccatagtactactttatataaccccatgtcatgtcctttgggtgagcatctcaaatcagatcatctcaagttcccaaaccctagctatctctgctggtctcccccaagctctcctttatataacacaaactacatcatctcctttctcttgtgtgcaacatcacaaacacaacctttcactcccatcttggctttctttcctgtctctagcttagctacctgttgcttccaagctgagaaaaaccaagcaaaagaagctgtttgtgtgcctttccaaggtatagatttgcatgcatatacactttatcctgtccagttagaaacttatataaggacttgtaagtttctttactgaattaaggttaagtaaacttgctaaatgcatgagttttctgatgcattgtgaatttgtgggtatttctcagagtgaaaaaaaaaatgcatcctaatggcgcgccgctggccgtgccaccgggtttccggttccatccgacggacgaggaattgctctactactacctgaggaagaaggttgcttatgaggccatagatctcgacgtcatcagggagattgacctcaa

SEQ ID NO: 80088 - DNA, 23753 bp, Oryza sativa
ttgttgacatgaatgtgaggctttgcactcgtgtggttgtggatggagacaaacgggattgagggaacaagagcaactaaccaataagctcggataccatattagactagagatatggtgcacactgatgcatagtatttgatgaaaatagtttgtggaatgtatcagcccaggctatcaaccggcctaccagctctgagagtttgatgaacacataaaaaaatgaagaaatatagggaagtgctttgagcatatatttttaccattgtaacatacccaccaaaaattttatgggctcacgatgccataaaaaaaaccttgtaatatcttaaattctgaaaagaaaactatttaagtaaaaggttctaagtgtctagaagtgaaataaaagaatttcatgacatcacactaagtgatggatgatgagtcaaatcatggaaaggtctctatccaccaaaaaataaatgtttacccccagcactgcatagtaatttagaagagaaaaataagcaaattaacaaaagcagcaaaacaaaggggctacccaagacagaaaacttccacaagagacaggaggctctcaacagcaagacttcaggaagacaataaatggttaaatgatgtatcagcctttgtacattcgaccagtcactgccttcagtggtgtcattgaggacatgacagcaataacagacgaaaataagggtgatgataagggacaagcagtagcagaggtggctcaaaaaatggcagaccaccaccactgaattaaaatgagcaccccagaaactacgatggggcagggtaaggtgaatgggatgaatgcttggtcacaggtagtgctggcccatctaatcccagcacaagaacgatcatgggccctctatgcagttaaggtcagtttttctgattcccccttgcaaaactgacagtcagacagcctgtggtcactagcgatattaatttttagaagtctttgacataaaaatgatatcactctataagttgatatgaataacatatgagctttcatgaacccccccatatcttgtattaatacaacaaaacaatcaaatgagttgataggtaaaatgtaactgagaattagtaaccttaccacaaaatgtaactgaagttgttaccatcatgtcagtataaggtagcttgaccttgacttgaagggtgatatcggacaagagtatcattatatctccttgcatcttaaattttgcccagagaaacttctcgactgcaaggttacgatatcaataagaacaagtagttaatgttgtaaggttcaaccctttcattgtatataaaagtattaaaccactttaagagtagctatcacataagggacatactcatatatccaagtattttgtaggcatgtgtccacctcataaggcagctccatgttcacaactatttcaacttaaaaacgaatgcaaattttaattttgtgcattatatttgactatgtactgtggttggcgtatcttataatcactctgttcacatgtgtacatcagcgcaatcaaacttcactcaagatttaattgtgaagattccattaaatgactatacagaaatcggaggtctgttatgtattggagagcatgcactgtcatgcatttaacaattatacaaaacaacaaaaaaagttataccataaaaagttaaatgaatggaactttttaacaaatgtcatgttctgcatgtatctaattggatgcatgctcaaaaaggaacacagtttcattgaagccataactgatggaaacaattaaaaaaaggataaagacaattttgtatcattactgagtttatggaacataagacagaaatgtcaacaggaagagaccaaacacaacatccggttccatagtgtagtggttagcactccagactttgaatctggcaacctgggttcaaatcccggtggaaccttcttttttttttttggtattcccatactactcaaatgggatagtcaattacttgcaggaccaatatatgaaacatgagttgtttttattaatagaatagtttagtcatgagagtgcataaataacaaatgcactgttttgaattaaacgtgcatgtttctagtatatgtgcatggctagttgatctctgcaataaataattgtttgcttgcaatacatgcatattagcataaagtcgagaaaatagcatttacagatcatggtaaatagggtatagcctcatgaataacagcaacaaagaatactgacacctggcattcccacaaataggttaactatttctagagagcctcagcttattttattttggtaactcgtaggagttgtccctagaacattatagtatagggtgtaaccataatgtgactacattccagtcaaacttgatgtgtgactccattcagatactaattcattcatttgtcttcatgattttttttcttactgcttagaaataagagtgatcttaaaaatcattacacactacagtgcctttcagcttcaaaagggcagaacccaaatagacttatgcatagagctcagcagcatggtcaatcctaaactggaaatatcacgtctatgccaagccaaagaagtcagcaaaactaacttcatgttatgtttcataccaggagaaaaccataacctaggtcagttcgttcgctttacttcctgatttcggaaattcattgtaagactatcacacaggatccacaaaacaagaaaaattaaccattacaagaatacatgagcatatgagaaaaagagaataaatgcaaccaaatgactgccgcgtgcctgtgtcatgtaagttaatcctttcatcaagagagaataaaacaaccgttgcaaggacctactagtaatttatcgcttcacacttcaataaaataaatatatttggcagtatgcagaattaatttatttaatcacctctattgacttgaaaagtaaaatctgcggtgctaaagagtaaacagaaagcagcaggatgtccaaaaatacacacgtcatcgattatcacaacactagaaacaagatcccgcccgagaatgcaagagtccccatacgctctaggcacgcataagagggatacggatacctccctcagcgaggagcggagcggcgacagagatctctacacacctggatgcgcctcgatcagaagccctaacaggtggacgtgccggaggcatggggaggctgctgcggcgccaattgtggccacggccatgggtgagagaaggagaggagagggtttagggcttggatgcggcggcgatggcgagacggagaagtggggaattctcgacgagacgaggaggggaagagatgagatcggacagggtaaatgggcttcatgggccgcctgagtaagtaagtagttgggccgtcgagctctctctctgctcggcgcgtcggcatcggttcgtcggcaaatggcggcgccagcctacgtgtcctctcgccggcgaatcccacatcctcgctgaccaacgtgtcatcccctcgtgcacacgtgtcaaacccgaaccgcttaagctccaatattttaagcctcccgccgcaacgctgtcccgatcatgtacagcgacccgatcactctctcactgtctcgttcacgtagctcacctgctcgacacaatggcgtcgcagcagcagcagaagcagccgaggaaggcgaagcagaaggaaggggaagggcactcggcggaggaggcggcggggctggaggagatcggcaggtatcgcgcccaggcgcagcagaactcgatggacgccatccgcgacgccgaggagcggtacgccaaggctaaccgggagcacggcggcgcgacgcgggcgcccggcgccaccgtggtgtcgtgcgtggagcgcaagaaggagcagccgccgccgccgccgcagcacgggaagaagcacgaggcggcggaggagggacacggaggcggcaaggcggagaccggcggccaggagggggtgaccgccaagaaccgcggcgaggggcggcagcagcatggcgagccggacgccgccggcgctgctgcccgggagaagagtgctggcgccacgcacggcgccaagcaggccggctcgaccgcggccacgcgcgccgcggactacgccgcggccaagggcaccgaggccaaagacgccggcgcgcacgccgcgcaggccgcgacggagaaggcgaaggtggccgcggggacggccaccgactacgccagacaggccgccgcgaaggcgaaggatgtcacgctcagcaccggcgggacggcggcggagaagaccaaggacgtcgcgctgagcaccggcgggacggccagcgagtacgcgaagcaggcggcggtgaaggggaaggacgtcacgctcagcgccggcgagacggcggcggagcacgccaaggcggccgcggagaaggccagggacgccgcggtggccgccggcaggacgacggccgagtacacccagcaggcggccgtgaaggccaaggacgtgacgctctccaccggcgcgacggtggcgcagaaggccaaggaggtgaccgccgacaccgcgcacaaggtggcggagtacgcgcgggagaaggcggagcaagggaaggaggccgcggcccgcgccgccgacggcgcggaggagccgagctccgggacggcggacaaggccggcgacatggccggacaaaccaaagacacgacgagcgacacaacgggaggcatggcgcacaaggccggtgccatggcggcgcagaccaaggacacagtgaaggacgcagccgcagccatggcgcagaagacgagcgacacgatcgctcaggcagggcacggagcaggtgaagcaaagaaccgagcggcagagtccggcaagaactcatcggcgaccaccaccatcggcagcggcggcggcggcgacggcgacgacacgacggtggtgggcgacgtgctggaggcggtgggcgcgacggtgtacgggatagcgaagcacacgaaggggatcgtcgccggcgaggaggagctcgtccccgtcaccaaggaagaagacaagggcaagctcgagtgagcgagcgagcttgcttcactgtagtggcaagctccccgactgtgtcacgtactgcgtactttagttgattaggagtttaagtatatagtgtttgcgaataatgtttcctgtatttagtgttaatcacggatccacggctgtgtatatatatgttacaatccgcagatgtgtgaaataaacttgataattagtctatcagtctgattggttacatattactcatccaatgaacacgcccccgcgtcgtctcccgtgggcgactcgggcgtcgaaacctagccgccgccgccgcccctctccaccctcctctctgcctcgccgccgcctgagcaagtggccggcaaagccggcggctcgcgaggacggcggcggcggggctcgcggcggcggccacccccggttccggcgcgggcggacctaaaggtggagctggccggatcagcgtcggcgtcgagttgggcgcatgggagaaggtggaggcagggaaggacgaagccggcgacctctctttggcgggcactcggggaggggagcgccaatgacggggcggcggtggccgccagatccgggctgctccggccggatctggcggggtggcggcggggagagcggggagggcggggagggcggcagcaacagtggcggggagggcgacggcaaaggcaggcgcgtgcgcgccggccgatggtgcttgcaggcgtcgatcgatggtgcttgcaggcggcggggatggcgttggcagagggcgcgaaggcggctgcggtggtccctacgcggcgacggagcggtgctcagcggcgacggcggcggtctccctcagatctgcgcctcttggccggatttggagggtggccggcggtggtagtcggcgacggcggttgacttgcgacggctggtaacagcagttggcaacggcagcgacggtggtggtcgcggcagttggcggcgacggtgtcggctaacgacgccgatggaggacttggcggcgacgtggcggacggtgacagcgaagcggccgctggcagtggcggctgttcgcggaggcggtggctggcgttggtggcagcggcgacagcggctgacttgcggcggctgtgactgtggaggcgctggcgatgtcggcggatgtgggtcgctggtggcagcaagtggaggtgcgcggtgaggatagcgacggcgaggtggctaggcgttcaacaacagcggctgtggtggtggtggccgtgatcgcggtcaccggaggcatggcggcctcagacagccgagggagtgggagacggctacatttggtcggcgcggcatcgtctggtggagggtcggagaccggcttggcgcagagaggcgtagccgatggcggcggaggccggctcggcgcgagaggcgcgggcggcggagatggaggccggcttggcgcaagaggcgcggccgatggagggaggccggattggcgcgagagacgcgtccggtggaggaggccggcttggcgcgagaggcgcggccggcggtggaggaggcgacctaggtgtgaggaggagctgccggtgggtgtggcgcgatcttcggcgctcgaaggctagccggcgggggacaccggtgcaggggtcccacaggtcggtagagcttgtgtggtggtggggcatcggtgcggcagtcgtggatttgcaggatctcgtctgggtccctttgttggtctagtggcggtcggtcacgcttagcggcggccggtccggtcctagccttctcctgggcttgtgtgttggcgacgtcggtgtgggtggtggtttatttttcctttttcctggttacgaccctccagattgtaatcttgtaatttttttctactctatcaatagaacttcgcaccgtctcgtgcgagtcgttaaaaaaaaatgatggtactgggaacagatcacaggttgcaacgacaaatttatcttatacatagcaaaataatcccaagagattgacatgtgcgcatagtaaagatgatgtcgttttaaacaaccataatttggatggatgtacattcataaccaagtggcagtggcagtggcagaatttgttggtaggaatacctgaagaagagattagtttcccgtttttttgacaaattgacccttttcaaaaacttaattcgaaactaaccactgccaaaaacttcaaccaaaactaggccgtcggctcagcgccaagcgcattggcgctgaggttggccgtgtcagcgccaacgggactggcgctgacattgtgccaccgtggcggccgggccgatcccctagctgacgtggcagctacctcagcgccaaccgcttcggcgctgaggtgcccaacctcagcgccaagtaagttggcgctgaccttggctacttagagcccggccgaggccgccccagccagttcttcctccgttttttccccagccgcccgcctagggttcggtcgccaccgcgttctcctcgcccaatctcccccaaaaacctctctaatcgaaggtgatttgtgcggcattgagtttgggatcggaagagaaggtaaacccctctataaaccctaagttccccaaagttttattggatattttgcattgttttggttgtagacgtggtttgataatagttggctaaggatggattattagatggataatatgggtggggatgaagtgtggaggtggcatatctttatccatttggttgttattgatacatttgacaaaatatatttgggatggatgtttggtgatgcactagggtttgatgggagatggatgtgtggtgatggcctaggatgtgggatggatttgtggtgattgagagggtttgaaaggggttgatgtgtagtgaagggtaggtaatttgtaggagtagagttttttttatcaataatgtgtagtatttgagtaatgtacttatttattggaaaaattagacatgttgttagcttttgaagtattggtattgcaatggtaattacatattattttcaagtaattaatgtttatgcatgggttaaaaattgtagatggatagattggtccggcttcattatggtggttgtgtggtagatgaaagtacacatggaagccaatttgagggaatgacagttagacaattagtgttttttgcgaagcctacctttgaggagttaatgtctcgcatcaagcatgaattggattggaatgatgagtcggttggtgtgcaagggagatacgatgtgggcggcggtgtcatgtcacataaatttatgttagacttgaatggagagatcgaatggcaaacatatatagatatagtattggggtcacatttcaaatctcttgaggtgtttgcatggaagaaagatggtaggatagggaagaaagaacttatagaccttaatgaaagtcaactcatagaatcacccattagctgtcacgaactgtcggagaggtgtagtaggaaggaagaattgattgaggaaaacgtggaggggggcgagggagtaaatgatatggcggatgtggaggtcagggaagagaatgacccggtaagggaggaagtacatgcagaggagaatgtgccgttaagggaagaagtacatgcagaggacaatgtgccgttaagggaggaagttaatgtggaggagaatgtgccggtaagagaggaaggagatgttgaggatggtcgggaggtaggagatgatgtggagttgcctgaggaagaagcgaatgctaagaatgtaagtatgggcctaagggagttggctaggctgaaattctatacccgagaggagtgtgaggaggctatgatacgcagtggattgaacccaggctggttggagtatgatacagaggatgaattggatgagtccgcttccgactccgatgatgatcgtagcacacaggtgggattggatgacattcattgctaagttcatattgttgcttcaatgtttactttctgttgtccctcctttccgttctcattgtgattgttccatttaatattttttcaattactaatgattccattttcatttgcaggatggagcactttccggggttggaggatttctacgaggagaagcaccgggccccacagattgccagcggagaggttagcatcaacaatattccatttttttatgatcgaatttattttttcttctttgattttagtttgtacagatagatcatccatcatagagataactcaaatcaaagttcaggagcctcaaagcagagcatgtaaacacacagatcttcttttcagttttcttgctcaatcccaaaattaaagttcctagttgcatgatgtattttccacaacccttgtatatgatatattgtcgctaactttatgttattatgtttgtctattgatgcagcgcttgaagacccttcgagtcagaggtcacacggcgcacatactgttcgacgaccggtacgtcccgtacctacggcgggcgcagctcttggcgttcgtgaccatggcgcagcgaccggtgcctctgtacaacgccgctgctctgacggccctagtggaccggtggcgtccagagacacacaccttccacctaccgtgcggggagctgacggtcactctggaggacgtcgccatgatcctgggtcttcctatccggggtcaggcggtcacaggtgacacagcgtcagggaattactaacgagtcttcgtattcatttgttaatttttttgcaattactaatgattccatttaatttccggttacaggtgacacagcgtcggggaactggagggagagggtcgaggagtaccttggtctggagcctccagtggcacctgatggtcagaggcagacgaagacatcaggggttcctttgagttggttgcgagccaacttcggtcagtgtcccgctgaggcagacgaggctacagtacagcgatactgcagggcgtacgtgctgtacatcttcggcagtattctgttccctgactctggtggagacatggcttcttggatgtggctgctgttgcttgcggactgggacgaggcgggtaccttcagctgggggtcggctgccctagcctggttgtaccggcaactctgtgatgcttgccgaaggcaaggcggggacgcgaacctagcaggctgtgtttggttgctacaggtaagttcacgcatgttatgtttcataacatttcaatttcttgctaacatgttggaagctaacgtatgtgacgcaggtttggatgtggatgaggcttccagttggtcggcccatgtggaggacccatcaggcttggccacaccaggatgcagaccgacgtcccactgtagctcacctgtgggaatcggtcccatctccagtagtaggccgcaggaatttggcgtactaccactacacaaacgagatggactacctacagccagaacatgtaagctattcggggttctatcacacatgaagatggtttcttactatatagtactaaatgtgcttcaatgtgttttatttttgttgctgcaggtggtgtggatgccatatcaggcacaggaagtgctcaagctagaactgaatcccatgtgccatatagaggatgcgttgaagaccctacggtgcccactgatctgcttctatgcagtggagttccagatgtgccaccgcgtgatgcggcaattcgggaggcttcaaacaatcccgcaccgtttctccacgagtatcgacctacacaagttagtaatttcacttaacaatttattttgcttgcccaatcagtcacttcaacatttactacatatttgagttggacattttgcatacgtgcagggtggaccgtcggaagaacaagaaggtgactgattgggcttactaccatcaggatcatatcacgcaatgggagaagttcgaggagaatggagtaccagaccagggtcagcacaacgggacggagttcgacttgtacttggcgtggctccacaggacctaccgtcttgtcctacgtccggcttggacactagccgacatagcggatgaccccgaggatgttgaggagcagaacaagtacgatactcgtacccgtctaggtaccacggtcgagacgggacctgttcgcgacagagtggttagtttctagcattaatgttgtatattatttcatttcaatgccatatatgttgtgacttacttcatttcaatcctacaggctcgagagctcttgcggaccgtcaacgacgcgggagtggcgctaggcacggctcctggctctgaaggagagggcggcaccctccgcaacgccctacaggtaatcgttggaaagagatgaaactacggtgttttcttccaaaagcgataacttaacatggattattttttatgcagagactacggcagcgatgtcggaagttggcagcaaggctcggctgcaggtcgactgatgtggtcgaacatgctcatgcccaccaagagggggatgaagaaggggaggtgggtgacgaggagggcgagcaagacaaagaggcggaggaaggagatgaggaggaagaaggggatgaggacagagaagaggaggcggatgagctcggtccctcgcagctagaggacgcaccagagtcgtcacagccggatatctcgcagcccggcccgtctcgaccacgacgccggcgggctccttcgcaggactggaggtacacccccgacgtgcctcgtcctcgcactagaggtaggaggaggtgagtgcatggttcaatggatggatggatagatggatggacttgatgcatggttcgatggatgtatggactggatgtatggactcgactggatgtatagacgaggatcgatgggatgtttttatttcttatatatatggacttcatatatggatgtattgatggattctatggatgtatggaatgatgttgggattgatggatggatgtatgttttgtatggttctctggatatattgctgcctgtaaatttctgtgatttgatgtttgcctgtgttgtgtgcaaagttttactaaagtttagcagggctgggacgtcagcgccatgctaaatggcgctgacatgtccaaactcaacgccagtgcagaggtcccagcccagccatccagaaggcttgctgggctgggccacggccgaaacggccaagtccaacctcagcgccaggtgggctggcgctgagtgtcgcacggtcagcgccattatggctggcgctgaggtccaagcccgcaagccatccagaagccttgcttgtctgggccttgggggttgcggccaagtcccacctcagcgccagtccggttggcgctgaggtagctgccacgtcagctggggatcggcccggccgccacggtggcacaatgtcagcgccagtcccgttggcgctgacacggccaacgtcagcgccaatgtgtttggcgctgaggcgacggcctatttttggatgaagtttttggcaggggttagtttcgaaataagttttccaaaagggtcaatttgtcaaaaaacctgctagttatgtggaaattcagttccaggtattgcatacatttttgttaatcgattggtgctaatgaactgccgtgtcctaattcctaaaagcctaaaattaatatatgatggaaattcagttccagatgatgcatacatttgttaatcaattgaagctaatcaactgctgtgtgacgagattacttgtgaggatatgaacatgcatgaggggatagatggcagatcgcatatgcatggcaaaaacatgcatatgattgttcatctgtatccacccatggggacttaactagattggaaggtaattaaccctgtcacatgaactactttgaatccttctttgaattgaaattcaggaaactattaccccttcgcaggtacgtatatagagctgatgctgatgctgcaacagctaattatactccgtttgttaatgaccgcgatccatacctgaatctgaatttctgtggaatttgcaggattcaaaatgtctttttatatatataaaaaaaaggactatgtttccgaatgctcagacattatcttctgcaacttagctattcattattcatgcagcgatcatgttgtgcaacgtagttacatgtggtgctcgtattttgggagtttgcgaccaatgtatatgcaatcaagttaattatagtttctgtagcactgcaattatcatttgttttgcgcgcgcatgtgaaatttgggcgaaaatggatccttgttttggggagaacattttggatcctcatttctcatctagctgtataaaatggattcgatattgcagctagcttgcaagccataatctgtctcatgtgtatatatgctcccaataccagaactggattgagtcatatctaactgattagatcgatagattgttacatacgtatgtcaaaaaaaaactcatgatcaataagcagagatgattaagtaggtagaagaacaaggagactgacttacatggatcatccgacgatgattaattttaattccatcctcttccaaatctcctcttggaggttcgattgagttggaattggagttcttctgtgcgcgactgaagttatctgcctctttatacaacgtaacacaacagtctcaccacccttcaaaaccaagagctttaactgtagagtaaatttcagtttgggctaggtattttgaccatgtttacaacctggactagggataagttgatgttttcacttaacaccatatatgttggcaagctttttcactttggaccggagtgaagggtttgaactgccactgtggctctgtccatggcatgccatcactactagaaaactgatctttactcggtcgtcccaaaactgatctttagtcccggtttaaaaccccacatccattctacgttaccaacccctgtcggtcccttgtcagaggggcggggatctttagtcccggttggtgtcacaaaccgggactaaagatcaccactactaaaatctcctagatctttactcccggtattactaaccgagattaaaatcacgtgtagtatataatccctattccctatcctctcaccaacaaccggcctcaatctcctcaacaaccggcctctcctcagatccatctccctctcttcttcctcctcccatccctaccctctcctccccctcctcccttcgcatccgatgcccagcaatgaccgcctcctccccctcctcccttccggtgcccagcggggccgcacccggtagggccgcaagcagcaggcgctgggcacgggccgagtagcgagcggcggcaggcggcgctaccggcatccattattttttctctttttttttacaatttgtgattcactgagattttacaatttgtgattcactgagatgtataattttgtgatttgttgtatggatctgagatgtataatatgtgatgtatttggtttgtgtataatttttttaagatttgtgatgtatttgatttgtgtgtacaagtaacttaagatttgtgatgtgaatgttttgggatgttgggtttgatttggaatatgcatcccacttgatttgggagaaaatacagggattaaactctggctaaaaaaaaacaatgaaaaaaaaagaaaaggagacctaatgggactgccgctaccctctcttaggtatctttagtcccggttatttcaatcgggactaaatatggacatctttagttccgcattgctagtctcggttggaaaaccgggactaaagtagtcccggattgctagtcccggttgaaaaaccgggattaaaaagattggaatcgggactaaagaggggttaccaaccgagagtataaatggtttctccacccgtgcatgcaagcagcaggtggtggactccacgtcttcacctccgttctgcattgccatcttcgatcttccttgggatcgatctagtaaatcgacagctctaattaattaaaaagtttatagtaagaataatgtcaagcaactctgtggtcaacatcagtcaccagcgcggcggtacaggtcatcgaaaccctcatcagcttcatctggcagtttgactttgtcagtttcatcaatggagaacatctcgcatgatgctaggattgaaaagaggagggagtcacgggtactttattttatggtttcttagggagattgttaattttgggttaagcttgattgattttgtgcaaaattagctattgctccgttgcgattgctgcgttagttataggtataagtgaagtaatttatgcgcatttggagaagcaacatagcagtctaaaccattgacccggtgcaaaatgcaaaagcttgcaaatatatatggtgttaaatgaaaacatagttctatccctagtccatgttgcaagtatggtcaaaatacatgccccaaagtgaaatttactcttaactgtatagtactaataagagaaatcagatcctatggtttcctagtttttgaattttaagttaaatgttatgagttttatcatagtaagatggatttatttctcacaaacccccctccccttaaaaaaggtaaatttcacttaattaattctagatattgtggtctaagttgaataaaatcatagcaattttagcacgtgacacttaacctcgtgtattatggttgtaaaattttacaaaatcatactattgttcattttggcattgatccaccatacttttaagttctacgatcacatcttaaatttatgaattttttttatccataatataaatgttacatgcacatatgtaaaacttttcaaagagtttatataggggtatataaaattggttaacagtacctggggttatgtaccatgtgctaaaatggagaaataaatcttaagggttttatgaaattttatgcaacttggatcataatatgtaaggttttatgaaatttactaaaaaaaatctgccagtatgctgttgcatttttacttttaaatgtgtgagttggcttgaaaatgtttacatgagttttttttggcacaattattccaataatatcatattcttcaattgccatgacccatgagtacaatagaaagcacaagtgaggaccagtagggcagtaggacaatatactgtactagtacatgtagtataacaattgcgttcttttggacagatcgtaagtaactagtgcactagtacgaccatgtgcgattctgaaacacgagatgtgaacttgtgaagtaactcttctggaatctgaagtttgtcctttgtctctcgtttgtcctaatgctcaatgtttaaacgaatcttttttcccttaagaagtactaatgcaatctggaattttcttcagttaacttggatgtacttgcttcagtaatcactcctactagtaccaaaggaaatttctttgcttttcgatatcttttgatatctccattgacagctcatacttcaaaacttatagggatacactgacaacaaaaaggagaaaacaaaccagggttcgtcagttcgtgggctgctaaaaataagtgcgaatcacatggcaagcaacgtacaacgcaataataaaaatagattcttcagatcagttcattagtttcaactcccacctgcatgcactgttctgaattctgcatccatcactgccaattgtatattcaggattcttctcccgttacctcgccatgttcagttcaattagcactagtaaccctcaccttctgctaattgtttgcagctaaaatgcaccaaaaataaactttcaggcagagctcattttctgtacaagaacgcagcaacatgttcagacaaaagctgctgctaagaacagggcagatttgaaccagggaaaccggagatactcaaaaagacaatttgtatcatatttccggaggcaatttacacaatcatgtgtctgttacattttcatagttatgtcgcctgacaaataaacaaaatcaagcttttgacagccctattccacctttgtacctgactgcaatgaatgtaatagaatgaaaatatacatgtatgcaaccttggaaccatatggaagaactactttccctgctccatttcagtgcactatcgtgatacacctctacaattacaacggaagaagtgactttctcatgaagattggaagatcggttggtcagcgaaaggaccatatacccaacctctggcaatgtgaccgtaagccgcctctgtcaggtgaatgccatcccagctccaatgggttgatggatcatcacacgcggttgcaccagcctcaccacatttggctgtgacattgaagttgtaagcggccttcgcaacggacccaggagccccgcagcatgccctaggtagctgcttgtaaaatcctgaattgaaaaggcaagaacgttagatgttttcaatttttaatcaacaataatgcatctgaatcctttttcttcaccagttgagacagaaacagtctctattagcagaattaaatgggccaaagatgtgtttgttgctaccacacacaatgaaagagaaatgctagcggatgtgatctagagatgacaaggccattgaaccgtgatgcccaacttggccattaaactatgcagaagatttcataactctacctgctgatgctccctctaattaaaaagcactaactacaaagcataaaaaaggtcattgccagcaaggtaagcaagcattagataacagaagtggatcaccaaaaaggatggctcagctaacagagcaattcctacatgtctgtactccccgcaacaaggacatgttgaaatttgtgatacacacgatggttggaaaaaggtaaaaaggttaggtagggaaaacgtgccaatgtgtcattttatttatttgtggtgttttcaagccactgctattcgaattaaactcacgaggataatatacacccactcgaacccatgtgcgaggttttaaaagaatcggtggcaaaatatgtatggagacaatcaaaatgtggcagttttgaaactgaactagatcatatcaaacaagagcagagctgccacaaccataattttaaagtaggtgacagtatggctaaggttcaaagcttttttacatggttgcctggagaaacaagttgggcagcctgtgtatgtagcttgtataacaatcagaccatcagacaatcctaattgttagccccacattacctatcatgggtggaatctcattatagttcaggatggccccctctctcaagaagacaattaacaacaggacaaggtttgaacaaagagtggtagagtactaatagaactgatagccatactactttacagactagtgtaaaagattctaatgaagatgggattagtaactttgcttccaatttactctgaacatagatggagctactctaattggtttcaaatcacaaattgtgatccatcattactgtaatttgaaatattgcagtgtgctactagagagataaggcacctctacccagatctgaactatctaaaaataatatattgtgtctttcaagggtgacaggaggaaaagttgactctaggtatcagttgacttgatctgttcaagtaaattagagcagcaagagctaaaaaacagttattttgctagaaaagccaatttagtaccgatgtgaaataaaggataagaacgaactgatgcttcctgagctagctaactatcaaagagctcaagaacttaccaaacttctcgggctgaagcatgaactggataacaggcgtgtagtaatcgccatatatgatcctcacattggggtgcttgggccggagcttctcaagcatgcgcttgagatgtgcattgtgcacccatgagaatgtgttgtaccgacggacgcagccgctctgggggccatacccatcggccggctcatcgagcatgttcaagtagacagggaagcatccagtgggcatcacaccgggtacaatcagctcccttgcgccctcagcaatcaattgctgcaccaaacacgaacagttgtataattgaaatcacattctccacatgaccactaacaaataggcgacacaacgaagctattgaatttctacctcgatgccatcggagatagcctggatgacatccggcatgaacttgtaggcctcctcaaggcccttccccgcaaacagcggcgcattgtagtcgttgccaccaaactcgccgacgacgaagagcgaattcgcatagaattcatcgcattccactgcaaaaacatcaaaacaatcagatacaattccccaatccagttctctctggagataaaaacaaaaacaaatccccaaattcagtgaggcgaggtagctacaaggtaaggtggggatttgggcatatgcaatttatgattatacccttggtggagttgcagaagaagggcttgagatcgcggaaccactggatttgggtgaggagggcgccggagttccagacgacggcgccgagccccttggcctcgaagtagggggtgtcgagcgcggtggcgccggtgatggcgaagttggcgccgtgagcgaagctggagttcttgagcttggacggcggcagcagcggcaggccgaactcgtcggctgcgatccaaaccaaaaaaccaaaccatcagcaacacaaagcaggcagacatcgaaatccaatctagcggagaaaccaaggggcgcaccgaggtggtcgacgacgaggcggccgtcggagcagcggccggtggggtggccggggaaggtctggccgtaggggagctgggcggtagcgaggcggaagtcgacgccgttggcgaggaggttgccggcgtcggccagcgagtccccgaagttgaacagcgccctgtacttccccttcgccttcccgttcaccttcccctccgccgccccagcaagaatcgccgccaccgcaagaaccaccgccacgaccaaaatcccccgaactgcccccatcgccgcccgccctatccctcctccgttcttgggtcaaacccaccaccacaagaagagggaagaagaagaagaagaggaagagagaggggtagcggctaggtaggtgtccggggtgggggtgagggggttcttcttgtagctaggagcacgaggagagagagagagagagattgggatgggttggtggtggtggcgtggcgcacggcggcttagctctctctctctctcgctctcgggtcgcgtggcgttttcttctcgcgagctagctgccgcggctgcgcggtggcggatggcgattagtttactctcgggctctctcgcggcttggggagtaattgcgatttgggattgggagggggaggagtggggaagaagaggggaggaggcgaagagaggaggaaggtgagaaggaaggaaggaagctgggggcaggctgtccggtgtggaggaggtgggggattcgacggcacgtatgtgtgagaaatggaggaaaaagtgggctacacggttggactttgggggcgtatttcgggcagggtttgttggactcgagctagatgaagagagcgtgtttggagtcaaagtttttggtctgggtaatttggcagtgttagatcaaattggggagtggagagtgtgtgactaatggtgggtctagttcacactaaaattagaagtttggctgaaattagaacgatgtgacggaaaagctttatgtgtataggaaagttttcatgtgatggaaaagttagaagtttaaataataattttggaactaaactcggcctgtatatgaggttggaagctctggattgggtgaactcatgttttcgtatttctacttttattatagaaacacagtataaacgtatgcgcttataacacgtgcacattcaccactataaacatacacacgtacatcatatccttatgattatctccgaaatattggaccggcatatttttttttctagtatattatttatgtcatacattttcgatcttaaaagtttaaataatactggccgattgtcctaattcactggcataagagatgaaaatattacatcattgtataaaatggtatggtggtatattgtaacgagtttcatctaggctcgaaagaattcctatatccgacattataaataggtagaataatcaaataagtgtgaccgcatttttcttgccaaaatgcagtgggggcatgcttgtgtccaaattgataggagttaatttataatcatcgtgttatttgtaagttgttagaagttcgttctgagaaacttggttttatccagctagagtattataagttgcaagcacttgttctggtttttaatcagagtaatacctctggctttaactcaattgagtaataatcggttggtccacactaaaaatttccaacagcaattgcacctaatgagatctatcataatgcacctctttagctaacgaagtataaattgacagcaaaaccatggtagtgacaacttttagcatcgcaaatccgcacgcaaaaaacttcagtgcataccaacagaacaacttttgacaccagttctgcccaaaatggcacgtgttgccgaatatgttcatccaagcaggaaatttaatagacaaagtcatggttgggttgcattcgatttggccgtcattttcccttaatcactgcgcagattgctcctcatcattttacagttttttttcccttcaatacttcttttttcttaccgttgtgtatcaatacttaagtacggtagtttgatcggtttagtgataagattgtatctagaatgcgggggatttctcatgaaataattcaattcagtatggatcaataaaatatatcccatttgctccaaagaaaacctaaaatgcgttgtcattgtgcatagcaatttaacaatgtgtcactgtcataaactgttagagcttagaacatactccaggtagatggatgatgaacacaagactacataagcaaaggtcgtatggtggtcaatttaaatgcgatacaacaccaactgaaaaagaaacgattgtgctgtgttaccaaccagtgaaccaaaatttcttttcttaaaaggaagaaaaggattggctggcagattaaaaccacatcagataggtcaaaatgatgcaaatctggttggtatgaaatttttagataaatgatactaatatactactttcttatccaccacggtgccataacatgggctccctgaatcacccacattagaagaagaaattaaactaatcctcccaagtttcctcctaatatcttcttgttgattttgttgatggcccttgtggttcggtgagaagtcagaagacagcaccaaaccttccagagcaaagttggtctaaccataaaaaaattgcgtaagggggtggtttcctctctaaacattgttgtcaagtagttgcaaaatacacctccagttttttctaatggtactggcatgtgcagctttttcacaagaaggaaaccactccaaaacctaacctgatagctgtggtgtgaccaaatgattgaggcatgaaacagatggattaatttatacattgaaaggggtggaacaaacgtggcaaataatgagatacatcgactgtagcaacagtagtgcatgcaccttttttttttaaaaaaaacaattattgtgcaaatacttcatgacaaaatgtaaaatacggaatcaaggtttttaaattctacctagagtgattagccataaaacgaattgcacttaaatcttcacgttcgcagggattacagacttgcaacgattagtgatgactgatggcttatatatgaataaatatatggtatgaactcatccttacgaccttaacaaccgctaccaccaccaccagaaatgggacataatttttgacatggatcatatgttaaaaaaaattattatgttgctttcacatggaacatatgatatgcctgcccataacctggttaagcttgctctaacatttgtattcaacatcaccttacagtccgtgagactgacaaaacggtggttctttaattattattatttttccacaggcataatccaacgcatctgacgttctagcatctcagaaagttggttggctcgtatctggcaacctgctcggctatcatttgtgcaaaggaaggcgacacttgggtggaccaaactgagcattggactacaaccattcgttttctcttttcttttaagagtacacgacgtttattcatacatgaatcagccacattcccacggaaaatgaagaaaatctgtcttcgaacaggcccaaacaaacagataacaatcaacatcccatctagttgtgcggatctataatgctgctgctttactactatcaagttagactggcactttagtcctactacaaagtacaaagagaacaagaaaccaaccaccagatgttcagttcatctcgtagtgaagaaaaagaaaatattaagcagcttccttcaagcttccaaccaaaacgaatgcccaacttaaatggatagagtccaagggtacagacaacgaacaaaacaaactatcataagcaaatggggcaaccccaccggaaaggttgcaaaaactagtgcacaaaacgatctgacaatacagtacgatcagtttcggaataagcattcatcacaaaggacatggactggatcacaggcaacacaagacaaacaccaaagcaacgtttatcaacagacttcatttgggtacattttacaacaccgtcaacaggccacattt

SEQ ID NO: 80089 - DNA, 13206 bp, Oryza sativa
cctcagaatctcataatacaaccatatgagagcaaaggataattgttcctactggtcacctcgctgctgaccagtgcatgctaaatggagggtcaagttccgtacagaccatatcataagccgcagaaaacaatatggaagaacctacaccagtagtctccgcatctccacaaccagaagataactctggattccagccgggatcaaccttatcagtcagaccaattggttgtaacaacagaaaggccaaaagttgtatctcataaattctagaatggttaaaacagtaattttagctccattgtgaaacttacctacacttccaagatgaaatcatctcgccattgtatttttaataaaaaaaaaagggcgggggggggggggggggggttgaatagaatagagtaaatgaggtaagcttatcatgtactggcatatttaaacagattttcagtaggaactaacattatccattcagtacgtcaactaagcgaaaatatagctcattaaatcacctgtaatatactctttgtgtttcatggtagaactagccactagtagttaacaagttggaattgatcaaaagaaaatacaagtctcaaggaaagagtcgtctataagagattaggatctatcaagctcatgcacagatgcactcagttttcctaatgtgtacttcaacatctcagtctccctctatttcatctaggagtaactgtctaccttattcagattcatcatttcaaaacatttctctattcaccaattcgtagttacttctgtccatcctaagttcatttctttggcattgtgcaataccaaaacaaaactttgatcactcttttttatcataatatcagaagaattacaacagtaattcatgatggaagtattttacaacgatgagcctagctgtgtcattttgatcatgtgggaaatatgtaatcttaagcgttcgtctgtgataaaagggggaaaatttaatctatactacagattttattggcaccaaataataccacaagattctttcacctttcaaaaataccaggaatttgacagagaaccaatttagtaagcagacaaaattacccttgcatctcacatcctttccctctcttcaacaatatggggcctccaccatatcatccgtgtctctgctccgtccgccatggcatcacgtccgggcaggagaccaccaccagtccagtatgcgtggaggggcatttctgttttgctgctgcggcgttgcgcccgggcaggaccccctgggtcggccatgtggaggcacttttttcctccaccactggtgtttgtgctgccgttttctaatccaccgttgtggcctcgctgcaaagcacaatagccgtggaggggtcttctttgctctgtcgtggcggggtcgcttcgagagcaacagccgccgtggtatccgagcggcctggaggccatgatgagacacccgccaactcgaactgcttcatcagttcacatgcctgagcaaggttctggatgatgagctccactagctggtaccaaatacaacttctgtatcatgctgctgctgcggccacgatggagattggagaactcccaatctagttcacacttcatagggtagctcagtaatcttctcaaacactggtaacggggacaaattagtttgtccaagattgggtaacatccattgaaatctgtatcatttttggaagagacattgctgcaatgtggtattgagtggaggtgcaagaatcttgtggtattatttggtgctggtgaaatctttgtggtatagatgaaattttcccaagaagaaaaaagaaactaattaacctcaagtagactgtcacagcatattttttggaccaggaaaactataccagagtagcagaggctaatgatcaatcacacatgtaactgagaaaagagaaaaatatgctgtagaaatattcaaggaaactgctgaaaacactagaataaattcaaaaaaatacagtcattgcaactgctaagatcagtaatagcatatgattgaagaggcattatcttcgagtactacaccagttggtactttgctagctaggtggtttatgcataataataaatacaaaaaaaaacagaaatataaaatgtcatagccacaaggttgtacaaataaaggtgtgtttgaaatttgaagtcatgttcaggtatttttactccctgcactcacgaatatttgcaatggagtagcagatagttaccaagaaaaaccagtttctatattaaaatattaatgtgaccgataaacccctgacaactagcccatggcccaatctagccacaaatgggtatagaggatttatttgatacggacaaaatagaagatgtgcaatggaaaatgtggggttaaggggattataaactagcatagctggagactgtccatcttcatcatgtccatcaccaatgctcatgcctacaaacgtttaaaagtaaaaaaaaagactcagattcatggagaaaacaattaaatattagggggcaactatgagaatgagatttagtttgaaaatgaaaaaagaacttagtttatttatttatctactatcccgtacagttggactcacaacttgcagcgcgacttttttgccaatgacataacgaactgttgtttcataaaaagaccaaaccaaggtgttattatggttttcagattattagcaagatcagtaaagataaaggtattcagtgaaatggcactatttaagcactaaaatgagccacttgagtacacatttgcatttcggttggcttgaacttgactttcatagagatcaaaataattaagttctatcagtaccaaaaagaaatgctgtactcatattttcaatctgtatatatacttcaactgctacagaaacaacaataacaaaaagaaaaacatcaaaatatattgaagagttcatcaagcagcaaaacaagagagtgatactaccctagtttacattgctactttagcaatcgaggatattcatgcatacatcgacaaaataattagaagtccaaattgctactctagtactcaaggatatgaaaggcaaacatcaaccaactatgaaatgtaaatcatgccattacctgcagtgtaaacacttgcaaatggataaatgaaaagggcagcacagtctttcaaaattctcttgaactccatagactcaagatggaccatgaagagaccattaattgtctttaggaaaatcacattatagtcctcagaaaaccccattacgattggggagcccttgcgctctgttggactcaaggatagaagctcgcccaattgaactgttttctccagcacccatccagactcagagacatcatcatcccaatcattcttcctcctccaaaattgtgagcccaaatccgacatgaagacgaagccgaggccaccatccgctgccggcacgacacaaaatcgtcggtatccatcactcacagccattggcacatcatcaatcacagctagcctctgctcgttcagatcgaactcgaggattccacccggaatccccgaaatcaaccagtagagggaatccccaatccgaacaccgggaacagccagggatatcctagtcaaattgtgtgggaggggtgttgcgatgagatccccccatttgccggtctccgacgagtagatgcaaccgatggcttcgtactgatggcgggtgcccaccagaacgatctggaatcggaatccgccgccgccgccgggaaggcgaaacaccgcgccgttccgcacctcggtctgtccctggtcgcactccggcgggaaggcaacgcggcgctggtcgccggagacggggtcccacacgaggaagcagccgcgcagccgcggcatcactgggttgacggcgaggacgaggccgtcgcggcagccgaggatcctgcagcggaagtcgtcgaaccgcagcgagaagcgcccgccggcgcccacggccgcggggacgcggtcggggggatccatggtggagacgaaggaggggctcacccggtggctgtggaagaagccgaggaggggcgcgccgcggcggtggtgggcgcggaagcggcggaggaaggcggggtcggcggtgacgaggcggcgccagcgcgcgcagacggcggcggcgcgcgggagggaggagggccgcggcgggaggcggagaagtatctcggcgaggaggtcgtcgtcttccagcggccgcgggtgcgggtgcgccatcaccgggtttcggttccccgcgcttctccgcttaggtgggaagtggagactggagaatgtaggcagactgtgagactgggactgtgttgtttaggcgagtttacttccaaacttttttttcaaactttcaacttttttatcacattaaaatttttctacacacaaatttttaacttttccgtcacatcgttccaatttcaaccaaattttcaattttagtggaactaaaaccaaatagatagaaaaaatttaggccaaaaacgtcacatcaaatatttatatatatatatatggggtattaaatgtgggaaaaaaaatcaattgcacagtttgcatgtaaatcgcgagacgaatcttttaagcctaattacgtcatgatttaacaatgtgatgctacagtaaacatttgctaatgatagattaattaggcttaataaattcgtctcgcagtttacatgcggaatttgtaatttgttttgttattagtctatatttaatactttaaatgtgtgtccgtatactccaaaaactttacactcaaataactaaacacacccttagatgaggaaaatgttgagatatttaactatttgccacttttagatgtggcaattaactatttgcctctgaacccatatgtcatagacacatatggatccacatttcattgagataggggtggcaaatagttaaataccaaatttaaaagtggcaaatagttaaatgccccggaaaatgttagctcgaggtcctcctcttttattttagtttttaaatcgtactttgaacaatattacgcaaatcccattaacttttaaaacatttgtaaatgaggtccatcgacggtattgtttacggttttagctgaggtggctcttttgactaggtcttcgtcccatatgacatttgcatgacgcttacgtggcaattcaattcgataaaaatcgtggagctcatgtgtcagtttaaccaaaaaaaataattaaaaaacatggggccttacgcgggacccacatgtcatctcattctcattttctcttccctttccttcctctcttatgttatcccttccccactcctctctctctctcacacactcctctcaggctggttaatctcagcgcaaagacagtttgtgctgagttcacggtttatttcttgttaaagtttcttttactgtatagtttcacaataagttttttgaaaaggaccatttaaaaaaaaacgggaggggggagagagtaggaacaggggacccgtgggctggtctgtcgggacaagttcgcggcccatgaaatgaaatccggccattaggcccatcccagtcatggtgccctgtcttgcatgccatttgttcgaccgatggaatccagtgtcgcacgctaaatacctcttctgctcttcatccatccgatcactctgaatccaagtgaatctccggattaggatcggccgcgagttattttgctctgtgaaagttgcttggctgcgtatagcactcctcattcatcaacatcgtggtgaagagaaacgaggggctcaaaaatcaaaggcaaattttactacagtacatcgtggctttgcagttttaactgcaggacaccaaagtgactttggggtgaagacactttcaaaagttggatatttgctggtggacactggacccactaaaataataatttttggtttaagaggagggagaaatcgtgtgaaatgtatgaaatgtccttgggcccacatgtcagatttccatctctcttctctctctatcccctccttccacactggcacacagccatgcgacgggcttcagggggcaggaggagggttgtgacgagggggacagcggcagccaacggcctaggccttgccgggccagatcggcgtcgccgccacggagcccgcatcttgccaagaccttaagagtggcatttaaatgtcgttcacgaaatcaacacgacatgttgtttcttgtttataggataaattatatgaatatagccacatccactatcagggccggccctggccctatggagccgaggcgaccgccgggggcccatgatggtggggtggggggcataatggtggggggcaacacctaatactagtagtctagtacctcatccgatgttgagatcaatgatttttattcagaattaaaggtgatgaaagtgagtttgccagattcttcgatttccctaagattttgaagtttgttatggatgcagatttctatccaaatgtttcagttgcctatcgaattctcttaactttacctatgatggtagcttcagctgaaataagtttatcaaaattgaagttgttgaaaaactatttgagatcaactgtcgcaaataaggttaaatggcttggctatgtgctcaatcgagaaggatatcttggacactattgatcttaataccgttctttatgattttgcatcaagaaatacccgaagaagtatcttttcataggaagcaatggatatgacggggttctattcttcattaagttaataaataattatattagttccaagttacaaatatattgttattttggtcgattttatttcttgataattaccaggaatgttaaatttaatatatagatgtatttgttttcattttgcaagtaaaattagcgtctatatatatcaataaattttatatatagcttggagggcccatcgcgatgagttcgcctagggccctcaaaatcataggaccggccctgtccactatagtccataatggaatatccatggcatgaagtaggaaaattaagaagtttgtaacctttatttagtactgatatcgaacagaatcaccaccaagtgtcatacttgtggtgttttattttactctacgccgatactagttctcaattacattactctgaggtctcgctttcggactcattcgataatcctgggtagtattgttgttgaaatctaggagtgaaggcaccgtgctcttctcccctgttgttcttgaggcttcgggcttgctcccttgagatgcgatacgcattagcgactacatcaactggcaaggcacggaatactgagtttttccctgcaaggtggctgacgaaggcgttagcgtttgtcttgattgcgatatattggcatccttcacgctctgctttcttcaagacagcataatgttgcggaatgatcaataattgtcctgggcgaaggacaccatcaaacacagtctttccaaagttactaacgacttgaactcgagatcgcccttgaatcatatagaccaaactatgagcattgacgttccagaacggcgagagaatagcattctgtagaaatcagtagagaataatgttatataagcaacaaatcaaagatcttccaaaaaaaatgaagagaacaaaacggtgctataataaatacctggtataggtttactctggtagcgctcatttggatgaggttaaggatggggaacttctgactattgacacttgttatccttccggcacgtgggttgtatgaatcagcacgactaggattttcaatgtttactctcaccttgatcgtgcaaaagttctcctccaatccgttccatcgagaagatgtttgctgtcgttcactgtattgaacttgttgatattgatcttgtgcttgtgcttgttcttgctgttgtgtcaaagtcggtttcaacaattgaaggccattcttcacatgtatgatctctcctctttgatcattttggctctgtagcctctttgctgctactgcgttgatgcctaaagcctcacttagcatctcaacaccaaatccgctgaatatgttttgcccagagtgttgctcaattgagctaccatatacttgttgttgttgagcccgattgttgttgccggctaataggaactcctgaaatttttatcaatgaaaaatttaatgttttacgctatgaattgcattgtaagaacatatgaaaaacatagaaaattacaactttgatggaaatatttgttcaaaaaattaccttttgcctaggttcaagctgattggcgttgttgtttacgtcataaacatatacggcaacaataggtgcatcaccatcattgtagaaccaatgtgcaacaccagctgggagtgcaacaatgtctccttgcctaaattgatgaatcttttggtgctcatctctaaacttttggctctgactttggccttgagatgaaaattgttggaattgttgctggtaagtcgcagggcaaccggggaaggttaaacccatagaacctctccctaaaaattataatgttcacataaggtacatacaacattaatttgaccatggagatcataactactagttgcatcgatagagttctcgattatatttattaggatacaaaccttggatgatgtagaccacgccaggaatatttgtgtatcgaggtaccaaaaggccttgaggctgaatgacacgtcggatcacaaaagtacccgtgcactggaataattcattcttctcatcgaagtactcagtcaccccagcttctgacctcactttccgaagtggttcaaatgcttgtagtctatcaaatctacactccctaaaacttccttgccgaggactatgccatgggtttgtgctgggattaaatagctgggccatagaaccatggcataatagaagaacacaaaagtatatagaaaaccgagagaaaacggaactcgccatagctatttgtacttgcttatggaaacttaagctaattgatgtgagttcaaagacagaccaagctagtttatatagcaataaaaaagcatcttgggatacatggtgatatagtttgttgcacgtacagacaatatatggcttgtagtgttaaaacagtacaaaaggaaaggcaactttgcaagattgaactatacatttcatgactcagccatgacaaacttctggtgcttttggagtaatacaaatggagtttgttaaagaaatgtctatccatactcttaatatgtatctttgccttgtcattatatttgtttttgcaccataaagctcttatgcttgagaagatgagtctaactttaagatgataataacttgtaagcatgttgtcatttttgcatggcaagctatatttgataatttaagtgttccttcaaaatagcaaatttgtaggtttgttgtcatttacttgatacactacaattgataagtaacttgtatttttaaatgacgtacttgtaactttgttgtcatgtaaaatatatcagacagtaaggcatattggtgtaagtaattttaccatgtcataagcctttttactgcttattgacccatataacttgcctatatatattatttaactatttgaaaaacacatattatgataattttacacatctgaccacggagagctgtgaggctacacgtgggcccgtgtcactcaaatccacccaggcgcacggatttgcttcccgtgcacctaggacggctccccgcgtgctcccgctctatgtgaatcgtgtttgcagacgagtggacccactcgggataccgcgcgggggaccgagtccactagccttgtgcactcgtcctaggccacatcctcgtccggtccactcggtcccccgttcgtcgtagctgctccgtcgtgtgttcgctcggctgtgcccacgcagcacgctgggccacacgccgccttcagcccaaaaaggcagaagccatcccctttttcctttttctttttccatttaattcaataatactttttttctttagacagagaatcaattaatcttagaaaatccatatctcttcaactgtctgttcgattgactctgttcaacttctaaaattcctcaaaaatcgagatctattcagtggcacacttagtactcactaatacgagcttttccttggtcgttttgttgagttatctcgttccacgtgtagcttcggagccagaagagtcctagtgcgcggaatacgaggaagaagctcaagatatcaagcaaggtaggtcacctttgattattttgagcccataatttgaaactaagtatttcatttctcaaaatgcacatctctaaattacacatgaaatgttggccgcagtttgcaatataaccaacaggccccacctacaattgctgcattaacctccttggtcgactacaatgctaggtctcagtattcgtgccctcaggtacggataccaatgaccctcctcaaaatttgaatgatcaactatgggtaaaacttgggtttacaaaatccctggaaaacccgacacacctgggtcggtgccttgaaaacaaatgagtttactaaactcgtatttcggtagaagtactggtggtatggttttctcgttcttgctcatatggaccgattcctttagaatttcatccaaccataacatgtgtgaccacatgggtgaattgtgacatgcctggctgagtaattagctaggtcaggcaaatcttgatgccaatggacaagtggatttgtcggggtggtgttggggaggaccccttggatttttcctggcacaacatggtttgggacctaacttgttgttggtctgtgggacccctccagttttcataaggtgtccttgtgtgggctttcgaaatgccttgtcgcgaaatcccttaagtcacaagacgtggctattttgcatgggctgggtaactcaggttagtggcgttgtgtaggtaaagtgtaccttctttgtagagattaacaaactgtttgaacagtcgtgctcacggtcatgggcggaagtgaggtgattccttagcatagttttggttgactactactttgtgaagttgttggtagcaagaatctgttttaaattgatatgtggctcttgggagcagccagactcggggagtcctcttatttgtttggcaaggagccacccatgcagatgcattaaatgaatacacttcactgctttggtcatgtgagatgcatcttctcacttgtgtagttgagaaccactcacttagtcgtttcaaaacctttatagaaaaaaaaaatctaaacatggaaataaccagcctttctctgaagcttgcattaaacacctaattcacatggtttgttgagtactagtatactcacccttgctctatataaatacaccccccaggcacaatttctcgatgaagaggagatggatccagctgatgagttcttccaggaacaagcaggcttcgagcggtattagggttttggcttagttccaaagtcatgcttgtggctttgtctagtctccgcttctgcctttttgtaatgcagttgtgaactcgggggttgttcgcagttccaacaatgattgtatccctactcataataacgaaacccatgtcgctgtgatattctatcttcctttgtactagctctatttcctgggactggtacatgctcacaagttaatatgaatctccttacattggttttcatttggagctagtttggggcgtgacacatggtatgctagaagaatatttctttggctaaaatttgcattcaccatacttgtgatatttttttaaaataagttcatcttagatggtcactgtaaatatataaatctagatggagacagttgcgaatatatgtgacatattttcggtgctatggaagatattttattagggaaagattataagtacataacttttcaaacaaaactcttgtgataaaagtgtgtgtggcacactatgaaccagcctagttttactgtaactaatttatactcccatcgttttttaatatacaatgtcattgacttttttacatacgtttgaccgttcgtcatcgaacataaaagatataagtccatgcttaaaaaaattaataaaaaagtcacaacaaaataaataacaattacataattttttaaataatattaattgtcaaacggatattaaaaagtcagcaatcttatatatattaaaaaaacgaatgtagtacttgtgttccttttgatcttaacggttggtttatgggataaatacatttattccattaggttcctacatatgtcccaaaggatatctaatcccttaattaactctgcctactggtggccttatggttccatgttgaatgccccgtgcaccaatgcccatgcctacgagcataaaacgttaaaaaaattaagattgaaatataaatcaaatatatattagaggcatccataagtatgaggaatttttatgtactaccccatctatgaattcagggacaactcagctttcagacaacattaggaatagataattaaacaaaaacatatctaccatcaaatgaaaagaacattcttcagcaaaatataaaatataatcaagtattttactattataatccaaataaattgattcaaaatagttttaaaaaaatcaataggcaagttatatagtcaataaactgtaagaaggcttatgacatggaaaaattacatacaccaatatgctttattgtccggtatattttacaagacaacaaagttataagtatgtcatttaaaaatacaagttacttatcaattgtcaagtaaatgaaaacaaacctacaaatttgttattttgaaggaacacctaaattatcaaatatagcttgccatgcaaaaatgacaacatgcttacaagttattatcatcttaaagttagactcatcttctcaagcataagagctttatggtgcaaaaataaatataatgacaaggcaaagatacatattaagagtatggatagacatttctttaacaaactccatttgtattacaccaaaagcaccagaagtttgtcatggctgagtcatgaaatgtatagttcaatcttgcaaagttgcctttccttttgtactgttttaacactacaagccatatattgtctgtacgtgcaacaaactatatcaccatgtatcccaagatgcttttttattgctatataaact

SEQ ID NO: 80090 - DNA, 662 bp, Oryza sativa
ttacttccagttttcttaaagtgaacttcaaaattttcatcaacaatttgtgaaactgaaagtaaattgtactttaagtcctcaaccaaagctacattcttcaattaaaatttttcatttacctatagcgagaacggtatttgtagcagcatcaccaaagataatcgattcagtcttagatgccttctttagggaggagaaccaatttttatcactggtcatgtgccgcgaacaaccggaatccatgatccacacgttctccttccttgccaccaaagcctacacacaagcagaagtcgaagcctcagtactggggttagatgataataaaaatttaggaatccagtactgagacacacgaccagaagatccaataggcatatatccatgtgcaaaatcaattttagaatttttagaaaaattcctccgacgccggtctgaccgaggtatagtggccggtctgaccggtggtcggtctgaccgaggcttcaccgtcggtctgaccggtggtcggtctgaccgaggctgttcagccggtctgacctgtcgcggtctgaccgcgggacccactacggtctgaccggtttcctcgagggaaaaccagatttttgccactttgattttgcaaaagcaatctctctctcctttttctgtttatgagc

SEQ ID NO: 80091 - DNA, 1464 bp, Oryza sativa
gttgttttaactttttagcagaaatcatgttaaacatcaaactagcatgaaaagcaatttgatatttttgcaacaactttttagttaaaaacaactcatccaaagtgcatgtgtgcaaagcaaaactacagcaagagaagatctatttttcaaatcatgtgcagcattaacatctctaatttttgaaatctcattcattaaaacctcacaattttcacaatcatcatcattaggaataagagattttaacctatcaatttcagatttaagagattcaatgataaattcctgttttctatacttcttctcacactttttattttttgcactcaaaatattaatagcttcctcaaaagcactcacctcattatcttcatactctatgtcagattcaccacgcgccatgaagcaaacatcggagacattcaccatctgcatcacttagtggctcgaagacggcgcaaacttgttgaaaagccttcctaagattctccatcttcccccttggtatgaaccctttgacttgttgttgttgggcttgttgttgttggtcttctcaccatctttgtcttctcttttgcctctcccaagcttaggacaatgcgaacgaagatgatcaattgaaccacattcaaatcctaaccctgcaggaactaatgggatgtcaaaagaaacgtcatctactgactcggctaacaaggagattcagccagagaagaccgtgccgcaggagtaccgcgacacacgattgctgccattcccttagcgtagtaggaaaccgtcagtggacgagtagttcgctcattttgttgaagtgatcgaaaagatccacatcaacgtgccgttgttggacgctatgcaagtgccaacatatgcccgttatctcaaggacatactcaacaacaagagaccgctcccaacaatggaggtggtcaagctggcggaacactacagcaacatcatactccacaagctcccggagaagaagaaagatccggggtgtcccacgatcacctgctcgatcggggcacaacaattcgaccagccttgtgcgaccttggagccagcgtcagcgtcatgcccaaagatgtctttgacaagctcaacttcatggtgttggcaccaacaccgatgcgcctccaactggctgattcgtctgtccgttacccggcagggatagcgaaggatgtgctagtcaaaatacgggatttcttcatcccagttgattttgtggtgttggacatggacacggggaaggagatgccgctcatcctggggcatccattccttagcaccgcaggagccaacattgatgtgagaacggggagtatccgtttccatatcaacgggaagtaggaaaagtttgagtttcaaccgaggacagaacaatgctccatgtccagaatcaggtacgggccgaacccgcaaaatattcaagtggtcgaagtggagccaccaaagacg

SEQ ID NO: 80092 - DNA, 2387 bp, Oryza sativa
gcatgaagttagagtggccggctcggaaaaaaccgtcttccgcactgaaatcaaagaaggtgtggagggaaaagccaaagacgcccgctccatcccctctagaagaaggctcctccagctgccgcgtccaggtgatcgcgggacattggggtgagcccattgtaaaagttctgcaggatcagccagtcgtccatcccataatgaggcaggcggccacgtactcctgcagtcgtacccatgtttacggaatggatcatcccttgtctgctggaaactggaaattcgtccacgaagggcattggttttgcccatcaggaagaacttcgagaggaatgtcgtagagtatttatcccaggtgttgatagcagcacgattggcatagaaccactgcttcactcacccgaggagggagaacggaaacagccgcagcctgacagcgttaggactgactccctttatgttgtacatactgcatatctccaggaattgctgcaaatgagcatgggcatcctcattagccttgccacagaacttcaagtcgaaatccacatctcctatgttgacttgcggcccgacgaccacattgtcagcagcgaactcgcgaagagtcttgttggccataatcttgaaggtcggtggcgctggtacggttggtttctctgtcggtagagttttctgctgagcaacgactcgcggcctaacgctccggaaaaaagcttctggattttctttgaagttttccggcaggttgaaaccagtcatgaactaccctgtttacacgacaaaaagtgaaaacaaccaaggttagcctgcaaatgaaaatgactatacagaggtaaatataaagtattagtttaagtaatctctattatgaatcttccccggcagcggcgcttgaaatgcttgttggtatttcttaacgacattactagaaatataattcgcagcaatggcgcagaaacacttctggtatagagttcatccgtaagcgcacggatataccattgtagcatttcacccgagagtattctaagggtatcgtatttattttatcccgtgggaagatcatgtagagagaactcaactaataatttatatattacttgtgataatgatattctaagcaggggtgataatccaagggtagagtgacacacaaacattagtactcatcctcataataaataatctaagctagatggaaagaaaagagaaagagaatctattcctatacttctaatatacatagtatatacatacattctagttaactgatatactagctaataccctctatccgatgccctcctggtacttcgagaatccacccctgactgccgagttccttacgacaacccgtcatgaccatccaaccggggctaaatacggaggaataccctccccaggaaattaacttaggattatatataggcgcggagttatacccgtattgagctatcaccatcagtggcccacctctcatccgcaatatataaccccaaataatgatatcccataatctagacaccacgtctaaactaccagatactactctaatatcatcgtcatgacatagagtaattgcataagcaaacactatacccgcaccagagcatcttccacataagctagcagtatattcagtataacatcaaacataatgtaaagtaggtactcgtatagtcggaaagtattccaataccataaatgtatatagaagagtattctaatgaaagtacaaagcttacaaaagaggaaaggaaagctactagagccatacccgaactctttcgaagacttccggactcctgattcctattctaattctattccaccagctagatactactaaactaaacttgagaggaatgagagagctcttgcttgagttgtgtgttgaagtgaagagagtgagctccttatatagaggtaggtatgacggttgtggaaggggaattgtccgtagtacactccaaccgtcataggggtgcaatcttggacgtacatgccaaaccctggcctcaatggtggagatgggggtttggcctaaccccctgggtcggccgaaccatgggctggcccaaaccagcccatctttggttggcgacttcctctattgcttcactttgtagacttgtgaattttagcccaattcatcgtgtcaattttgacttcttggcccattcatacataagtctatctctcgacatcgttcgattgatttatcgtctatgttgatgtaattctcctccactttattgtcattttctgcaaacggttagtagacctaataatagtggaatattattattctaacaaacaaatgcattgcaagcaccactactctcctctattttggtaatattgacggtcgaaactgattgata

SEQ ID NO: 80093 - DNA, 5400 bp, Oryza sativa
tgcattgccttgctcgccaagaaggcgagaatgctagagagagaggaagaggagaaagaagaggggagagagtatatatgacaggtggggcccactatttaaaaaaagaaaatgctaactggagtgccacgcgtacaccacatcggataaaaccgctctggattgggtcgaggggggtaattcgtccggtattgaaagtttagggggagcaatgtttttgggtttaggggggtaattcggtcaaccatgatagttcatggggttaattcgtactttttcctttgcgccacgttaataggcttggatccaccaggagttggcctcccaaaaaagaattcacgtttacgtgaaggcctcgttaaccgcataatttcacaggaacagaacacgtcgagcataatcctgggaaaacacctgatttccaatcggggtcagttgtgaaccaacaagctgcaggcgcaatgaacgaacttctctgtccagtttcaaactacatgcaaactgttctaagtcttacaaattcaacaaatattacggatatgcaggtgagttttcaacaaaattttagtgagatcaatgatgtgccgctagttttcatctttgagtgcatgttagagggcacatttacgggagtgtgagtatgacgcagtgtgttgtgcgtgcacgtgcatctgccgtgtaataaaaaaaaattcaaagcaagcaatgtaggagtaaaacgaaaactgatgcaaagcctttggtaacccattttgttttcctattgcacttcttgtaatccacaacacagtcagctacggataaaaggagctgacatcttagtaggaaggtgcttgaaacctctagtactgtgtttcacctatcatcctcttcaaggttaataatctgaagaaagatgcttgcagcagtgagagattttgggctaggcctaagtataatggtaccacaccggtttactgatgctaagatttatactctaccctatactcttaagctgctacttggatggatccttaccaaaccatccacagggtcaggtcatgtacaattacaagttagtaacctccaaatcctttttgtcagcctgccaattttatctagcttcttgatgaaaatggcaaagaactggtcgtggtttatagcaacaatctgttgtcctccaaagctgtgtgcaatttcaccaccaaccaaatttgtaccagattcttcactttggaggtaaatcctgttatttccatcgttcttgtgtaggtagaaatttctacctcccacgtctccaatcttatcgtttttgttcaaacctgccagcaaaagattcagcttttacttctataatcagatcactcaactatgtattggcaatcgaccaaggtaacaagataatgttggaaatttgacttaatagtgagtagtcacctgggctcaacgaaagcatttctagtcacttatgttcatatcctttgttccgtaaagaaaaacatgaacttattcatgttttagtatgtaacaactagtaatttatatggtccaacgtgggagataataggactcaggtaaacaaagaactgttggataccagcatcattacactggcattaaaacctgcaacctccataattaactatgttccgtataaacccatcagtataatttaaccaattatgggttgtaagttgaaagttcatactacacatcattttactgtgttcaggaagacctgaataaattttcactaataatagtagtagccaaactatcatatatacctgcagtaatttcatttcactcgaaataatgctacaattcttttgagtttcgcataccattcttctagttctatgttcccttaaggtgcgccacagcttttggatgcgtttcttactagattcactttacccttactcacaagtgcaattcgacatatattaagcgacgaatgtgaaggctcgtgttaaatgacttactctggaggcagaagtgggagtggtggagctggaaggcctccgcggcagctggatccaaacgtgggcttctcccctccttcgcgtacctctccaccacggctgcgatcgcctccccaacactcgcacccagccgaaccatcgccttcacaggcccgacgctcccctcgactgtcacgctcaccaccacctttgattcctgcaccaaacgaagcccagccaattcactcccgcgaaccgcgcggctaacaacaacaacagtccacttctgtacctccctgggattgcagttggacagggaggcggcggaggcggagcggccgaagggggagtccggggtgaagacgtcgaagcaggtgtgcggacgctccagcggcggcggaggcggggacggcggggagagcccccgcggctcggggtggacgcgcccgccgctcaacaagagcgccggctcggacgcggagcgcgcgagggccctgctcccctcccgccgcggcagcgaccgcgacgccggcgcggggcgcaccgccagccgaaccctccgccctccgctcccgctcccacgccgtcgcgacggcgacgaggagagccccgccggcgatcgacctagccggatgcttgcgaaccgggaccggctcttcctctccggcatccagttcagattcgagaccgcttgtttgatcctgtgctcgcgcgtggagatcgcggatggacgcgatgccgcggagctcgatgtgtttttggtcggtcggcggacggtggtgtcgtcggcgcaacgtttactttcgcgtcgccattacggcgagcttttttctgtgctttactcaacaaagggaggaagcttcccttcatggtgatcctcttccctggaactggtcttatggactgtactccatccgtggtacgcgtggccccacgttgtcagtgagaaaaaccgcgtaaaccgggagtaggcgtggaagagagggagttgtctcggcaagaatttggggtgggggtgccggcgtgtggtgcggaattacgtcaatgggcaccgtaccttcataaataacgaatgtgccaccgggtgtttgtagcttggttttttttctttttaagatcatgtgtttttagggatttttggagcttagaccttagagggtagtatggggaggtgttacgtgcgtgcgagcgggattcttttccatgtcgctactcgcgagaagatttgttgttttcttttttcgttttttcgatgatacgaatgcggaatttctatttctacgtcagaaaatccattgggccgtctaatatatttagagattcatgttgagagatagacctatatacttctcatgggccgtctgtatgggctattttttttgtgtactagactatatgggcctagttctttgggctctataggtggtggtgagcgagccattactgttcatttttttaaagtccgcatctacttttgctcagttctgacatcccacacatgtaagtgatttactcaagatataaggatgaatgataaaatttaaccaaacttacaacgggttgtaattattaggtagtatttgtgtgaattttgccaagatttaatgttgtaccaataatttttagaaattcatctagcctatctctatatatgtgttcccactttagaaatggatctaagcatctataaaaattatatttaaactcttcttgacctaaggtgatgttgttaggtttgatattcagttcatgatgcacatgtcacaagttacttgcttaatgatttgtatttatattttgtattatgttaagagaatgtttataattaagatataatatactctatgtgagttaatatgtttattaagtcctatgttcatgatatatgttcaggtgagtttgtcaagttagtttgtatgaatttgccactgattagaccaaaaaattcaaaatattaacaagtatataaagattagaagtaaaatcggcttgaaggccaatagatatatttacacagaaatgtttcaagtgttttgagcaaaaattttttaagatttatattattacatcaacccaagaaattttggattgtcgatatcgcgtgtaggcggatgtggtttacttcatcgatgatctttgcatcttcggcatccgaacctggcacaagcttcatagctttggtttgagcaggtagatgtttggtcaatgccttcaactttgatctttgctcttcaatggccttgggaagatcggctaaattctgtttctccaagcaatatattcttgtgagtttgttccaattttgccaggagatcgggttcttgctgttcaagttcattaatgcgcttttgggttgattctgggccagcaattagttcatcaagtttggttttgcttttgtttacttgctgcctgctagattggagagtcgattccatagccttgagttcaaggcgatctgctaatctttgttgaggtcgttgaaactagaatcgacgcgattcaagatgagctgccggtgtgatggcgtcaattatatcatcgggcagctgatcttggacttcttcaagtctccctttgatcgggccactgtcagtcactaaagcatccaatgaagcacccagtcgatcagctatgtctaacagtcgtgctctcaagtcatcagagatagaaaatttggtcttgcttgtgatgtcttcatcatcttcgtccaaaaattgccttatgtaagatgaaaacatatcggctagcttctgcgaagtatgggtgaaagatgagaaaaagcaaagatggccaggaattgtgatatgggtatgcttacttggattgggggtacaacagcagcagttatttcttcttctccctgttggctgccgatcgcggaagtagtacgttcacttggtgctcgtcgacgaggagaagacgatggagccttgggctgaaaatgttggatgtcagaattgataatatcagctgaaatgaaaggatagaaataaaaagaacttgccaatacatgagtaggagcgcgaggtctaacaatgcttgtatcggctgcttcattatcggctgagtctttgtcatctgcctctttgttttcattggtaggatcatcaaccacagtagcaggagcatcatcgacttgttcttcttccacttgttctgtcaagaactcttcaacttctggatcaatgggagaaagattatcatcggcagatgttttggatttagaagtcttgggtttcttggatgttttcttggaaattgcttctttacgctttcccagtgtctggattagtgttgatggtcgttatagaccagcttcgactgtcaatacaactaaaataaaagagaactagctatacttgcaatgcatattttgctttagagtaatatattttcacttgtacttggggtattaattgtttgcagagatttctacataaatgggggctgcagg

SEQ ID NO: 80094 - DNA, 890 bp, Oryza sativa
ttcacattagcctagaattatttaatgagagaatttaagtcctttgttttgggtcactctacccatataattatatatatagccaatttattttacacccctcccctagaaaaactaatttacacccccccttccaaagggcaatcccaacttccccaacctccatagggccaaatcccccctcccacctcagtcaaaggctagtcaaagcaccctcccaccggtcaaacccgagtcaaacccacccgttgactccctcccccgcccaccactttgttgttcacgtctcgcaggaatctgtagtaacataacggtcatcgtgcagtaacaggatagctttctcacagtaacaacatcgaaaaatagtcatgatggatctagttttgttaagcacttttttacgaacatcatagtgcaaacggattagaaaaatactatataacgtgagagatattgctctctaaagattgagatttacttttttttagttctcatcttgctgaaacggcgtagtaataggacgttcaatgtgcagtaacaggactactttcctttctgtagtaacaacgttataaaatagtcatgatggatcaagtttcgttaaggatttttgtctcaatgatcgtagtgtagtaacatgactattgtcttgttgtaacgttgttttaaagcattatggtgaaaacggttctaaaaaataatatgcgatgtgagagatattgttgtttaaagattagaattctaaaagtttacttgtattgagcttgctagatgtacttttaacacttgtgttaacttgtgaccagcacatgcacttttttaacacttgtacacaagattgagatttaaaaatttagcaatgtacaagcagtgatactgtagtagtaccg

SEQ ID NO: 80095 - DNA, 1221 bp, Oryza sativa
  unsure (1)..(1221): unsure at all n locations
ctgcagcccgactaatttgtcaaaaatagttaggtatacgtacgtagtaacttgctatgataatccgtgcatgtattactcgtctattccgccccgtggtggtccttattgttccttgcttttgccaaagtcgtcctctctggcccgtgtcgtcgtcgacagtcgccatggtcactacttatccttccaaaatacttgcccaggaaaaaaatattttgctggtcgaccaaaccacgatagtccccggtttaaaagattatntttagtcccggttagaaaccccacagccattctatgatatttagtttcgattgatgccgggactaaagatcattccctgtcaaatgcatgtcagggggcctaggatctttaagatcaccactttagtgccggttggtaatactaatcgagactaaagatatgactaaagatcatatctttaatctcggaactaaaattcaacgtgtagtatataatccctatcacttatcctctcctccacaatcgcaaatcacacagatcgaatctctccccctcctccttccccttcctgctcccctgttatacagatcttctacagatcagatcgatcctctcttgctcatcccctcccctctcctccacctcctcctctctcctccccctcctccccttcccatccggcagccggcggggccacgcccggcggcgggccggcggcagcggcgttgttttctgtctttttttttttgataatttgtgattcacagagatgtataattttctgattcattgtatcatatggatatgagatgtataatatgtgatgtatttgatttgtgtgtaattttttaggatttgtgatgtatttgatttgtgtgtataagtaacttttaagatttttgatgtggatttgggatgttactttgatttggggatttggggatttggggtttgatttggggatatgcatgccatttgattcgggagaaaaaaaaaggaaaatgggaccatttgggactgccgctattctctacttacttccggttagtaacatcaaccgggactaaagatccctctctttagtcccggttgctgttaccaatcgggactggatctttagtcatgcccatctttagttccgaatttatactcccggttgaaatcctgggactaaaggggttatcagccgggagtaaaaatggtttttccaccagtgttgtcttccccccattcaaaatt

SEQ ID NO: 80096 - DNA, 2092 bp, Oryza sativa
ccttgtcggatcatgtagagacaaatgaccatgtaagacctggtcatgtaagagttctcgccgtgcgtattaaccaagccatgtaatcggaaattgagttttccaacttcacagcagggggctagggtatgtgctttttcaatcaacgcaagtcaagggtccaagagccttatcctcgagaacgattctccaacacaaggctgggggctagggagagtgtatgactcaacaaactgactgatcgaagtcggtaaaagagaagacgctcgtacataaaacattggtctgtaaatttaattcattttcagttttccatacatattataacatgtcaccctttgagcgttcgctcgggggctatttctatttaatattcttttctaagtattgatttcaggaaattctattggatattgtcgaaggctccatgtctctatggttctataccaagatcgactaaggcgagtacgacgaatgttgacaaggctcagtcgcagactctgcgccttctcgatcactcgagaacggttggtggatctcgacaaggaatacggaatgaagagatggtgtacccgccgagataaaatttcttgacttcaatccaaattctcaattacagcaagacgagagacttagttgtatgctctgtactttcttggttgacgtcggagattaactcagacaaaccctataggtgcctgcacgaggctgataagggaagtctaacgttatctctgaactcaccgagaacagtcacgtgagctcgataacagttattccaaggtctgcggattgagaatatgaactcgttcatttgcattgaagtcgggggctactgtcagggttatggataccacatacctaatagtagttggctaaatctcggcaggacccaccacataccatgtcttatacggaaacaaccttcggatataggaggagttccggataaggaaagacaactagagttctacatggaaacgacaaggactactcggattgtatccatattggttttcctagttctacttggacaaggggacacatatgagtataaatacaaggcccctaggaggagaggggacacggaacaatagatcaagacacaagatcaacatacaagccaacatacgccaagacaagacgccaccggatatcgacatcagagatatgcttggactgaccctatccagtacctacagaggacgactgtagggatctagcgctgtctttgatctcctcgggcacgggttcgaggaggaagactaccctgttgtcgactacgtgatgatacttactccgctatgtcaacaatagttagataggctaccctaaatattgtactggtgtgattatggtgaataagagcaacgaccggcttcggccaacaggagtacagttattacctgacaattcaggggcccgaacctgtataaaaatccttgtccccatctcttttactacaatctcgcatatatcctagtaccaacgatccccatactatgtaaataccggaatcgcgatatcaaacgtcgacaccatgtaattagcaaaacatgcaattttatttgtaaaaaattataaagtgggttcaatatgctcaaggggaatgtgtacttgctcgaatcttcaaacaatccttcgaacactcatcctcgcgaacgcgatcttccgaaacggtggattctagacgctggcacgcaaaacgaggaaaagctctaataaaaaccaaataagtagtatgtgaaagtaaacaatcatgcaaatctcaattttagatgaattttgcaagatgaatggcccaatttggagttcgtatgaattagttgagaattttagaagttttgagccatttaaatgaatttctagaattaaacttgattttttgtgctattattaattatttttcttaaaggaagtcaatggttattgcatcagcagtggggcgggtgtggaccgagtccaccaaaggtgggccccactcgtcagggtacaaggggcagcaggccaccgtggaccaagccacggcgtcgatcggacggtcgagggtggccggtcggtatatccagcgaggaaggcaaccgtgcaagca

SEQ ID NO: 80097 - DNA, 5194 bp, Oryza sativa
  unsure (1)..(5194): unsure at all n locations
ccgttgtccccgagaaatctcacaccgtttcctctgttttcaccgccgaagcaaactccgtcctatctctctccggtgatcccctcggtgcacaaagcgatttctaggtgatctcttctccggccaaatttccgcccgcggcgatgtcgacctccaccagcccgtctaccgcgccatcagccgaatacgctgaggtatgtgcccatcagcagatccctcttttctgcacagtagattggttttcctcatctcatcttgttttcttctctattccttctggattcgtagcacatttccaatctagttgcaattccaagtctatcgcatgagagacattatttccttggtctgatcggcaatctcgaccctactgatttcatcattggcgaaaccaatagaatccctttcaaattggccaaccctaatctaggtcattggaagagcaccttcaagtcttggccatctcttgaaaaaacttgtctgtgaaaatcctccgagcaggggccgagctatccacattggcacccccagtcactccccacccccaacctagaaacttaggggtgatatttgtcaagcccagaaattcactagtaattcccgaacttatttgtgcataaaagcctcgtccaggaatcagccgaggtacacaaactgacaatttaatatacagattcatcataaaaataacgttacatacttacaaaaaaaagaaactgcagcggaattacggtctagcgaagctccggctccactcccacaggcagctcaactggggtataagccaaacgtcttctccttcgcaacttgtcttcaactgaggtttgattgattattgcaaggtgagcatatgacatactcagcaaaccacacaacaaatatgcaagtgcacaaggataccaaagaatggcataatatagggctcatttgcaaaagcagcatttagcaaacagttaagaattgtaaaacagtagagtaattaatcatcaatattaatcaacactgaacaacgctgcacaggcccaaccatcctgaacaaccatacccggctgtacagatctatctccaaaccaggaatgtaccattccaaaccaggagctaatcaaattattactagttatagcatcattcattatggtgagaagtgtgagactaatcacaaaagacattgttagacccgcccataaccgcgggcacaattattcgaatagttttactctggccagaggtgtaccactgtatccacaagacacgattccacacatgttaccatgccctgaagtaccaccacggcactgcaaagggggaaatcgtgactgtacccttcgcacaacacaactcaccacattgcaccattcccggatcatagtcacccccttataaacaaggtatggactccccagcgacccccgtgggcttatctccaccacttctcaacctggtgctctgcaatgaaccatgctatacaaaaggtaaagccgttgcccacgctggcttgtggttggcacggttaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataatagtaagtcataagttatcccaatagtgtgctaatgtttctaagcatggctaagcaatcatatctaatatctagctgaaccaatatataaagctcaactagtcaagttataatatcccaaggtatcaaggaatagagtaatcaatgcaaacaggccataacaaaggaataggttcacaccacccggtgacatttgaaaataaatgcacagttgaaataaatagagaatttaaatataggatcaacatgctcaaaggattgtgtttaggatctgtgtgacttgccttgcaataatcggtcttcaattaatcttcttgaatacttctggcgcactcgcgaaccttcgccacgacggaaacgacaagctaacacgcaaaacgaggaaaaagactaataaaaaccaaataaacaatacataaaaagtaaacaaacatgtagatcataattttagatgaattatgagacttgaacggcctcattctgacttaatatgaatttaatatgaattttacaagattaaatctaattaaagcccatttaaaaagaattaaataaatttaattcaatttatggacaattttaatatgtagatctttattttatataatttttgcaacttgaaccacattaaactgagttcaaatgaattagttatgaattttcaaagattaaatcggattaaaacacttatatggattttaattgaattatgacgcaataatgaattatttttgaaaaggaaaagggaatttattgcgtcagcggctagggtttcgcggtggaccgggcgcacggcggcggttcacgcgaacggatggccgagatcgatccatccaaaacggacggccgagatcgatcggtccacaaccggctcacggaaaagggcaacaataacttcggcaataacgtcaccaccggcggcggcggctcaccggctcgaacggcccaccctcgccggcaaacaacggcgcgacggcccaaacggagagcaccaacggttagagcgcgacgcggcgaactcaccggtgaccaaagcaactgctggatgagcaacggatggcgcctgtgacgatgaagatacngcggcggtttttctggtcgactgtgacngcggtgctccggctgtctccggcggcgacgaagaggcggacgaggacggcggcgacttggcgaccacgatggcgacctgcccgagcgacgacgacgaccggaacggcggcggcgcatggctggagcggcggcgacgacggcggctcgaggttacacggcgctagggcgcttccgacggcaagagacgaaggcgagggtggcggcgggtaaaggagacaccggggatccttttaaaggggctagcgagctgcgacggaggcccacggcgaccggagacgggaaggaaaggttagggttcggaggaaagaaaccgatccgattcgacctcgaatcctcgagtttccaaaccgaattaggcgattattccataagagaaaaggaagaggagatcgagaagatcatttcccctctattgatttccccggatcgggaaaggatcgaccggatttggaaggagacgacggcggcgcgacgctagggttcgagcggcggccggcgcgaggaggaagacaggcctgacaggtgggccccacctgtcagcggcaccgagagagagaagagagcagcggctcgagctgggccgactgggccgagaagagagagagaggaggttttgggccggctttcggcccaaagccaaaagagacttttaaaaacctttttcaatttaaattattcatgaaatgcaattccatttattaaaaatacttccttagctcaaataaatcccagaaaaatctaggaattatagaattaagcaaagtatttaacaaaattttatctagcccaattttatattgagatttaacagattaaaattagatcttctcttctaggcttttaaaatcatttctaataattccttttaaacaacaatttataatttaaggattttaaacaagaaaagctcttaacaaatataattagatcattaaaatcaaataattactgaactgttctttgtatcatttaggaattgagctccgaaaaatccgagaaaatttcagagagttgacttaatcatggagaatttaataaaaattaaatccatccatgctttatattaaggaaattttatttcccacatttaacttcacttgtaaattaatgaacatttaatataacttctaataataatttattaaataatttataaatcctgaaacaaaaatcaggatgtgacatatttggtccctcagctgcggcggtgagctttgagcaggcgacggcggggctgcgagcttggaagcggcgatggggtgacgcggacgaggccacgcagaacaaggcggcgtctcgcgccctcgccctgtcgcctggtcgattggatctgagaggagggggatgggaagactgagaagtggagacggtagaccagggtttgctcagattatatatgtggacctaattgggccagtctaattgggttgtgggcttaggaaatatagcgtggcctatccacctcggggacccatggggattcggggcctggggactgttgaacggctccgcccccggcccacccgatgagggcttttcttttttgccgttttcagccccatggatggtagttttagcccatttacatcccctaatagagtaattccccaccgggtgtgaggtgtcggggccccattgccatccctacttgcaggaatttgtaccagccagccaggtttatcgtccaattgaccacacgatcacaatcgaaactttggaaggttagtatactacacccaacttaagtgtcgatcaaattttattgaatgattctttaagcctctttagcaattctactagtaatcttacacgtgcaatgcacgtcttgaccaatatgaattaagtccagtgtaatacaattgtaaaaatatgttatatcaaaaatcaaatttacggtggtatatcgtccaaagctaggatgggcatttcaataagccaatgtaagtgtatacgtggaatccacatatgtaataaaacaaccaatgtgtaatatttgataaattataaatgcaatgagttaagaaacaaataaacaacaaatgtactatctgcattttaaatatatgatattgttggcttttggacatttgaatatttgtctaattcaaaattttagtatgaatacgcaaagatataaatataagtcatgcttagaaggacttttaagcatgacttaaatttacataatttttagattaaacaaatggtcaaacgtcacgtccaaaaatcaacaacgttatatatttaaaaaggaggtggtaatttcatgcatcaaggtgtgacatcaattttttttaatctgccccatttagtattacaccattcagaaatcttggtgtaaataaaaattgttcatgttgcgtacataaattcttattgtttcctatgtgaaaagaggggcaataaaac

SEQ ID NO: 80098 - DNA, 1153 bp, Oryza sativa
gctcggtacccgatggcatatgatggatggacatcgtgtgggagagatcttcgcaacgggcttcacgaggtgtgcgtgcaagtgccggtgttcgctaagggaattgtaaagttggagtagtatatggtgctacagtacacgaggtactgtagcgtgcaggtatgcatgcatgtacggtgctgtacgtgtatgtgtgatcgatacatgcatggtgaagcatgtatgtgtgcatgactggttggccgagcagcaggagagcggctcggtgggcttcggtggctgttggcgacatgccaagtcggcccaggagaaagcaagggccctgctggcagcgagtcggtgacggtcacacgtggatttctggtgcgaatccgttttggatttctggtgcggccggttgtttgctgcacgtttggaaattgtaaaacgtatggaaactgaaggatggagtcctattgtgtataggagttctacacctactttgagtaggagtttttgtggtataaatagagagggagcgtgaggcttcctgtatcgctttagagagcaatagagttgagttttggtttagggtttcgagtttagtcgaaatttttgtaagaagtgctgttgttgcactttataaacatagagagaagtaataaagtcgtcatccactttaagagttcttcgatttgtatttcaccgggtttcggcggtctaaccggtaactcaccagtggtcagaccggcggcattgcggcggtcagaccggcgggagcgaagcggtcagaccggcggcggcaacaggtgcggcaggcgacttcagcgatcagaccggagattcaaacaccggtcagaccggcggcatccactcggtcagaccggcagatcaatctcggtcagactgacttccgttgatttcgagggtaacttttatttccgttaaaatttttcggtttttgggtataccaaccattcacccccccctttggttggcttagttcttgtgattcgatcctacaacagcggatcacgagtggacttacctcccctcgtcgtgatcgccttaacattttcaatggaggagtcgggttgccccggaatcctcccagattcatttgcagggactaaagatgccaactgagctaactgggtttctatcatcttattaa

SEQ ID NO: 80099 - DNA, 1125 bp, Oryza sativa
actgagctactgggtttctatcatcttattaaagctcagttggttttgaaacgcggaagcaaagccatctagcttgacatttatgttttctaagaccttatcattggcagcaagctttttgcttagcgcatcagtggttttagcttgcgcaaaaacaagatacttcaaggagggctggttagagatgttggcagagggagcagcgaactcgcgaagagtcttgctgggcattgaattgaaggtcggtggcattggtacggctggtttatctgtcggtagagttttctgtggagcaatgactcgcggcctgacgctccggaagaaagcttctggattttctttgaagttttctggcaggttgaaaccagtcatgcactaccctgttttcacaataaaaagtgaaaacaaccaaagttagcctgcaaaggaaaatgattatacaaagataaatataaagtattagttcaaataatctctatcatgaatctttcccggcaacggcgccagaaatgcttgttggtatttcttaacgacattactagaaatgtaattcccagtaatagcgcagaaatgtatattatggttacagagttcatccgcaagcgcacggatataccatcgtactatttcacccgagagtattccaagggtatcgtatttattttatcccatgggcagatcacatagagagaagtcaactaataatttatatattacttgtgataatcatattctaagcaggggttatgataatctaagggtagagtgacacacaagcatttaactactcatcctcaaaataaataatctaagctaggtggaaagaaaagagaaaggaaatctattcctatacttctaatatacatagtatgcatatattctaattaactgatatactagctaataccctctataaacgatgccctcctggtacttcgagaagccactcctgactgtcgagttccttacgacagcccgtcatgaccatccaaccggggctaaatacggaggagtaccctccccaggaaattaacttaggattatatataggcgcggaggaatacccgtactgagctgtcaccatcagcggcccacctctcatccacaatatataaccccaaataa

SEQ ID NO: 80100 - DNA, 2178 bp, Oryza sativa
  unsure (1)..(2178): unsure at all n locations
cccttggtaatcggtggtttcacccatataatcccataccaattggattaggctattacctatcaaggggcctgaaccagtataatccctgttttctgttggctccatgtggtactaggtagatcttggtaccaacataccccaataccatctatatccggtctacgggtatcccccgtcgacacatataatggtatttgagcaatggcaaacccctgaaatatgtgttttgcatgtcattcaccgataaaaaaagatgccaaattagtgttaaaaaagacatatattgatgatcggccgtatatatgttacttgcaagtatattagttcatctgtcaactacctaaaaaatgcaatcaaacttttgggatatgtacacacaaaagaatcaaatagcatgaatagtaacagcacatgggcaccctttgtggagagtgactcgctaggcgagcagcatgcccatagatgaattcaggaatatagttcgactcaaaatgtgatgggaaatatggaaaaaggaatttcttaaattgatagctgctgacctgatgttccaagaggaattggataaaaatcaaagcagtttggtaaacatataatttagttcagcaattatatataactaaacattattatacagctaaaccattcaattgctatgtcaataatcagtaggaattttgatgattagtaccattataaccccaaatcaacggatctacccttcaattttcctcactgaacaacctcgaaatatgcaactcgctagctcaaaacagttttatgccaacccaactaacttggtgactccagtcccaaccagctcaaaatagcacggtagcacttgcatgagaataaacagggaatctagaaggatccaatacctgagtgagatgatccccggccaacccaatgggcgcttcaccttgtgaagaagtgcacaaatcacaagttcccaagaattttgaagaaggtttggcggaccgatggccaaacttggacgacgcgggcacaaaacaccacggcgccatcggggaaagtcccggccaaggctctagcggaaagnggatgcgtgcggcgaggagtcacggcagcggtgcgctagtctagcggtgcatcgttgcagatctgtcgcgaggaggagggagcatgctgcagagcgaggagacgaggaagatcggggggcggagtcatcgggcggggaattaatcaacggagttggtggaatcccttattaatagcatacaacgaggaagataacggacggattagattagattagatagtggatacacagattagaagacaggggatgatttcacgtgtaagattgctagggacaacttctttttatattagtatatagactagaaaaattgcccgtgcattgcaatgggtgaaggctattttaaatttaataataatggacgggttaggtaaggttcaaatcaatggtaagaattggttggaataaatatttttttagaaaatcatgagctgcaattaggagtctgatcatctcaagttagcatgtaagttttttttaaagcgacttcttatacaactgcttctgcattttcaaaagggaacgaacttaaaacccgactcaaatacagatttgtatttccaaaagcgaacgaatttaaaaaccaactcatacatagatgatgtaccaaagtacggacaaaaacatctttaatttttataatagtttcactgtgagaattcgcttgtatatatgttttttagaaaatcatgagctgcaattatgagtcagatcatctcaagttagcatacaagttttttaaaacatattttttatatgactccttctgtatttccaaacgcgaacggatttaaaacctcactcaaatacaaatctgtatttctaaaagcgaacgaacttaaaaaccgactcatacacggatgatgtaccaatgtaccggtaaaaacatcttcaatttttataatagtagagatatgctcaattggttcagtttagtaagtctgaatttcacatgaattttatctgaattctatttgagtataatagtagagcttatgatgttttccatgcatgagtaaatgagtaatatgaaagttctgctgaatttgtttctgtaaacctaaagaaagaaacaatatcgacaatcttgtacacggaggatcaacgggaaa

SEQ ID NO: 80101 - DNA, 5961 bp, Oryza sativa
tgcttctcctttccttgggcggttgaaagatagaacagcaactagagcacaaatcacccaatctttattcaacttttattccagaagttttcaaatgattttgcaaaagaaagccaagttcctcatatgattaactcagtctctccaagtgtatcaatatgaattcctcaccatttttgcctttttgattcctactctaaggtttgatatgtggagctcggtagggatcaaacatggcatacttgcattcacatttattaccaaatcaaaaactcagactaaagaaaatgattaaacatactcaagatcaagatcgtgcaaagtgtgtgtgtgatataccctgtttccacaacaaaagtgaaaataaccaaggttagcctacaaagggcagtgattatacagtggtaaatataaagtattagttctagtaatctctattatgaatcttcctcggcaacggctccagaaatgcttgttggtatttcttaacgacattactagaaatataattcccagcaatggcgccagaaacactcatggtatattatggttacagagttcatccgcaagcacatggatataccattgtagcatttcacccgagagtattccaagggtatcatatttatttaatcccgtggaaagatcatggtagagagacctaactaataatttatatgttacttgtaataatcatagtctaagtaggggttaatataatccaagggtggagagacacacaagcagggagctactcattctcataaaatatctaagctaagtggaaagaaaagagaaagagaatctattcctatacttctagtatacatacatcctagttatccgatatactagctaataccctctatccgatgccctcctggtacttcgagaagccacccctgactgccgagttccttacgacaacccgtcatgaccatcaaccggggctaaatacggaggaataccctccccaggaaattaacttaggattatatataggcgcggagttatacccgtattgagctatcaccatcagtggcccacctctcatccgcaatatataaccccaaataatgatatcccgtaatctagacaccacgtctaaactaccagatactactctaatatcatcgtgatgacatagagtaattgcataagcaaacactatacccgcaccaaagcatctcccacataagctagcagtatattcagtataacatgaacataatgtaaagtaggtactcatatactcggaaagtattccaataccataaatgtatttagaagagtattctaataaaagtacaaagcttacaaaagaggaaaggaaagctactagagccatacccgaactcttccgaagacttccggactcctgattcctattctaattctattccaccagctagatactactaaactaaacttgagaggaatgagagagctctttattgaggtgtgtgagtgaagtgagaaggtgaagtccttttatagctgaactatgacggttgtgacggttggaatggtcggtaataccctccaaccgtcattggggcttcatctcaaccgtccagccaaaacctggatccaacgaaggcgagggaggttcggccgaaccaccaggttcagccgaaccttgggctggcccaatccagtccaatttcggctggcggcctcctctgctgcttcacttcgtagacttgtgaattttggcctgattcatcgtgtcaaatctgtgtgcttggcccattcatacacaagtctggttctcgacattgtccaattgatttatcgtctgagttgatgtcgattctccttcactttattgtcattctctacaaaaggttagtagacctaatactagtggaatattattattctaacatatttatgcatagcaagtatcactagttctctcctgttttagtaatattgacggtcgaaactgatcgataatgaccgtcacatgcagctacctctatctcaatgtcttcaacaaaaggtaaaacttgttatgatggcttgcgttctcgggattagtgcttccatctttatgatactctaatcttgtttatgtaattcgtcaagttatcatatatcttacataatctctagcaatatcgctatctaacccacaatcggctaacatctgttaatagagggcaaccgattaggttaaatatcgacgttggtttagattatataagatatctaccactctatgaaacttccagcggcttaattgtctagatatggtcttcttttcatacttaatgctgcatcagttgagtttgatctattaagtcgtgcttagaatatcaatctttagccctgccttctggttgccgattagggcagtatcggggtttcagccaatcttatctggtttaactatatttgctctatacgctccattgacaagttagatccgccctttatgtcaagatattattgcatttaagtatattacgcttctgtttagtatattctacttgttttaacatcttaacatagagttgtatcggagtactagccgatacatgctagatctatctgattggctatgctataaacatatatagtcctgttattaatatatatttcaacctaagtgattaatactgtctcggcatggcgaccgatctatcccaatcacttggtttaagtatatatcgatataagaactatatattgttgatatctatagccaatcgagtagatttagttctttattatctatttataaccgccgatcgatttacatatgatatcggctcaaaaataaatgatacgtcatcggcacctagccgatcggctatcatttataggtttaaccacggtttctttgtctctatttcttgttgattgcaggatcaaatcaactggcacgctaacacacccgaaggcgagctttggacctgcactggagttaagtagatctcccaggccttgtgtttcacgtcaacacgctcttggcacgcctggtgggaccaagaagaagttagcaagcaattcttcctcatggccgagaaaccaccgctgtcgccatcctcggctagtccaggcactgttaaggaaaagatccagaagttaggattgaccgacgtcaatgaaggaaacgtcgtgcccatcgatccagaaaaattcacacctgatcaaaagaaagattttgacgcgatgatgcagcaggcacgcaatcagttcttgaactcattcatgcagactcgcaagggaacacttgttcagaagtataaagtaaaggtagttgctgatgatcctgggaccagttcttctaaaggtgaagacgggaaacaagctccggatggctcggctcaaccgagtgacaaaggtgctacagatggttctctaggaagtcaaggtgacaattctcaaggagtccatggggttcaaggtgagggggtgcatggagttctaggtgatggtgctctggggttgcagggaggaaattttaatcaggatggcaatgcatcacaggagtttttcaataacttccaagatcgggttgactatgccgtgcacaatgctttgatcaatcaatctggggtgttagtcaatacattgtcaaatatgatgaagtcaatggtcgatggtacaatagctgaataccaagctgcaggcccagtttatttgcaaggaggagtatttccaaattaccgaccattgatcaccaatactcatccacctgttcaagcagctccttctattgcaccatcggctcagccgatggcaccagcatcagctcctgcacctaccgtaccaccttcggctccaggccaattgatcaatccccgactgctgataagagaatagccacaacacgctggatagaatgtggatcggctaacacaagaccaggttgcatcccatgtttttgcctcctcaaaacactgttgatccaacccagcagcagccgattcagcaaacaccaccaaggcagcaggttgtgcaacccatacagcaaacacccccaatccaacaagttgtgccaccagtgcagcaaacaccccgagctcaaagagttgtacaaccgattcagcaaatgccattaaggcaacaggttgtccagctgattcaacaacaaggttcaatgaatgcatcggctgggtttgcgacacctggtgggcggcctgtgcagcatgctacaaatcaggttgtcccagagcatttagtccatcatgtacaaccagatggcacggtgattccgcaagttattcctgaacatttggtgcgtaatattcagccggatcttcaaaattaccaggggggcaatttgaattatcaatatcagccaccgtcacctcatgttcaacaccagcaagcaggatcagctcagccccaatttgttcctcaatataaccaattcgagccgatgccacaacaacctcaagggacacctcaacagcggccatgggccgatttgattgcagatgtcataaaggagcagttcgggctcaggccgaaagatgctggaaatctatatcgacagccatatcctgaatggtttgagagagttcctttacctaaccggttcaaagttctagatttttcaaagttctcagggcaagatagtacatcaacttatgagcacagtagccgatttttagctcactgcggtgaagcatcggctgtggatgccttgagagttaggttattccggttgtctttagctgggtcagcctatacttggttttcttccttaccatatggatcaattaacagttgggctaatttaaaaaagcagtttcatagctgcttctatagtgggattcatgagatgaaattgtccgatctgacgtcgatcaagcaaaagcatgatgagccagtacatgagtatattcaaagattcagggagatgagaaataagtgttacagcttgagtttgactgatgcccagttagccgatttggcttttcagggtatgattgctccaattagggagaagttctcatctgaagattttgaaagcttgtcacaccttacaaagaaggtagctctgcatgaacaaaggtatgcagaggctaggaaaaattctaaaaaggttaatcatgtttgtccttatatatatggatcggatgatgagggtgatgattctgagatagatgcagtcgagtgggtaaggagtaagaaggttataccatgccaatgggtaaagagctcaggtaaagaggagaagtatgactttgatataaccaaggctgataaaatttttgacttgctactccgagagaagcatattcaacttcatgccagtcacacaattccatcggctgaagaattgggcaagaaaaggtattgcaaatggcataattctaggtctcatacgactaatgattgcaaggtcttcaggcagcagatccaagcggctattgaaggaggcaaaatcaagtttgacgattctaagaggccgatgaaggttgatggcaatccttttcctgttaatatggtgcatacagctgaccgaatagccgatgggagtcgtgcaaggggttttcaggtaaattcggctaatattatcagcaaatatcagaggaagtatgacaagcagcaggagaagcattatgaagaagatgatgatggttttgatcctcattggaatgaaggtatgaggctgccatctatcgaagactgtcctgggtgcagtgatattgctgagagttcaagccgatcatatagtaggggcaatcggctaaggcagacaagagttcctgttcatgaaagattgggtccagtgaatcaagacatagccaagaggacaatgaaatcaggaaaaatcagtggtgtccatctggtattttcacgaagaatcataagagaagggttcaaagattgaggaacagggagcacttttaggaggtcgaacaagaaattaaccattggctgaggaaaacaaagccgaggcaggagtggcgtgttaagaatcaggttcctgtagccgat

SEQ ID NO: 80102 - DNA, 1606 bp, Oryza sativa
tccagactttgaccgggtatgcttactctttgggtgaacgtgaagcttatattttgtcatgccatcttaagtttctattttaataggcctatagtctaacgttactgattttaactttttgtttatgaagattgattggcttaacaagtttgtcgaaaacatttggccttatcttgacaaggttggctcatacaagctagtgcaatattatttgtccaagtttttatttggcactgttttgtaaatattgtcttttacaggcaatatgtaaaactgcaaaggaaatcgctaagccaattattgctgagaacactgccaagtataagattgattcggttgaatttgagacattaacattaggttcattaccaccaacatttcaaggttagttctactcttatatcttagttgcagacattttggatcaatttaattacacagaagtactttttagccaaaagttgctacatcgtaaaaagacttttcatgctaagaatgcctaactaatttgatcaagtaaccatggaagattcagatccacggctaattgaaacaactatatttatgaactttatgtgaaatatcacatttttgttgaagagtcagttatgaaactacatagtcctttgtcagaatagaaagagtatggcccaaagggccagttacacttagtttatattatttttaaagttactttattgaatttatagcttatgtgccaaatgtgagtatacctagcaacagcaagttgtttaggtgtacattccagtcttacaactctgttagcaaccgagacttccaatctcaattccactcaaatatgcaagcatccagtgcaatagcaaccaaactccagtaaatagaggtggagaggaggatgaactaagggaattcaactggtggaagatgccagaaacttctggaaggaagaggaagaaggaaggtagggaggaagaagatcgacagggccaaccggccaccaggtcgccgccaccgttcgccattcgccgattgctcgatcgatctccccctagaagtgcatactctgttgttttgtagttcctctcctctcgggctaggctttggaagcgacggagccagcccagcccacttatgttcctaacaaactcatgttattggccctactcttgctcaagcactcaggcttctatctggatttggattatcaataatcactaataaaatgaaaccaaaaataaagtaactgcctagcttaacttaggcttccaatccaggtaaacctatttgaagtttgaacactcatttccgcgtcaatgagaaacgtgcaggattatggggccaattaagcacttttgtgataaagctctcttcgacctaccttaaaaagaaaaaatgtatgttagcggagttatagcatactagcatatggcctgtgcgtggcaccggatttttaatcaaaaaaaattatcattaacatgttattaatatctcttaattgttgaacatatttgttaatcacatgtggacctttttagtcccgcataaatcctttttccttcccacgaaaagtagagagttggtgggagtagttgagatgtggcccctctagccccacatatcattt

SEQ ID NO: 80103 - DNA, 15556 bp, Oryza sativa
ttgcattcctgaagttgtgccaggagctcaatcttgcgagcctcgagccaatcaatgttggatttgatcggactctccgaaagctgatcaagtttggatttctcctcatgcacaagctgacgattggcttggattgtggcctcaatatccttgcgctctcgacattcggctagtcttaatttggacttttctagcttgaattgatgttgctcaagatagaccactggagtaaggatattggctagctcatctgggattagagcttggatctcatgtagccgagtcctaattggcccacagtttaccaccaaattatctaatgatgacgcttccagccgatgagagatatcttcaagtgttttcttcacatcatcgggtaagggagctaaagctttgcttgaagtatcttcttctgcctcatcaagataatctctgatgtcaaaggagaaaagatcggctaaaacctgcagcaacaatttcggaaagagtaagagctgggtaaaatatagccgatctaattattgagacaaaggaaaacttactgggatagcagaagaagctggttgttcttcctcctcgatgtgatgactccccacggccgatggagtctggtcacttgacgattgctgtacaggaggagaaggaggaggaggaagctgtaggatagataagtgttatatagagtcggttgagattgattaagtaaaagaattaaagatatcttactggtggagccgacttgacaattgtcgctgctggttttttcttcacagcagttttcttcttctgcaaccacaaagtccatgagtaattaactaaagagggaggtaacttcagaagaagtcaaagagagatacttactcttctgaaatgaacgggggcaggagttggaggcgtttgcttgggtgaagccgatggtgttctttctgtgtcactcatttcagctacaatctggtcaatatcttcaccaatttcctcttcatccagagcttgttcaatagatggatccaaggcaggcagatcatcggtcggcttagttttcttgaatttggcctttttctttggagctaaggccaaggtactcacggccgatgatctggttttccttttcttgcctgcatcggctggttccctggttaggccgtgaaggagagttgaagtcttgggggcatggtagccgataacggggggagatagtccacctccattcggaattagtcctggagaatattcaatgttcctgccactgttactttggtgtggcggggaagagtcgattgtctgcagaacaagaacaagagattagtcaagtaataaatcggctaacaattattcaagctaacaatggtgaggtttacctaaggtatgacatcagggaatagatctgtcatatacatcgaagccgattgatgaaacaagtgcagcttccattcaccccaccatctgtcgaaatttttgcttctaaaccctgccaactcaatattatcaatgctgcccagagagggtcctggtaggttaagtagccgatccatcattagagtggatgcgatttctcctcagcactgaatcttgtcgacaaagaataagccgattgggagttgtcctaatccaagttgtctagccgagctcattgggtgataaaactcataggaaacttggatatttcttccttgatgaatgccgacaggaaggatgcatgggctgattgcggctgtaagaacttccctggatttttgatacttttcatgattgatatcttcaaatctaaagactgatggaagttcaagatctgctgagtcttcataaggaaaccaaactcgggcatctttcttaaagccttcatagaagccgcagaaccaatccttgagtagctcggccgatagctttgctctagcatcggttggtgtggacgcatattccccatatgatgtgcatctacgatgagtgcgttcttctccatcatctcctgcaatcggctctggcaatgggaactcagcatctgtcacagatggccgattgacgactttcatgaccattaggttcaaccaggtttgcagcagccaccattgtccacctgcaccaactactgagccaacggctatcttggccgatgcattgttcaatgtttcgtataagtagccgaggagaatcttgcctaagggaaattctttctttgattctaaggcttcggctacaaattgccagttggttgtaggaccacaactggatccacaaaagagaaatttttcgagccacattagcaagaaggctacatgctctcgaggagtaacagatccttggcccatatatgccgccacatagccagaccagccacctatgcttttggttctgaagtcaaactgatttttgctgttcatgctcatgggattagccgatgaggttacatctaaaccggtgatcatggtaatgtcaatcaaagttgtggtcatcggcccttggttgaacaagaaggcgttaatggtgttggactaaaaataagaggcggctgccattaagggctcgtcgttagctgagttggctatggttaggtcaagtgcttggccgattccaatctcatcccagtgtactttcttactagctgatacgcgctggtaccatgtaacccaagttttctcaggggtggttttctcaagagatggccaagacttgaaagtgtttttctagtggctcaggttagggttggctagcctcaaggggatcctattggtttcaccgatgataaaatcagtggggtcaagattgccgattggacccagaaaatagtgattttcatgcgacaggcttggaatcgcaactaggttggaaaggtgctgcaaatccaaagcaaccgagaagaagagagcaatatgagacgagaaaaatcgatttgctgttgagaaaggggatctagccgatggggacttacctcggcatactcagctgatggcgcagcagatgggctggcagaggatgacatcgctgtgggcggagatctcgccggagatgaagtcgcctggaaatcgctttgtgcgtcggagggatcgccggagagagagaaggcagagtttcgcttaagcggtgaaaacaggagtaacggtgtgagatttctcaggggcaacggttagtatttaaagcgcttgaataacggtcggaaaacggtaaagtgcgaaacttgctcggagtcgatgttaagcaaatccgaaacattaccaaatattccggacttggggggcatgtgttaacgaccaaatttgctaatatcagcatcgaaaaagaggattagatcgaagtggagtcgaaggtggagatcgattcgagaacagagaaagaatcggctggagtccagatcagctacgattaggatcggcaggatccgagtcagattgggttaagtgatacagccgattccgacaatatgacttgtatgcgatatcggttttgagttgacgtacttcatgatgattgccatagatggatagagtcctggggaggcaattgtatctattaattaggataatttatgtaaattccttagggataaatataggcaaaagtctgccgtagagacttatggtatcttagagcttgtttgagataatagtcgtgtccggtatggacatatcttgtaattcttgggtataaataaaccccgagccctatgtaatttttaaacacacacgttcaatacaatttcggcgcatcgccacccttttgcttttgttttatttcgacgagttcttgcttttgggttgagctgcatcggtttcgatcttcaacaaaaggtaaaacttgttatgatggcttgtgttctcgggattagtgcttccatctttatgatactctaatcttgtttatgtaattcgtcgagttatcatatatcttacataatctctagcaatatcgctatctaacccacaattggctaacatctgttaatagagagcagccgattaggttaaatatcgatgttggtttagattatataagatatctaccactctatgaaacttccagcggcttgattgtctagatattgttcttcttttcatacttaatgctgcatcagttgagttcgatctattaagtcgtgcttagaatatcaatctctagcctgccttctggttgccgattagggcagtatcggggtttcagccgatcttatctggtttaactatatttgctctatatgctccattgacatgttagatcttccctttatgtcaagatattattgcatttaagtatattaagcttctgtttggtatattctgcttgttttaacatcttaacatagagttgaatcggagtactagccgatacatgctagatctatctgatcggctatgctataaacatatatagtcttgttattaatatatatttcaacataagtgattaatactgtctcggcacctagccgatcggctatcatttataggtttaaccacggtttctttgtctctatttcttgttgattgcaggatcaaatcaactggcacgctaacacacccgaaggcgagctttggacctgcactggagttaagcagatctcctaggcctcgtgtttcacgtcaacagttacccggcggggataacggaggatgtgccagtcaagatacgggatttcttcatcccggttgatttcgtggtgctggacatggacacggggaaggagacgccgctcatcctgggctgtccgttccttagcaccgcaggggccaacattgacatgggaacgcagagtatccgtttccatatcaacgggaaggaggaaaagtttgagattcaaccgaggacggaacaatgctccatgctcagaatcaagtacgggccaaacccgcagaacattcaagtggtcgaagtggagccacccaagacggatagcctggtaaggttcatgcagaacttcctagagaaggaaacaacaatgcccaggaacccctattggaggaagtcggtaaaatcacatataccgcactgaggtaacgaaacatcactgtgccacgaccgcactgaccgttggattccaacggccgaaagtggggccggttgggcccactaggggttcgaccgaacaccctggttcggccgaaccggctaggcaacagtcggctgcctcattttttgaggcaacggctagtgggccccataggtcagttttgaccgttgtgggtgcactacttaagccaaccggctagtgggccccatttcaacacattttcattccccctccaaagtttgctctcaagttcattcaagcttttatagttttcctcaaattcaaatctttagtttcatacatacaagttgctttggtgaaactaaccggcgggtgatactcttgtcatttctaacccccgccgagttagcctgttcttgctccattgtgcagtatgaggaggcgactgtctcgtctgttcaaagggtcaggctctcaatcaagtcgtcatgacaagtctagtactcgttcatcagctgatgtctcaatggaagacgccgacgctccgcgacaactcctgagtgacgctgacctcgaccttgtcagtgatcgggagagacaagcctactacatgctgagcgaccgggagtatgctcacacgcgagtatactcaccggagttgctgaaaaagataggtatgcatgttgaatttcgttctatttggaaagatgttggttggcagagatttgctatggtagatgagcccggttcttgcttgcttactttgcaatttctgtgcactttgaaataaatagaagatggtatttcttttcgctttttccataaggagttcacactcacatggaaaggcttgagtacacttcttggttttcacgattcctggaaaatcgatctccagaaaggaatttctgggttcgagaaaaataggttttgggaagatatttctggtgctccaatttgtaagaaacctacaacgaatgatatccataatcctacacttcggctcatgcacaaatggattgctatgtctttgttccctagaagtgatctgtgacccattagggggatgaattaattatcatgtttgccatggttagaaagataaaaatttctccagtgaagtgtatgataaggcaatggttagaaagtataaagttctctgctcctgttgagtgcacttctctgattactcggatagcaaaagggctaggggtcgttagcgaccaaattgctcttatctcagccgctcgtccgcgtattgatgaggcctatctagtgcaagggcatattttgaaacatggagcagatggatctttgatatactttttccccggttgtacaaatgaaatcccgttgccaaatgcggggtatcatttgtacaactgccatgaactaaccattcccctgcagaccaaagaagaatctcatgcaggtggaacatacagggagacgcgcaacatgacaaggaacgaacaagcaagttcatcatcctcaacacccgtgcagatgtatgaggcaggttggacaccaactggggatgctccaggatggacccaagctccacgccatagcatcggagtctcaacctgggcaggcgccagtgaggaccggtggcatgcgcctcatgacatccactggggggacaaccaaccctcaaagtgaatggcgctcaagttcctcacgttgggacttgggtgaaattactaggagaatggacacccttgatgtgcagacgggggagatccagtacgacctcgcggaacacatagcccaaacgcaagaatggcagcaatctgctgatgctcagttcaccaacatcaacaacatgacgcagcaacagcatgatgaccttcaggcgtactttcgctttcaggggttcaatccttaccaaggaccctgagcgaaagcgaagcttgaggggagacctcgctctccccactgaggtaacttgtatcacattgcatatttcccttcccaattgcataattgctttccaattgcatcgtataaaccttgaaaaacaacataaaaaattgtaaaatagaaaataccaaaaagataggataggtttgagtcatgctaggtaagataagctagttctctttgttgaaatgatgaatagttgctctgttttatatctctgatatatgggttcttggtaaatgctctctcaaagattgaatataagtagccaacaattatccgggaacctgaggtaaatgagctgcacttgctaatctaagtctaagttgttgcgagatttgacatagtaaaaatgagtagctatgatcctgatactaatttgacttgaattccggatgttttgttttgcaaaatgataaattgaaagttcctcatttgatataaattcctaccagagccaaaaatgtgttatcatgataaaccatatacattttggttacttgctattccattgaactttgtcaaactcttgtgacttgtgtagatacttctcacgctctatgatcaagatcatacacccacatatatgcacatgctaaactcctacactgggagctaaggaatattccattccattttcatattaccaccaaaataaattctccatgctttgaagtgctttcttctcctaaaaagataattcgttttgaaaaaaaaggagaggagggaaaggcaaagttatgaaaataataataataataataaagttatgctccatcaagcatgagcatgatgttgtagccatggcctctcccaataaaagaaggatttttgggataagagagtaaagcacaaaggagaagcatttttcttttatttgtcctcatacaccgtttccaccatatatcacacacattttgcacgatcttgatcgtgagtatgtttagttatctgctttagtctaagtttttgacttagtaataaatctgaatgcaagtatgccatgtttgatccctaccgaggctccacatataaaccttagagtaggaataaaaaaggcatcattgggtgaggaattcaaattgatacacttagagagactgagtgaatcaattgaggaacttggttttcttttccaaaatcgtttgaaaacttccggattaagagttgaataaagatcgggtgattggtgctctagttgttgttcagtctttcaaccgcccaaggcagggagaagcagtgtctcgtgggaatcaggggtaagggtaagccaccgtgccaaagattatttaatctgagagagagtacatatacctttcacctgtatctttgaggtatgcagcatagtagcaactcctgatcaacaaccaagtcattgtttcctttcgtccttcactcaggacgagcaaaggttcaagtttggggggttttgttgacggtcgttatcgatcagtttcgaccgtcaatattactaaaacaggagagaactagtgatgcttgcaatgcataaatatattagaataataatattccactagtattaggtctactaaccttttatagagaatgacaataaagtgaaggagaatcgacctcaactcagacgataaatcaatcggacaatgttgagaaccagaattttgtatgaatgggccaagaacgcagacttgacacgatgaatcaggccaaaattcacaagtctacgaagtgaagcagcagaggaggccaccagccaaaatgtgggctggttgggccagccccaagttcggccgaacctccctcgcctccgttggatccaggttttgcctggacagtggagatgaagccccaatgacagttggagggtattaccgaccattccaaccatcacaaccgttatagttcagctataaaaggacttcaccttctcacttcactcacacacctcaagcaagagctctctcattcctctcaagtttagtttagtagtatctagctggtggaataaaattagaataggaatcaggagtctggaagtcttcggaagagttcgggtatggctctagcagctttcctttcctcttttgtaagctttgtacttttattagaatactcttctatatacatttatggtattgggatactttccgagtatatgagtatcaactttacattatgttcttattatattgaatatactgctagcttatcagggagatgctttggtgcgggtatagtgtttgcttatgcaattactctatgtcatgacgatgatattagagtagtatctggtagtttagacgtggtgtctatattacgggatatcattatttgatgttatatattgcggatgaaaggtgggccgctgattgtgacagctcagcacgggtattccttcgcgcctatatataatcctaagttaatttcctagggagggtattcctccgtatttagccccggttggatggtcatgacgggttgtcgtaaggaactcggcagtcaggggtggcttctcgaagtaccaggagggcatcggatagagggtattagctagtatatcagttaactagaatgtatttatactatgtatattagaagtataggaatagatttcctttctctttactttccacctagtttagattatttattatgaggatgggtagttgaatgcttgtgtgtcactctacccttggattatcttaatccctacttagaatatgattatcgcaagtaatatataaattattagttgagttctctgtacatgatcttcccacgggataaaataaatacgatacccttggaatactctcgggtaaaatgctacaatggtatatccgtgcgcttacggatgaactctgtaaccataatataccagaagtatttctgcgcctttgctgaaattatatttctagtaatgtcattaagaaatacaacaagcatttttggcgccattgccggggattatatttctagtaatgtcgttaagaaataacaacaattaggccccattttataggcaagagagagagccgaccacgagattgagtggaaacggtgccggagatggtggtgtcagcggcatcaatggcggcttttgaacaagatccaaatcctggcgattggaggcaccattcaagccttgttcggttaatgcccatgagggaggaattggagaggatttattccccacctattgtggtgtggaattattccccctcaatcccctccaaaccgaacaaggcctcaccggggaaattagggggatttaaagagaaatcaatgggtattaaaacccccaattaatttggatttaaccggcttgaatggagcgaatttgagggagagataggctagggtttatgggagagagaggaggccggcgggaggaagaagacgaccggctgcctagcggcttgggctgggcgaggcaggggtggcccagggcagggcaaggagaggcccgagagagaaggaagagaaggaggggacttcggctgcgggccgagggagaggagagcgactttgggccaggggagataatttttagtttttctttttaatgaactcttataattgttttgtttcttaataaatattttcggtgctctgaaaattggaataaaaattgagggctccatttagaccaaggaaaatttaagaaaaatactccgggccacaatcgaatttatcttgtacgcatgatgaatttatcaggccatgacaaccgacaaccgatgactattctaagcctaactccactactacaagagagaatacaatatgaaatgagagaattgctccttgaagttagtgttaaaactgaagaaggaaatctccttttataactctcaagggcggttgagtatgacggttatggaggttggtgcacccctaactatcattaagagtggttgtggagttgacacgtggaggatggggccgaggggtgccacccttggttcagccaggcaaaccgcctttccccaccgcctttggtcaggggatgataggtgggtcccttggtcggtgcacactctaagtcagtttagtatgatttgtgggcccataaatccgtgtgttcgcatgtgattcatcagaggtgtgtttctttgcggctcatttctcctttactttaatgtataattcctgcatccatagtatttctccaatacaagtgaaactacattatttataaatgatatgcgtgtaagaaatgttagttttctcattatttattatggtagttgatggttgaaattggtacttaacgatcgacaccatggggatagcttgtttgggatgctgacatggtgtggccatcacggatgtcgatgaaacagcgactgcgacgggttgaggaggtgggcaacggttctaatggcaccaacgagtcttgccaatgctcgcgcgaatgctatggatagttgaaagggttgtcgcgttgtgttcgtatggtcgttacaactgcgacggcaagagctcgatttcgatgaaatccgctagaaccaaggtgccatatatggccttgcaagattggggagcttcctagcggtaaggtaacatgattgcccgcttgtgctagaggggatgctatcctactatgtaacgccccgattttcgtttgggataaaaatcattaaataatgcattttctagaaattaaaaaaaagttaaagcaaattaataaagtgaaataatgggagaattaaaatttttcccttaaaagtcatggccgagaatattttgtaatattctttgtgccctaaaatactctccggatttttccgtgaattttcggagctcaagaaataatttaaatagcacaaagttcattaactcaatttaaataaaaagaaaaatgattaaaattccctctccttccttccttgggccatttttggcccaatcccgcccctcctcctcctcccgcagcccgttgggcttccctccacctcctcctcccgcagcccgctcgctcccctctccctccaaagttcacctaaccccctcatccctctccctctcacgccgacaagtgggaccgtcggacccacttgtcaggtcctcctcctacctccggctccccaattccaaccgtcatgccgccattgccgcctcacgcgccgccgattccgcgccaccccgccaccccccttcttgcccaagtggtggaaccgacccccaccacctcctccacctcttccccctctcttcccaaaaatacggcgccggtttgccccgccacgcgcccacgatgccgccccactccgacggccgttgccggccgattccaccctccacagccacgatctcgccactccaagcccatataaacactccccgcagcctcctctctcgtttcccgagctccccgcgcgttctcccgctcaccccacgccgagcccgtgcgtcaccgctttccggcgagctccggccgtcgctcctcgccgccctagccgccgccgcactgcgccgccaccaccatcggcatcgccgtgctgtgccgcaccccggcccctattccttttcccctctccacctcagaaacactgccgcaccgcgcgcccgagctccaccgcccgccggcgtcgtccagccgcgcgccgccgccgctatagtcgtcgccgcgctgcgccgccgccaccactagctccaccgccccttgccgcacatcggccgccactacacttccccaaatcgccaccgaaatcgcctttccaccaccacacccgagctgcctcctgccgcttgccgcggcgctcgaagccgcgtccggccgcgccgacaccccctccgtattcgcagtgtcgagctgtacgtcggccacccctccctcttcgcgagtcaccatcggaactccgtcccctctgctcgaggtgagcatccgtcgccccctctcatctccggccggcaactcacttcaccgtgagccacctctgtaacaactgaaaatttaattagtagtttaacgtgtcatatgttatgtttcggataaaattataggaatttcaaaaactttcttagaaaaaaaattcttcagatgattcttatgtttaaaatggctagaaatttaaaccttttgctagacttttgtttgggatgatgtcaatctttagctaccattatagggaaagcattttttttccagaaaacaaaataaccatataaccttggtggcgaaatctaagttgctgggttaaggaagaatcatccaatttttcaaatagtgctttgacgctaataaaatttaccaacacaactaaagacctactcaccaatatttttccttgcacgaatggaacgagaatataagagactaagccaactcaataccagataattcacgaagatccacctttctttttctcccttttagcttttaagccaagttgaaacctctttgtatttaactataatgaatgaccaatcggtaattttgtaactcatatttcgcttatttgataatctacccgatcacgcatagcttttggctagtagattaagtaactagtgattgtatgcttgtgtacctggttgtagtgtagtccaatttattggcttaaatgattttctttgtttggctaattggtaaatgttaaatgaatatagatactctgtaacaaatctaagcaacataaaattccatgaaggtcctcatgtcaattagacaacctaagatgaccactgtaaaggtttcatcattttatcaccctttttactacctcagatatatcagtcaagtatagtcacagtgattaattagaaacctaatcaggaaaatgaagcaactcctaaatgtgcttaaaaattgatcagaaggatataggttttataatttattcaaatactagattatttatcatgagttaatataatttttctagaatttttacacttagttttgacctcattgaaattcaatttagttctcagcataccccatttcacctttttgccagaattaaaatatttcgaatttttgagtgaaactttgaaaaatggaaactaggtaactcaagctatacacacaccagatcacccatttttggaattcttgtagctaggtcaaactagttaaccaggagagaaaattcctgaaaattcactaatttcattgtgtacctatgtttctagccttgatttatctgtcctatgggcccagttcgacttggccccacatgtcactgacctaggcccgctccatatctcctagaccacctcttgggcgtgcaaccccacctcaggaacttaagacagcaaaaaaaaccctccatcttcctcctccctttctattgccagccactttacgttcttccttaggctgagctccctccccactttctcccccaaattcttcttcaatcatccaaaaccaaaccctgcatgtcacacctttggatccctggggctctaggttttccatccatccaaatatcttgcacatgcatggccatttgagagagatcgggaaggaggaacagcaaggagctgcaggctgcgaggttgcagcagctggatgacacgtttcttttctgtgttggtaagttctttccacatccatggctccctacttgagttcctataatgccgacaatcccttctttcttcccctccctattggtcaccgattcaaatcttgagagcaaagagcagctacaattcatatttctccactccggcaacaataacccatgttcctttgagttcctctgttttggtgagttctcatgtctctacctcctgtagatttatgttcttagctttaggatcaagtactcacggtgcttttgtcctgcaagtagcgtaaggtgagttttgtattattcttccttgtactacttgatcgtgctctttctatattgatagtttgatacccttctccggtaaacccgtgtaccaggcactgcaacctcaccaaatgtaggatataaatgagctcacacctatccttcggcagccatcagtggatcatggtgatttgcattagtgattcgagtcgttgttgagtttgtcgcccctaagaaaattagggccagcctgctgcacctcgtcctttggtgagatttttcagcaccttggcaatttgttttctctcacacaaaaggacctcacaaagattgctttgccactgaactccaccaatagctagtagttgcaaaattctagaaacactgttcttggtgctttaggtagattgttaattagcaagaagcatggggatattcagaggaggatggaactaaagtcacttggtaatatctgagaaagagataactggagttacaatgtaattacactaaattcaagtgctaataattactgaactaaatcaattatccccccacatagcttatgcacctatatcatttctttcaattgtaagctatgaaatcaaatttctgctaaggggcagccagtagcagttccacttgtcacattaagtcaacgcgcatagttacttcattccaagtctaaattgggtgattcaaattgtattagaaccagtgaatttggctccttggtgtgatataaattttattcacgtaaggctgctaaaaatctcagtatatggttgggtctgtttgttctattttcaaaagttgccattttagtgtatatggctggttagttgtgtatctcctaagctagagcagcaaatgtagtttttatgtcaacttgtacgctgcc

SEQ ID NO: 80104 - DNA, 678 bp, Oryza sativa
aatggtgagattttggtaaacctgaaactacaaaactgtggttaatcggctggtatcatgtctaccttgaatgcatcttcttcaaaatccaatgtcgtgcatgcaaaatatcctgttgttgcttctattgctaaatcttctaatgctaccaatgtgtctaatcatcatgaaaaatatacttgttctttttgtggcaaagatggacatattgttggtttttgtttcagattagctcataaacagaaaaaggagagagagattgcttttgcaaaatcaaagtggatatatgcctattggatcttctggtcatgtgtctcagtactggattcctaaatttttattatcttctaaccccagtactgaggcttcgacttctgcttgtgtgtaggctttggtggcaaggaaggagaacgtgtggatcgtggattccggttgttcgcggcacatgaccggtgataaaaattggttctcctctctcaaaaaggcatccaagactgaatcgattagctttggtgatgcttctacaagtgtcgttcttgctacaggtttggtaaaggtaaatgaaaattttgaattgaagaatgtagctttggttgaggacttaaagtacaatttgctttcagtttcacaaactgttgatgaaaattttgaggttcactttaagaaaactggaagtaa

SEQ ID NO: 80105 - DNA, 7492 bp, Oryza sativa
cctcaatttgatgggacacattacgccgcttggaagcacaagatgaagttgcatctaatctctttgcatccaagtatttggaaagttgtttgtacaggtattgatgtacccaatgatgacatggagctcacctcggagcaagagcaactcatccaccgcaatgctcaagcttccaatgcaattctctccaccttgagtccggaggagttcaacaaggttgatggacctgaggaggccaaggagatatgagatactttgcaactggctcatgagggatcacccgccgttcgtgaggccaagattgagttgttggaaggaaggcttggaagatttgtgatggatgacaaggagacacctccatagatgtatgataggataatgatccttgtcaacaagatcaaaggacttgggaatgaggacatgacaaatcactttgtggtcaagagacttctccgtgcttttggtccaagaaatcccactcttgtatcaatgatacgggaaaggaaagacttcaagaggctcaccccaagtgacattcttggaataattgtgtctcatgcgatgcaagaagaggaagctcgtgaagtgaggcaaatggtgaagaatgccgccatgatcaaaaatcaagaagtagctttgaaggcaaaacaagaagaagtgtcaagttgtgaagaaattgaagatgaagagatggcttttattgtcaagagattcaagcactttcttcgcaagagtggctatggaaaagggaggaaggatgatgacaagggaaagaggcaatcaaagagagcttgcttcaattgtggcgaatatggccacttcattgccgattgtcccaagtcaaatgaagctaaggctaagggaggcaagaagaagctagagcgtgctcatgtggcagaggtgtggtactccggagatgaaagaagatctcccaggtcaagggccaagagctaaaaccaaaaacaaaagtttaaaagaagaggggggtttcgaccctgtcccttaaatgatatcctctaagagaagagagtgtcttttcacacttgagagaagtggggaggagtctccatcactacttttgtgttacggccccaagccccaaagtgagatgactcaaaagccctctcacatctctcttgatgttgattctagtgatgaggaaagtgataatgaattagatgatgtgcttgagagctttagcaaacccgctatgcaacatttggctaagttaatgagagctttggatagtaaagaacaatcactcgaaaggcaagaagaattgcttattcttgagaagaaaagaaaccttgccttagaggagagcctagctacaaaatgtgctaaaaatgaacaactagctaatgagcttaatttggctaatggttctctagctatccttagggatgtcaatgaaactcttcaagacaaatttgctaatttagacaaaagtcataaagatcttgaagttcaatttgacactctttggaatagcacctctcaaccaaatgtggtttctaatccttccaacccatctactagcaatgattgtgctaggtgttacaatattgatttgaactcttgtgctactaatgttgatgctatgcaagctcttaagaaagagaatgaaaggttgggcacattggtaaaatatggatacatgaagacataccattcaaaagatgccctttataagaccatcaccgctcatcctaacaaggatggacacgggctcgggttttctagtggaagtcctgtgtctaagcgtgtgatggtaaatgggaaagaatgcttgatgtttttgagagaaggtaaagctccacaagcaagtgaggtgacttgtcccttcactggtcagacactcggaagttccgggcaaaatgacgggaagttcctgccctgtaagacaggaagttccgaacattttgtcaggaagttccggacttctgatgagtcgaaggggctgaccggaagttcctggtataatgccaggaagttccggccagaaggtctttactatgatttatatgtaatttccaaaaattcagagggcaaagtggttgcttattttaatgggaattacaatgatgagtaccgcacttgtgtgtgggtgccaaaggctttggtaactaacatcaagggacccaaacttatgacgggagagaggtgtatgtttacaagtcttgatgagcagggtggaagtcgtgaaaatattttctttggagatgatggtaaaggaaaggtaatgtgtctcggtaagattgccatttccaagaatcagtctctatctaatgtcctccttatcaattcaataagctacaatttattatccatgtctcaattgtgtaagttaggatttaattgcttgtttaccgatgtggatgtgaccgtttttaggcgagatgactcttccatagcattcaagggggtgttaaagggtgatctctatctcattgatttcgatgtggatagagtgaatccggaggcatgcttgattgctaaatcctctatgggttggctatggcaccgtaggctagcccatgttggaatgaggaatttggcatcccttctaaaaggggaacacattcattcttggtctatctaatgtttcttttgagaaggattgtgtgtgtagcgcttgccaagccgggaagcaagttgggagtccgcatcctatcaaaaacatcatgactacaacaagaccactcgagcttcttcatatggacttatttgggcccgtggcctacataagcattggaggtaacaagtatggttttgtcattgttgatgatttttcacgcttcacttgggtgtactttctccatgacaaaagcaaagctcaagatgtcttcaagcgtttcgcaaagcaagcccaaaacctctatgacctcactatcaagagggtgcgaagtgacaatggaggagaattcaagaacactcaagtggagaaatttcttgatgaagaaggaatcaagcacgagttctccgccccctatgatcctccccaaaatggcattgttgaaaggaagaaccgaaccctcattgaagccgcaagggcaatgcttgatgagtacaagacttcggatgtcttttgggcggaggccatgagtactacattctaatgtttcatattttcgtgtctttgggagcaaatgctttattttgagtaagatgcctcgctcatctaagttctcacctaaggtggatgagggattcttacttgagcaagttgttgtacatattgtaggtgatgtggatccaagtcaagctataggtactaaggctattggagacatacgactagtcgagacgcaggatgaccaagaagatagggatcaacctccgtcatcaacatccaatagccctacaagtgctgtgtctgctgagccggaagttccggatcctattgaccagaacctccggacatctccaggcccggtagttccgggttctatagtccggaacctccggaccagtggcagtgaagacatgccaacggcgcaagtggatgggatcgatgctgcgagcactttagagcatactgatcaggcttagatccccccagtgcaccatccaaggatacataacactgtccaaagagatcatcccgtcgacaacatacttggtgacataagaaaaggggtaactactcgctctcgtgtcgcatgtttttgtcaacactactcgtttgtctcttctttggaaccaaccagggtggaagatgcgcttggtgatccggattgggtgatggctatgcaagaggagttgaataacttcactcgcaaccaagtatggactttggcggagagacccaagcaaaatgttgtcggcaccaagtggatctttcgcaacaagcaagacgaacatggggtggttgtaaggaacaaagcccagatagttgcgcaaggattcacccaagtcgagggtctcgattttggtgaaaccttcgcacctgtcgctcaccttgagtcaattagaattcttttagcctatgccgctcaccatgatttcaggttattccaaatggatgtcaagagagcctttcttaatggacctatctcagagttggtctatgtggagcaaccaccggggttcgaggatccaaagttgccaaaccatgtgtacaagctccacaaggcgctctacgggctccaacaagcccctagagcttggtatgaatgtctccaagattttcttttaaaaatggttttgaaatggaaaagcgggatattactttcttcattaaaaaatttaagagtgatttattcataggccaaatttatgtcgatgacataatatttggttctactaatgcctctttttgtgaagaatttagtagtatcacgactaaaagtttcgagatgtctatgatgggcgagttgaccttcttcctcgggatacaagtgaagcaagcccaagaggggaccttcatctctcaaactaagtacgtgaaagacatactcaagaagtttgggatggaggataccaaacctatcaagacgcccatgcctactaatggccacctagacctcgacaataatggtaaatgtgtggaccaaaaggtatatcgctccatgataggatctttgctttacttatgtgcatctcgtcccgacatcatgcttagtgtttgcatgtgtgcccgttttcaagcggaacctaaagagtgccatttgattgccgtcaagagaattctaagatatttagttcatactcctaatcttggcttatggtatcctaaggattgtgactttgagcttttgggctattccgattcggattatgccgggtgtaaggttgatagaaaaagcacaaccgggacttgtcaattccttgggcggtcccttgtttcttggtcatacaagaagcaaaattccattgcattatccaccaccgaagccgaatatgtcgccgccggttcttgttgtgcccaactcctttggatgaaacaaaccctacaagattttggctataacttcaccaagatcacactcctatgtgacaatgagagtgccatcaaaatagccaataatcccgttcaacattcaagaaccaagtacatagatatttgccatcactttttgagagatcatgagactaaaagagacatatgccttacccatgtgagaaccgagacccaattagctgacattttcactaagcctttagatgagaaaagattgtgcgagcttaggagtgaactcaatatcttagactctcgtaacattaggtgatgggtggttgtctaattcatagcaaaacatgtatcaataaaatgtaaattaaaaaaaaagagcttttgtgttttgagatcacttcttggtagaagatggtcttgataccaggtataaaacttaaacattccccctcatatccaaaaacccttttgtgaaaatttgcgaaaatttttgtgtgtgtttttattgcgaaaatttggtttttatccccgtcttgtgatgtatattgaccattgttatgtaatgatgattgttggctggtcatatgcatcataagtctttatatgtccataggtttctatttctaatcgttgaattctcgtctattcctttgaacttgggcctgactgccctctgttctgtcaggccggaagttccggtcaccctagtccggaacatccgggggtcgggggtataaatacccagggggagcccgagtctgttatctctctcctcacttcttctcctccgcgattcccaaaccctagccaccgctacagtgctcctctcggcgattttcacttccaaccatggaaatttgattcctctccgtggaatcaaccacattggtggctagaaggttcatcccgcgatcgttttgcaatttcctctcccaaggtagcacttttgatcctcacttttggttcatcatgtttttgccccgatctctaaatatgtgaacctagggagaaaaccttttggatagaattgttcctgctaccttgtagattgccgatctataggattttgtcacatgcactggcctgtttgaatcctctgtgctttagttttgcaggccggaagttccagtgttcttggtccggaacttccggtctctatccagccagccagcaaaccttgattcctccaatttttattttaaccattgcacttcaaccttgttgattcttgttgcagtggtcagtatgcctcatgagaagagacagaagctttcacaggatgttcctgctgactcgagtcccccggttcatggtcctaggaggagattgggcaaagaaaaagttggaaatttttacagtgggagtcaaattcctattcattctaggagggctggtagcattgtcattggtgatgctccccgctctccctctccagttgcatctaagtcagatgatggtggcaatgaggatgagcctagttctgagagcaatcctttgaggctttacaagacaagggttgttgatcctgatcctagacgtccaagtgtgaactatttgaagaatctgctcaagtgtggaatggacagaatggtgagtcctgacacaatgcctgctgactctcaggatgacagattcaggaccgtggtgcaagttgattggtataattctgtgatcatgggaagatctcatccagtggtagagatgaagtggctagactggcagtacatgtccttaaagaacaacttagttttcagtgaggtacgcaaggtgtgtgagcgcaagcacgtggcagatctgttggccttgcagtattcctggaatgaggaagtcattggtcagttatactccaccgctttctttggcaccaccaagaagggcattgaatttgtgaagtggaccattcaggggcagcagtatagggtctctatggcacagtttgctgcagctctggagttagatgatgatgacctgagtcgtcctcatatctttgtagaaaatgctttgtcaccgaccagcactactttcctgtatgagaaggatgctcccaaggattgtttggggactactcgtgggttgcgtccatactatagagtgctttattctatcttcaggtggtcattgctccccaaagtgggagatactacagcacttccagataggcatgcgctcctcctcagtcgcatacgctacaacaagccagatttcagcatcatgaagcttatctggagtgagatatatgagatagtgtgtgaactaaagaggggttgtatctatgctccttatataatgaagatgattgaggcaaaaattgggattagttatttcaaggacaaccagcacaagccttttcgtcctcatgttccctcctcttcagctcctccttctaccagggcgactcgtgcttctacttcagctgctcgttcttcctctgcagctccacagcgctctgagtcttcttcccccataaagaaggctctccgggctatcttttgcatgtgtgctaagacagctaagaaagtgaagaagatagagaggcgtcaaaaggaagattggattgcagcaggcaaggatgtctct

SEQ ID NO: 80106 - DNA, 2008 bp, Oryza sativa
aaattctagaaacactgttcttggtgctttaggtagattgttaattagcaagaagcatggggatattcagaggaggatggaactaaagtcacttggtaatatctgagaaagagataactggagttacaatgtaattacactaaattcaagtgctaataattactgaactaaatcaattatccccccacatagcttatgcacctatatcatttctttcaattgtaagctatgaaatcaaatttctgctaaggggcagccagtagcagttccacttgtcacattaagtcaacgcgcatagttacttcattccaagtctaaattgggtgattcaaattgtattagaaccagtgaatttggctccttggtgtgatataaattttattcacgtaaggctgctaaaaatctcagtatatggttgggtctgtttgttctattttcaaaagttgccattttagtgtatatggctggttagttgtgtatctcctaagctagagcagcaaatgtagtttttatgtcaacttgtacgctgcccactgtatttatctatcaatttatagagcatgttgcatatgcatgtttatttgaatcttatttgcatatttgtcttttatcggtagattcagatgtttcggagtacgtggagcaagaacctgagattgagtgtgatcatctacagcaacaaggcgagcacctaagcatctagcacccatgttttacttaaattcctttggttgtgaatatatatatatatatatatatatatatatatatatatatatatatgcatttgcttagttaattgttttgggtgacatggtctataattaattggtgcatttaccttagttatatatagttgccatatacctattactctcctggttgggaatagttgggatgttttattcattatgcttagttttgcttagtggggatacaactatatggctggacagttttgttaattctaggatatggacaacttggttaatgggctaaaactggagcacttacattaaataatggttgatgaaatatgattgacttggacgggtggtagggcgatgatgggaggtatgtttcccctgatgcagtagctccgtctgggtcgttaaggactaaatattttgacgtctattcaagcaccctacgtacttaccacatgccgtatcatgggaccggcttgtttgattactagacccactgtgatcatttacgcccatcagagaaacgtgggtatttgggatccgcggagtgcttggttggccgatgtcacgcccagaaatttaacccaaatttctagactattttgcgtattaaatccctgtccaggaccagccagggtacacaaaacgacaagtaatatacagttccaaacgtaaataaagcgtaaaatacttacggaagaggcacttagtcctcacaccgaaacagaacgatagcagcggaaaaaggcgatcctagcggggcttcagctccactccataggcaaaactcaactggggtctgagccttggtcctctaacttcatcttcagctcagaagcactacacttctgaaaaagggggaataatagcaagactgagtacaaccaccgtactcagcaagccacaccaacgatgcagacgtgcaaggggatacaaggaggggtttgtggctatttgcataaaggcagttgtaaaacattttattgagcaaaacagtaaaactgttgagtaattaaagtaacattaaatctccattgatcaacgctataccacattgaacaggcccaaccaacccacctgaactacagtgtattgggtcgatttattaagatgggactaatcacggtgaatctggtcgaccgcccataaccgcgggcacggctattcgaatagttttactctgatcagaggtgtacagctgtacccacaagacacagccccacgacatgtttccgtgcgccgacatgccaccacgacataccggaaagaggccatgacaggacccttcgcataaccccctc

SEQ ID NO: 80107 - DNA, 7178 bp, Oryza sativa
tccagtggaccggcggtggacctccctgtggtcccggtccacggtggaccgatcaccttgacccgctgacgtgtggggctcgcttgacggcgccggcctctttgatgacgtcaacgcttaatcttttcctttgataaaataattaataattccacaataaatcattaataattgtataaatccatctaattcatccaaacttcaaattgggccattcaacttgcaaagttcatcaaaaattgagctctacatgtttgtttactcttcatgtactatttacttggtgtttattagagtttttcctcattttgagtgccaacgtgtagaatccattgtttcgggagttcgcggtcacaaggatcagtgttcggaagactcttttgaagaagtaaggcaagtcacacattccccttgagcattttgagcctaatttaaaaatgttttaccgtttgcaaataaagatgcatgttttgctaattacatgggaatagggtttacctatctgctcgtttgtgccatgtctacttgatatatgtcctttgtcaaccctgggtaataatttgactacctcatgttacttatgtgacctagctagaactatatgcttagccatgcttgattaccactagcccagttgatgggataattgcagtattagacctattagtatcttgacgagctgcgtgctcgagacatccggccatgtttcgttggtcgtaattatccaactaaaatgtgactgaatggtgggctgtgggtgcatggttttgctagtcgcgcccatggcaattaaggaccggttcgcgggatgcactagaagacatacagcgcttgccacaagctagaatgggtaattgcctgacttgaagtatagctttcctcaggctgacgcatccaggcaagggtaagcgtgatggagttcggatgggccctgtgacggcctatgcggctttctgattcgcttaggcacgagagaggactgcccgctgcctgttgaagagtgggggtgaaacctgaggtatggtgtgcttggttagagggggttatatgaaaggtcttgtcacaatcactcgacatggtaacgtgtcaggcctggcgcggtgacatgccgatggattgtgtcctgtgggtacagttgtgcacctctggctagagtaaaactattcgaatagtcgtgcccgcggttatgggcgatcaaccaaaatcaccgtgattagtctcgcccttaataaattgactcaatgcattggttagttcaggtgggatggttgggcctgttcaacgtgtagcgttgatcagtggagatttaatgttaccttaattactcaattgttttactattttgctcaataaaatgctttacgaccgcctttatgcaaatagcctcaagccattcttgaatccccttgcacatctgcatcattggtgtgccttactgagtacggtggttgtactcagccttgctattgttcccccttttcagaagtgtagtacttctgagctgaagacgaagttagaggaccaaggctcagaccccagttgagttttgcctatggagtggagatgaagccccgctaggattgcctttttccgctgctgctgctttcgtttcggtgtgaggactaagtacctcttctataagtattttacgctttatttacatttggaactgtttattacttgtcgttttgtgtaccctggatgattcctagacagggatttaatacacaaaatagtctggaaatttgggctaaatttctggacgtgacatactactacataaatgaatttttggatgagaccctctttaggttgcaaacgtaattttaactagccgcatctgcaaaaatcgtcctccattttcgcatacgactccttaaggggaccacacacaaaaatcgatgttcacagacgagcctcttaaggctccgcacgtaaaaataagcatattttttgcaggcggacctcttaaggggctgcaaacaaaaatatattttcgtaggcagacctcttgatgctccgcctaaactttgagttaactcctcattccctcttaatatttcaaagtttttcatccttatccactcatatttctctcaccttctctctctcacctcctgatgtgccctaacccccatcacatgatgatgagcacatcccagctacacttgacataaacaaggatgatggtttacgtcataagtcacatgaggaaaatgaaaatgacgtaaattatgttgatggattacgtctcaacaagaacgatcaagcatatcatggtccaattacgcgcagccgtgctaggaaaatacaacaagaggtgaactcactctttgctcaacttaatccaaattttatactacataaatgctctacatttgtattgctcaagtttacgcccgaggacatcatcactacggcaagaaggatgggttacgttgaggacgataagggttacgtcgaggaggaaccagcccatgccaaaccagtagctgtctacgctaacaagaagatggtttacgctgcaaaaggatcaacttccaaggcttgtgcgacccaaccagtcaactttctccatgcttaatatatatggttggaaagataatcaagtctagtttcacctccaacaaacggctcgtcatttcgacttcccactaaggagttatggacaaatcattgaagactgctcagaagccaaacagacgcgcgagtcttctcgggaattcacttattatgacctttgacctagcctatgtccagtaaactcccaagacttttcattctcatctaggagggttgttcctagtataaatatcccctatgttttatcatttagaagacttttggacagtgaaaatatgaacaccttttgttcagctgtgtgctaataaattcagagagagatctctacccctttgctcttgtgatttccttgtgagattacagaaacagcgttcgacgccccccaattggtgctcctggtcccttcgaggtttttccttgattgatttaaggttgtattggttggtaaacttagagtgtggttgggcgaaccctcgattcagactgccgtaatagagacggtggttggcttcgagtacgatcgtcaggttgcactgttatcttggctgcttgcagctagttatcttagtctctttgatgctagttattggttcttgatcctacgccgtaaagatcgggacatcagccctaccggggtcacatcatctgatatcagagttttcgttgtcaaaatatcctatctttctttgtgcgtgagttggtgtttctattcctgtggggacccaaaataggacttcctgtgtataagtgctagtctaggatcaagctagcacacacagaaacaaagataatatcacaaccaacatcacaaaggaaacctaatatttaatattaataatgactgtgataagccttatggctaaagtttacatttattctgccacgaagggcctaaggaaaatattaaagtaccagcggaaatatgataaatgcgtagtagctccattcaacttgccacaggcagtcaactgggactcacgacctattcctcgtcttcagcagcaaactcctcaggaaacagcgggaacctttcttctggaattgggggaattggaaggtgagtacatggaatactcagcaagcacacagaaatatgcatatgcaaagatgacaacaaaggcaatggctattttgcataacacagcaatttgcagttataaacaatttataaacaggtttaaaacaatagttataaataacgggtattaccaactatccatccacacaggattcgtccacacaggaccacatagctatattcattaacctgcacacagttcattcccagttttcacaaactacccctcatgagatatcaccgagcatgtccatgaccgcggacgcggctattcgaatagattaattaacactctgcagaggttgtacagcttgacccacaagatacatcgtccttttaacggccatgcgcaagtgtcacacttcaggttgtgtgcggccaaggagtctgtaacaaggctttttagaaactccgtcccaacactgccttcccccatgagacacctttccctcacatagacaagaaagtccccatggcgaacctaaactcctatcatctagctacctgggccaacagtgccaagactcagaatcctactgggccaggttcttcccatgagaacatgtggttgcacgttaggctcagatccatgacttatgaagtgaagtccttaattgaccaaggcaacttgccaaactacaatagcacacagctcaacagtaggctcacacagagaccatacccagcaacgatcacacagatacattaccacctaaccaggttcacactgaaccacccatcaccccggtcaaaaatgttttatccgcccgttgttttacacgttgcaacacatgctaccgaaaagatagcacacagccacacagttcatataaaagtgattataagtatatgattaatcaaaattatattttgcttgtaaaacaaccttgagcgggctaagcataactactctaccatgagttgagcccaatgttcaactcacaaatactagggagacaagatatcatgggcaatcaataattatcaaaggtaggataataataacaattaggtcacgctacccatcgatagtttataaacaaaacaatgcatgtattcaaaacaaaacatttcacaaataggttcaatatgttcaaagagtgcacttgccttgatcccaatactgtccttgcacagcgtcttctgaagcaaactgctcttccgctccaacgtctacacgattgcaaacgaaaaacaaataaacacaaagaaaaactaactaaataacatcatatgaaataaccaattaaaccaagaggttgagctcgattttagaagaatttaggaagaagaatgggtcgaatcggagttcaaacggaaaagttatagcctccggaagtttgaattcagggaaaatccgaggataaaagaaaagggaatattccgagaatattctctggatttttaatttcagaaattgaattaattttggataggaaaatatatgtgggcccactatcagtggcatagagtgtatgggtgaacttggtgtatgtgaactcgatgacgtggaacgacacgtggcgacataaggcgatgaggtggcactgacatggatggatctagggctgaggtggcataggttagggattatgtagatccaacggttgggatttgatctagggatttggacggctgtgattatttggagtttttggatggcaagtcccacacgtcagtgtcacagggaagaggacaagcagcagctgctccaccacaggcctgggcgtgcccggccatggcggcatggcgactccggcacagcgacgtcggcggcgttctccagcgacggcgcgcagctgcagcgacgagcagctacgtcggcaagagaaggcggaggcgaatccggtggcgcagcaccgagctccgggacgacgtggagatgacccatcaatgacgagcggcggttgccggagtggaggaagagagaggaaaacggcgcggaaggaaaagaggctcggcctcagggctttaccagcggctgcggtatggtaggaagatggtgacgacgacagcgcggctcccggcggcggcacggagcaacggcggcggcggctgctcacggtggagatggcggcggctttgaaaaaggggggaaaaggggcggtggccgacggtatttatagaggaaggagtaactagggttagggcgcacggcgcaagctttggaaaggcggcagctccgaatttggcggcgcggcttgcgggatttggtggcgcggccggcgcgggctcggtcggcggcggcttgggccggcgacacagagaggaggagaaggccgggccggggcggcacgtgggcttggggcttggcttccccaggcctgcagctcaagaaggagagagagagctggaggtagaagaaggtgggggaaaaagaaaaaaagaaagaagaataagggctaaactgcaaaagggtagaatagagaaaaagagaggaaggaaaaagggaaaaagacagggacttctctagaaaattccaaatataaagtatttggaatttttgggaaggatttagatttgaaaaggaatattggatttggatggaatttgaattagggattgagcttcacttccgaaatacaaattaaatccaactaactgcaattaagaatcacaaagcgaacaacgtaattaactaattaatcattttaaaaccttttgatttaacgaaattttcattaagctattttagacgaataaaccaaatgtgaattttcacaaataggcgagaagaacagaaagcgaaaaatcaggacgtgacaattccaaaccttttggatcagcactaggcattgaacttctagtttgaattgttacttatctttacaacaactagatttcagattgcttagtgtaggtttaccccaccaagctccacaaagaaaccatcgtttacgtcatcttggtcttttgttcgcttaaccatcacacttttttccaccacacatatacttctgtaacttgcaaggaatacataagagcttcggttggtaagagaaggtgaggttgtgacagtttccacatattttacaattccacatatattttgttttgccacttgtgttctaaccatgcaagaagatgtctgaaattaatccggaggattgtgttaccatggctcaatttaatgagttgaggcgtaacatggaggcaagacaagatcgaatggcacaagatgttcaaaatattttgggtcattttgaaaatattaatccttttggtggagatgcaagtgtgcacagtggagaagatgaagaggatgataatgatgatttgccctatcgttttggtcgcataccacggcggagaaataatgatgaagagaggcttggtaagctgaaattcaccattccaaagtttgatggtggatctgatctagaggcttatcttatgtgggagttgagggttgataaaatatttcacatccataattattccgaagagaagaaattggcatggcttcacttgagtttgaggattatgctctaatttggtgggagcaattgatgaatga

SEQ ID NO: 80108 - DNA, 2818 bp, Oryza sativa
cacaccaacttgccttaacccaagacctacgatgagttagatcgaaccgacagccttatatagctgggccccagctcatcccaagtcaacccaagccatccattccaggttttagttgattaaacaagttttaagagggaaaccactaacttgcgtacattgctaggattgctcataaccaagggcatggctattcgaatagattatactctgatcagaggtgtacatctttacccacaggacacgccttcctaacgtgttgccacgcgccacataccactacgttatacggacggatggcatgacatagttcttcactcatcctagccttgaacaaaagtaccgactcaacgctcgcctacggccagggttcctaggataggtaggttatggttaagctccatggcatcaggacatcctttggaagtgaccacccggatgcccgtcatgtgccacaacatctcgactaccgaacacccgcacgtgtagccttcatttgcctcagagatatctatcacccaacttcatccatctctatatgtgtcatcctgttcatgactagactaagctacaaactaagcctaacccattagacatgtggaagtacggtagtgctttgcaatagaggctcaagattaattcttatatttggcggggtgctaacttcccacaactggcatgcactcaaaccccactagaaaataggttttaggggttttgaaagagaaagagagtgccatgttcaggccaattaatgttatggggattaatatcaccttggaaatgtggtgaggaaatctcaagttaaatagggaactattagagagcccctgttgaccggttgaggtgatggtaggattgctacatgcgcgcgcatgcgcgcgcagaggcgatacaaagcgaggcaggcggttgctgctactcctctctctctctctattttgtaacggacgggaattgaatcgacgttaattcggctaatcaattacgtaacggacgagaattaaatcgatgttaattcggctaatcaattttgtatgaatgagtgaatgaattccaacggattgatttcgctattaatttacagagttgaatccgattagtttcgatttaattactcctgaacgagtaagcactatataatccgccacacccgttcatcctctcacaccatgcttcctcgttgtttcctctccgttttgttcttgcgctagccactgctttccccggtcctgttcacctgcgcgcacaggtaaacgggacgagcaggcctccagaagtccgtcctcttgtgtacctacacgagtaggcaggcgatcaagtttttggggagcgctctcaggtgcgacggctctgtgttatctacgtcaggctctgcttcccctacgtcaacatctctgctgctgttgctagaggtggcttaggcgcaggcagtggtggctctactggaggagactgatccgggaacgtcaacaccaacggaggcaatactgcctcatcatctagcggaggaccattctctaggtatacttccactctcctattgtcactaggggtgtgtttggttgcctgcatggtacctggctcgcatgcatgcgtggatgcagtggatggtcgtttggttgcctgcacgtagctcccatcctggctgagtggatgcaaaaatgccccgttagccaggctgagcaggaacgctcgatttgagcttcgctgcccagccaggcccgcgcgatgcattgcactgcacccatacatgcagcattgcacccacgcatgcaagagcaggcattggagttaccaccctgcccctctccccctcttcattctacccaacaagcaacgagactatggacatggcgaagaggcagcgaacggctcgaaggcgacgaagcttgacggggggcacaacgacgagcacaacagctgatccgtcctgctgctgcatccctcctcctcttcatgccgtcccccaaccttcaatcgccgggcaccgtcgtctcctatctttaatcactggcctccagatctgatggagcggagcggcgagcggcgggcgaatgggagcgtggggagatgggtggagtggtgagcaacagggggaggggagcgacgggaatatgggcgcatcggtagcaggcagtggaggggagcgacaggcagatgtccgcatcgacagcggcgagcggaagggagttgctgatggcgacgaggcaacgccgatcccctttccctttttttctctcgttttccgctttcttttttctttcggtttttctctcatataactaaacgctgtatgtactactaatgatttttatatagacaagatagtgattttccagatctaatattatataaaagattatctaattttttaaataaaaaactaatataattatatatatatatatatatatatatatatatatatatatatatatatatatatatatggtgtataggtaatctcacccaactaaatgaataggtaaccgcactcgagtcaatacaactaaccaaacacaatctcttccaaaccgtatctctcatgcgagtaactaaatacaatctcatgtcaacctggctagactaatgtaaacaaccaaacaactgcatgtgcatgctcagagataggtcaaattcagcctatatgagagagatgacccttgcttaggggatgcgagcaaccaaacacacccatatatgttaatggttaatgctcatcgcaatgacagtattgtgctatcatgtgaatgttgatgattattttataaaaagcacactactacacaaccgatttttgcgtgcggctaatatg

SEQ ID NO: 80109 - DNA, 2254 bp, Oryza sativa
ttcccgcccgtagccgagggagagggagggaggggccgagcgccgccgctgtattgtccgtcgccgccggtcggccgggagaggaaaggagaggagtggagtgggaggagaggagtggagtgggagagagggagagagtgagtagggagggaggcagtgggcggaggggcgcggaggatatcgctcgaggtattttcatgtacgggtcagttaacagccccgcacgcaaaaataagtttattttcatgtgcgggcctgttatgtgattgattttcttgtgcgggcgatggcctggcgtcggtcccccattttcctgtgtggttccacttacgaaccacatggaaacaaaacgggaggcgtctaggaaaatcaatgtagtagtggcatgatcatgttgttcagtaccgtcactagatctactcatattataaatatcatgtttattattatgttattatggattaaaatatgcagaattataaccatatttccaacaattactccccttttgccgcaatgaaaagggtggaacgtacgtacttgttgcgtgatgtttgtatagctagtagtccttgcttatagatcgtgtcctgctggccgaccggagccgttgaaatatgcaaacgaaagggtgtcgaacgactaaaatttgagttaaataatttgtcatgttccgtccggaatttagggacaaagctagctgtatagctgtgttgtttttttttttctttgttgaaacgatcgcgttacggcatcaacgacctcatatttttagctaccgttttcgtaccaatcgggagaggcaacgtacgtacatatgcatgcgtactcggccaattggtacaaactctatctcggtatagctagtttatgatgacatctatagagatatttacactgtaaagtttgtggcctatatattattttggacatttgtggatccatcggaaatacaagctagcgccgcgctcctcaccaaaaaagaagtaactctaccacatttgatagtgttttaattgaaaagcttacaaatttaacttaataataatactgtaacgcaatataacttctaaaagagaattcgtatgtaaccaaacaaattgagtgtgcggcctgatacctagtgccgtgagcatttgccaacaggttatatggttcgactttgagtccctatgcacgatcgagatacgtatagaggttttccgactagtccacaaatcttgagaccatccaattatcaaaattgagaaagttttttgaagaaaaaattgccgaatgctatcttgcaattccacaaaagaaaaagaatttgatacatgttatatctagctagacaaatactttgagcggactgtaccatgtctcctctctaatctcctactagtagctattagtagcagctagctagacagaaatatcctactaagctactccctccgtcccacaatataggatttggagtttttcttacaatatttgaccactcgtctcattcaaattttttttgcaaatataaaaaacaaaaagttatgcttaaagtactgtagatgataaagtaagtcacaaataaaataaataataattttaaaagaatttgaataagacgagtggtgaaacgttacaagcaaaaactcaaaatcccttatattatgggacggagggagtagtagtactgatttatgcacactacccaagtacaggacaatccaatggcacatcaagcatacttcgtgacttcgtgtttagttcacccccaactaccttaaacttttaacttttcatcacatcacatcacatctaaaatttttctacacacataaactttaaattttttttcaaacttccaactttttctaaacttctaacatttttcaaggaaaacacaccccatatactactactcgaaacgatgacgcgcgagctggccggactgacccacccatatattcataagcgcacccgtatgtggacttactgttgagtctaacacaaattaaagctagctagctgctagctacgtacccccatctcgcatcacgtcatgcagggccggaattctcaccagcggacaacacatacctcacggacacgaccacatgctacttattcccaatacaatgtacatacagtatatatatacacgtttaatttatactcccttcgtcttaaaatataccaatttttttgttggatgtgatatatcttaccctgtttagattcgtagtactacgtagtactaggatatgtcccatct

SEQ ID NO: 80110 - DNA, 1310 bp, Oryza sativa
aaatgaataaattttaaagttcaatttggacaggggctggattcactgggatttggtttttcttttttacagaccgagtacttatatagctacctccttcgtcccaaattacctggctttcaagaatggttaacatattctaaggtttaaaaccaaaaactataatacccttataaaataatttacggttaaggatagaaggttggttgagggtgttgacgatcaaatttggtaagatgtgaactaggttcgacattgggatcgaggcggattcaataaagagatcgattcgaagaacagggtatgcatcggatgcgaaggcatcggctgaagtctgcatcggcttagatggatcggtcagagaatagccgatacggctgatagaggtgatgcagctgattccaatgaagacggttttaaggctctttgaatcgttcaaagtgcttcacaggaattgccacgatagagataaagctcttggtttaggcaattgtatctattaattaggatatttcatgtaatttccttagagatatgtttgggcaaaagtctgccgcaaagacttatgatatcttagagtttgttagagataagtgtcgtgtccgacaggacatatcttgtatctcgggtataaatatgatccgaacctatgtaatcaattaacacacgttcaatacaatctcggcgcatcgccacccttttactttcgtttacttttgatgagttcttactttcgggttgagctgcatcggttttgatcttcaactaaaggtaaagcttgttatggcggcttgcgttctcgggattagtgcttccatctttatgacactctaatcttgtttatgtaattcgttgagttatcatatatcctatataatctctggcaatattgttatttaacttttaatcggctaatatctataattggaaggcagccgattaggttaaataccaacattgacctagattatataggatatccaccaccctatgaaacattcaacggcttgattgtctagatgttgtccttcttttcatacttatagctgcatcagttgggtttgaccttataagtcgtgattagaatctcaatctctagcctgctttttgttgctgattagggtttcatcggactttcagcgatcttacctgatttaattactttatatcttatacgcttgattgatatgttaaatctgtcctttatgttaagatcttgttgcatttaggtatattaagctccatgtttgatatattttgcctgctttaatatcttaatatagtggtatcggagtatcagccgatacatg

SEQ ID NO: 80111 - DNA, 4154 bp, Oryza sativa
ggcggtggccggcagtaatgcagcatggcggcgggcaattccgctagtcgaaggatgcgacggcggctccaccgcgctgatccggcggcagagagtggacgacccccacctagatccgacgacgggcggcggacgacgagcgccgcccggatcgggcggcggtggttagggtttttttgtgatttttatttttttttggacttttatttttgagtgcaaataacagaaccactcgcacgtgaaaatccgatttccacgtgcaggtgcgccacccacatgaacaaatagcgattttggagaccatttcgagcagacaggccggagttctgctcgtcaaaataatttttaacccgtctggaaaaattgtttttgtatggaattagttcaccggctgtccctcaactttacgtcaagtctgtatgacatccctaatccccaatataaaaaatcttcacccctaaattatacaaaaccgtgcaatttaggtcctatagcagtatgtatctctggttacgctaatttggcatcctagtcagtaaaaaaataaaaaaaattatggggcccacatgtaagtgagaaaaaaaatgtttggtctgtgttggtatttcttaacgacattactataaatataattcccagcaatggcgccagaaacactcatggtatattatggttatagagttcatccgcaaacgcacggatataccattatagcatttcacccgagggtaatccaagggtatcgtatttatttaatcccatgagaagatcatggtagagagaacttgactaataatttatatgttacttgtaataatcatagtctaagtagtagttaatataatccaagggtagagtgacacacaagcagggagctactcattctcataaaatatctaagctaagtggaaagaaaagagaaagagaatccacttctacatacatcctagttatccgatatactagctaataccctctatctgatgccgtcctggtacttcgagaagccacccctgactgtcgacttccttacgacagcccatcatgaccatacaaccggggctaaatacggaggagtaccctccccaggaaattaatttaggactatatacacgcgcgaaggaatacccgtactgagctgtcaccatcagcagcccacctctcatccgcagcatataaccccaaataatgatatcctgtagtctagacaccacgcctaaactaccatatactactctaatatcatcgtcatgacagagtaattgcataagcaaacactatacccgtaccaaagcctctcccagataagctagtagtataatcagtataacatgaacataatgtaaagttggcattcatatactcagtaagtattccaataccataaatgtataaagaagagtattctaaataaaatacaaagcttacaaaaaaggaaaggaaagctactacagccatacccgaactcttccgaaggcttccggactccgatttctactctattcctattccactagcttaagactactaaaataacttaagagaatatgagagagctcttgcttgaggtgtgtgagtgaaatgaggttgaggtgtgtgagtgaagtgaggatgcgagctctttttatagcctcccaatgatggttgtgacgtttggaaaggtcggtaatacccaccaaccgtcattggggagctatctcagccgtccaggagaaacctggatcgaacggcgttgcggggggttcggccgaaccataggtcgggtcggcctggccaaaaatcggcatgtggcctccgttgctctcctacacagacttgtcaattttggctcaattgatcgtgtcaattctgagttcttggcccattcatgcataagtctgatttgatgtcgattctcttccactttatggttattctctacaaaaggttagtgaaccaaatactagtggaattttctcttcttttctttctattattctggtctcttgtcttctttagcgagcgaggctgccggtggcagagggcgaagcagcgacgggcggagcaatgcggctgcaggctagtgaggcagagggcggcgggcgaacggggcagtgggaggcgagtacagcggcggccatggacaccagagccgcccgtccttatcggtcgtgcgattgctgcccaattccgacggcgcggggatgacttgggcgacgtgcaggggaccatggcaggcgtgctctcctacatccactatgccctccctgaccccccccctgtgctttgtcgccgtgctccactacgtgctcgccccgcatgacgccgttgagtgcatcagcgcccttcccgtccgcgcaccaacctggcacccgctctagcgcttcacactactgcctacctctacaaacccgtggcatatagcatcatttaatggtatctaataatctaagcaccacgcttacattactaaacactactctgcatgtctgcatatgacatggagcaatcatataaatgaacattaaaccaatacaatcgcatatctctagtaagctagctacataattattatgagacaagtatgaactaaaatcggtactcaaataattatgtaaatgaagtaaagaaccaaaactatataaagaagaatatttcattactgaataaagtcttacaagagagagagaagctactagagccataccggagttctccggaagacttgaagaactaagagactattctatctctactccactagcactagaacaaagtaaataaactagagagagcttcttgattgatccttcttgatgtgtgttgaaccggagaaggtgagctccttaaatagacttcatatgacggttgtgaccattggaattgtcggaaataccccgcaaccatcattaagaagcaaccctggacgtccacgtggaaggacgtccacgtggaaggccaggatcagaggcgacaatggcggtttggccgaaccctagcccatctggcatgtgccttctccggtgatccgcttgatggattctaaactcagtggtatggtggttgggccaaatggcaagtgttctaatgggtttgtgggcccatttatccataagtatgccacacgtcgagttctaattaattagacggttattttccattgtttcttctccatttatatgaaggtctcatgcatacaaatacattgccaagtacaagtggaaatagattattcttaatcaaatatgcatgcaagcaggctccactatccgccgctttgcctgcctgctccagcccctcgccgccgcccactgccgcgctcgccggccgttgcccccccccccctctaccgccggcgacctcttggcgctcgcccaccactacccccgccctgttccgttgagcaccgctgcttcacctgcctgctccagctgtttgccacccccgctattgtaccccgctctacggcaaagagaagaaagaaaaagagaagagaaaaggagaggaaagaagggatgcaaaccccacattatttattcatctcagttacatgcaggcccagattgctgattaggatgccatgtcagtgaaaccacccatatatactgctatgggacctattttgcatgattttgaacatttgaggggtaaacatttctggtattggggattagggatgtcatatagactcaacgtaaagttgtgggacagtaggtgaatttattcctttttgtactagtgtccaccactgcagtccatggtggcgtcaatttctacacagtggcacacgtacaacgcaagcagataggcctaatcgagggcgcaaacgtggggataggatttggggtggcttggggcgacacctagtggatggtcaaggatcgggctcgtgcaacagcaacgacacgccacctaggacagggcatgcctaggttaggcggctcgcgcacgtgctatagtggcgcggtcgccttgttgttaggaggtcataccgataccgtgcgctaggtagcctcgaggtcttctgggcgtagcagccagccaaccaaggcaaaggcacctcagcagcagtgtcgtgtggcccaaaacctatagcgagcgggcacgacaaccaggaaaagtgtgtgcaagtgggagaaaaaggtggggagggtggtcgggttctcactgtgtat

SEQ ID NO: 80112 - DNA, 779 bp, Oryza sativa
ttctctcactttatcccaaattttgcgcagaacaaatttagtgctctgctagactgctacaaggtacagaccacttcaacattggtaacacttgattaattacaacagctggagtattacaatggtacaaaacaccagatgagaaaacaacattaatttaacataagacaatttattgtacaattcatcttcatcatgtattccctttcctccaactaaatcatgcattcttcacttcgtgaattactgcattgatatcctacatcactcatgtcctcgatggtcaatgaaatcaccatgggaagttgtttccatttcatttctttataatggattttcctatgaaaacatggtcacagacttaactctgctgaaaaagaattttctccctgccctcacattattgccttttgctcttgcaatctgtaatgtttttagtctcgaacaatggtcacaaatggatcatcttttatttcacaaaattcatagaagtaactataggttgttatccccgaaaaaaaaaactatagcttgttatgacaagccgtccttagagcttgataatgtcatggcactttaattagcaagatcatcaagtggagctcgttcctgtagagacattggtagttaagacttgaaaatagcctataaagagtatagatggacacataaatgtataattatatatactgtaaatgataatattatggttcagcattttcataaaaaaagatagtatggttctacaacttgaaacaatgcatattgtcagggttacg

SEQ ID NO: 80113 - DNA, 2568 bp, Oryza sativa
ggcaagatggactggatggccacaaacttctacgggcagccggcgcgcgacatgcggctccggtacgtcgagtattacgtctcggaggaggagacgacgctcaaggacaagtacccaagggaccactacgtgttcaaggaccccatggccatccacgcgcagggctggccggcgctcgccgagatcgtcatgaagcaggacgtcacggtgaatgtgacaagattcaagccgttcctgctcaaggcgctcgacgaattgcaggaataggaggagcgccgtttgattggttttgtgtgggcgtggctcgtccataagtgggatgtaggatgttttgattttatatttatattgtaatattgagttaatcaatgtaatttatttcgttggagattcatggtgtttgtcattcagaaaaatatgatttcttctttttggttgttgaatgtaaaagaaagaaagaaagaaagaaggaaaagcaatgtataaatttcagcattataaaaaaatatatatatacttcagcccaatttatgttcacacgactattataaataacgggcttaagtagtgttcttctttttggacacaaatgtttctagctatacataacggaggtcatgggatccccgtccctgaattggactgaatcgagatgttaacagtttcttactactacatctattctagaacgtagcaacctaaaaccgattttgatacatcataataccatatgtcaaattcaattataggttgctatacttaggagcagagggaggacaattgtcacacccggagattctgcttttccgtagtttctaattcaccaataaatcgtctacagaaattactttagttaactagaagaaaacccaaattaacaatgtatttaataatcgaaaatatcagggagaattttcttcgaattctctttttgctctaaaatcattacaaggacttaaccgaaatattcagagcatcggagttaatgatgttataaattgtcaatatttgaattaataatattttttctctcccgcctttcgtcgagggtcgtgccctattcactcccctcttcttctgcggtttcgttttgcatgatgagccaggtccgattttgttcgcggattccgtttctgttcttttcctaaaatggcaccgcatttcttttccaatttaggaaagttttttttttgacgtgaaacatgtaacatcctgatctttcgtttcttttaaaaacctattttaaatacaaaactattttcaaaatttggttcttatttgaatattagtgtttgtgccattaaagatctcaaatctctccttccaagtccacaaataaactcccagaataccaaactccacattcccttttacagtccatttacaatctttgaatccaattccaaattcctgattcaaattccaattcaaatcaactttgaaactcctaggaaaaataccaaaacttcctatccttttgggccatcaatcctctctttccctctcttcccttccttgggccagcccccacctccctctctcggccggcccatttcctccccctcagcccacaaccagcctggcacatctccctcttcttcctccctacccagcagccatcctcacgcgcacgccacgtgctcgacgaaatgccgagccggacgagcgacgcgtcgagcagcctcgcaccctccgcacagggccatgcaccgcccgagtcattccacacagtgccgcatcacgttgtgctgcgccgcgccgcaacgaggtttggatgagctcccttccttgccctagaagcccctccacagtggccaacgatgtcgacacccggccccatgtcgacgccgtctgcaacgccgctgctccccatccaccatatcgcctcctcgagctcgagcccagctgcagcaagtccacgccgcccgcgtgagtcgtgttcacgccgccgcgccgccactgtcgccgtcctgtgccgatgttgacatccgcctcgccaacactgctacacccagtgcaaaacctcgcattctcgccctccacctcccgtagtcgtgagtccacacattcggtgtgcgctgcgtgcacgccgcccacgccctccgcgtcgccactatgccaccacagtgccgccatatccattccttgctacttccttctcttcgaagccactgcaacaaaattgtcacttcctgttaaattcatcccgaaataaaaatcattctctaaaaaaaataatagaattaattaaaattcgaaaagaaattagcaaaccttaaaatgcgtacaagaaaatttcgaatgtggtccggaggatttttgttaaattctccttggtctaaaaggagccctcaaaatttacttgaattttcagaacgccggaaataattattaagcaacaacaacaattaagaaagtttatgaaaaagaaaactaaaaataatcctccttttcttttgggccaagtctagcccaaagttcccctcctccccctcggcctgcggccgaagtctctcttccgtccctctctttttcctttcccatctctctctcgggccgcccctccct

SEQ ID NO: 80114 - DNA, 7830 bp, Oryza sativa
tcctgcagccccatctattataagcatctagctgaaccaaaccaatatataaggttctagctaatcaaattataacccataggaaaataaagtcatctttggccctaattaaatgggaaaggctcaccacccggtgacattcgaaaataaatacacagttgaaataaatagagaatttaaatataggatcaacatgctcaaaggaattgtgtttgggatctgtgtgacttgccttgcaataatcggtcttcaattaatcttctggaatacttccgatgtactcgcgaaccttcgcaacgacggaaacgacaagctaacacgcaaaacgaagaaaaagactaataaaaaccaaataaacagtacatataaagtaaacaaacatgtagatcatgattttagatgaatttagagacttgaacggcctcattcaatatcatataaattaattatgaattttacaagatttaattccaattaatcctattaaagaaaagactattcaaaattaattaaaccgtttacaaatgatttataactgagataaagattaaaacaacctccagaaaagattagattatatttggtagatgacatatgataaaaagaactaatatgccattgaagagagggaacggatttatatggctgagattaatcttgaccgagtcgaccaagatcggattagattaatctggcaagcaagcctcaagagataccgactcaacgagtcaattctacgtgacacgggatcacccaaatgatcaaccgaaaccggcgaacggaaccggcggctctgaacggctctaaactaaaggacgactcaacatggacgaacgaacgaagcacggggaacacctctttcgaacgaacgagcgaacgacttaacaacgactgcgactaaaccggtgagctagacacgattcacggtaaagcccgggtaccgcaaacgataggccggtaggaatttagggatgcacctacggctagacaacttgactaccgagcaacggttaaagcggcagctaggttaaagcggcacacagctgcgacacggcggcactagggcgacttggcttggctaggcggcggcgactcggcggaggcacgcggctagggttagggcaacggcacagcgacgacgacacacaacgacgacagagcacgaaagcaaggcgcagcagctaagcgtggcacggcggcggctactcgacgacacaaacgagagattaaaaactaaaccgagggaacacagatagacgtctcaccgaaccaaagcgatcggagaggaagggtcgacgatgacggtccggcgacaacacacggagacgatgacgacactagggccaaacaagattagattagattagatgggattaagaccctagggataaactacaccagtgaacgacataggagcggcggttgccggcgaaccatggcccaataatgcaaacggagggcaccgggaggtagagaaggcgacggcgattcttaccaacacttacgcgacgatggacagcgacggaagatggccggcgatgagcttcgaagggcggcgaggtactgtccacggcggcgatgattttccggcgacaacacatgaagatgatgacgacactagggccaaattagattagattggattaagaccctatggataaactacaccgatgaacgacaaaggagagaggaaagctcactgaggggcagcgtgacgatggatgatgacggcagacggccggcagcgaggtagaggcggcgacggggacgggtcagcgacggcagcgacgtttctgcaatctttggcaaagaaaaaccggtggccgggcttcaccttgctcctgcgaacccaatggagtcgacggcgaccgaaagaggcggctaaggcggctgctagctgcggctggaggcgcagcaaaggccgaaaccttctggttcgcgtcggcaagcggcttccggcgggatttggcacaaaggaaccaatggccggggtggagctcgactttgcggagccgagggaggtggtcgcgctgaccggcgacggtcggggcgatggcgcacggcggctggagcggcggccggaggtggagagagagggagctcgcggggagagtgtttccggcgacggtggagatagggagaggtggcggccgaaagaggagaaggagcgggctctatatatagccatgggagcccagggatcgagcccacgtcgacgggaaaaactcgggaaagtttaggatcttcgccggaaaaaggaaagattgatccgcgaaattggaaaggatttccatagaaacttgtgggatttcttggggaaaaggaagaggagattgagaggattccattcccacaactaatttggaaaaaggggcaacgaggtggccggattagtgggaggaggcggcacggctgcacaggctcgggacggctcgggctctgtctggaggttgaagatagagtactgtagcgtcagggaggtcaaacagacttctctgcgggctgagaggagaggagggaatgggctgaattcggcccaagactaggaaggaagattttattgcttttccaaataaattaaccaataagatgatctttcaattgttaaaaatacttccaatgctcaaataattccaagaaaaatcttgaacatacttggacactctaagtatttaacaaaattgaaaccagctcatttaatgattaatttaatatgtgaataattactgaaatgttctttgcattattaacattaggaattgagctctgaaaaaattcgagaaaattccagagagtataattaatcatggagaatttaataaaaattaaatccaaccattctttatatttagaaaattttatttcccacatttaacttcacttgtaaattaatgtacttttaatataaattctaataataatttattaattaatttataaatcctgaaacggaaattcaggccgtgacaaaactccacccgagaaaagctagattacatggtacaagcgtgtattggctagcaagcaaactcattgggacgagattggaatcggcgaagcacttgccctcaccacagcgaattcagccaaagatgaacacttaatggccgctgccacatacttctgtctaataccatcaatgcctttttgttcaatcaagggccgatgacaccaaccctaatagatatcaccatgattactggtctggacgtgtcctcgtcagctaatcccatgaatctgaacaccaagaatcagtacgacttcaggaccaagagtataggtggttggtctagttatgtggcggcatatatgggccagggatccattactcctcgagaacatgtggccttcttgctcatgtgactagaaaagttccttttctgtggatccagttgtggtcctgcaaccaactggcagtttgcagccgaggctctggaatcaaaaagagaatttcctttaggcaagatcctcctcggctacttataccaaatgctgaacaatgcatcggccaagatagatgtcggctcagcggttggagcaggtggaccatggtagctgctaaaatcttggctcaacctgatggtcatgaaagtcgtcaatcggctatctatgacagaagctgtattccctaggctagagccgattgtagaagatgatgaagaagagcgcacccatcgtagatgcatgtcatatggagaatatgcatccacaccagccgatgctggagcaaaattattggctgaattgctcaaagattggttctgtagtttttatgaggactttcaaaacgatgctcgagtttggtttccttatgaagattcaatgcatcttgacctcccatcagacttcagatttgaagatatcaaccatgaaaaatttcaaaaatctagagaagtcttctcagctgcaattagcccatgcattcttcctatcggcatacatcaagggaggaatattcaggtttcttatgaattttatcacccgatgagctctgccagacaacttgggatgggtcaactaccaatcggcttgttctttgctgataaaatccaatgccgagaggaaatttcatcaaccttgatgatggatcagctgctcaatctccaaggacctcctctgggcagcattgaaaatatagagctggcaagatttaggagcagaaactttgacagatgatggggtgaatggaagctgcatctgttccaccaaccggcctcaatgtatatgacagatctctttcttgatgttatacctgaggtaaaccttaacctcattaatttcatttgaataattgtcaaccgattcataacttgactaatcttttcttctattttgcagacaacagaatcttcccctccacaccaaagcaatagcggcaaagatatcaaatatgccccaagtctaattccaaatggaggtggaccatctccccctgtcatcggctatcatgcccccaagacttcaactcttctccaagggctcattagagaactagccgatgctggcaaaaagagaaaaaccagagcatcatttgtagacacatcgactctggctccaaagaagaaaaccaagtcaaagaagaccaagtcaactgatgatctgtctgccctagatccatccattgagcaagctttggatgaacgagagatcaaagaggatgttgatgaagctgcagctgaggtaagtgatacagaaagaactccatcggcttcacctaaacaaattcctctgactccctctgctccagctcacttctctagggtaaatatctttccttgattcccttttataactattttatcctcaaccgattatttactaatcttgtctttgcagaaaaaaagaattgccgtgaagaagaaatcggcaacaacaactctcaaaccggctccaccagtaagatgttcttaatttctcattagccgatcatagccaatcttatcttaacatttatctctttttgcagcctcctgctcctccttcttcccctgtacaacaatcaccaagtaaccaaactccatcggctacagggagccattatgttgaagaagaagaacaaccagctgcccctgctatccaagtaagtttccctttgatacaagaacttagattggctatgtctatttagctcctaactctcttgaaattgttcttgtaggttttagccgatctattctcttttgacatcaaggactactttgatgaggtagaagaagaaaccacaagcaaggctctagcccccttggatgacatatcaagaaaacacttgaagatatatcccttcgggtagagtcttcattagacaatctggtagccgactgtggttcaattcgggcacgatatccagaaatccaagccctgatcccagacgatttggcaaacaccattactctagcagtattccttgagcaacaccaatttgagctggaaaaggctaagcaacatatagacgatcggcgagagcggatgaatatcgaagtcactattcaatccaatcggcagctcatgcatgaagagaaagccaagttagatcaactctctgttgggccgattcagttgaatatagattggcttgaagctcgcaaaattaatctaatagctcaacttgaggaatgcaacgctgaactggatcatgaaaaacaaaagctagccaatcttccaagtgccgttgaagaacagaagtccagactgagatcggctatcaagaatgtggctgacacgactaaatctctcaagatcatccctggaaccaacgcccaagacatccaagccatcgaagaaatagatcaaatcaggcaacgggctttgtcggctatccagcgctatctgtctcaatgacattttgtgtaatagactctaggaatttttgtaatcggctaagaaactctggctcttcatctaactcatcttgataatctttatgccgattcaatataactccataattttgctcaaaaatttgcaattttgcatatatgtgaccccctaattttacaatgtcaaaagcattgataaaattataatttgaactaagggcgatataacaatatcggccgtacatcggcaaaccaaaaccgattacaataaaaaaaacggagggcgatataacaatatcggccatctcaaggcgatgtgaatacattggctatcatgttttggcaacaccagccgatcatgcattaacccaaacacttgggtaatatttcttcaagtatttgtcatttagcgctcgtccatagacttctccatcgagtccttgcaacatgtaagctccctttgacacaaccttatagatttgaaatggtccttcccaattcggtgaccacttgccgaatttgttatcccgagtcccaatcggcaaaatcaattttcatacaagttctccttccgaaaaagacttgagtaccactttcttgttataatgtcgagcaactcgctccttatccttggtaaccttggcaagggttcttaatcttggctgaaccaagtcttctctttcatcggccatgagattataatattcatcagctgtcaaatcattttgcaactccgttcttcttgagccgattctaacttcccatggtaaaacggcctcatctccgtagacaagcttataaggagggacttggatcgatccatgacaagccatccgataagaccacaacgcttcggccaatcgagtatgccactgccgaggataatcagaaatctttctcttaatcaatttgatcaaactcttgttagatgcgtcggcttgcccattagcttgtgcataatatggtgaagaattcaacaatttgatacccatgctatcggcaaactgaacaaactcatcggacatgaagattgaaccttgatcggttgtaatagtttgaggaataccaaatcgatagattatatgctcttgaacaaattgtatagcatccccagaatcaaccttcttcaaagcaatcgactctacccacttggtaaaataatcgattgccaccaatataaacttatgccctttactcgatggtggattaatcataccgatcatatcaattccccaacctctaaatggccatggtttaatgataggattcatagctgatgccggtgccctctgaattgctccaaatttttgacaatcttgacatcccttataatatttaaaacaatcctccagcattgtcagccaaaaataccctgcacgtcgaagcaatcacttcatcttatgagccgattgatgagtgccacaaatgccttcatgaagctcaccgactgcaaccttagcttgatcggcactcaaacacttaagtaacaccccatcaatcgtccgataatagagttcatcatccaataaagtatacttcaacgctctatatcgcgatttccgagaagccgattgagatggattctgtaaatattaatgtacatcatatctccaatcatcggctgttaatgcagcaacctcaattttgacatctttgatcatcggcttatatcccgaagtcccttgggccaaatcattaacatcaatattctgctctcgagatacatgcttcaaagtcaccagccgaaactctttcatcaattctcggcacttctcattataaaccatcaatgtatcatttttgcagttatactcccctgccaattgactgatcactagcaaagaatctcccataatctcaatagcatcggcttcaacttccttgagtaactgcaaccctttgagaactacctcatactcagtctgattgttagttgcataaggtttaatagtataagcaaactcaaaacttgccccccgagcagaaattataaccaagccgacaccacaaccat

SEQ ID NO: 80115 - DNA, 9914 bp, Oryza sativa
tcactaacaaccgtcaacaaaaccccccaagcttgaacctttgctcgtcccgagtgaaggacaaggaaataaaaacttggttgttgatcaggagttgctaacatgatgtatatctcaaaggtataggtgcaaggtatatgtactctctcttagattaaataatctttcgcacgatggcttacccttacccctgattctcacgagacactgcttctccttgccttggacggttgaaagacagaacaacaattagtgtaccaatcacccaatctttattcaacttttattacggaagttttcaaatgatttttgcaaaagaaaaccaagttcctcatatgattcactcagtctctctctaagtgtatcaatatgaattcctcaccatttttgcctttttgattcctactctaaggtttgatatgtggagctggtagggatcaaacatggatacttgcattcacatttattactaagtcaaaaactcagactaaagtagataactaaacacactcaaaatcaagatcgtgcaaagtgtgtgtgatatatggtggaaatggcatatgaagataaataaagaaaatgcttctcctttgtgcagtttcttctctcaaaaatccttcttttattgattaggagagggcatggctatatatatatatatttttcaatatcatgctcatgcttgatagagcataactttatattattattattattattttttcataaccatgcctttccctccctttttttttctttttctctctttttttcaaaaggactttccttttaggagaagaaagcacataaaagcatggagaatttattttggtggtaatatggaaatggaatgaaatagaatattgctagctccaagtgcaggagtttagcatgtgcataattgtgggtgtatggtcttgatcacagagcatgaaaagtatctacacaagtcacaagagtttgacaaagttcaatggaatgacaactaaccaaaatgtatatggttcagacatgatggcacatttttggctctggtagaaatttatatcaaatgaggaactttcaaatttatcattttgtaaaacaaaacatccggaattcaagtcaaactaggattaggatcatagcaactcttatttactatctcataccttgcaacaacttagactcagatcagcaagtgcagctcacttacctcaggttcccagataattgttagctacttatttatttaacctttgagagagtacttacctatggacccatatataagagatataaaacagagcaactatttaccatttcaacaaatagaactagtttgtcttacctagcatgactcaaacctatcctatctttttggtattttctattttgcaaattttttatgttgttttcaggtttataagatgcaattgaaaagcaaatatgcaattggaaagggaaatatgcaatgcgatacaagttacctcagtgatatctccccccaagcttggctttcgctcagggtacttgctaaggagtgaacccctggaagcggaagtacgcttgaaggtcatcatgctgttgctgcatcatgttattgaagttggcgaattgagcatcagcattctgttgccattcttgcatctgggctatgtgttccgtgaggttgtactggatctcttctgtctgcatatcaagggtatccattctccaagtgatttcaccaaattcccaatgagaggaacttgagcgccatccacttggagatggaggcacaccacttgatctgggccgttggttatccccccattgtatgtcatgaggcgcatgccactggtcctcactagcacttgcccagcttgagactccgatgctatggcgtggagcttgggtccatccgggtgcattcccagtttgctcccaacctgcctcatacatctgcacgggtgttgaggatgataaacattctcgttcattccttgccatgttgcgcgtttccctatatgctccacctgcacgagattcttctatggtctgcaggggaatggttagttcatggcagttgtacaaatgataccccgcgttaggcaacgggatctcatttgtacaaccggggaaaaagtatatcaaacattcatctactccatgttttagaatgtgcccttgcactagataattctcatcagtacagggacgagtagatgagatgaaagcaatctggtcactaacgacgcctagacgcctagcccttttgctatctgagtaatcagagaagtgcactcaacaggagcagaaaatcttatattctctaaccattgtcttagcatacatttcacaggagaaactttgatctttctaaccatggcaaacatgataatcaattcatccccctaatgggtctaagatcacctctaggaaacaaagtcatagcaatccacttgtgcatgagcctaagtgtgggattatggatgtcattcgttctaggtttcttgcaaattggagcaccagaaatatcttcctaaaacctatttttctcgaacctagaaattcctttctgaagatcgattttacaggaatcgtgaaaaccaagaagtgtacttaatcctttccatgtaagtgtgtactctttatgcaaaaagcgaaaggaaattccatcttctatttctttcaaaatgcatagaaattgcaaagtaagcagacgagaaccaggctcatctaccgcagcaaatctctgtcaactaacagctttccaaatagtacgaaaatcaacatccatacctatcttttcaagcatccccggagagtattctcgtgtgtgagcatactcctggtcactcagcatgtagtaggcttgtctttccgatcatcgacaaggttgatgtcggcgtcgttcaggaaacgtcacggagcttcggcatcctccatcgagacattagctgatgaacgagcgctagactcgtcatgatgacttgacgaagagccggaccccttgaacaaacgagacagtcgcctcctcattctgcacaatggagcaagaacggactaactcggcgggggttagagtaacaagagtaattgcataagcaagcattatacccgcaccaaagcatttctcaaataagctagtagtataattagtataacatgaacataatgtaaagtaggcattcgtatactcgggaagtatttcaataccataaatgtataaagaagagtattctaaataaagtacaaagcttacaaaggagaagagaagagctactagagccatacccgaactcttccgaaggcttccggactcccgatttctactctattcctattccactaacttgagagaatatgagagagctcttgcttgaggtgtgtgagtgagtgagaaggtgaggggtttatatagcctcccaatgatggttgtgacggttggaatggtcggaaataccctccaaccttcattgggagctaatccacaccgtccagccgcaatcctgcatcaaacgatgccaggggggtttggccgaaccccctggttcggccgaaccaggggccggcccaacctggcccaaattcggcaggtggcctcctccgttgttcttcttcgtagacttgtgaattttggcccaattcatcgtgtcaattctgagttcttgacccattcgtacataagtctggttcttgacatcgtccgattgatttatcgtctgagttgatgtcgattctcctccacttttatggttattctctgcaaaaggttagtgaaacaaatactagtggaatagtattattctaacatatatatgcattgcaagcctaactagttctcctctattttggtaatattgacggtcgaaactgatcgctaacgaccgtcaacacagacgcagaatagaaaatgactaggagcatgcatctataactcatagaacaattagaaagccaagtgaaactcacctcattgcaacttataaaaactctgagatattgcattatcttaaatagtaatatatagatatgtcttccaaaatccaaataatgttattgcgtgtaaaaacaatataagttattagttaatacaagccaataaaaatattactgaaagtaatatatatagataaggaataaggtttagaacatacatggcatcctgtgtatccttttcatgacgttttttcatcttatgaaaacgattgacaattacatcattagtgattgtgcccaacatatccttctctacaaagcaaatgaggatatggctcagaaacttgtcacccatcttgttgtgcaaagcaaactctttagtgccttgttgtgaaaactattacggtcaccaacatgagtcaccaatctctttgtcttgttccaagaatagaaaccttctatgacaaatgcatcatacccatagtgattatcttttatgctgtccctaaacaaatagcaacataaacagtaggctttgtcatctttttcactatactctagccaattagacggattgaactgcctcttcttattcccaatcaacctatacagatattgaaaatcatcatgtggctgatatggtccccaaactaaatactttctccttatatcttcatgttgattgggataataatctgccatctcttccttttactaggatcccaaggaagcttgtccaaatcaattggttgaggcactgcaaaattttctctcggtattggtctagatgcatttgcactagaacttcctctagtggtgttcatagttgatggatttctaataaaaaacttgtccattatctttcctataaaatcatgagaaggttgattagatagagcacatgaggagggagacctagggctagggatccatccactataactattcacagggaagaggagtacttaccagggagggaggcagagaggacagcgagcagagcaccgctcaggtgctgacgatgaagagcgatcgaggaaggaaggaagtagcgatggcggtgaagatgaaccaatgcgggggaagcgcgatgaatgggcgaagaagaggagcggatgttcgacgtcccctcgactcacgcatgcgcgatggaaggaacgaaaactagggggagtggggttcttttttccaaatggactggggcccagaggtcatactactatgaatatacctaggagcataaattttgacatgggtccagggcccccatcgtgtgtacattaaatccacccctgcacgtattcaccggcagcatcattccaaccaattggaggtggcttaaacaaccatttgatggccttatgccagtcagaaataacacacataaacttcccatatcctattactccttccgtagccatctcataaaccagccccaatttgtactatcctccttctccacaattgcaaatgcaagaggtatcagctgattattagcaacataaccacaagcaattaacaatctggcctttgtacctccctgataaaaagcatgcatcaacacttattactggatgcaagtagggaatggcttcaatgcatggtccaaatacccaagccacactttgaaatgatcgccgcccttcctgattcatgggctttgacaaaagaacatattttgtacctgcatttttagcattaatagcatctagaaaatggattctctcttccacgccataatttattataagatattttgagcccataagaaccttcctaactaccgaaaagttgtgctattgctttctctcttccacgccataatttattataagatggcttcgcatttctatatctttgttggactagtgatctcgcgttttttctactcaattccaggtcatcctttaatgcatcacatatcacattagcaatcatagaagatgataactgagcatgatcaaatctatcagccggtgctcgacaggtgtgagcatagggacatttccttatcatccaacctgaacctatttttgttggaattgcatagagtctccacatgtagctattatcagtgcattcagctactagtttagactgactacttgtgctatacttgatttctgaatttttacatatatgaaactcgcctatagcaatttgtaggcgctcttttgaatcaaaagtctttccttgtgctagtgggttagaaaattgattcttacgtccaaagaaactctcgtctgctgttgtcttccacaacacagatatatcactaaatgctttataggattttgtccagatgcacgcataaaaggaaatgcattgacagaatgaacaactcgtggttctgggggactcatcatctgaactattatcaagggcagcatcaaaatcatgctcgttgtcatcatccagtccaaatttgtcctcaccaagatctgtctcctcacctgcatatgtgtcttctgcagcattgtcatcatctatagttggttgtgtttcgcaatccacattatcctggttgacaggtggagacaactgaactgttgttgaatgtataccatgtgctaaagtgggtacaacctttgcttgtgaatgaactctacctggctccaaagaaacacctaaaccatcccttccgagtgcctagttgatgcaaccaaggttgtactattaacctgacttgatcttgcttccgtagaggtgcatttgacataaagctcaacaacctgcccacatttcttctcaaatatcatcttccatcccctatcttcataaataggaatcaattgaaaatattgtggtccaggatttccgatatcaaatcgagattggatactcattggacaattatcctcagtgtacccaagggcttgaaaaatttcttttttgacttcctcaaaggttttaacctcaactgctggaaaagttatttttggaggaatattatattccgcacccttagctccatgttgtattttcccatcaacatacactagaacaataatcattttttctccgccaactctacaaaacaaaccaaataagttagcaaaacaagttatataaatattagttagataataatctacagatatatccattcatgtttaaaaaatgttgttttgcttagtaaaaatgtcaatgaacagctcataagttaagaatatgcagtaccgatccaactacaataacaaatgaataaattatgtctaattaagaaagtaaatgggctatctacaataaagcaaacatgtcaatatataaagtatgtatgaacagctaatcaatgataattatataaacgtatgcatgggcacctgctgttagtgatatgccctagaggcaatcatagagatgattgtatcatatactatgtttacatatttatccgacattgttccttgaaatagataactccttattggttaatgaatatgtgattctttcatgagactctttatgttgtttgttactatttctaaaggatccctgatcaaatatcatatgtggaacaaatatgtttatatgatcagcacatgtattaattgatgatcatgtctcatggatcatggtatagagataccaaattaataatatggacatatgttggtgaacatgttgttggatagacctaacatgagacactgcaagagccatatgtgttgtgtcatcagtgatctcatttagtgttggtgttgaatccttacatctaagattatcatggttctcaacatatgtagtagcttacttagtaactgctaaacgctactccgtaaatgggtagctataaaagtagttttcgggtatgctatgaaacatgtagtgggatatgaataatcaagatgggattttctcctcccatggagagatatctctgggccccttgatgttgcagattatggaagtgcatggccgtgccaaaggtgattgaggagtcaatcacaagttatataatctatcaacaggttcgagtgaatgattgagctattagaggatggcacatatctagccttgagcttaatcgatatcgtgaggcaaaggggttcatacaagtatacactagaggttcagccgatatgatctttatgtatgtccggtgggtcaatacattctgctaggggccgcttgtgacacgtggaccgaaaaggagttttcgggttacagccgagtatatatgaacctacagggtcgcacgcttaatgggccggaataaggggattggatagagatccaatatgagcttaattccgatagggatccgaataggagtcctacgagccttggaggcccgagtgatggatcctatatattcgtgagaggtgtgaccggcggaggcatcgcatcacgtgagaaaccctagccgtcacttccctccccgagcaaaaccctagccgcgcgcgggtgctagcacatctgcgcgtggcgttccgtccctgtacgtgtggataccggtagaggcgccgctggtttgcggtgctgatcggcgtgggagtacggcgaggagaacgcacgaggaggagaaggtcgagccggtgcaatcgactacttcctctacatcgatgcgcgctacttcgcgagagttcctttgacttctcagcgtcttcttccgctgcacagcgcgtcgagtggtaacgatctatgatctaatacttgcatggttccttgtttacgcgatagaaaattttgacttatgctatcgtagtctacacgtatcccaacacctgcatgttgcctcacagcggaaaatgcatgctgatcaatagacgtatgcatgtgtgatggaacttgcagagccgctgttgcctcacacggtgagcagccaacggacgcagcgccaaggacaccttggctggattggtggcactgactgatggtgaaatcgaaggcgctggtgtcgacagcgggagtgacgacgtacggagatcacagctaacacatacgacgatgtgccagcgaacggcgagcggcgaaccctaaacctctaggtcgatcgatttttttcacgttgtgccatcgacgcaataggttttcctttctataattctcgttttgttatgcatttctggtctggctgcaccaacaagctggtgtacgctgtttccagtagcatcgacatctggccgctgtttgaatgcgcgtccaggtctggacgctgttagaaacaccgtccatcctgttttgataaatcctccaaaaaaatactaataatttaattttaaaaatattaattattattaattaagccatctgatagccttgatacttttatctttaggaaaagttcacgttttgttttactagaaaatatatccgtacgttgcaatggataaaaatgttttttcagtggtacaaccgctattagagactaagcgatgaatggaaacattaggatcaatattcattataattgaaaaagttaatgaaaattgttccttcgttttgggcctaaaacctattattttcttccttttcagtaccaacccagtccgctacctccctctgctcgatctgcctttcttcaatctagcccacaagtggagctatgatgacggttgttatagaccaatttcgactgtcaatataactaaaataaaggagagctagctatccttacaatgcatatttattttagaataatctacttccacttgtacttggattttatttgagtgcaggaattgagcaaataaaataaagagaaaatgaaaaaacctcactcctaagcaagcttattgataagatgggcccacatgtcaggtataaccgtcccagaaattgtcataactgtcacaaccatcatagggatccacctgatagtgacccaggagaatttggaggcctgctgggccggcccaggggttcggccgaatgctggcaacgtcggttcaggctagccttacacgtggacgtccaggattgcttgctgaaggcggttgcggggcatttccgacatttcgcatgctcaaccatcaaaactgccgtataaaaggagaagcttattcact

SEQ ID NO: 80116 - DNA, 3847 bp, Oryza sativa
catgagtgctttgcttcgtatcattctacccatataaatgtcttaacccctgcttagactttgattatgcaagtggcatgtatatattattagcatagttctctcttaaaatcttcccttgggattaaataaatatgataccttggaatactccagggtgaaatgctataatgtaatatccatccgcttgcggattccttttgtaaaccatatatataccaggaccatttctagcatcattactgggaatttatttttctagtaatgtcgttaagaaataccaacaagctataggcccaggtcgcacagccgactgccgtcttcggcctccatatagtcctgtggccgtatggcagagccgatcttccccatcaaatctagccaaatcttttttgatctctcaaaatttgttgagggcttttgatccactcgatctcctctttccctttttcccgaaattggaacgaatccgcaaaattcgggatagaaatggctggacggccatcatcagcaactgagattaaatctagttaattaaaactaaattgaaaggggaaatcatgagacaaatgaagagggaggaatggggaatcaatttttgcaatcaaacggaggagaaaacgcatggggagatagatcgaagtggcaacagtgctaggttttggtctggcggcggcatgcaatgcataggatgagataaaaaaccggctaccggaaaatatcagataaaaaacatacaatttttttagtttctcccaatcagatatgcggtaagggcaaatcgcatgcgcaagggcgttgcgggcccaatcgagcatgcggaaaatcatgcgcgcaagggtgttgggggtccaatcgcggcagcgcgtgtgtactggaagtgcatgtaggctcctaattattttgatgattaatgacaatacgattagagaggactaacaattttatttaagtgaatgtgaaggattgttagtccgtgatgatttgtagcgcaatgcaaatcttaatgagtgcgacaaagtcgtgagttgcggcaatgatcaaaggctatattgtgtattttcattatttgggtcattaggaaaaccccacttttaagagggattatgcattgacatattagtaatgatgaatgtgctcaaaacaatttttaaaagtgtttctcctcagtttctgtgttctggaaattttcagagttgtctgaaaaaaattttcggaacttctgaaagtagtcagaaccaattttagcttctagaaatttttggggtttaccgaaagtgattttcagaatttccgaaaatgaccgagaagcaaaataagtttccgtaaatttttggacttgtccgaaactggattttggaatttccgaaaatggcagtgaaggcaaaattgtttctataaatttttggagttgttagaaatcgattttcggaatttccgaaaatgtccgcgaacctgaaaaagaacttctagaaatttaggaatttccgaaaatatccaaaatgttgttttggttctgaaaattttcggacttgtccgaaaagttttcggaatctccgaaaaatcttcaattgacttcattgtttcactgatctggaaattttcagatatgtccgaaattaattttcagaatttctgaaaaatgcaattattgtgcataacgggtagatctggtgatgtggctatatatagcccactctttccacttgtgagggctactgtactaattggatatttcgcgccgttggcttgttcgtcttaagattcagttttgagccttattttcttgtttcccctctccacccgggtttgatttggatttggtgtgtgtgtgtgagagagttgtgcattcgagtttgtgtgagtgcttgttgttggcttcgtgaagatttgtgagcacttgcatcatttccaggagttctttgcatcatttgttactcctagaggttgaggactcctaggcggctaggtgtaacttccgagccaccgatctatgtgtggttggccaggagaagttggtgaaggtcagatctcacctccgaaagggaagagataccaccagtggaaggagtgttttgtgaaacatcttgaggaaagggttagtgaagacctggctctttgtgatctcctgaacggagagtagaatcccctcaaggatttggactccgggaacaactcagcttgcaacaactttggtgatatccattttctcactcctctagctttgcttgattgtgccgctattggtctagttgctatctgtgctagcatattcttgttgtaggcagccaaatctagaatttactttgatttgcgcatactctactattttcggaaattccgaaaatccctgattccgcatttacttgagtttttgaattagcctattcatccccctctaggccttattgaccctttcatggacaatggactcaggcgcggcccgatcgctgtgtgcagcaaggggcgtgtgaaaaggtgcggacccaattgattcgcgcgcgtctcggataagaggggcactatggtgtaagaaaaatggaaagaatttgacagaaacataaaatttaaaccgattcaaacgcggatgatgtaccaaaattctagcggaaatatctttaatttttataatagtagagataacatcaaatgttaacggttcactataataggatcggaagttcctatccgtttccgtttttagcacttctgtcacttctcgatggtttgctgtcaatgttactcatctactttcgtcagaaaaaagggactcatctacacacgtaaaatggcatttgtacccctcctttaaataaagtatcatctatttttgtcacatccatcaatctctctcttgtcgccacacgccagtggcaaccttggcccgcgacctggtgctgcctgctccatccagtccccttgcttgtcgtgtcccctgccgcgccaatgattgtcgcttgccccgtcccattctctcgcttgcagcaactcggccctcaactgcgctctatcgctgcaccaccgccgctgccatcaggagcaggtgtccgacaacctccgtttgtcactataagcctcatcctctgaaatgaattttatttgcttgtcgtagatgtaagccctcatcaatttttcatgtgggaggagtattagagtagctagcagattaagctttccttcgacacgtgcaagacttgaatatcagttacaggaagttagtcatgtaaaaattgttgaagtgtgctgaatatatagaatgaattttgccatatggtgtcgagccaggcatgatgggacagatggcaatggcattgccgcgccaaatggaggtgggtgctggccgccgaatgccgcactagcccttgggctgactgtgagcagccaatttctgcaggggatggcaaggtgcagcagcggcagggtgtctggccaaggttgccgtgtgcgcgcgatggtgtgagagcgcagtcgatcgatgggtgctgtagcggcaggacgttctgtttatcatttgcttagatggaagtatgaaactattaactgggagctagtttcatatgagtatgagtttagagcatttgagatgacgtagagctctagcagatagtcagtctctggagatgtggaacacaactggccgccgccttcatgtggtttgattggtatgtctcaggctaaagttgattggcacgccgagtcccagcaatatatcctatgctccctactcgatgcttcgggtttcatattatgttggatatttgacttgatagggaaatgatgagattgcatgttttattgggaactcatccaactaaatatttatatttcacactgtcatttcaagtag

SEQ ID NO: 80117 - DNA, 29386 bp, Oryza sativa
gatctatctctatagatccttatgcccagaatatatgctgcttcccctaagtccttcattgaaaaactatttttcaacgatgtcttaacggattcaagcataggaatatcattcccaatcaataatatgtcatctacatataggattagaaacaccagtgcgctcccactaatctttttgtatacacaaggctcttctttgtttttgacaaagaccaacgccttgactacttcgtcaaaacgaatattccaactctgagatgcttgcttcaacccataaatggatttatgcaatttgcatatctttttagctgattgtggatcaacaaatcccttggattgtgtcatgtacacatcttcatcgagatttccattgaggaaagctgttttgacatccatttgccatatctcataatcgaaataggcagcaaccgctaaaacaatccgaatagattttagcatggcggctggcgagaaagtttcatcataatcaacaccttgaatttgtctgaaacctttcaccaccaatcgtgccttgtagatgtaaacatttccatctacatctgtctttttcttaaagacctatttgcactcaatggcttttacaccatcaggtggatcaaccaagttccaaacttgattgacatgcatggattctatttcggatttcatggctccaagccatttctcagagtctggtcccaccattgcttcctcataggtggttcatcgttgtctaacaacaatatatcacattgtcctgtagttaacaatgcatacctcgcaggtgtacgccgtatcctttcggaccttcatgaagccggtgcttccacaactggttcaacaacaacttgttcaacctgttgaacaacatcttgctcagcttgtggttgtgtggacgttgaagcattttccggtgtttcctgaatttcttcaggtcgcaccatgctcccactatcctttcttgaaataaactctttctccaagaaaacactgtgtcgggcgacaaacactttgccctcttcccgattataaaaataatatcctttcgtttccttaggataccccacaaagaagcatttatctgatttaggtgtgagtttgtccgattgcaaacgttttacatagacctcacagccccaaatttttaggaaagacaaactgggacgcttccctgtccatatctcatatgatgtcttatccactgattttgatggaaccctatttagggtgaacgcagctgtctctagagcgtaaccccaaaagcatagcggcagatcagtttggctcatcattgattgcaccatgtccaacaatgtacgattcctccgttcagacaccctattccactgaggcgttcctggtggagtgagttgtggaacaattccacactcctttagatgattgccaaattcaagactcaagtactctccaccacgatcagatcttagatacttgattgtcttgcccaaatgattttgtacctcattctgaaattccttgaacttttcaaaggactcagacttatgcctcattaagtagacataaacatatctactaaagtcatcggtaaaggtaataaagtacccaaaaccacctctggcagttgagctcattggttcacatacatcaatatgtactagtcccaatagctcacttgacctttcactttgacccgtgaaaggtgcctttgtcattttgccaagtaaacaaaattcatatgtctcaaatgattcaaaatcaaacgagtgtagaagtccatctctatgaagcttctccatgcgtttctcatttatatgacccaagcgacaatgccaaataaaagtgggattcaaatcattaggacgttgcctttttgcattaatgttatagactgaacatccatcaagattcacaatgtataagccattcatcatgggtgcatggaaatagaaaatgtcattataatagactgaacaaccattgcccacagatctaaaaccataaccctctggttgcaaacaagaagcagagataacgttcttacacaaagctggaatgcaataacaattatttaactccaaaactaatcctgacggtaaagataatggcagagtgccgaccgcaacagcagcaactcttgctccattgcccacgcgaatatccacttcgcctcttgctaagctcctacttcttttcagcccctgcaacgatttgcatatgtgagcaactgacccggtattaaatacccaagaattagtagaggaagtagcaagattaatttctgtaacattaatacttgatgtggaactctttccattctgctgcttctgcttgagctactctaggtatttcttacagtttctcttccaatgacctgtctccttgcagaagaagcactctgcattcttagcgggtcctgtcttttgaaccttggtcttagagttgctagtactcatgatctcatcagagtttagctttctcttttgaccactcttcttgttgttgggcttgcgcttatgcataaccatcacatggttggagtttttcttaatgctttcctcggcagtctttagcatcccatgcaattctgccaaggtcctgttctagttgttcatgttgaaattcattataaacggctcaaagctgggagggagcgactggagaataaaatctgtagccaactctaggctaaggggaaagccaagcttatctagactctcgatgtaaccaatcattttgatcacatgtgggctcactgcattaccttctgcaagcctgcacgcaaacaaggactttgaggtattaaacctctcagctcttgcttggtcctcaaacatgttacgtagtcccgtgattatcgtatgagcatccaatgcctcatattgcctttgaatcttaggggacatagtagcaagcatgagacaacttatatcatggtattcattgcatcgcctttcatgctccctacattgagcagcaatagcattgttgggcaagtcaactggaaaaggctgtgtaagcacaaactctttgtgctcttgcctgagaacaattctcaggttgcgataccaatccatgaagtttgttccagtcaacttctctttctcaagaatagaccgcaagttaaaattggatggtgtaggagctgccatgatgtatgcaaaatcagcaccatgtttacatttaacctttcattaaacaatttaacaaaatatacttccactatgtattgtgaaacaaaattccctctagtaatatagtgagtcaagatcctcattttattagtgtctagtgagctttggcatcacagctagacaactatcaaaataggtaagcaacaccttgctaatcacatcatatgtgactcttgtgctgttggggtgacatctccatgtccaacccaacctatgccccaaggtccaaaactgttttgataaccttgtcaagtaaaccaataatctctgcatatagatgtccgacatctatcctattttatcatgataaaaagtgacactttactatggcaaacccatcacttatgatcacaaccgtaataggtgcaattattggaagagcataaattacacttaatttttctgagagaatctatcctaccatgttatatcaaatatacaacaacaataaagtaagatagatataaaaacctaagagaaatctaaggggcaacgcacacggcggtcccgttttttctacgactcatgcaaaggtcacggggtacatagatctcatctacgacccgccatgtgaaaaccttaacggcgtaatcaaattatgctgaaaccgagtcaatctcattggctcattttttctcattggcgtgcgttccagtggacatcggactatccgatgaacacaatcgcgctcggccttggtgagtactagacattccagtgaagtcaccaacacacattccgatcacctaagaactcatctacaacaagatagatctcatttactatactgtatatcaactatatgcaatgatctagatcataagctatacatggcggctctgataccactgttgggatacgatacgcataggctacgatagcataaatcaaaattttctatcgcgtaaaccaggaaccatgcaagtattagatcatagatcgttaccactcgacgcgccgcgcagcggaagaagacgctgagaagtcgaaggaactctcgggaagtagcgcgcgtcgatgtagagaacgtagtcgatcgcatcggctcgaccttctcctcctcgtacgttctcctcgccgtactcccacgctgatcagcaccgcaaaccagcgacgcctctaccggtatccacacgtacagggacggaacgccacgcgcagatgtgctagcacccgcgcgcggctatggttttgctcggggagggaagtgacggctagggtttctcacgtgatgcaatacctccgccggtcacacccctcacgaatatataggatccatcacttgggcctccaaggcccgtaggaatcctattcggatccctatccaaattaaactcatattggatctccatccaatccccttattccggcccattaagcgtgcgaccctgtaggttcatatatactcggttgtaaaccgaaaactccttttcggtccacgcgtcaacagcggcccctagcagaacgtattgacccaccgggcatacataaagatcatatcggctgaacctctagtgtatacttgtatgaacccctttgcctcacgatatcgattaagctcaagactagatatgtgccatcctctaatagctcaatcattcactcgaacctgttgatagattatataacttgtgattgactcctcaatcacctttggcatggccatgcacttccatattctacaacatcgaggggtccagagatatctctccataggaggggcaaatcccatcttgattatttatatcctactacatgtttcatagcatacccgaaaactacttttataactacccaattacggagtagcgtttagcagtccctaagtaagatactacacatgttgggaatcatgataatctcaggtctaaggattcaacaccaacactaaatgagatcactgatgacacaacacatatggctcttgcagtgtctcatgttgggtctatccaacaacatgttcactaacatgtgtccacattattaatttggtatctctataccatgatccatgagacatgatcatcaattaatacatgtgctgatcatctaaatatatttgttccacatatgatatttgatcagagatcctttataaatagcaacacataacataaagagtcttatgaaagaatcacatattcattaaccaataatgagttatctatttcaaggaacaatgtcggataaatatgtaaacatagtatatgatacaatcatctctataattgtctctagggcatatcactaacacttccttcgtctgtgtactttttaacactgggaacatggccgggtttatgagtgggatggatctggaagaaaggtggagttgggatatgacgccacatgacaggtgggctaagactgaatataactttttcttatgctaggagatttttttttcattttatttagaaaaagtttctttgagcaaagttgactggttcgaaaaattcaaaggtctacaatgttataaatcatcatgggtcctagccaaagcaactctatgttgttgatttgtttgtgtcgataagattatgctcccacatgacgcacagttgttatcgaggtctgatttaaaacgtcgataagattatgctcccacatgacacacagttgttatcgaggtctgatttaaaactagattacgatgtgagacacacagggtttgttgtcttttttttcagtgtttaattctaattctgttatatcgggccctctactccccgttcgctctttctgactaaggtttggcatgcgccatttccctccataattaggcgactaccctctctcttcttttacttcctcaacttcctcacattttctttacttctcaatcgcattcgatgcggcaaaatgacggtgtatgattctaaggcattagaaggtgctgcaagtgaaaatatgtagataattgatgttggtaagagcccgccctctagaaccgcacagcgcagcccaatcaacgggtgagcctggttacacacaccaccccgcatatactttcttctacgcttcatgtacttaaagagttaatccgagagtgatatggttagagggaagatgccttataaattggttccacccttgctaaataacaagttggtactaaacacaagtacacagctctcatggatcacacaagctaaattctaattgagtcaggatatcacaatgttacatcactagattcatttcaatatgtaagaaagtttttctagaaaatcttagcgaatgttaaaggtggtagattagaaaaataatctatttttgagtaagttaatgaaaaatatattttctcagagggctcatatcatgaaaaacaaaccctaataatctaatatttatatatttattataattttggtttacatgtcctaacgcacgtgtatttttctagcatataaaaacgatgatcgatctgtcaagaatttaaacagcaaaacagctaactaatctcggatttgggttacccaaattgagtggcagtgtatgacaccaagtcgctaacaaacggatcgaaccgtgaactgataaagaaaaggaataagttcactttgactcccttaaaaagtgactgaatctaatccatgaccctaaaccgcaaaaccggatatctcgacccccgaactattgaaatcggtgcaatttgactccctaggtggttttggagggcggtttcgctgacatggcgctgacatggcggtgttgacctagtctgtggggttgacgtggcgcttaggtggcatttgaattaaaaagtatctgtaggacccgtttgtcattcacacactaaaaaattgtggagcccactgacatgtggggccccacatgtcatcatctctttcttcttcctcccttgtctcttcccttctctctctccccttccaccggccgcggggagcacgggctggagcggcgacgggagctgagctcgccactgccacggaggtcggcgccggcgccgctggaggcgagatcgaccggccatgcaagtgcgtgagtcctgggcctgggagcccgacgggattggaccgccacggagctgcacgttggctgcggcccgggcgccctggctgaatgcttcatgccacagctcgtcagcgtcatgcgcgcagccgtcgagagggtctgcgtcgtgactcgtgacccaccaataaaatcaaaaaaaaaagaaaatcagccatccagtgcaaattcaccacaaaaacacggtgaaaaccacctgttaattatgaaatctccaccgcgatgcaggagatgggaaagagcaggtctcggagttctctttatataggccggaggggaggaggtcgaccgcacggacggaaaacggcgccggcgacggtggagctcccaattgaaaacaccggtttaagaaatcgattgggggcaatttagtgcgggattaagtgggatttgttggggaaattgatgcccactacacaaggaattgatttttgcaattaatttggaggagaaacgatagggcagggagatcaacggaggcggcagtacttgagtttcatgggagagatgaacagacgacggacaaaggtggaagaagctcctggcgagcggggcccacctgccagcgcatggacagcgaatggaagagaaagagaggggggaggatgaggagaggatgatttatgtgggccccacctgtcagtggtcccacccgtacttttggtgaatgacaaatgagtcccacacatatttttttttatttataatgccacttaagcgctacatcaacgccacgtggaaaggagaccgagtcaacactgccacataggcgccacatcagcgaaaccgtcctccaaaaccgtcgagggagtcaaattacactggttttgagagttggggggtcgagatatccggttttgtggtttagggtcacggaattttgagggtcacaaagtgaacttattcctaaagaaaatacagaatgaattataatcaggccgaaagtacagcccaaggccgggccaggcctatatatgtattcatactgacccatgttttcgctggccttagtctgaccatcaacaagaccaaagcccaaaggccatccaacaaactagtcaccctgcatctctctctctctctctctctctgtgtaacattttgattttgtttgaatgcaatttgatcccaaaactaaaattctaaacactaattaaattaatgcgttgcaagtggagcctaaatagctgacgatggacccatcaatcaatactaatagcacttcttttactatctaaaatactatcgcaactttttttaagaaaactttcaattgtaacagtaagtataattagagtataattcaaatgcaactgtgccgggtgagttttttctttcttcgctccacacaaatctcgacaggatctgaattcccccccttttttccttcaaaaatctcactgcaatctaacagtctataagttacggacatgtaaaagtttttttcacccaaaaaacttgtaatattctttagcattatcatttctttttgttacattcagatgagttaatgctttgccatttctcttgacctcttgccgccatttaatcatacagtagagatgtgtagttggattcttagcccaaaatccgtcataaacatctcattccatccactaattatcttcgttttttcaattaagttataatgttattcgatcgcgatattttcactcgtctctcccagtactcatgagctacgtcctacgctttctcctcttgtatgccaacattttactttattattttcttagctactacatactccatcctaaaataatttaaacctgaccatgagaatatgagtctgaacaaggttcgtagttaggatttaatgcttttttatgacagagggagtatataaattcagtagacaatccttaaactaatttattaattcgtcaaattccagccgggtcgaaaaactcctatccaaaacgtaaatgtctgaaaccacaaaccatttattgtttacccaaattaatttccacgtgcgtacataaaattgtccatttcttccgcatatagtgacagtaacaaagaacaataattaagcaccagaagaactaatgaacagtcaatcgattaagcatgcaaaagttcatatattgatcatgacccacactactaactaactacttacttgacactctacctgaagattaattatatatgttcgtccagcttcaataaacctagcctgccgaacacatattacatatatataattatagcttggtcatgaattaatacaaatgcatgcgcataagtaactaatcaattaaagacaacatcacgagagttaataattagttatctaagaacaaccaagcctaagctcaagatccaacccttcctccataccaccaccgactccaagctccaaatccacctccaaacccttcgtcgccgccatcgccgccgccgccgtggagaagaagctgtagacgatggccggacgatcgccggggcagtagcactgctgctgctgctgcggcggcggcggcggcggcggcggtggcggcggcggcgagaggttgaggttgggaaggggatgaggtctagggttggggaattgcctgagcctggccctctccctcctgtgcacgttcatgtggcctcccagcgcctgcgccgacctgaactccctcctgcagtagccgcaggtgtacgacgacgacgacgacgacggcggcggcgacctctgcagcggcggccatgagaagccgaagctgcagctccatggccgctgatgctgctgatgaaggtggccatggccatgctctctcgcgctcctgctctccattgatttactgatcgatttgtagtgtggttgtacaatgtgtagagctagcttgacactgagctgagctagaaggccatatataagcaactcaagaacagtgctcacggaaaactgaatagtccattagcgcgtgattaatcaaatattagctaaatttatttttaaatttagatcaatatgaattttttaagcaactttcgtgtagaaacttttttttaaaaaaaacacaacgtttagcagtttgaaaagcgtgtgcgaggaaaacgagagagatgagttgggaaacttggggtaagaacacattctaaagtgcatgacatgtggggtcccaggctacatgtatgacagacatgtgggccactgcatgtcggtcagacacacacaaactatatatatctggttagtgattttcaaagggtagctagctagtgatgcatggaaagggagagagagaagccattgaaagcagctggtttttgccaagatgtacaaacggcatgcaatcgatgtgtcgaccaagataccgtcagagcgatgagagccaatgtggggaagactatgtgacatgtgtttgcaacccctgcagaagctttccctgcaggacaagacacccgtggctatccagccatacatcagatgcaagagattaacctgctggctttagggttagcatccatgcatgcagatgcagtcacacagggcccaccatttttctgagctcttgcaaagctagtcttcgtcctaggagactgcacagttgcatatatatttggatatggattttcatctctcgaggggatgtcttctctttgcatgtcatcagttataaaaaaatttgacaacatagattaatatgaaatataaaactccaaaaacgtgcaagaccaaattcaacttccacaagttgcaacaaaaagaacaaaataaactgaaaatagttatcgtacattcgcaactatatttgttatttttgttacaacttgtagaagttaaattttaacttatgtgttatggagtgatatatttcatattaatctatcttaccaatttttttaaaatattttgatgactatttaggtggcatgcacgatacgaggggttatcacttgagggatgaaatcgctttccacacacacaatttatctaattgcagagatctagctaggtttgcactgtgatctgagctaggttttttgcttgcttctgactcactccagctagctagctgctggctgcatctgcttatatatatgcattgttcagagaggcaaaaggagtagtgatatgttaccgatgccctgaaagcatacttggccttactccatatatatttgcattcaactttggtcagcatatgttagagtacactgctcttgtgttcatctttcttcctttttttttcttttgtttcacatatgtaatgtatatgtatattcgagcttcatcattggttaggtgtcatgtctagctgcaagacatcacatcagtcaatttaagttgttcacagctgaattgaatcaatgaatgcatggagtggttttcatttttttctgggtcaactcggtcgaaagattgaaggcctgcaggcatgctatgagctcttactggcttgtctgacgagtgaacaagccttttggcagtttgcactgcatcccattggccagcatggggcgggcaattcaggcttaggaacacatgatgctcttagaaaggtgaagtaattgttgctaaaagtgtactagagtactagctacaactgttctccccaacacaactatatatgatccttgatggcatgatgtcccctgaaaattgagatggtactattatctctttttttttacttgatgtttacaacaatatagatacaatcttcagtgcatatgtttggtcattcctttttattatgtatttacaacaaaaatattggattttcagtgcaaattttcagttcaatagaatatatttgattttaccattatatttgttacaattaaatcattacaataagttcatattttgttatatttctgataaaatatataaatatgattatattgctaattaaattaattttatattatacataagatagcgaattataatggttgaaacattagaaaaatacttactgaaacatccaaacaacaacatgagcaacatttataaatgaattaatgaaacactagaacatatttactaaactatccaaataacaccacatgcaacacatgcaaataaaccagtgaaacgttagaaaatatctaatggaacatctcagtaactttcgatccggtgtttcggaaaacatctaatgattatatatatatatatatatatatatatatatttcgaatatagataaagggtgtgttcgctgcagccggctcccaatgtacgcacggaaaacagagcggtccattagcacgtgattaattaagtatttgctaatttttttttcaaaaatggattaatttgatttttttaagcaactttcgtatagaatttttatttgcaaaaaacacatcgtttagcagtttgaaaagcgtgcgcgtggaaaacgagagagaggggttgggaaaatgggcatctgaacacagccaaagtgtgtgtcgcacaacaattttcgtccgggattaaaaattattaaataatgtatttctagaaattaaattaaaagttaaagcaatttaatcaagtgaattcatgagggaatcaaaattttcctttaaaaatcgtggctggaaatatttttctaatattctccgtgctatagtatactctctgaaatttcctgtgaatttttggagctcaatatctaattttaacatcacaaagttcattaaatccattaaataaaataaaaaacaaatttaaatctccatccttcactttgggccgcttcaggcccaaagcccttccttcgtcccttacggcgcccactcggccgtcctcctttccttttcccctcccgctcggcctccctcctatctactcccttccctgcccagttcgccgctcggctcgctcctctccttccccgtaagatatctcgcctccctcctctcccccgagccaccgaccgttgggacccacctgtcagggttatccacttcctccggccaaacctccatggctgccagcctccaccccacgtcgccgccaaattcagtgccctcccgctcgcgcgcccgcgtccaaacagcttggaccggtcccctccacatcctccaccatttcccccactctccccatgaagatcaccgccggtttgacctgatgcgccccacatcgtcgccccacttcgccggcgatttccgcctcttttagcctcatgccgcacctccgagacctataataaccctccccatgcatccctatatcaatttcccatcttcctgagctctcctgtgccccaaaaccatcccctcgccgcaatcctgagctctgccacttgccgcaaaactccggccaatcgttgccgctggtgtagtcactgccgcaccgcgccgaggccgcctctggcttcgccgccccacgccacgtacaacccgtccaccaccctacttccccaatccattgtcgaaacgccatcttccctgcaaacccgagctctaccgccactttgctgactccggccggtcgctttcgccaccctagccaccgccgcaccgtgcagcctccaccacgcccctacgcacctcagccaccgcaaccctctcctccccgtcaaggtgaggtccaccccgtgctgccaccatcggccgtcgtttccggccgttccacacccgttttaccctccctaatccctccatctccctcccgaggccgtcctgctcctcagctgcccctccgccatcgccggcagccgccggaatgccttccgcgccatcgtcccacgggttccgtcgccatatccctgccacggagttccccgtggctccactcgcagccgtcgggcacttggtgagtaccccctcctcctcctctcacggttaccctctcctgcgcctccttccgcgccgcccggtggtaaccggcggtgaccccaggccacgcgcagccagttcgtcgccgctgtctgctcgccaccctctgccttggccgcccgattggtcgccctgaccaatccgggccgtccatgaggtggacgtgcgcccgggccacatgtggacctggttcgccgtgcgctctcccattgtgccgctgacgtgcgaggcccgcgtgtcggctcgacctctccttgatgacatcagcagtcccctttttcttttgtaaaaataattaataattgcacaacaatttgtatttaattccaaaaattgatttaaatggctcaaaacttctaaaagtcatatctaattcatacgtactccaaattatgccactcaacttgtaaaagtcatctaaaattgacttctacatgattgtttacttttcatgaactgtttatttggtttcgcgtgccagcgcgtagattccgtcgttttggaagatcgcgatgttgaggaaagtgtttgaatgatcggttgaagaagcaaggcaagtcaaacattccccttgagcatattaagcctactttataaatgttttactgtttgcaaataaaattgcatgttttgctaatttcgtgggaataggttttacctatctgcttgcttgtgccatgtttaattcataaccatcctttgtcaaacttaggtgataattttactagctcgtgtcacttatgttgatcttgcttggattatatatgcttagccatgcttaattaccactagctcacttaatgggataatcacattatttacatatagtgtcttgttgagctgcgagctcgacacattggaccgttgtttaatggtcgtgagtaatccaataaaaatatgtcttaatggtgggttgtgggtgcatggttttgctagtcgtatccatggcagttaaggactagttcgcgagaaacccttggaagacttaccgcacttaccacaagcaagaatgagcaactgctggacttgtagtgtagcttgtctctagccgacgttcctaggcaagggtgagcgtgatggagttcggatggaccgtgctgcagtctatgcggctgccggattcagcaaggcaccagggggacttcccactgccagttataggggtgggggcgaaacacgatgtaacgctctgctttccgcgtggcgttaaaaagctaatttaacgaaaaccctaattgcgaaaatttcgttctttgagtgttgagtctaagttgtaccaaagatctcaatttaaatctctcctttggtccatcttcgtgcaatcaaaaatcgcctcatcaaaaattccccacctcaagatcccaatcccgattcaagtctccaaatcaattccgaaattcacttccttcctttgaatccttgacaatattcgccccgactccaaaaatatccaaagttccattttgcattcttctccaaacccaaatctctccaaatcaatctttcagcaaaagtctattttacctccctcaggtgttgtgggccgttttcccccttagcccacctccctccctcggtcgtttctcctccgtcagcctcgcacgtgcgttgcacgtgccgagccgagccgagagagagctctctcactctctctgtttctccctctctctctcgttttctctctctcgcgccgacgccgcttcccgccgtcgctgcccaaaatccgccactgccttcgctctttcccgcgctcgcgcgtggccgaccggccggtcgttgccaccgtcagccctgccacgcctgcgccgcgcagccgcccggttgccgccgcgtcaagccctggcgtcgcctgcatcgtgcgctgccgctctgccgctccatgccgctagcttccaaagccgagagaggcagcccctctctcactccctctccctcctttaacttttcccgaaacagcaaggagtagagctccctttctccccctcctttttccttttgcccgaccaccattggcgtcaccgcctgccaccgcctggaccacgggcgcgaccgccagctcctccccttgaccgccctaagtcggtttcctcccccaaaaccgacttcccgcacccataaaacccaacccgagcccctccctttcctcctcgtttccttgcccaacctccatcgcgccattgttgccaccccgccctgcagtcgccctcgctgtctgtcgccgaagcaccagggagaccggtgcgtgcgtggacgcgtgacgcgggactccgggcaccctctccttccccttccccggcccgaggccggagagctcgccacgcaccgccgccgcccatcactgcgcccggctcagtagtgcctccctccgttctccttcctcgttctccctcgccctctctagcttgcatgatagctcagttagcccctcgaacgcgcgtagacgccgccccgagctccgccgccgctcggcatggccttgccgccgtcggcgccccctcccggaggccgcctctcgtcgccggacctccacggcgcctccccaccctatctgatcccagaaacgaaacccttgagccccggagatgctcccgccacctttaattgagtcctcgtcgcccctcggtgatttcccctttctctcgccgccggccgccactgtcgaattccaccgctgtcgaactccctctagcgaatccgagccgttggctcgctccttctcgatgccctcgtcactccggtgtgctccccgaagaccaaatccgtcgcgcttgctccggtgaacatggcctccgtccgccatccatctcggcctccccttcttcctcctcccgccggcctgcgtggctgccacgtaggcgccacgtcggcgccacctcggctttgaccgagccgagccggtcagccgcctcctccctcccccctcggacgcgcggtccatggtgcgccaaccggctgcgcgtgggcccgccgcatccctggtccatccggtgcacgcgcatgaaccgcgctcacccgaaaccctagcaccgccctcatgcgccgctcccacggtgagccgcgccaccgacaagcgggccccactcgggaccccacaaggtggactcggcccaccggccctttctctccctcacttaccccgcgcccccttgggccgcctctccgggccggccggcccattagttcggccgagccgtgcctctcctcttgggccgcacccaagccgcccgaggaagtctaaatcatatccctccttcaatttctttccaaaaagggtttaataaattattaaatcctttttcctttagacagaaattccttaatccttagaaaatccatatcttctcaaccgctcatccgattgactccgttaaacttccaataattccgtaaaaattgagatctatctaatggtactattatctagtctaaataggatctttattttgggtcttgtgtagatttttaattgtttgcgtatagttgcggttaccggattttcgtcgatcgcgggttttctcgaagattcgtgaagcttcgtgaagacctcgagcaaggcaaatcaccctttgaccaattgctcctataattggaaaatcattattaatttgtttgcaacttgcattattagcaacacacatttatagcatgcttggcctcggtttgcgtgccaaaccgacggacctacctagtagtcgcactaattcctgtaggctgtactaccctgaatccttgtcgctccacctttgtggtacttcggtatccgtgctctctgagcgcgtataccaactattccacatacaccgttgtttgtcgataatctgagaaatgggtttgagaagcctttaaaacccgacatgtggtgtcggcgtgtttgaaaataaaatgaattgtgaaaactcgcgatgcggatgctgtgcctgggtggcactgtcccgtattcgcatataaggaccgattcctttgggaaattcatcaagcataacaagtgcaaccacatggtggtatgggacaccctggctaagtaattagctgcttttgggaaatcttgtataccaatagaggcggaaagccgggatgtgggggtagaggcatcctgggagtccgaaacagaggaaggcacccgggagtcctaaaaggaaagccggagttggcccgatgttggtcagggagaccctctatgtggcatgaggtaacccagagttagctttggaaatgccttgtcgcgaatctcccttttccagccgtgtgtcatgaacacgggttaggtgatgggagcaagttcgtgttgtgtgggtaaagtgtacccctctgcagaggttaaccaactgttcgaacagccgtgcccacggtcatgggcggatgtgaggtggttcccgttgcgtagatttgtttgcctgtgctttgtgaaaagttgttgtggattgggaatcgtaaccagaatcagcctaagtggcagatggatgacctgagtggtcagaaacgaatctgtgtgattcgggatgtctgcgggcatcatagactaggcttcccgagtggaagcggattgttgtgctgctgggcagctggactctgggagtccacaaaaatgaaaaggctctgggagccgcctaatcaagtgaaatggctctgggagccgagaagtaatgatctgaccttggaggtcggtacattaccaattgagttgttgaaaagcatctcttaagccgaatcgagacgcaagtctcttttcaacccaaacctaaaaagaaataaatcacttagtgatttcaaaatgatttcaaacaaaagatttgcaaaacaaccttgcctctcttccaagcttgcattaaacacctaagttcccgtgacttgctgagtacgaaagtactcacccttgctctctctctctctctctatatatatatatatatatatatatatatatatatatatatatatatatatatatatatatatagttcctccgcccggatgctgaagatgaagaaaagtgaagattagggtttcgtcctggttcccagccgtcgcctgtggtgttgggtgttagaccgttggttccactgctgctgctgttgctggtgtttcctcgtctgtgtcttcggttgtattctcaggctgtcctgagctgcaacctaagttaaggtaaataagtcctctacttattttaaggatttgcaatgattcatatttgtcaccgtgggtaccagcactatgtcctgggactggtactatgatcgcggtttcgtaggaagcggttcgcgccgtttttcctacgacacgctcctgtcaggtgctgttgtacggcggtgccggattggggtgtgacacacgaggtgtggtgcgcttggttaggggggagttatgcgaagggtcttgtcacaatctctcgcatggtaacgtgttaggcatggcatggtgtcatacggtggattgtgtctcgtgggtacaattgtgcatctctggtcagagtaaaaactatttgaatagctgtgcccgcggttatgggcgatcgatcagcttcaccgtgatttgtcccactctattaattaaattgacttaatgaactggtgtagttcaagtggaatagttgggtttgttcaacatagttatagcattgataagtggagatttaatcttgagttaattaaacaattgttttaaactataaatgtttacaaccgtctttacgcaaatagccacaaacctcccattgtctccccttgcatgtctgtatcattggtgtggcttgctgagtacggtggttgtactcagccttactgttactcccccttttcagaagtgttatgcttctgagctgaagacagagttagaggaccaaggcttataccccagttgagttttgcctgtggagtggagctaaagccatgctaggatcacctttttccgctgttgttgctttctttttgtgtgaggactaattgcctattctataagtatgtacgctttatttatgtttggatctgtatattaatttgtcgttttgtgtaccttggctgattcctagacagggacttaatacacaaaatactctagaaatttcggctaaatttctgggagtgactgtgcatgcaaaatgagaaatccattagcacatgattaattgagtttaaataatttcaaacttaaaaatggatttatttcatactgtaatggtacttctacatacaaaattttcatatgaaatgtatcatctagtagtttgagtaccgtgccaacagaaatcgatgaaaaatatgtattttaatcagaaaaaagaacggggcttagagtggttttgacaaacaaacagattgtgttgccactccgataatttcgtgtagagtcgtattcggagacatttaattgtattttttctctcaaaaacggaaacaaatatggcatcaatgttattgggtagatatgaaaaaaagtaagaaaaccgtgtatagatgcctaccaaaagtaggaaatactttttttttcacctacaaaaataaaaacttaaaaaatgcttttcataggcaggtcctaaagagagccacccgtggaaatcgatttacagaaacattcgtaattcagcccgtgcaaaaaccagcgatttctataggcacatggttgtaggtggatcagaaaacgctcgtgtaaatgggttatcagccacctgtacaaatgttttatgtagtagtgcgttttactttttctttttcttagaattcctctaatttattagaggtgacacatggcagcagggtttgtaagaacatcaccaacagcatctcgatatcatttcctatctggtattttggagatttttggttaaaaattgcatccaatagattctcaaccaactctcccaatccttccagttaccaattgagttcgctcccaatctgtctaagggcggcgaggcggcagttagggttgcatgcgagcgtgatctcatgagagcgaggagtgaaaactgatttctgttggaagtatcctaatgggcccacctttttgtttttaggaaaccaattatagctaatgtgttggagggatgttcttggtgatgcatgctcatgtttagtggattttaagaatatggataatatggagattgctacctatcggacgtatgacattttgcaaaaaatcggacggtgtttcaccacatgtaaaaaaatgtttcaaatgtttcatcactcattgaataatgtttcactaaaaaatgttttagatgtttcattactcgatgagaaatgtttcaccacttggaaaaaaatgtttcaatcagataaaacaatgaaaaaacactggttgcaacattaagactctattatgcaacatcgaagaaaacacatcgtacatcatgtgcaacatccgatgaaacatggatgaaacacacaaataaaatagagtgcaacaaacatatacaatatattgcaatgcaacatgatcgttaagaatgatctcatggctctattcagagaatttcataaagggacattacccctttatagcctaaactttgggatcatcgtgctgctgccaaaaaaggctgatgcaaaacaaatttaacaatataggcctatttgcctactgagtgtaggctttaaaatttttacaaaagttggcaccaatagaattacagcggttgctcacaaagtcattcgcccaacccaaacggcgtttttgctagatagaaatatcatggaaggggtggtgattttgcataagactgtccaagagttacacacaaagaaaatggatggtatcatattcaaaattgacttcgaataggcttatgacaaagctaaatggtagttccttcagcagacattacgaatgaaagggttttcacaatcatggtgcaattggatttccaactgggttgaaggaggaactgtaaatgtcaaagtcaatgataatgtaggaaaaaaattccggacatgcaaaggcttgagacaaggggatccaatgtccccaattctttttaacatagtgactgatatgttagccattcttattaaaagagccaaagccgatgtccaaattagaggggtaattccacacttagtggatgatggtttgtccattctccaacatgccgacgatagaataatatttcttgaacatgattttgaacaagcaaaaaacatgaaggccattcttgttgaacatctctcggggctgaaaataaactttcataaaagtgaaattttctgctttgggggagctaaggaaatgaaggatcaatataaacaactgtttggttgtaattctggttcctttccattcagatacttaggaatccccatacactatcgaaaactcagaaattctgattggaaatgtgtggaggataggtttcaaagaaaactgagcacatggaagggcaaaaataactcctatggtgggatattggttcttcttaactcggttctttcgagccttcccatgtttatgctattcttttttgaaatacctcgaggtgtacttcgaagactggatttctaccgatcgagctttttctggagcagtgatagccagaaaaagaaatataggttaacaaaatgggattatatatgccggccaaaatatcaaggtggactgggtgtcctaaatcttgatatcatgaatagatgtttgttgagcaaatggctattcaagcttcttaatggtgatggcctatggcaaaatcttttacccaacaagtacttaaagggtaaacccctctcccatatgtcacacaaaccaggaacatctcaattttgggttggcctaatgaaagtaaaagatcaattttttcagtatggatcttttaaacctggtaatgggatagagataagattttgggaagacacatggttgggcttgcaacctctcaaatatcaatatccttctctgtacaatgtggttcgaaagagacattctactttggcagaggttacgagcacaacaccgttgaatgtttcattctgacgatcaattgtaggaccaaagttagttgagtggaatgatttgatttctcgactagctaatataaccctgtcaaatgaaaatgattgctttatttagtcgctacataaaaatggccatttttcggtcaaatccatgtataatgcgatcatcaattccaatgtaaggatctgtaagaggatcttatgggaggtgaaggtaccactaaaaatcaaagtatttatgtggtttcttgacaaaaaaaagtaatcttgatgaaagataacttcacgaagataaaatggaggggaaacaagcaatgttgattttgtaatacacaagagaccatccaacatcttttgtttgactgtcatgctgcacgttttgcttggcgatgtgtcttctttgcttcaatattccctgcccacaatgcaaaagatatttttggtaactggctaaggggagttcctagacccacaaaaaaaataattttatttggagctagtgctctatgttggtcaatttggcgttgccgtaatgatatagtttttaaccataaaaaaatgcctaacatcatgcaggttatcttcatatgttctaattggctccactcttggtgtatgatgctttcacagaaacaacaggatactatgcgcaatggtgctacacgcttggaattggtacgtagccaaggaacttttattctagtttggatagcgtagtacctacagaatttcgtgatagaatctacgtgattttaaaaaatattatttagtagatcatattatcggcaaaagttggggatttgtcccatctcgccttttttaagctcttttctgttcacttctggactttttggttgtgtgcctatggacagaagccggagatgtaacccatttccattatctaaaataattgcaatgcaacatcaaatcaaaataaagtgaaacagcttactacaatagagtgcaacaagctaaaacagtaggatgtaacatccctaaactccaactaaataaacccgtctccgtcttcatcaaaataaacccacctccatcttcttcatctccggtcgccggcgagtccacctccatcaccggcggcggctgttcttgctgtagcgccactacgcccaccgccggcggggatgggggagataggtgcagaggtggtttacctggcgaggccaatggagggcggcgttggagcagcaggagaggagcccatcggggtagaggaaggtgcacaagcagccgagcatgatgccaacggcgaccgccgccgcgatgcacgaccccaccaccgtcgtgtcgtgccgcccccacccctgtcggcgtggtcgctagcctcctcctccctcttcgcgtggtcgcgagaagcagtgctacggtgttgaggggagagaaagagagaagaatgatagagataaggttgatcggtggagagaaaatagtgtgatagtggttaagtgggacccactcggtggcacatctgattttttgcgccgtatcgaaattccgttgtaaagaattttcgggataatatccatgaaagtgacagagacgtaggcatgagtatatgacacttaatttgtctattcgttgcggaaactggacgagatggaagctgttggctcttcagagtacatccggataaaaatacttcctaaacatacattgttgagagttgcatgctttaatttgtagtagtacgtacgtacacgcaagttttattttaattcatagcataatgcccgtgcttcgctacgggtaaacaaaatttcatactaaggccctgtttagtgcccacgcaaaaattttacaccccgtcacatcgaacgtttgaacacctatataaagtattaaatataggttaaaaaataactaattgcacagattccaactactttgcaagatgaattttttaagcttaattgcttcatgatttgacaatatggtgatacagtaaatatttgctaatgacggattaattaggcttaataaatttgtctcgcagtttgttgacggattgtgcaattagtttttttattaatgaccgaacaccctatacgaaaccctatataatacccaatatgaaacgctaaaactttacgcccctagatctaaacatcctcttaaagtatatttcatgataaaaacaaatcacaataaaataattaataattatgtgcttatactacatttcttggtaaaacgaataacaaaataattaaatcctatgagtaacattcacaggcctcactaacgcaccaagatttttaatttccaaacaaccaagaatttttggatgaaaaaagtggcacgaacgagaccagagctacacgaacgtgacaccgtgttgtgtcgaccaccaccgtcgtcttcttctcctcctatggcatttgaaattgacaaaaatcaagaggagacacaagcggacgatggacgatggacgaaaatcaagccgagagaagttgcgcgctgcggacgacggatctctgtttttttttgtccgctgtatgtgattacgagcgcacagacacaaagggtgtagctctcggtcggattacggacgataaaattgtgacgattggaaaattactaattttttaattagttaagatttgaatacttcagagcagatgatttttgacaaaagaaaaacattatgatcaattatacgtcgccacgccagctgtcacgagtaactaacaaatgaaggtcgtactatatatgtactcacgcagattgacgctcctgggatcagtaatgcccatggtctttttctacatatgtcattttgacaatctagcaacacacaacaataatcgtcatttgatacatattccatgaatgattgatctcttttgcatttgttcgtccctttcgttttcaacttggtactcgtaatttcttttaaagaacaactacttgcaattcccaaacatggagtactacatttgtctagcttccatcaaagtatatatatatgaaacagcaaccttcaattaatttagctctcgttgatcgattgatcgatcagtttgcaggctgtgttggctgcatcaggtcagcaattaatctagctagtcatctacggctagataacccttgcagttctcgtctacacacttctctttgcgaggtacgtatgtgttctctttgtcttgttaaagttaatttcgtaaatataatatagattatttgataaaataatggaattaaattatagattttgaagaattgtgtcaagctggaacctttttttaattctcaataattttgtcatgaccttgatgctagaattcttacagcgctatggctttgcagtttcgtgacatatatgcatgttcattgctaaacctgtagattattcgtagataaatcttcttgattaaatatatatgtttacaataattttattaaactataataaatacattcctgatcaagaagcagaaactttgcagagccgttgttcatcatggcaggcgagcaaggttcagctatggccaacagaggaggccgggcaaatcggaaagaaggggaggacgagctacgaggctggctgatgttgctggcgacgctgacggcgtccatcacgtacgcggcggcgctgaaccctcccggcggcgtctggcaagccgacgacgccgccaaggacttcgtcgccggctacccggtcctcctcgacaagtcgccgtggcgctactacgtcttctactactgcaacgccacctccttcgcgtcgtccgtgtgcatcatcgtcctgctcgccaccaacttctacctgagccataccagtgtcatggtcttcaacgtgctcgtcgccctggacatggccagcttgggcgccgcgttcgtcgcgggctcgtcgagcagcaagcggtttacggctttcaacgcggggctgatggtatgcctcgtcgtgctgttcctcctgtggaaactgaagtttctcatgggtaatgatcaagcaggtcaaaatcctgctagtggaggtgtcgccaatttacaacatggcaacagtgcattataaatttataataatgtaaataaatttctctgatttaatcatgtcatggtagatgtataccggatataatgcctgctgcctggcactttgctatggaacctaatgatgaatttatacgttaaataatgttgaaatatggtatatggatatattttaaaatttaatattatggaaatgatgtcgaggatatatagcatgatgatatgattagtcagtacacgatgtgatatatttatattttgagctttagaagttcataattattattggatgatgttgcggtatatttacatattacctttaggatctaatatttactagcgggtttcaattttatacaagatatactacattaggaatgtttatcgtgtcattacaaaatatttcatttttattggctagaactagattatttaatattaaccgattggatgaaagataatattacaagatgctattgaaggaactagaaatgtaagtgccggttccaaagaagtttaatccatctcacaacatgccattttaaaaaggtaaatcctattccaatcatcctccaggtgaccaaaatttaaaaattctgtagctcatgtatcccagcaagttaggccgtctccaatggacagctcttatctagctcatagagtgttttaatcgatgaacaggaccgctagctcttcttcaagcgttagctcgcacgctcaccgaggcggtgccctctcacaggcacgctcgcccaggcaatggccggcactatgccgagcgcgtatgagctagcagccggctcataccgctggataaggccttagacaaactgagccaatgccacaagcaacagtggcgtacattcatgcacctactcctctatgggtagatctatttagagaagcttctagcatctatatattcttctacaattttcagctcccagatttttattcatgtactgagaatatatatagtttcagaatctatatttacgccaaacttttcatgtactgaatatgaagctgaaaaactaaacttttctagcttccgaatcttaagcactcttagacagtacttaagccagtgacgagcatgcgagtggtttggacggacaaacacatcgtgcccgctctgataatatacataccattgtactcggagacatattaaattttaaattggagtttttttcactcaaaaagggaaacgaatatggcatctctagtatcgggcatatatgaaaaacagtgagataaatatgtatactgcctaccaaatacgaaatattttcttttgagcataataaaattcaaaaattcaattttatggatgggaccttaagagagtcatctatgaaaataatttttaagggcagttggaaatttgcccgtgcaaaaccggtgatttctagatgcacacgcgtggtggcaggtgggtataaaaatgcccgttatcagccgcctacaaaaacgtatatttgtagtagtgtgttttgctttgttttccttaattttttctctaatttattagaaatgacacatgatggtttaaaagcgtttttagtatatttaatgaatttttaagaatataatagatatcccatgacagggacagagatgtaggctgagtataaaatgacgattatggttatatatcagattgacgctcttgggatcagtaatgtccatggtctttttctacatatatgtcattttgacgatccaataaacgcatataacaataatcgtcattttatacatattccatgattgattgatctcttcttttgttcgttcttttcattttcaactttgtactcgtaatttcttttaaccaacaacttgcaattcccaaacatggagtactgcatttgtcttccatctcaagttcgacatatatacgtacgtactaacgtacgcatgagagtatgtacgaaacatcgacctttaatttggctcgttgatcgatcgatcagtttgcaggctgtgtgtagctaagctagctagccatcgacagctagataacccttgaagttcacttctctttgggaggtttggtatgttctctttgtcttgttaaatttaattttatgaatagaaattctttgataaaatcatgaaattaaattataaattttgaagaaatgtgtcaggccagaacttttgaaattcttgattttgtcatgaaatcgatgctaaaacttttggctttcaacgctgcgctgatggtatgcctcgtcctgctgttcttgtggaaacgaaagtggctcatgatgggtcgagcagcggcgaacccaaatcctactagtggagatgtcgccaatttacaacacgacaacagtacattatagtgtaaataaatcgctgaattatatcacggttttacagatatgtatatgtatactagataatacctgcctgg

SEQ ID NO: 80118 - DNA, 5480 bp, Oryza sativa
gttgagcgggagcgtggggagcgggagcgcggaggcgatctcggagtggacggtgttgggcaggcggcaggcgcgctcgaagccggccctccggcgtccgcctcggccggggtccatggtggggctccggcgagcggagcggaggggaggggaggtgaaaccctagattcgaggaggggaggggtgggggatcgaattcgaattggaattcgaattgcggcggaagggcggatttgagattagggttgcgtggcctagataggcaagcatttaccactcgcctcgcctcttctagcctagcctagctgctacagtgattccagttcgcgcccgcctcccgccggcgaatcgtgccgcggaaggaggacgacaacgacgaggagacttttttgtttttttcgtgtgtaccctttgtttcgtttttaggagagagaatgaagatgttgggctactttttgaaaggaacaagtctattttatctccctcctccatctcttgcctgtgtaaatcacctttcaatcgtaaaaccgagtataatacattcctcatatttaaaaaccggtgtaaatcaacctattcggtggtttcaaaaacggtttcaacctatgtgccgctcataagacccacatgtcaatgataaatatataaaaaaaattaatctcacacggccacatgttcagtcatcctaatcttcatatgtcagccaccctaatctccttttctttttcctcgccctctttcctcgttctctttaatatctcttccatagtctcttgaatactttcaaacccaaatatgaggttgtggagggctgaaaaaaaattaaaactgatgaagaatttttttatacacataattatgtatagccctgactatgtaattagttgaatataactaaataaatactcagagagtagataaatcaaccagtcgagtggttttattaaacaattattggcaaacatggtgtcaaatatgaattaataatactcaaaatggatttaccaactccctattaacaaccaagaagaaatatcatgaacatcataaagccaaagatattggtcttaaaaagttgcacacatatgtggtttttgttaaataaaaacaatgacgcagcagttggctgattgcatttgtttaacatacgctaaacagtgcttatctttaatgtaaaaaaagttaaagtgtaaactataaagctcactgttcaccacctatttaaatcacattgtaccaactcttctaaataaaaggttgtgtaacagcaagaaaagagaattttcaaggtattggatactttccacgtgcatactgcaaagacaaatatacttgagtccctaaaaacccgtggaaggtcagtaaatgtttaatggacttcagcccaaaaaaaagcttaaagattcctaaaaaacaacacgatactgtgtatcgtcttgtccaccgcttcatcttcacaaaaattcctcttcgcgctcctattcacttgccatcgccgccaaagttagggctaagcttgtgtaggtatttcgctgatctttttttaagtactgcacttgactataatatgggtgtagttagaagttactagtaatgacggcgactccctcgctctctcatcgccgcctatctattttcctccggtggctagtgagggtagaaggggaaaaaccgggggagagagcggtttccacatgctcctcccctagccacagccgacccaacgcgactcctcgctcggtcccccagccgaggagctcgtagagccgcgtcccttgcaagaagacgcgcgcctctactgggggacggcttgggcggaaaagcgcccaagcgaacgggagctggacgccgtgagccaaagccactcgctgagctacgcattgtagatggcctaaaagagctggccccagtacaatgtcaacacttttttgtcaagattaaaggctgatgcaccatataagccaataaacatgcagaagaagcattttattcacccggtggtagtgtggcactgatgaaataataatttccgtaactaaccgaggagctcaacaatgaacaaatcctctctggaacacaaaagcctcataacaccaaaggctgttgtttaagttacaagtgttgggctacaaaattgatgatgctgtgtaagaacctgtgttctcacttctcagtctcagttatcagtcttttagtgtggttttggtacaaagccatccaccgcaaagtttcgtgtagctgctggtaatgccagtcgcatgccatcaagttctggctttgctatcacttgacagccaagacgagacctgaatacagttcacaaaattgatgccagattagaaaggacacgcatttaaattgaacaaaaactctagtgcatacaaagctaccatggtatttatacaattacaacttaccagcatgagaatatctcacttggctattttaacatgttggttgataagttactttgtctttaatttccattatgtcatgcatatagcttaagtcacggatagcggcaattagtttgtaaaggttgcacacagatacaggtggagacatatcaggatgattaaggaagcaactgcatatcgtatcctctcatatcaaatgcccccagtcctttgttttcccctccctccctcactatggccatcaactacttaaactattctaacaataccatgcatactcattggttgatacccaacattcttgtttgcacgataatcagacagcaagcaccacggaaccatgaaactggataagccaaattaataaaaccttcaagatatcttcacttacgtttctgtaagtccaaatgcaaggtcaagcatatcattttcttcatctgttggatcttctagcttattataataatttacatcctggacaaaattgaaatggctagttagtggcacttcaatctctacaatagcatgaaaaataataaaaaaaggaatggttatatagagcataccataactatgacatgacaggttgaacacgcaagtgaaccttcacatgctcctgcagtacccaaaatactagaccaagttactaactacaattaaaaatcagtcaatagtcaatacatgaaacatgtcaaataacatcaagtaatcaataatggacgccatgtctattgggtaaacataatttgctttttatagctgttcttatcagcaaaagaagttaagaattgaaagcatagtacagttgcaatgataaatcagtaaccttcaagttcgatgtcattttcatgagcagcttctaagatggacattccaacagggacactgattgtctgctctgtgccatccttgttcacaaatgttacagagatcctgtgcagcacaaagaaatttgctcattagaaaaattaatcggttgttttggacagctatttcctaggagggaaaaactgaaggagaagcccctttaaagacaacaaagacattgaagaaactcacattacaacgacatgggatacatcactaccttgtccaatacaaatattgctaggtattcaaatttcatgctataccagaaaaaggaaaagaaaggggagaggaaatatacttacttctccttgctctgactgccatcgtcacgatcactactagttgttgctgtggagaataagatgttcttctgaaaagttacagaccagtgctcattacatacaaggacatttgcaaatggtaaatcatctcttctggtagtacagaacataatcccaagataaagatggtggtggagaatgtgcagatagataaaatcttttgtctctcagtttcagaatgcacaattcatattggtcatttcagaaaatccatgtcatatctagaaaacatttatgattgctctttttgtagggattgtcagtaacagctatacaaatttcagaatgcaaacatcataaagggtatataagatacagttgacttggccaagttaagctctcggtgaaaacacatacaaagggtatgcaaaattttcgtccaaactcaccactaggcatcacaacaacaagatacagattggactaaccgttgggacaaaacgtcggctgagttgacctcgataatagctggttgtactgcttgccaaattccctactgcacaagagggagaacaataaaaagccaatggtatagcaccaagatttactcaacaatagtggctcagcctaaaccggccatagaatggatagtggaagcatgcatatcgttcatacaaatcgatcgctctctcctctttaatcattcgtgataatgtatagattcgtcatggtttggaagtatttctcagctgcttccagaggattaaccaataaaaaacaagagagacacgaaaagggtgcgtaccagctctgttctcgcgcagaagccgcgccccgagctgcgagatcctggacaacatcgccgcagccgacttcactacccaacacccccactcccgaaccctaacagcaacaatccaagagcgtacacgaatcagcgagaaccgcgtgggggccaacaaagcaaccgaacatccggggggagcagaaggcggagagagaggagacgaaccttccggtggccggtggccggcgccgccgctttcctcccttccacgacggcgggggaagaggagaaggagaagtcgggtgtcgccgccgtggcagaggttaaccgtggagtttggaagcaactcgtgggccgtgattttgtgggccttgaggcccattagtgcagagattagatgggcccattgaggcccatcaaagccacacggtataagagcctcaggagaaaccctcccctaaatttctctccccctcctcctccgccgccacgcagagggggacgccgccgccctccgccgccgcctcacgacgtaggtaacgtcgcttctctcccctccctctacctgctcatgctcgtgtgtatgcttagttgattctgatgagttacgggttaatcgggtacatggtcgttttcagttgattctgtcattagttagtcacgaaatatcgtttttgttctggggacatcttttttctgttctgcggtctgttccttgtgttgattgccatccattcaagcgggtaaatcagatttgatggtttggtggataaaaggtagtatgtgattgttcagcacggtttagcagcgggctagctgctgctaagatttaacatcgatatggaagtttgagaatcggtggactctaatacttgtgcgtgcttccgttgctgccaagccatattgcttattgtctgaatgctcgctcttaaccatttcatgtgctcatatgagcaatctgatttttgtatcaaatatgttatccctccttttttttttacaatagcagatagtgtttatgtgtgttaattgtgaggtcaatttttttttacaatagcagatagtgtttacgtgtgttaattgtgagatcaacttgtcattacatgtatgtacatgtcactggtt

SEQ ID NO: 80119 - DNA, 16545 bp, Oryza sativa
gtctggttacattgggtaactggtcccttgaagtgttttacggcctttatccgccgcatgtgctaataaacacttttaagttgcacaaataaactgtgggttccattttgtcttatatttttagatttactggatattgcttgggaatgtaagttgcagagtgttgtagtaaatgatataatgggtttgttgttctgtgcaatttactctactgtttccaaaggaaggggttcatatacatgttcccaattatcttatttctaaattctcggtattggatcctgttatcctgtattgatttcatatgcactgttgtttgtatgacagaaatagtcatctcagctagtgaaaatggtgcaatacaatttcaagcgtatcactgttgttcctcctgggaaggacttcattgacatcatcttgtcccgcacccagaggcaaacaccaactgttgtccacaaggatatgctatctcccgcattcgtcagttttatatgcgaaaggttaagtatacccagtcaaacttctatgagaagctgtccactgtcatcgatgacttcccaaggttggatggcatccatcctttctaaggtgatttttttcatggttcggtcaacaaagatcactacaaacttgccttgggccaaatcaacacagccagaaatatcattgcaaagatagctaaggactatttgaggctgctcaaatatggagactcgctgtaccggtgcaagtgtctcaaggtggctgcattaggtcgtatgtgtactgtcattaagcggatcagtcctagtttggcatacctggagcagatcaggcagcacatggcgaggcttccatctatagacccaaacacccgtactttattgatttgtggctatccaaatgttgggaagagctctttcatgaacaagatcacaagagcagatgtggatgtccaaccctatgctttcacaacaaagtccctgtttgttggtcatgctgattacaagtatttgcggtaccaagtgattgacactccagggatccttgatcggccttttgaggacaggaacatcatagaaatgtgcagtatcactgctcttgcccacttgagggctgctgtgctattcttcctggacatctctgggtcttgtgggtacagtattgctcagcaggctgcactcttccacagtatcaagtccttgttcatgaacaagcctctagtcattgtgtgcaacaagacagatttgcagcctcttgaaaatctgtctgaggaggacatgaagctggtaatggagatgaaggcagaggctatgaagaccataggccatggtggagaagctaatgaagagggtgttttgttgactatgagtactttgactgaaaatggtgtgatggctgtcaaaaatgctgcatgtgagaggcttcttgatcagagggtggagatcaagatgaaatcaaagaagatcaatgactgcctaaatagatttcatgttgcatgccaaagcctcgtgataacaaggagaggcctccttgcatccctcaggctgttctggatgctcgagcaagtgctgatgctgcaaaggaaaagaagaagctggaaaggaaactggagaaggacctagagaatgagaatggaggtgctggggtctattctgcgagtctcaagaagcattacttattggccgatgatgaatggaaggaagacattctgcctgagatattggatgggcataatgttgctgattttctggatccagatatattgcagaggtgtgaagagttggagagagaggagggtcttcgcctcgaagaggaagctgcacaggaagctttccagattgatggccatgaactaactgaagagcagcgtgaaatcttgggtcagattagaaagaagaaggcattgctcatccaggagcatagaatgaagaagagaactgcagaaagtcgtcctattgttcctagaaagtttgacaaagacaggacattcacaactgatagaatgggtcgccaactttcatccatgggttttgatcctagtgcagctatggaccgagcccgcagccggtctagaggtcgcaagcgtgagaggtcactgagcagagctgccagtgatggtgatgatatggatatagatggccagcagtccagcaagaaattgcgcgcgttgtcgaggtccaggtctaggtcgaaatcaagaccacctgaggaggttgttccaggagaaggattcaaggactctgctcagaagaagaaggcaattaagaaagctaaggattctgtgaggaacaggaacaaggaggctcgtcgcggagaggcggaccgtgtcattccaactttgaaaccaaagcatctgttctctggaaaaagttctataggcaagacgagcaggcgataagtgattcagcacagctgctggtcatcactggtttcaggtaggtggatgtggagcactacttataaacacataatttgtgacatgaactcaattatttctgggcttataactcatgttctacttgctcattttgtaggaagtgcagcatcattgcagcatggtgtgggaaattaggcgaaggaaggcctgattatccaatctgctggacttgttgtgctctgtttattcatactgtctgatggattgctgtgtatcccgtctcatcctctgccgagacataattttgttagcttatgttgtagctttacgctacattaatatggtttcgctagtattagttcgttacatggtactatgaaatactactcctgtaatggtgactttgttattatacttgaattccagtcctattcgttataattaattctttataataagatatcacatgattatgttttgacgaaaggaaaatatgtttcaaatcgttaaaacacgtttcatatgtgataacgatatgttttaatatatgttctcactgtatttcacaaattttttaaatgtttcatcatgtactactagggcccgttcgaatccaattaaaagggtggatggaattttgaattaaagtggcacgtttttcaaactgctaaacggtgtgttttgtgcgaaaactttctatatgaaagttgttctaaaatatcagattaatctattttttaagtttgtaataactacgtgaaacacttaatctttatcttcatcttcaggagattcaaacaccacctagaacatttgatcgcctgatattattttagaaaaatcgagcactgatattattttagaaaatcggacgctcgatttgtagagggttcacagcaatagatgtaatgttctgaaccaaattggataactgtatatagcccgttatcattcgcagaaataactaggactgcagatgagaaaagaaaaacaattactacttacaacgccgaccgaggtgaataggactgatgaatattactccctccattccaaaatactataaggcataatcacccataacccaaaaaccaagaaaataattattatcatcttgtagtttggatcatcctaataaatataatgtatgcatccaataaaattagagaacatgagagtgatgtatttaaaaaagtaataatttaatggagaagaggtcatatttaatagcctatatgcatgtatgccttatattatggaacatctaacaaaatgattgtaatggagggagtaataagaaagaaacatctgatccaagtccaagtgcaagtacagtatttggagcccatgatcgggcgggcatatacaaagaaagcccaaaactaccttagtttagctgctgggccgagtgctattgggccggacgaacacgcagacgcaacggagatatgtatctggagtcgaagcgaggccaacacgtagtggcgacggtgggaagctatggtggcgtggacgctacgacctgcggcggcgggcagggccatccggcgagccgcgtaccactccgacggcgcccctcctccccgcaagctccggggcccccgcttcagctctttcaataggaacaaccatgaggtgtgtgtgtgtgtatccatctcccttgataataacctagttcgttcttaggtttcgatctagagtttcccctcccaaattgaatagaaatatatccttttttttaagcctactgcctctgtgctaatacctgtttcatcatcgcgtttggttgttccccaactaggttaaaaaaagatggatttatttttgcttttcttatttcgaaattatgcccgtaatcccatatgttgagtatttaataaactactaaagatatatatgctcccgcgaaaaacacacacacaaattcttcaactaactagattcaggtttttcagattatgctgcctgtaccagtacgactgttatctgtttattgtgaggggaggagatggtattattccgtaatatgacagatcattctgcagttgtagatgatgcattattatgttcactaatgctcttgtgcttaaccatctcaacactttgctctagaattttgactgttagcactgttaaatttcattatgccgcataagagtgcaatccccctaagatgacaggtcattgtgcacacttgtttgtattgattattgaatgagttcgtatacgtatcattgcgtttcataatttcatagggttttagctgttatgatgttgctcatttgctgtagcatcttgacactacgcactagaattactcttgctgttaccatcgattaattaaagcttgtcttttgttcaagccttcatctctaatgttttagttttataacttcttttttagttttcccttccttttttattttaatttatttgtttggcaaaaccctccatgctctgaaaataatcctgtgttgttcagtattactcttgtctcccctgctagcttgaggggaaagaaagagagtgacatttttctgttcttacaaaactgtacctgttctcccgtatacttggggtttaactactctcaattcccaaacatttggttgaagcaccaatgccaaacctcactaaaagttatattcagtttttttttatcatgctgtactgttaaattatatgccaattgaagtgcactcctcttgatgaaaagtaggcacagccaagaaaaatggtgcttgctttccttcaactatgtcccttagagttcacattccccaggatgatataacatggatgagtttgtacaattaagtttgtttgggtcatgttccctaagtttgggttgcagaactcgtagggaatcgagtaatgcttctttgcttatgtagcatttgaatatcatactttataattttcaattctgaacagtgtgcttttagctgattaaaagcttggctcttgtaccagccttcacatccaatgttttttattcatctaacttcaactccttaccatagagattgtattaagaaccattaacaccagaaagaaaggcttggttgggcacagtgcacttgtgtaaaaggatatagattgccatcattcatattttgttttaattgaacagtgacatagagcgtgtggaattttaaggagaaactgaagttaaatatctgagtctttttgtacaagtctgatagtggatgtggattacaacagtacgcatgttgatatgcagatcgatgcgttgcttgaggaagtcaagaatacaccggttaacatgatcaccgatgacctaatgatccgaaccgtgcggcagtatgtaattctgtgaattgcagcttgtgtttttttggttctctatctggctgaccatcctatttactactgctcttccttgtctgcatgtgtagttcttttctggctcgtcaggagattctgtatcaaaatgttctgcgatcatgggtggttgtggcagcggtactcacagggtatagctgggggtacaacaaatttgctgaaagttctactgtcggatctgaaccaccaaaagaacatgaggggaagtagaagacttgacgattgtttttgctctttacggaagactgagtgtttgggataaaatgcagtgaattgtgcctcagaaactcgcttgtaaattggtcaatttctgttaactgactatcctgtaagacagggcttgggcgaccaatcttgctccgccttttacaatctccagctggtttggggtgtttcatgctctagataggctgctgctggtcgataatcaacggatgctctttctttttatagttaactcacaaggcagcttggtattacaactaaacaagtatatactgacagtgagaagaattaatttaaaaaattcagtaccagtaatgagtaaaataagcaaatttaaggcactacactaaaataaccaaagttataagtgtagcatacaactagctagtaagacagatacagtatgatgatatacaataatccatccatcttcagtggttgctctagcttgcttaatttgtattttaatgtatgacgccgttgactttttgtcaacgtttgaccatttgttttattcaaaaattttgtgcaaatatgaaaatatttatgtcatgcttaaagaacatttgatgatgaatcaagtcacaataaaataaatgataattacataaattttttgaataagacaaatagtcaaacgttgtataaaaagtcaacggcgtcatacattaaaatataaatatggaggtagtaacatttattataggttaattaatgtttggcatcatatgctccaaatcaggaggagtaacctgtaaagagggggagggccgctgtgattggcatgtatccatgcagaattggagatacgccgaatgcgctagctgctcgcctgctccttcaaaatataacttgatggtgatgataactcgtaaaattaaaaaaccaacttaaaaatcaactctaatatgaatgacgtgtcaaaatcccgaaaaaaaaaatctttaatttatataatagtaaagataaagacgcgcgggcacacagatatatatatacacacacatatacatatacgcttctgttgcaaggagtagatatttaggtacaactatgtgctagtaaaatcgaagcactgcaaaattatactccctccatttcttttagtttgaagttggtcatacatttggaagcaggtgtagtatttgaaatttggtagcaaattaaagataaactaaatcaccagtacacgaatagctcacatagagcattcttggaggatggaacaaaaaaaaaacaaatatcttccaggtcactagacacgttaaatacaaggggatcaccacatgcttacaacacacgtactgtaatttaattagctggagtacataatactccctccgttcaggttataatatgttttgattttagtcaaagtcaaactgttttaagtttgaccaaatttgtagaaaaaagtagtgacattttaatctaagacaaatttattataaaaatatatattcaattattgatttgatgaaactattttagtattataaatattactatatttgtctatgaacttagtcaaacttgaaacagtttaactttgatcaaagttaaaacaacttatgacctaaaacggagggagtaatggttacaaacacaatgcaagtcgatcatcacaaaatatgtgtcaggggcaattgcgcaacggaccatattctaaggactaacgtccagttctatttcggctcgtcaggagatgcttgttcaaaacgttctccgttcacgttcatggtttaactgctatcagagttttcagacattctgctattagctctgaaccaccaacagaacatcaggcttttatatatatatataattagctctgaatgtagtgaagatgagcatgtgacataatcgaacatcagcatttttttatatatatataattagctctgaatgtagtgaagatgagcatgtgacatgatctctcctgtgtatccgtcactcttgcgtttactatatatggttatgtttgtcaacgccaggttgtggaggcacttgttcaagacagaaacttcaatcaggttttagattgccaactgagagaatcaaccacttcctttatgacattctgatgaccatcattcaggattcaggagggaattaaaaaaaagtgacaagcatttcagagaactcgcaacagcagctaagttacatgatataaaagggaggtcccaatcaacaacgatttaaatcatagacggtccaaggttaccacagcttgttagaggcatttgattacagaatcatttccagtccatttggaattgagtactattactcttctagtcgtccaagcttcttccttagttcctgccgctcctagtgttcgtctgttgtatcttccttagttcctgccgcttcaggtgttcgtctgttgttccctttgataagggtagcgaccccagcaccgaaaaggtagccagacattgcaaatgcagcaaccatccacaaatgccttatgttgtgtgtgccaatcttcttcctgcgctcaaggatcaagctgcagtacatggatcaaaaggaaaagatcgattagggtgcatgtgcagacagattacattggcgacaaaaacgcttgtagcagcatcacagctagaaaagtacatatatatacctctcaccgctttctctaaccagatcatgttgtgacagaacggctgatgcttgttccgccttcccatacactacttgaaactgcatagcaacatgttaaattccactggaatatgcattgtaaaatttggcttatgatgacaggcaactcccaaaacaacagcagtatatgtcatttaatgatctagtatatatcatttaatgattctttttagtgcagacacttggatcaagtgctgttcttgacagtactccctccatccacaaaagttacacctatttcacatttaagtttttccaaataagttgtttctatttgtagtctgtatgcattcaagatttaagtgaagagataaattaaatgttttattagaacccaaggagtcatctaaatactcattggttccatgcttgcattcactccttgattttgtaacatccaaggtgatctaatttctccttggtcttggtgtcaaaagtaatatgtgtaacttttgtggatggagggagtaattgtgaaactgtggatgacccttaatttgttgacgggtcctgatatgaagatgcttggtttagattactctttgaatgattaccatcatttgtaatgctggtgacaccaagtaggcatgtagatggcccaaaccaaactggcccaacccaatccaaactaggcagtccaacacaatgcaatccagtccccccacagaaactgaactcacaaagagatttctctagcgcggcggtggtggtgacagcacacagcagctttgttggcgctagctgctagcagaggcaaccctgacttgactgcaaatgcaacatccttagcacaggaggtggcaatggcatggtaactttcggttacctggtatccgcagccacattaactatgcctagattattaattgggtgatcttctctaatacctcaatggacattcaaacaatttgattttcttaaaaaaaaataaagattttggtgagcttggtgatcttctccattacctggtgaagttctcctcacaaaaagaagaggctttttaacttatgagcttcattcactactagtagtatactagtataaagttccagaccaaataaaattccacgttgtgcgaagatccgaaattttcatatctaagcatatgcagccctctaattccaaattttcatatctaagcacatgcagccctgtaattccaaatgtaagcaggtaatggatgaaattctgtttctaatcaagaagctcacttgtgtgtgcagtggtccttatccatcagacttgatgtccaacgaaatactccgtataacaaactaatggttgccattgattaattgaatgtttgctgtcaggaaagaaaaccttattaccatttgcaattggttagatcaaccattacgagataaggcacagtgccgtcagtctcgagctttctttgccttttctctgttctaatccactaaaaaatattacttgactgagatgttgttttccttttggaaaattgcaactccagcggtccgtgcaaatacaatccatctgcttggatcgtcaaaatcataatatgtgccaataatcatgatttgtttcacatagaagcgatatcagcaagggtaattgtaatactagctatcatttgctttgtgcctgctagctagtttgattagaaatagaattcaggataatacgtgctctcatttggaattaggggcggcttgcatgtgcctagattgaaaaaaataggcaaaaagattcttttctttttctcccatgtctctatcgacgatagactatcgttcaagctggtggagggggattgaaacactatcgaatttaaactagatcgaatggtaggaaggagctagggctataaatgatataattatagaagagcgaaaaagggtagtagtagcaaggatcgagtacgcacccactcaacaccgtagccgccggccatctgggaaccatggcgcgcgctcctcgtcagcttctctctcaagggaacgccataaatccctcgatctcgacctcgatgtcgcctgctagagttagggttagccagattcgtttttgtttgggttgcgttcgacttgggtcggccttagtctccgatttagtccagccgagattctcgaaggccagtgataataaataaataaagactaagttcactttgactcccttgacaccagtgacccaatctaattcgtatgactgcaataccggatatcttcacacacacacccaattattaaaactgatgcaattttactctcttaggctgtgttcgggagccgacacgcaaaacaaagcagcgtttagcgcatgattaattaagttttagctattttttttaaaaatggattaatatggttttttaagcaacttttgtataaaaactttttttttaaaaaaacacaccatttagcagtttgaaaagcatgcgtgtggaaaacgagaagagggagttgggaacggctgggaatgaacgcatccttagtggttttggagggcggtttcactgacgtggcgtctacgtggcagtgttgacctgatctatggcgttgatgtagcgcttatgtgggacccatttttcattaaaaattttttgtggtgcacactaatatgtggagcccacatgtcatccgttgcatattagattagagagaatttattatataccactgagtttgttcgagtttaacaatttgccattgacattgtctctttctataatataccaacgactttatcagttgttttacaatacaccattggattgggccttcttttcaaaaatacccaaaatacacttagagacatacaagattaacaattggtttatttcattagaagtttcaaaaaatatataattttttttgtgtggccttgccgccttgttacaaaatatggaagtttgtatacatgttttaaattttttctggtatatttagtttttagaaaaaaaatatttttatgtggtatatgagagaaatttgcttatacaagagataatagcataaaaatatcttatatagtgtatgaaagatgatttatattaataatggcaaatagtttgccagactggcatgccacataggcaaaaatgacaaatactccctccgtcctaaaatataagaaccaggactggatgggatatttcctagtactacgaatctgcacaggctgcctaacttctctttgtaaagaggataaagataaataatggtcatctcaaattcaataacattttgtagtgatatggaacgaatagaatggaaataaaactatggtgtcagtacaaagaggctgctaaaatgattacggtgtcaacataaagaggctgctaaaacagaattcattacagagggcattaggatgatcttgggaaaggagaaattgcccaatctgaatcaatggtccaagtattcaacccactaaactatgaaaaaaatagaactgagtattcaatccactaaagtatgaaaagcagttcgaacagctccatagtggcttggccatgtggactatgacaagtgatagtgaaatggtgatggattcgataaaaaaaaattcagtaagtcatacagcatgaaaaagaagtgtgttaatgtatagtattcctgggctcactgattagtgaggaaagggctcggcttgagtaaaatgagctaacatgtgagccacgtaagcaataccaccaacaactgttggatagactttttattccatattataattcaatggttcaagcagggcatagcatggcaagaatcttctaagaataagtttgcattttgtgtcttgtcattcttcataaattaatcttatataagtgcaccccccaaaaaaagtatgtatcatgttgttatttttcacccagccacttgtaacatgtttgtagttcaatgtaacttgaatagaaagctaagaaaattgtgcaagaaaatcacatgaatccttaggggcaacttcaaagaggaatttagaaataagattttattcacaaggccgtgtgcaagtgattggtgtgcatcttatagtgctcccatggcatgcataggtcgatttcacctttctggagggtacagagaaaataaagttatactacaagttactccgtacaagtttagttatagggcatatattttgtttcgccagtacaatgctttgatcaactattactctgtgtagttggtaatatattataatatttgtgtacaaaattataagtagaagaaagtatttatgaatacaaaactaaaaatacattaatattgtttctcgaaaattatatttaatatatatagtaaaaaaatgatgaaagcattatcgtaacaaaataaaagatgccccacaatttgtataaataagttggagaaggatcgagcagtgcttacaagccaacaacaaatataggcagtagcactaagtattttaatgatggggggaaaatagaaccagtgtatctctcttaaaaatatactatatgtttggggtgggaaagaagaagaaaacgtagcgtattaacgcatgtcgctagagcatgtggtatatcatatcagaaatttacaggatcagtagagctcctagtgatgtacagctcctatacagtcgcatatccatggcagcgtagcgttggaccggatcggaggcacctaccaaaccaaaccaaaccaaatcaaatcaaatcaaaataataatataataataaaagagtaaaagaaagaaaaaagcagcgttaatagaagaagagagtagagcagacacgtactgcgattttgcgttgacggacgacggcatgagattatctgcgcgcgccacaaaaggcgaaaaaggtactgcatgtcctctgctcctccctcctctgcgatgcgagggggagggtggtaaaaagtctggcaaaacaaaacaaaacaaaaacgaagaaagaaagaagagaaaatctgtgcgcctccctccctcaaatcagaaactctcgtcgctcctgctcctgtactgagctcctgtactgacagactgacagacacgacgagattcctctcctcccctccccttctcttccttccgtcatcgatctgtcgcacggaggagggatcaggcgacgaccataaaaaaacccacaccgatccgatgagagagagagagttgggaggccagatccgatctccccattagtaacttatccctggaaagaagaagagagggaggggcacgcgaaattccatccctgcccctctcccttatctgactcactccttcccttcgctcgctattcactgactcattagggccggctgtgttttcccaactaatctcttttttttccatcatcacgttttttataaacttctaaacggtattttctttcataatatatatatatatatatatataaattatttagaaaattcatattgatctattttttaaataaaatatagctaatacctaattaattaaatgctaattgatagctttgttttacatgcactgtaaatttaatttcggaaccgcaatgaacaaacacagcctagttaaggctgccttcgcacatctaggagttaatagttcctagaggtgcgaggtgtgtcctagatagatatccgatcgaacatccaataatcatccatgtcagcaggaactctcaacctatgaaatgaaggggaaaaaaagaaacaggagggaaaatatatatatggtcactggatgctgctacttttatacactagaagaaagaaaaggagggtgaatatgtataccagacataaggaggaggagttggttctcctagcgagcgttgacggactggcatgagtcatctagttatctgcgccacaaaaggctgcagcagccagcgaaaaggaattgcctctgctgctgctcctgaatcgcgtgaaatcatgggggtcgcccgctccgctcgtttcgtccgtcttatcgctccccctcctgtactgacagacacgacgagattcctctcctctcctctgctccccttctcttccttccgtcatcgatccgccgcagggaggagggatcaggcgacgaccaccaaaaacccacaccgatccgatgagagagagagagagagagagttgggaggccagatccgatctccccattagtaacttatccctggaaagaagaagagagggaggggcatgcgaaattccatccctgcccctctcccttatctgactcactccttcccttccctattcacggatcgtcgtatctatatttatatagaatataaaaaatatatatgggcttctttttttcgccctacttttttttccatccgtttttttcgtcgcctccttttttttcgccgtttttatccatattctttttttcgtcgcctttttccgttttctttgtccgctttttttcgctatttttaagtcgcaattttttcaataatctttatatcattccctgtctaataatatgaggatttttgttaaaaatttgttccaatgaattatctaatctcattcccagaattctttgttccctactccggatcgtcgtttctttttcttggacacattttggctctctatcgtggcacttaacgcgcaggaagagatatggtgaagtgcaaaacaaatttttccagtggagattttatatggcccgcctttttagtttttgaaaaccaattttacccaatctcttggtgaaaggaaaattttaacaccataaattctgtttaggatttccataataaaaaatttgggaataaaattttaagttgctgttagtgatgcttattcgggtttatttagatgtccgtcttcttatcgtcgggccgtatctagcgccgccgccacatcgatatgcctcccccatgcgttccctcctcctattaattgcaaaaggccaaaaatcaattcactactactcccctgtcattttcccatgagtaccaactcaaccatttgtatattcaccaatctaaaaaaatattgcccaagtctatcaaatatatttatagggtgtgtgtgcgcttcatagagatggctatatgcgcttcatagatattatgagtcgaatagagtagcacatacagaaaaaaaatgaatgaggggtagaccgtagacgtgtactcggtagcatcatgaaaaacctagcagatataacgttgcatagtaaagtaaactatgaaaaaaaaaacacctaattgcagtagtatactctgatgtgcagagcttaattgggtgggctgtcacgtctctaccacctgcctcgtatgcaacatactaatatcctccaatatatgtttgataggagtagttgcgtactttttactttttagcataattttgagcatagttttttttttcttttttaccgagggtgtagtaagcccaacatgatgcatatgactcatgtaaaatttctgttctttttgtttaatgtataacccatgtaagtttagattaatctatgggacacccgaaagctccgctacaaataagctcgcaacagccgtcgttagtatacgagccgtgatttagtataatggttttttctctagtaatatacccgtgtttgtaacgggtcagacttatgcaagtaaggattgactgagtgtagattagaataaatcacaagccaggttcgtataattggggattaaataagtggatggattgaggagaaaacacgaggtatacttatataattaggacttgaattggctggtaggtggattaagaaagtattgaacaacctcaatagatggatggtaagaaggtgacatatggagtagagaaaatcataggggtagcattttcaatgttatgattcaaatatggagcaattgacaagttggtggtaacttggcagaagaaacaataaatatcaagtaagtcattcctacgtcccttaatataaaaagttttaaagttggacacggttattaagaaaataggtagaagtgaatggtgaagggttgt

SEQ ID NO: 80120 - DNA, 1684 bp, Oryza sativa
aattttagttgatgagctagttgtccatcccatggtgaggacacaccaggatgtattcatggagtctccccatgcctctggaattgaatcattggttgcctgctagaaactcgagatctttccatgaggatattggttttgcccattaggaaaaacctcatgatgaacgcagttgaacacctctcccaattgtccacagcacctctcttggaatagaaccaatgcttcagtctcccgagtagagaacgaaaacagacggagcctcatcctaggtcactcctttgatgatgatggtgttgcagagctcaaggaattgttggagatgggcgttagcgtcctcattggctttcccacaggatggggtagcctgtagcatagtgatctgacctgtcttgatctcaaagttggcatccccaaagggtgctgagtaatcacagagggtcttctaagccatcggcttggaatttgatggtgcgaaaatgactggttcaggtgccgagaacctgatttgtggaggaacgacgcgaggtttgactcttctcgcaagtttctctagattttcaacgaaatttgtcggcaagtcgaaaccgttcatacactacctgttttcacaagaagaggaaacaaatcaaggttaacctgtttggaccaaggttcactaatcatagaatgattatgaatgtatataactaaatctttaacaagtgtcttctctggcgatggtgccagaaatgcttaccggtactttttacggccagagataaatccgcaagtgcacagatacggctgtagcatttcacccatgagtattccaagggtgtcgtatttatatttccgcagggacgtgatggtataaagatagagttcatacatccttaatcaagctataattactttacaatagtttgaacaatggttaattgataaatgacaatgagatagtgtgtcacacaggagattcatctctaataatgacacattaggcagtggagaaaaactatagaaagctaaggtccatatatatgtacttctatattaccaatgtttagtttacactaaatacatatatgcttacaaggctaggacttagtctaggcacctaagaactaccgagagaccactcctagttggtttgtcagcgtggtaatggcattttaccaactcttacgtcatacctggacgtggaggaatacaatggatggagaggactgccaccatctaccgcctacctcactttccgtggggcatactcgcatccaatggcatttaactaacctaagcaccatgcatatcttaataaataatttcattaattcccccgggactctcacccttcgaatgaacaagttagaactaatgcaactcgttaagatcattggaccattatcgtagcatagatcaactagcataagctagtgaagcacataaatgaagtataatctattcatcgaacacgtaactagtaaactatgatatgaactatgaacacaatataataaagaagataattcttttattgcaactatagtcttacaagaaaagtaaagtactaaagacatactggaatctatgagaagactacaggaccaatgctgcgctcaaataagctagtgtggcctttcccaaatgctagtgcattgatccccgtcccaggaaaagttggggtacacttcaacaatcatga

SEQ ID NO: 80121 - DNA, 4334 bp, Oryza sativa
taaggattgactgagtgttagattagaataaatcacaagccaggttcgtataattggggattaaataagtggatggattgaggagaaaacacgagctagacttatataattaggacttgaattggctggtaggtggattgagaaagtattgaacaacctcaatagatggatggtgagaaggtgacagatggagtagagaaaatcataggggtagcattttcaatgttatgattcaaatatggagcaattgacaagttggtggtaacttggcagaagaaacaataaatatcaagtaagtcattcctacgtcccttaatataagaagttttagagttggacacggttattaagaaaataggtagaagtgaatggtgaagggttgttattggttgggaagagaatgttggtggataagttattatattttgagacaaattctaagggctaaaagttgtcatattttgggacggaggaagtaatagctagctctttcaatttgaaacaagtgaaataaagttttagttcaaaacggcttcttcacaaggtcaatgctaataaataacgagtattcccaccgttccgtaaaattataatataaggctatcaatctgaacgtaaccttagcctctaaaagttttctatttttttaggctatctatatatttatcgataaattttattatagaaaattttcagttgcaaataaagtacgatatgagtgtaatcactgcacaatcatatatgatataacaaattaaagataaacaaaatcactggctcacgaatagctcatgtagagggaaaagaacccaaaaatgcgtgagctataaaatatatgtactagcaaaatcgggaacggtcagcagtggtagaaatagaagggcaccaccacatcaaataattaaccaatcaaccaactcacatgcttgcaccaagcagaatactttagttacaataaccaacacatgcatacaccataaacagtatttagctacattatagtcagaatcaaaagccatcacgaagggttgtgtcaggtgcaggctgtagacccccgattttggaaatcgaaaatcttctatgtttatccgtaccaatctctggatcagtagttggtacacacatacatagttggatcacaacatatcacgaatgaatttaggctaaaagagttaaatacttacattagggccaggtaggccaacaactatcagagaacaacagcagaagacaaaataatataagggcctggttaacatgccacaggcagtcgactggggaacgagacctagaacaagaccgcactccgatcatcttgtgggatacgcaagcgtaccgacaatggcttctctttaacactctcctaaaaaatatataaatagcaagggtgagtaccaaccgtactcagcaagccaccacaacaacaatgcatatgatagagggtattcaaggaatgctttcaggttcttttgcataaagctgcgttttgcaaatattttcacaagcctaagacctatcatagactgatcatattttaattccagtgttcacattaaacaacgacggttctgtccaccatccattgtgatcccaaggatagcttcccgccattgagtcgtcatggttttctgaggacgtccaccttccctcctctcaggaagtggctccatcagcataaaaatcaccatgcaatatcccatcccacacaagttaagaatttagagtctagccaagtgtaatacatgtcccagtgctcattaaccgcgagcacggctattcgaatagatttggtttgctcacactgcagtggatgtacactttacccacactccgcgactgcccaacacatgagcctcgtcccaacacatgagacgcgtcacggcaaagcttttcgataacctcgcattggcagtacccgctccatgaacttaaatcctcatgcattctaggcgtccatgtttctagcagtgagaggagttctggcgctcccgggaaagagaagtctcacacgcatattaaattatggttcaagttaagttctctctctcacacactcatggcagtcctaccaatggcgacaccgatgtagggcacgcttctcggccctacctcaacggctgtcccatcgtagcgcacctgcctcactcaggggtgaaccatctatgcagggatactgcctccgctcggctatctaatccgctaggtctatatcccttcgagaagtacggttgtacgggggtcgtttcatgcttaacttcatggctcggtccttaattgactggggacggtactagccttttccagataccacccaaatcctccatccgccccagtcgaaaacagttgtttaattttatttctcctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcatttctaagcaattgtcatagttgactagggactcatacgtaaacatggttacaaagatttaagggtaaacaataatcaaggcatggcataatcacaagtacgatgttcatcattgcatgcaattttatttgtaaacaaaacaatttcgcaattgggatcaacatgttcaaggaatagtgatgacttgccttgctcaggatagtccttattcttgatataattcttgatcaaccttcacctcctgaaagttgctgacgttgcctcacaactttccgatccacaaagtctataatacgctagaaaaaccaatattcaagcaacattcaaatatgcacaaacaaaatatattggttgaggttgaacctaaggttgctcatattattcgcgcttgctaatgggttccaacatgctaagggctaaagtttcttaatctttctgttatcatggtggtctatttaggagctagccaatgtagtatgaatgagatacgtatctggctaatttggggtttagtctagctaatggctatggaaggattatggctacacatgcatctatctaaataaaatggtcgtatactagaggttctgttgtcggatggatttaggatcaatcaaataattacagtgaatcatttgtattatttattttattgatggaagctttactttaattatgaacatattttacttgtcacaataaattataaaaggttaataattatccatgcttcgtatgttagagttgtttaggttaatcatattatggttacagattatcccatcacataattttacaatgaataatcctaatttacagttaaactataattataattatatgaggtcaagatttataactagtatttatctaatatacatgtttgtcatacactctctcttaatttcatatatgcaacacgcaaattaatactataccgtaccactataatgggatgtatagtttatgtgtaagcaacaatatcttattattggatcatatatttgagtagtttctttttactgtaagctatacaatacatgttgattttaagatggctctatttggttaactaatggatatcaaccgactatatatatatatattctacttcacatgacattgaatcaactaatttttttaagtggtccaaatacaactagctctgtgattactctcctaaacaagttaaagattcatctatgtgtgtttatagtttagttagaaaatatgaggctaaactttatgtaaataatttataagtcatagaattaattatatttggacataggctagtaaatggcactaatattttcctttacacccattaatttgaaggattgattataactaatttatttggttgctacagtgacaagacatattaaagataattatgctactgtacaatatccattttttttatttattggcacactatttaggttaactattatctaatcatttgatattaattaatttataattataaatatattttattgaatagtgaattatatatcattggaaagcttatgaatttagatgaatttaggttcaagtttcactcaaatccgagttaaaatgaataagttatgctagtgtaaagattcaaatttgaattaattctaataattgtgaaatggtactgttcctaattcatttatttttaatacaaccttatccacaggctatagtgactgacaggtggggtcttcctattttcttttattttattttatttttctttctaaaggaatcatatgggcaaatgacaggtgggcccgactcctttgactagggtcaaaccggccattaaacccggtagggcc

SEQ ID NO: 80122 - DNA, 2583 bp, Oryza sativa
acgcgcacggcgcggaggggtgcggggcgcgaggtggcgcggcatggggcacgacgcgggggcgacggcggcagcgcgcgcggaggggaggggctcgagacgacgcgacagacgacggcgatgcgatggagtgtggcgcggcgacaggacggcgcgcggcgcggtagtggagtcgacgggacggcgatggcgcgcggcgggatggagacggcgcggcaacggcaacggcgcggcgctcgaggcgagcggtgatgtgacggcgacacgcgacgacgtgacggcgacggcggcggcacgtgcggaggagcggggctcggcgcacggcgatgggacgggcgcgcagcggggcaggggcgcggggcgcacggccagctagggccccgtggtgggagaggaggggggagggctaggggaccacatcgaacacctatgccgtaatgaacagtgacttttcctatttatcccgattttagtccatttcttgtgtaaatttgattctataaatcctagattttgtataaatgaagtttacccaatatttgtgtcattccaaccaatggatttattctagattaatattactcatattttatttatataatttatttgaatttttaattagggttaattcttattattattatatatttgtcaaagttttcctatttttcttcttttagggttttggttgatttataaattcagaaaagttgcaaattaaatttgtatttactcctaagcatttgggtgaccgtattaagtgttcaaatgtgaatttgcccaaaatttaatattgtccaatatttaaggtttattaaagattctataattttctaatgagaccgttattaacacaatagcactttagttcaatttatttatatgttagtttatatggaggggtttaatatattaaatttcaatccctaaatgcaattaggaacttggtgtaatatcgatctacatatagaattaaatactcccataattctattatatatatattatatatacagagagctcagtttatttgaataatcatcatttcatgtgtactcatattatggcacccacctacattattcaaatattttaatatttgataaaataggttaataataacttttcttttatttgattttaatatcttgtgcataattatttgtaggattaaatatattctcgtaaatcatttctattgcttaaatgtagttcttttctttactttcttggtgatcatttatggtttggcaagcaataggaatcataacaaccagcatgatgcaaaagttttaaaaagttcgaaattttagtgatttttattatcaggaattttcagggtgttacacaggccctcctccatctaacattacagctaattaaacttcaagcattagtaccaaactttgcacgcttacgccgcgcatctctccagccagcactgcatgccccaactacaccggatgcaacaaacaccgcaactacgttacatccaaacactagattatctcgaaatacacccctgggcatcccgcagaaagtcaacaacctgtgcgaatgatatacacaacacatatatatgaagctgcccctgaaaccaaggtggaaaacaatgacaaacataaacttgcaagcaaccacataccggctgagcacatttctatcttcattctccaccctttttaccttctcgacatcttcaatcatttccctcttcaccttcgccttcaattcatcaatttctctgacgatgttggtccttctgacctgattaggattcacaggtttgagcacaaatcaagacaaaaatgatcaattactccctcatggtatcagaggacggtaagtcaccagcattgttagtgctgagttgttactgacaagcattcataggcctcaacgtcgccggctgatttagagaagaaaatgaaacacacaagcatacggcggactgaggttacaagttagaaatatgagagaaattcacatactcttttagaacctatatagattcagcggtaacacttaaaaaacaacattttttaattagtaactgatgaaaatgagcctgtaatcacagtatgaaaattaactatgaacattcagcaagtgtgttcttaacatatatcagaaagccgactgctttctaactccagaactgttttatgtgcccatgctcctaatacatggtattactgttacattcatgcggtcattttctaatcttttagagaaaaacagaatctcttctaatataacaaataccagccaacttgcacatacaagacgatttaagttggtcttagggagttagggaagaggagcccagtagcccaccacctctccaatctcatcttaatcttatatatgttttaccttcagtatccaaaccaagaggccagataaaggctatatttatgtgcaacgcataaggaaactctaagacatatagacagaaaccaaaaagaagagttttttttgaatcaatttctaaataggattagagatggagtaacataagtgaaattctctacagttatctactgctgactgttagaggggacaaaattaggtactgggatt

SEQ ID NO: 80123 - DNA, 1135 bp, Oryza sativa
  unsure (1)..(1135): unsure at all n locations
cggcgtctccgccggtgggcgatgcttgagaagaggcagacgcgttcggactcgacctagaaaagaaggaagaggggttagaaggggganaggttgtggacaccccaagtattataccatcagtgtccaacgcgaccaccacatactgttggaggagtgggatccaaacacgcataaaaaaaagacactcatcctcaatgtgtccatgatcacggttgacaccttctactataataaccggaatgccgagtagtgatcacaagagataaccataagataacttgccaggctactccgtcatatgcccgtcaaccacacgaaggtggcgaccagaaaacaaggcataccccagtgcctcgatccaaagcactatcaccaattatctcaagcgatcaaaacccgttactcatgctcagctagtccccaggaatgcgactagcctcacacattcatcgcaagcaattggaacatcatcacaagtgcataaaaaggggttaagtacagcaagtatctggtacataataggatccgaggtcccatctaacagcacacaagtagtagcggaagattcaaacaaaagccagaagcacaaaacaaaagccggtggtgccacaaccccacaagggcaaaccaaccgggcaagagccaagctgaagatagcagaagatcatttactgccctcgccgcccccggcagaacagtgaccacacaggaagcacaattctacgctagagtcctcacctgaaagcagcggagcccgtgtgccgccgtcgctttggtccctgccgccgccgccgccagccttgtgtgcgcgctggccaggccgcgccgctcggacgcccccagccgtccgatcggccctggccgatctgggccgtccacgtggtggacgcgcacccgaggccacgtgtggaccatgtncaccgtgcgcccttcccctttgactcgctgacgtctggggcccgcgtgtcggcgccggcccgccctttgtgacattagcgaagtccatttccttttgtaaaataaataataattgtgcaataaatcgagtttaattctagaaattcatttaaatggctcaaaacttctaaattcatatctaattcatacgaactccaaattgggccattcaact

SEQ ID NO: 80124 - DNA, 3939 bp, Oryza sativa
cctgcagccccaagaatgtggtagttgaagggcacaatgtactggaattatcctttttctttctctgtaagaacagtttcgtttctcctttttgaaaaatatagaaaagaacagttagtatcttgggagcagaaaaactctaagaatgaggcgtagaagagcccatggtaggccccatgatacaaggaacatgttggaggcccaaacaaaagtaagcccatcaaggtccagtgcggcccattatctatgtcctcgtcgatgccccacctataaaaggagattcattcgtaaaccctagagcttcgcttctccgcagccgccgccgccgccgccgcgttccaccacctaccacccccaccggagaagaagaagaaaaaggagaggaagatggtgtcgggttcggggctgtgcacgcggcgggtggtggtggacgcgcggcaccacatgctggggcggctggcgtcgctggtggcgaaggagctcctgaacgggcagcgggtggtggtggtgcggtgcgaggagatgtgcatctccggcgggctcgtccggcagaagatgaagtacctccggttcctccgcaagcggatgaacaccaagccctcccatggccccatccacttccgcgccccctcccgcatcttctggcgcaccgtccgcggcatgatcccccacaagaccccccgcggcgaggccgccctcgccaacctcaaggccttcgacggcgtcccccctccctacgaccgcaccaagcgcatggtcgtccccgacgccctcaagtacgctcgcttcgaaccctttcctctcctctcctctccttttcttttcctccatgaactaatccatggcttctagggttcttcgcctccagcccggccacaagtactgcctcctcggccagctctccaaggaggtcggctggaactaccacgacaccatcagggtacatttcctttctgtattcatattcacgctgcttttcgttttagcttgaatgcatatgctgctgtaatgcttttagttttaggttgaatgggacgcagattcagtgacattcccccgtgacattctcggtgacattgagtcactgatatgtgggacccacatgtgtttggacccacatgtcagtgactcaatgtcacgggggaatgtcaccgaatcacaatccggttgaatgcatatgatgtacacatgtgcccccttttacttttcggatgaatggatatgctaaatacatgtaggagtactattgaactgaacgtgttaggatgaatgcaatgctgaatacatgtgttggactgttaagaatagttcatcttggaatgttatggtattatgtgatcacttttgtgaatattgggcccttgtagctatttgattgtacaactgtacggtggtaacgcgttgaactcaaactcaacatgctctggatttgaatatgtaggtttttgctgagctacttttatgctgtacacctctctagcttttgttttacaccatagcctcaactgtctgagattagttgatgactctgatgatgcacgaaatcttaagtatcctatttatttatttgcacaaagatgatggaattcccataaacctgtgattacttatgctatggctgtgaatttgcaaatgcatctttttttttcttgtttgcatccccttttcaattgttacacagcatgtttttttttctaatccatgttgagttaaatagcatatttggcatgattggtaaaatgaagaaaaaatacatgtattctcactgatttttcagaatgatgtttacaaccagctacttctgaccaactgtgccatttctcacaacaaaatattctgtttgatacatttatctgctttgtttctgagtttgtgctattatttcaaccatgtcctgcatttctaggctgttatcatctcaattctggttgggctttttatgtttccctttagttcttatacatgaaagcacactgatcaccttgtctattgcacctgcaggaattggaggagaagagaaaggagaaggctaaggttgcatacgagaggaggaagcaattaacaaggcttcgtgtcaaggctgagaaagctgctgaggagaagctgggttctcagatagatattttggccccaatcaaatattgattggcctgattgtcatcaattttcttttcgcctttataatatttctgcttatcggtaccatgagaagtgaaatgatatgtctgtcgaaacatgataattttgttccaattgaatactagagagttatattggcttgatctgattttccctcttgaattttcaaccttgaactctcctaactggacaaatgacccctctggtttgttctgggttattttgatcctacttaacgagggagtaatttggcctgtgatttttaccctgtggttcggaactaattttctcattctttgcaatgatgtctgttaatattatgctcggctaggttccttctactacgttttatcccctagccctagcaccttcgcttgctcatttcttcctttctattcaccaattgtaccgtgtaattagctctgttgtgtatttttttaaaattgtttgtgcagaacaccagattatagactgtataatatagatagaatcaatactcctcctgaatattttaatgtcagacactttatgcctgaatattttaatgtcagacactttatgccaatgttagtattaattttctggagtaatggtattggaggtcataggaagtgtgtagtgtcgcacagatgcgcacatacttcagcggaaatatataaacccattctgataatcaacttcactcactaaacgttcaaaagaaagtgctcaaagaaagagtgaaactaaaattaagggttcgaatgcatacgcaccagcatcaaattaaacatagcattgttctagtgatgatcgactgaagctgcataataaaggggatcccagtccacaacgatttaagcatggaaagaaggtacttgaattttgagtacataataatattattattataataactgggctttgtggatacatatatggtgcattataaaacaagctaggggtacaccttcctattccatggcgtattacttaacttgggtcaactgatagatacactaaggtcctgtttagttatacggctgaaaagttttggcgtgtcacataggatatacggacacatgtttaaagtattaaacatagataataacaaaacaaattacagatgaatttattatgcataattaattcgtcattagtaaatatttattgtagcaccacattgtcaaatcatacagcaattaggcttaaaagatttgtctcacattttatacgcaatctgtgtaattagtttttttttgtctatatttaatactcaatgcatctgtccaaacattcgatgcaacaggatgaaaagtttttacgtggaacccgtgtctcttttcccgatgcttcaaccacgcaagcacattttatcttttgaaccaagccgtcgccttccatccttgcatatttggcaccagctgtgctcccaaacatgtactaccaacaaaacccgggacattcaactctataacatgtgggcccttatgtttctatgatatgtgggttcagtgataaataatttatcaccacttgtaagagtggcaaatagttaattattccgcaaaagccactccagcagcgacccacacattccttaggttgcaggcgccgatcttcttctgacggtcaagaattaggctacaatgcacatcagaagggagggaaaacaaggaggaatgcgatgttatcattacattacaatgatcaattgctgtggagataaactacatactacaataagaactaccgagtcattctagataattaagaagtacctctcggtgctttctctcaccaaatctcctttaacccagt

SEQ ID NO: 80125 - DNA, 6307 bp, Oryza sativa
  unsure (1)..(6307): unsure at all n locations
tctaaaagaacatgaactagggaggttgtcaaaatatattatgagcagaaagcaaaattgaaaatatttctcaaacataattgccaaagagttagcctcacaactgattgctggacatcacagcagcaagaaagttacatgattgtcacagcccatttcattgataatgattggaacttacataagaagataattgccgttttcaaggtcaaaagtcataagggggaagaaattgggaaacacttgcaaaaggtgttgttggattgggagttagacaaagtaatgacagtcactgttgacaatgctagtgcaaatgatgttgctgttagttatttgagaaaacaaatgaacaatttgaatactagcattgcacaaggaaagtacctacacatgagatgtgctgcacatattgtgaatttgattgtttctgatggtttgaaagtggtggacatttctatcaagcgtgttcgtgctgctgttaaattcataaaaaatggtacggcaaggttggtgaaattcaaggagtgcagaattggagaaggtggacagcaaggctttcttgaaccttgatgtgtgcactacgtggaactccacatatgatatgttgaaagctgcctgcacatatgagaaggtttttataaggtatgcagaagaagatttggccttccaaatagaattgcttggtgacaaaggtcccggcgttcctggtgagggtgattggaggctgcaaggaagacggctgactttctaggccattttgctgatataactctccatgtttcagcatcactaaacgcgactgctcacaactttttccacgagattgcagatatcaatattttcttgcttgggcgaaagaaaagagatcgagcgtaaggaatacataaggtagtcatggttatattcgagctagttgtgtactcaatgtcaatgcaattataaatttaaattaaattacagggccctgcaatgttatgttgttcgagtcaatgaaaagtgcatatataagggacagtcatctacaaatggatcagcactgaagagtgcaacggattaaacaatccatgcaatttactctcataatgagcttatctaatgtatacatatccattcattaaagctattcacatgggatgactataaaacatctctctcacctgctttcttctcgattggtttatttccttctaatggagcaaagttacatctctttcacctcctttcttctcgatggtttgtttccttctaatggagcaaagtttctgtttgctataagaagcacttgagctatcaattcgccgttattctgcacatgtgaaaaacacatttgttgagtcatcacataaattcaggcagcaaacaagagtcattctgacctgacatatgcagactgacacatacaagagataacaatttataattgttgccatgtttatctttacgatctgaatatgaaataatagaagattcagatgcattccttttttgaattttcagaaagtttaaaagaataactctgttcttttttttgaataaactgcaagtttgtttgataagtttccttgctatatacaaataatctccaatatgagatctttcatgatatccaaacctaaacaattaaaaatcagcagcctctcaattagctcctagaaaccacagtccagaatagtacactgaaacaacatggaaaacgttgctctgtttttcctaaagtaattatttagtaaaagcttgtactgcttcttctttaaacagtccacaataattggattgtcacatgctacagctaacaaattcaggggagaagcttcgcgacagtccctgaaagagaattttatggcagaaaaggaaaaagaaaatcataatttaccctgaaagcaaatgcagaaaagttattcttttaacaagcctgcttttcggcagttagtcagttactggccaggttttagttggtggaagtgcacataaagcttccaaatgcatacataggaggtgtattaatcaatgaccaactactatagctacagcctaatatatcccagaaagaacacaccaatcagccaatctcatttcaaaatgactgtaagaattcaagcatgaagataaatgccggcagtgatatgatataaaagtctttccccttcaatttgactacacagcaaatctatttcatcagaaattagaaagaaaacccattagatttaactgagaacaagtactatgccacaaatatgcggcggtgtgggagtggacgaccggcgaaggtcaatggcgaagaaccggatctgacagcaatgtggtgactggcggtggcggtgaatcgtgtacggctgatggagggaagctagtcggcaacacgagtattggaaaaagggatgagcggaacgaacatattcgagaatcaacctcgaggtcgacgatcggcgggcggcaatgggcgatcggcgggcggcgtggtcgtggtcgacggggatcgaccggccaggcagcgatggcgcggccgcggaagacggcagcgactcgtggcagtgtcgaatcgggctatgcagcgcgaccgtgagggcggcgaggcgacagtgatctagcgagagatggaacgcgatgcgaggggacgtgttgcgggcttgcggccttgcgggggatttggcggagattgcgtcattggaggggatggggaggaaatcgcggcaatactggcggcacggatgcggagtgggagagaggaaggtgtgggacaggcggatctgggagggaggagaggatgactttagatcgttggatgtgtgatatgatgaatgatgaatgagtaaaactatttgttgaactataaggtagactacggagagggctctgggtccacatgtcattgggttagtgttttagtctctcatctgagcacttgggtttctagaaattatgcataggttctgaacatatttttccatgagtgatacttctacagtttggaccctatgtttcttgctatttatgtgccaccgtccttcttcttcctccagaactaacgatagacagggagagggatggcagttcgtgatggttgcggccatggcgctacagagggcggcgtctctattaggagtaaggagatggtctagggactacttcaaagcttaccctgtggtgtggagattatgggtaccccatacctacacggcatggttatccgactggttataggggataacttatatctatggaatatgtaacagatcatgacttgagtattacgtttccctttatattatggaatggcctaaagtcctggtttgataagattgtaaagtagatttaggaaaccaataccgtattggttaaggtttctatcttgtaatcatgccccccctcctatataagatgggcaggaggccctctagggggcatatgagcacatatgatcgttagatctatactacacccggcggattcaaatccccaaagaggagtagggtattaactctcattaagagggtctgaacctgtctaaatccttgtctccgcatccattcacttttaggtctcgtgcgctacccccttttattattgccgaattcatgtttcgacatgtggctagttggggatgaggcgacgtggagaggtccggcgatgaggctctcgatctggcagtgagcggcgtcgacgacagcagtgctcgggtggatttttcctgcaactgattgagggtgtcgtcttagggaggtcctgggagtgtgatggcacgagggactgagctttagctcaccgaggcagcggatcgatggtgagggcggcggcagcgttgttctagccgacgcgaaggacgtcggagaggcgtcgttgcccctgcggcgttttgtctgaggacaagggtaaaatgggtttagtgagggatgctaagaaagatgacatgaacggtttctcgtgaggctcaccagagggaaatcaatggccacatgggctttccggcactgacatgggcgctcgcgttccagccatcccaagggacttacttccctgggtttgcttggaacgtgaataggcgagctaggagagagtgttggagtaaggggaggcttcaaggtggactttggacgcggtgctcgtgagctcggtctatggccttgtctctggctctccgttctcgagcagcgcggcgatggaacaggacagctgggtgtgtctggagctttgcttcctatccagaaagagtaatggaggaggagatttggttggggcgcggagatttggccggaacaacttcgtctactctcaatggagccgtaatcatgtgacgattggggagaatggcgcgaggtggacgatgggtatggagacacggtgtctaggcccacctgcagcaacttactacaacaaatctgggctactatgacgattacctgatgacagaacacatatctgtcataaacagaggctgtttatgacgactgttcacaggatgacaactgtttatgaccaaaccatgtatctgtcataatcagcgtcacagtatactctgcatgggctctatgacgatagcacgatgacaatagtggatcgtcataaaatatagaactattatatttttagaaacaaacaaaatattgttatactacattgctaccagaccacaaattgtttgtcctaggtggactcttcttgtctacagcaattctagtctcttattttaggatttaggattgaagtcatctctactctcattttatgaatgaaaaaaaaatcaaaattatggcgtttcattttatgattgattgaaaaaacttaaacaacagactaaaatggctataaattggtctaaataattctttgaaatttttcatgaattttcggagtacaataactaattttaataccacaaagttcatttaacttattaaaataaatagaaaacaaattaaaattcctctctatgtctttgggccttttttggcccaagtatttactctctccctccctcagcccgcagcctccctctcccttctcctcccttttcgggccgccggcccagcccttttcctcctcctttaccgacaagtctattttacctccctcctctcaattcaaataacttttcgcgtagtaaatgatttcaaatgaaaaacttgtcaacaacaaagttgtataacttatcaatatctacaacttttgttttggtcatttttctatataactttttttcaataatttgaattcgaattccaaattatgacaacttcaaatactattttcaaatagtaaataatttcaaatgaaaaagtcattaacaacaaagttgtataagtattaaatatctataacttttactttttcattttgctatgtgactttgtttcaataatttgaatttgaatttcaaattataacaacttcaaacaacgttttcaaatactgaatgatttcaactgaaaaagtcatcaacaacaaaattgtataactcatcaatatctataacttttattttggtcatttttttatccaacaaagtgatagtaacattgttcacagaaattagatatctctcttacagtttataaaaccatataagagatatgtaaattttatgaacaatgttactatcactttgtcggatgaagaaatgaccaaaataaaagttatatatattgatgagttatacaactttgttgttgatgactttttcagttgaagtcgttcaataataaaaagttctatttgaagttatcaaactttgaatttcaaatttcaaaatgtacaaataaagtcagatggagaaatgaccaaaataaaaaaaattgcatctcaatgatctgtacaactttggttttggtgacttttccattcgaaatcatttattaaccccaatttttgttcgaagttgtcaaattttgaaaattcaaaattcgaattgttcaaatgaacttatttgtaaaagggaccaatacaacagttgtagatctcgatgagttctacaatttttctgtttatgacttttgcatttgaaacataaaaatcaactaaaatcaaatttaaagttctcataagtttaaggtgaaatgtccattttgtccatgaaatttcgtaactaccctcacaccagggacagtttggtaattcgcataggattgcttcttatccatatactctgttctcaaaaccctagccaaactccatccatccactcacccgccgctaccatctactcactctcctcctccatccactgcgccgcctgcatctccgcccccagccacctnttcgcccttccccggctcactcccccacccagggaaggacagtggcgcgcggatcc

SEQ ID NO: 80126 - DNA, 2468 bp, Oryza sativa
taattcgcataggattgcttcttatccatatactctgttctcaaaaccctagccaaactccatccatccactcacccgccgctaccatctactcactctcctcctccatccactgcgccgcctgctctccgcccccagccacctcttcgcccttccccgcctcactcccccacccagggaaggacagtggcgcgcggatccgccgcctcccctcctcgggagcgacggcggcgcatgaatccagcggcctccgtcctcgggagcggcctggcgtgagcgggagcgccggcagcacgcggatccgcccgcctccgccctccggagcagcggcggagggcttaggaaggcgggagcgagcggctacggtggcggcggctgcggcaacgatggcgatggtggctgcaacaatgacgacgacggcgacagctgcgacggtagctgcgacgacgacgagcgtcggcgcctcggcacaggagctgtacgccgtcacggcggccagcgagtcggcgactaggagcactggaccagcaatggttgcgccggaatgccaaccaaaggtccagctccaagcgtcgttcactcatctgtctatgtgcacggctgacggctggtatattcagtgagtatttctaggatctctctctggtttggtttttctcttagcagagagtgagattaattaaaaagttgaaacctagaatgagtaaactcagttcagttcaaggcatatttttgtgatttgtatgcagagaattgagatcctgtgtctttacttcctgggtcaattagcaatgagtaaaaatgaagcgctgcaattaggaatgattaattatattattgtgaacaagttttttatttgactcaactatactatgacatgtgggcacacccatgacaaaaatctgacccttgttttctgctaaattcaaatgcgctgttaagtttaagtacactgggtttgtttgcttagcttgttcttctgatcgtatagtcactagaacaggtgctttactggtacaggtggacctaattacttttatcataattcatgagtgaattggaggcattgcacaactcaaattgacttgaggatcataactcaaattgacttgaggttcatagcttggacaagtgagcaatccatccaaggaaattaactaactgaaccaaagggtggaatttgatggcaccgcttcttttgggctttctgttttgcaatgggcttcctgataagttctttcaagaaaaatgcatggttaactaattatagttatgaagatgtttgtgcctgcccaaccgatcagagctgttgtttactcctttgatctctactatgtaccaaacttacctcatgcattcttcttgaaaaacaaacaccttttttttgttaatgttaggtgtggtagcattaatctgagctcagtttaatccaagtatatagatcatgatatctccaaggaagaaattttttctagaagaagtaggaagggaagctactgctgcatctccacctcagtctgtcgttcataaagtataaaatgtcactggtaaaagggaagcatcacctcctgagaagaaaggccatggctagcatctctctgactccttttgtaatccaatataatgtctgtcacagaaatatccctttaagaatgtaaataagatgtgagatttttactaaattggctataaacttgctcaaagagtacatgttctttaaaatcatgttccttagaaccctactcaactgacagatttgcctagcaaaaccggttactagtcagaagcttctgtaactctaatgcaatgttgtgatcctttcttctgatcctttcttcatctgtgttgcagaatgtgactacaggaatgagggcctcgggactgcaagatcaggtggcgctggtgagcatcggcgggtggacccctaaccagggcgtgctgcagccggccatcatcgtcaacccttccttctcgcgccacagacggggcctttgccctgggcggccatattgggcggcgtcaatgcaattgagcaaccgcactttaagtacagaactgaagccaatggaattgagcactactgaacaaggcaagtaacttggattcttgttcttttgtccttatatgtgctatgcttcattcatatcaagtgaaggatctttttattgacacatgtaaatgttttatgttaggcaccctcactggcagtagacaagtgcagctaagggggaagagcatgggcactgcaattgacagtgagcccactgcaattgatctctttaaggagttgcattgcagcaaaactaaaggttttagtgaacctgtgaagaaagctatagtaagtattaaactattacttcttctttccttcttttattaagtaccttatgcaatgaacctttatttatataataatgcaaaactgaaaccttgctttgattgctaggaggatatgcatgcacaggaaa

SEQ ID NO: 80127 - DNA, 13812 bp, Oryza sativa
tatattgtgaataaagaaatttccaaagtattgggcatacgccatgcgcacactgctttaacagatgtgcttaagtccctagaagacacatggtttcaccacacctggaaatatatggcatatgtggtgtaaaatccgaataaataaactcataaaggatttaccaaccgcctagaaaatgaccacaatatataatcagcctaagccataatattggtcaataaaaatgcacacttacgtggcaaaaagcaatgatattgtatccaatcaattgcttaaaaacccaaacagcaccttgacttatatataaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtgacatgctcccgagtaacaaatcttctgggtaatatagaccaagtgtagctcatatgaatagcttctgatctgaatgactatcccttatgggatactccaaaataaatataataattgaatcccgactggcgcaagtattcagttgatagcctttacggggaataataattggtccagtctttgagcatagaagatagactcatgactatgaatccatgtggaatgtatccggaacaagtcccaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaaaaacagtgacaccaatcaaaggtaatgaagttgcataaccatggaggcgaagaaacagtcggtgatgacaaaagcaaaccgacgatgaagacgtagacgcgcatcaacagtgatggcgaaatccaccaatcatgaagatgaagaaaatagttgacgacgacaaacgcaaccgacatgatgaagatgacgatgtcggtgatccagccaatagcagtgtagcaaccaatgataatgacaaagacgctcatcagcatttgcatagtaggtcaaccgtcaaggtgaaataataagtcggcgaaaacataatcatccattagcaacagcagagatgtcagggtcgatgaagcagaggtgctggtgatgatgtcagtgacaataatccatcaaattggtgttatagctgttgcagatgcttcacttggaggaaagtagatgatgttgtccaactcgtcgaaactgagctgattggttgataactctgctctaaagcaaagacgaagataatgactcctggaattgactcgttggctgattaattgattgcttcatcttgtcgaattttgagagtcttgtatttgtgtagcccccgactctttggttagttgggaaacaactgaacatagagtcgagaattatagcttcttgtcgtcgagtaatcattgcttgattgaagatatgtgttgaagatgtccaagtagaaatccggtagtgaagacgcgcagttgtgaagataaaagcaccagtcggcggcggcataatcagtcggcgacggaagatgatgatgtccatcagtagtggtagctgtataaaccagatgtagaggcgagggcactagtcagcagcagacgagacgaccggcgatgaagatggtaaggccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgcaggcggtgacaccagtcagcggcggatgcggcggccggtcggtgaagacgtagacgcccaacaacggcagcataataggccagccgtgcaggcggaaacaccagtcggcggcggtcgaagcggccggtcggtgaagacgtagacgcccaacaacggcagcataataggccagccgtgcaggcggaaacaccagtcggcggcggtcgaagcagccggtcggtgaagacgtagacgcccaacaacggcggcataataagtcagccgtgcaggcggaagcaccagtcggcggcggacgaggcggccggtcggcgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatatcggatgagtagtatctgatataaatataatactcgagaaaaaatcaagtattttaaaatatttataaatatgtatttctcctcttatcaattgtgatttccccgagcagatgactctgtacatttaaacactctgtccgactagtcatagcccacaagcatcgggagtcggcctaggcatttcccaaacatgcatatgagtgatatgagttcgtcattaatggaacaaagtttcacggatcagaatttactactcgggtacttttgcaattattaagagcagaaaataaatttatctcgtctctatgcttttgatttattccgaataatacttagcaccttgcgttactcggtccatcgaacgagcccccgggtgctaggaatcggcccaaaggcaaccatccaatggcaaaccaaacggaaagcataggaagatagaactccataactcgataggtacttttgtactcagattatgtcgcaagcaatcaagataaatattataaaaaatatgatataacatctatagccctcgactcactactcaatggaagaccaattggtgtagtgaggcagaggaaaaggaaaaatatcatataaaaaataaaataaatgatgacttagctttgtaatattccccttggtgatggcagaagtgaccaatgtgggaacaaagtcgtccatcaataacaatgaagacaccagtcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaagccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgcaggcggaaacaccagtcggcggcggacgagacggccggtcggtgaagatgtagacgcccaacaacggtggtgtgaccaaccaaccatataggcgaagacaccagtcggcggcgacggaggcaggccggcggtgaagtcgtagacgcccaacaacggtggtgtgaccaaccaaccatataggcaaagacaccagtcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataacaggccagccgtgtaggcggaggcaccaatcggcggcgacggaggcaggccggcggcgtgaagtcgtagacgcccaacagcggcggcataataggccagccgtgtaggcggaggcaccactcggcggcgacggaggcaggccggcggtgaagtcgtagacgcccaacagcggcggcataatagaccagccgtgtaggcggaggcaccaatcggcggcgacggaggcaagccagtggtgaagacgatgtcgctatcggcaacggcggcggcacacaccaaccgtggcagcgaggccgcaagcagtgaatgattgtttgatctcgactgccatccaatgcatgcgaacaaccatcgctccagcatacatgtagattaaatcgacgtatacacgtgcttgctcctggtggccgagtatattcctgtgtcctgtgccaatctagcagcacgtccatctgcatggaagggaagagaggagcactcggacacggcaagaggcacccgagtggccgagtaggcgacgatggcggccgtgtcgtgatctcaaccagcatgtgaaaaacaacaaaaattgccaggaaatcaaaacggccggcgattagggattaattaataatcaatctaataaaaattaaattggaacagccaacccaagttgtacggcgtggcttggatacgtcgtgcgcgtcgatcagcttgggtcgcaatgcctcgatcagcagtagccggcggaagccatcaacggccctgcgacctcggagagtcggcagcatgtagatgaccgaccggggcagctgtaaagcctaatgataacagctcggaggcgaccgactacggagacggtggagccggtcggcgctgacggatatagccggcagtagatacggccggcggtgtacatgcaagacagatagcaacaaaataattgctggttagaatcaactagtaaacagattaactctgtagatgtaatgtgcatgttggttggatcgtgcatgtatgttgatcagttgaatcaactcatgcagtgttttctcctggtaaactgtgcccagcgatggccaccacatgtccgccggcaaagcacgaagaaagtctcgatgcgtgagggcgtcgtcgacagcttcggcttgatctccgccgaccgacacaagatcgacacaggaaaatataccagaagattgatctatgatagaaaaaaaattaatctaataaaaaatagattggaacgacaaacccggtccaaagttcgagccatcgaattcggtgagattgatctcgccgtttcttctgaagtggattccatctcacttttcgacgggtaattcgacgcatcccctacctggcgcgccaactgtcgaaacatgaattcggcaataataaaagggggtagcggacgagacctaaagtggatggatgcagagacaaaggatttagacaggttcaggccctctcaatgagaggtaataccctactcctgtttggggatttgaatccgccgagtgtgtattgatctgacgatcaggttgtctcatgccccctagagggcctcctgcccaccttatataggatggggggcaggattacaagatagaaaccttaaccaatacggtatcggtttcctaaatctattttacaatattatcgaatcaggactttaggccgctccataatataaaaggaaacgtaatacccaagtcatgatcggttacatattccatagatatatgttatcccctattactagtcggataaccatgccgtgtgggtatggggtacccataatctccacagatatatttactagtaactttctgacaacaaagtccatggaaatgaacgtctatatatacttccatagattcaccgttcaattgagctcagtttggaagcacaaccttttgggactaatattgggcctttttcactaacaacagagaagcaaatcaggcccatatctgggcttgcaccgatcgtgggtgtgacggatcagagcgacccagtgatgggcctttttagtacccagggcccagtgttcgtctcaagaagagagctgaggcccatatttgagtttgagcttttagtaccacctcggagacgcagagctgaggcgcgcaaggcgctctgtatataagcaggcagggttgcacggagcaactcatacctttctcggccttttggctaagatcaagtgtagtatctgttcttatcagtttaatatctgatatatgggctatgtgcccacttcgatattaaatttattttttgtgggggagggtccactacagtggcttgccgctggggccctcacgcgtcgcccaggtgttgcactgctgcccgggcctggcgcaccccaaccaaaccaacgattaatttttaagtatgcagttgcgctgatagctagacggagtatcgatgcctgatgtgttcgtttgtgtgagatagggtgagaaaatacctcgttttccgcgcgcacgttttccaaactactatgcgtttttttaaaaattttctataggaaagttgctttaaaaaatcatattaatccatttttaaaatttaaaatagtttatactcaattaatcatgcgctaatggctcatctcgttttacatatcttctcaatcctctatatctcaaactcacccttagtgttcttgtatatagatgatatccaatttgatgttgatgtgtttaaagtttgatttcttcttggctaggctctgaattatgatcctctgcgccttttacattcacatcttcctgcaggaagagttgtcactgatgttcggtgtcgctaatttgctactacctccgtctcaaaataagtgcagccgtggatatccgtactcaacgtttgaccgttcgtcttatttgaaaaatttatgaaaaaaattaaaaatatataatcacacataaagcattatttatgttttatcatctaatagtaataaaaatactaatcataaaaaattttcaaataagacgaacggtcaaatgttgaacatgaatagtgcaaaactgcactaattttgggacggagggagtatgaaattggtgatccatgaatgttcggtgtcgctaatttgctatgaaattggtggtccatgaacacaaactctgcaagagttcggatagctctcgtcgtaaattcgctattatgaaattggtcacggacctgttgatctgtgaacaaaaactctgcaagagtgtcagaattcggatactatccaactctcatgattgatcagaatgtcagcgctcgctctacggttcagataccatcgatgacatcgtcagagttcagatacctgtccaaactatgaaaagtgtcgtcagactttagtgctctggagttcagataactctccaatttctgccgaaacactgtaaactcgacgtgatctgcacacacatttaacacttcaactccatgcgatctgcagggagagacatttaggttcggtactgcactgtatactaggaaattgcctcgcaaaataggaataaatacagtgccattcaaatttacatcctgaaacccagaatataaatggaatccatatttgcatttacaattccctccatgggaccttattgttcattacagaagggttttacatgtgtaacaacaaaatacaaatgcctactacacttactcaaataaacaatttcatactgaattctcagagcccttgtattttcttgttttttttttctccctgttgctctctgtttcccatcacaacagacaaatccgagtatttgtatctcgattataggtaagcacgttttggaacgggataaatcagaggcaggtgactcttctgctgcatgcataagaccgcctcatgcaaactcttcctcagtggagtgaattccaaccccaaatccttgagcctctggttcgagaacttgtacggcttcgccatcggcttcccgtcatcttcacacctgaaaaatccaagaaacacacgcatgaaaaatttgagatcgatcgattacatctcagaagactatttcagcaacgcacacaagcaaatcaatgtctaatagttgcgtactttgcagtggcagggtactgggggaagaggtccctgagcatccggaggagctcggcgcggtggagcacggtgccgatgcagaggtagcggccgcgtgcgtcggggcgctcgtagacgaggacgtgcgcgcgggcgacgtcgcggacgtcgacgtaggcggcgacggcgttggggtacgacttcttggtgcccatgaggtagcgggcgacgtggttgctgctgaagttgagcgtctgctgcagcatgggacccatcgtcatcgacggcaccaccaccgccagctccagccccctcttcgccgcctcctccgtcgccgtcatctctgccatcatcttggcgcagcagtacaggttctgcacgtacgacgagaaaattttgccgagatgatcaatttactgttcatgcaagcaacgcggttggagttggtagaaacgcagcagagtaatgtgcttacgtcggtttggcggcagaattcgtagtcgctccagcaggtctcgtcgaggacggcgtcggggctcctgctggggttcatgtgcacggcgccgtaggacgacgtgaacaccacgcgccgcacgcccatgtccgccgccgcgttgatcacgttcctcgtcccctccactgcaaccggaaccaggtcctgcagcacggagcagcgttagtaaaagttggaggaggttaaaggcgccattgtcgtctcttttgggctcaagaaccaggctagtgaacttacagggtcgttggacaccggggaggcgacatggaagacgccgtggcacccgctgaaggcggcgcggaggctggcggcgtcgaggacgtcggcacggcagagggagagcctctggtcggctccctccagctcaagcaggtgagcattcttgctgtcagctacagatacgcgcgtgcaagaaccgatcaataaatcaagcacaaaatgcagcaaattaatggtaacaccgtgaactactagttagtaacttaccaggatctctggctgttcccctgacgtggtagccacggatgaggagctccttcaccacccacgacccaatgaagccacctgctccggtcacacagaccagctgcttctcgccattgttgttgttggcctcaaaattggacgacatggtgagagacactgaccagttactgtcactagccaaatgctactctgaacttgtgagagaactttcactcgaactctgaatgttggttgtgtgagtctgccgtgtatggacatggccgctatttatacgcgagctgcgagcacctgcgccgccatgccacggagcacgaggaggacgacgacaagaggaagattgctagcgtagggtggtcatcgggtgaggggtgggggaggcgcaactgcgaccacgcgaaacggaatgccgtcgccttgtcgtccatttttgaggattcagcggcgcgcgcgcaaaaactgggcagcacaaggccgaattgccgatgggttgggcgtgcgcgtgggctcatctcacgggcgcgtacgagcagtagagtatattccattgcctttctggacgagaggatcacgaagccaactctggcacgtaaaccgtgcgaggttttcgctgaacctggcgaatcttctactgtactaggatgcaacttgtactaaacaattgcatctgctgctggaacgaccgacgattcgagtcagactggtacgatcgactaatgtctttttgaaaccttgacggaaatagtactatagtagtacgttcgagtgaatttgacgattttttacgctaagtcttatttagttcctaatttttttctttaaactttcaactttttcatcacatcaaaacttacctacacacaaactttcaacttttccatcacatcgtttcaattttaactaaacttttaattttagcgtgagctacacatgctaattatgattgtcttagagatacgagagaaaaccaatgaacaatggcaaattcggtatattgtggttacaagttccgcgattacaatttccaaaggtaagtaaaataccgacgtagtgcaaaatacgatactactaactgaaataggagaaaactggcacaaatcaacaacagtttatgacataattaatggaacgtgaaaatagcatataagaccgtaaaacaaacatatttatattaagatgctttgtttacttagaacacttagggcctgtttggcacagctccagctccaactccacccctcctggagctggagctcagccaaacagttttagctccaccaaaactaggagtggagttgggtggagctctctcacaaaatgtaatagagttgtggagctgggtttaggcagctccacaactccactccagagttggagctgtgacaaacaggcccttaagctgaatccgccgtgctcaagtatcaaaactggagtacttaagtggactaaaccaaccgaagaattcagtcggccgttgaaactaagatccggcgcgtgttggctgcacgactcgcggcttttgaaaccgaacggcacggcacggtcggagttaacagaacccacctggtatctgtttacgggaagccccatgtttgagactccaagggaggaggtgagcttggcaacgccaacctttttgacggctcgtgtcggctgctgcctgcttgcgtcacccggtgggcgagcgccagccgatcgggagcaactctaagagcaagtttaacagtatagcccactacaagctccaatttatctatagtcaatttaatagccaattcatataatagttgcttactatactattaatatatggtcccatctgtcatacacacaccgtctcttggagtctatgctgcagctacctacagatttgtagcccgctgcttttctctttcatcttttatatcattaaaatatgtttatagctagctaatagtctgctattgtacctgctctaatcccaacttcacccccaataccggctgaaccgacgggggcttatattcattctcttttcttttttttttaacttttaactcagatttacaaatttttaagttaagatttgaaaatttttaagttaaaaaatttaaaactttcaactcatatttaaaaactttcaagtgaaatcattaatatttaactcaaagacttaaaatttttaactaagatttaaaagctttcaactcagatttgaaaaaaaatccaagtgaaaatttgaaaacagtcaactcaggtttacaaactttcatctcaaaattcaaaacatttaactcaaatttaaaactttcaaccgaaattaaagatgaaagattcatttctttttttaaaaaaaaggtgaaagaaaaagtcccacgagggcgcagacccacgggtcacacaggtgtgtgcgccagcaagcgagttggcgtgtctccgccagttagtttttgtgttgtaccggtgcttgtattcacgctactcggttaagttatgcacttacgcgtacataagaaggaagtcgctgacacgtggttctcatttgttaacgagacaaccatggttaactggccacgtcaacaaaaaaatcattttcaaaaacaccgaagtagtttatttgtatcagtttttaaagatggaggagacgtgctatatcccgttctgtagccaagggagatattcattcaggatcaagaggacgagggagatcaaatagacttattcaaagagtgtggagtacataatacgtggggatttcattccagcccaattcgttgcaaacgtcctttgtacctatccggcccaactcaccaccgtcggctacggagacgacccggttctcctccgatgctactgctgccggagccggactcccaaaaccctcgccccatctccgcttggctttgagaccgctcatcgcggctgcagcagcgtcggcaggatccaccgccttgccgtcttcgatctacccggacgctcggcctccggcgacgactttaggcatgtccagcgccgtcacgggcctcgtccattaccatggtacgtcgtcgattcctcgtccactttgaccttctcactccctcccctttgccgctcgtccggctcaactaggccgcggtggcttccaatgttaggtagttgggaggaactgtgttgcagcctggcttgatgcagactaactgcttgctgtcttccgcatttcttgttgtttggagcataagtctcaaattattttcggtgatgatgtgatgaacaatccacaaacgtacatgccacctcttttggagcataagtaagcaagttatgggcttctaaactaatcatagtggtgttgaacttttgatggtcttccagccaattgatggatgttgagcaatcgtcgacaatggaattttgtgcttctataggtgtttgttttttttttttaaagaaacgcttccataggtgttgaggatgaagttttcacataaaaaaacaaactcaccgtagttaggcctgaccaactctaaaatttctcgggtctgctactattccagcccatgccattcaattgaaggcctaacactgaattttatccctgtttagcaccatcgtttaaatttgagaaccaattgattgctaattaaatggatcagagtttcataaactactctactcgaatatgtacacaataaatgtcatgcctacttcacctgcagtacaattgtactgcattttttcggagttactacctccgtttcacaatgtaagtcattctagcatttcccatatttatatgtaagtcattctagcatttcccatatttatattgatgttaatgaatatatatatatatatatatatatatatatgaatatgggaaatactagaatgacttacattgtaaaacggaggaagtagtcatcttgtcttattattgtaatctgtgatgccaatgccctcaatgcaaatttttagaagatgatatcgcatttataaaatctgaggcctctcagcttaatgttttattctaaaccaaagctggcgtgtgcaaaatggaacttgccgctaacttaagccttttatatccctagattcatgcagaggtgctagtgggaggagatagatattttacctgcttaatttacctgaagaactcaaggccaagatcaagacactgaaggatgctgacaaaaggtgttggttgaaagatttattggtttatcactatggccttgttaacagtgaaatttggtaagtccggagtagtcatcggtttagagtcagcatcggcttcgaagtcctgagattagccgatgagagttgtcaagtcatcagttgtcggattcttgctatattcggttaaggaaattgatctactaaataaaacttatccagaagagaccgagtttaaagagaatgcggcatgacaagttatctattaattaggaatagtttgttagtttccttttatctttaggaaattgtgtttagtgtctgacggagcgtggggctccttaccgggagaccgcgctggcccccctttgccggttcggccggggaccctgggtgagattctaagctctcaatctgtatgtggaaggttcgcgagacaggaagcacag

SEQ ID NO: 80128 - DNA, 22022 bp, Oryza sativa
gcccggcaagggttttcctgcaaaaaaaccctccctccgtcaccgcccgttcctcccccgtttgccacgtcagcttgctgccccagaggtgggcggcaggggctatttctgtaatttttttggtcgatagattatttctgtaaatattaaaaaaaaatctaaaaccgaaaaaaattctggaattttcgtttctcttgtgggaagaaaaaaattggcaaatagcagtgcagttgactggtcagagcatgtaggagtcagcagtcagcaccctgcttttccgcatcattcgagtaaatcaattaaatagctttgtcgagtgcaggctgcttctttacaatacttatgtaagattagcctagagctaatgttaaaaggtaatatttagtcatgaattggtaggctaaacattagcctagaatcgtatgtttggatctatgggcaaggctaaaaggtggagagagagtaaaaagagaggagagagaaggagagagagagctgtttttttatggtccccacacaaaattagccccattaacatatttggagagactaatgttttgaggggggctaattcatattagcccaaaattagcctacctgtttagattcttgtgggctaatttgaggctaaaaggtgagggctaaacattagcccatgaaatcaaacctggccttaattactcggccatcagctcttgtataattaaccgcataaacgtacgtactccgtagcatatatacaggccggtcgtactacattagtttagagtagctttgtaacgaggagcaaagagaaaaccggcaacacagcaggaagtaagaaatcaacagaaatagccgagggacaattgatcagtgatcaagggcgaatccagcctccaaaaatcattactgttggttgcccttaaattttacaagacgacacttaggcgtcattttagattctactccctccatttcatattataacttgctagtattgcttacatatatatgtgtgtgttttaatgaatttagacatatatatttagcttcattaacatatatatgaacgtgggtaatgctaaaaagtcttattataatatgaaacggaggaagtagaataaaatcattgtttgccaggttatctttctgaacgctgtatatacgatggtatccactactaaatcactactcccttcatatcaaaatattccaacctaagataagatataatataatctagcacaacgagaatctagataaaccaatgttagattcattgtacttgtactagattattacattccatcccatgttgttttgttttgggatggaaggaatagaccactgcaaatccgtttccatttacgttcgcaaaaaaaaaaatacgtttccatttctgaacaaatgaatcccgcggggactgtcctccactgaagaaaaggattggcaaatgggcaaggcaattgactggaccaacagtgcaagtggaacacatgctcggattcgtgcttttctgacccacccagcattacaagtggaacagcttagctccttccttgtcgtacgacgcaacagtccggttcggaggacgtgtcgagtcgtcgaccgccgaagcgaccaacctagctcgtcaacgagcatatgcaaatgcatcttcctttacaattctccaactaaattaaagaacgaagtgcacgtgccatatactcatgtcatgtcaatacgatctatttatgcatgctgaaaccagcgtcatagtaacgagaagcaatgcagagttcagaaatgggggtgttttccagcttaggcgtcgtagtgttgctgttactgttagtcgtcgccctggcgccggtgagaccagcgtcgggtcagccattgccgggctgccccgacaggtgcggcaacatcagcgttccctaccccttcggcatcggcgcccgctgcgcccgcgacttcggctacgagctcttctgcaaccacagctacttccctccgcgcctcaccttcttccctccactccccacgcctacatcgatcttggccgggcgccggctgaatctggccagcctgtccatcgccgacggcgaggccgtagctctcgtcaacgtgttccgccagtgctacagcagcaacgagagctacgtcagcgacaactcccgtaactacacggtgtacctgtccctccttggcagcaacacctaccgcgtatccgccgcgaggaaccgcttcgtcgcgctcggctgccccaacctcggctacctcagcgacgacgcgggctactacatcaccggctgcacgtccgtctgccgaccgtcgcagtggaactccgtgtcgccggcggcgtgcaccggcgttgggtgctgccagagcaggataccacccaatgtcacctactacgaggcgtccgttcaaggcttccaggaagcccaggggagaatcttccgcgagaacacgacttcttgccggtacgcgttcgtggtggaggacaggtgggtcgacaccacctaccgggacagcgccgacttcaaccggaccgacgacttcgccgtccccgtcgtgctcgactgggccatccggaacgtcgccaactgcgacatcgccaagcgcaacaggacggactacgggtgcaggagcaccaacagcgattgcgtcgactccaccaatggtgtcggataccgctgcaagtgctccaatggctacgacggcaacccctaccttgacggtggatgcacaggtatacaatactagacaccttaatacaatgcagatattggttatcaagttaacattgaggattgttcatttgctcgccattcttatattctctgccctcaaataaataacaatcattctgacaagaagtgatgagtttgtttttcctcttccaagatattgacgagtgccaacacttagacaagtacccatgccacggagtctgcacaaatctgctgggaggctataagtgtgattgccctcatggattcagcggagatgccataaaaaatgattgccgtccaaacgacaagttcacattagcactgaaaatagtcacaggtaattttgagacactaaggaggtgtttggttcatggccacaccacacttttgactgccacagtgtgttaggtatatgtttgtttcactgccacagttgtgacttgccacattttttcaataccatgtcctacatgtcatagacttaattttttttgccaactttaacacattttgtggctagcaatttgtccaccacacttttgtggctgctacaacttacctaatgttagttgtggcaaagtgtggccagcaaccaaacacaccctaatgcacctttctctctattgattctccgatttctgatgagtgacattgcaatgccatcttcaggggtcagcgttggtgtgttcttgtcggtgttcatgtgcttttggttgtacttggggctccagaagaggaagctcatcagaacaaagcaaagattcttcgagcagaacggtggagtgatcctccagcagcagatgcactctggtggaggcactggtgggttcaaaatattttccacggaagagctcaagaaggccaccaacaacttcgccgctgaccgtgttctcggccgcggcggtcacggtgttgtctacaagggtgtcctggaggacaacatggtggtggccatcaagaagtccaagatgatggaggaggctcaaaccaaggaatttgctagagaaatgtttattctctcccagatcaatcacaggaatgtcgtcaagctgctcggttgctgcctcgaggtagaagtgcccatgttagtctatgaatttgtctcaaacggcaccctctaccactacatccatggcaaggaacccacaactgacatagcacttgataaccgtcttcggatagccgcaaagtccgccgaggcgctcgcctacatgcattcatcagcttctccaccaatcctccatggagatgtcaagacggctaacatcctacttgatgacaagctcaacgccaaagttgcagattttggagcatccaaactagcaccaactgatgaggctgcaattgccacgttggtgcagggaacttgtgggtacttggaccctgagtacctaatgacatgccagttaaccgataagagcgatgtctacagttttggtgttgtcgtgctggagcttctaaccaggaagaaggcattgtacctagacgggccagaggaagacatgagcttggtgtcacgcttcaccacagcagtgaaggctggtcgtcatcgagagcttatggacagccaagtgaggaaagagatgaacgacgaaatggcaacagagattgcagacctcctcatgcgatgcctaagcatgaacggtgaagaacgaccaacgatgaaagaggtagcagagaggttggagatgttgaggagataccagcagcacccttgggctgaagctaaaggtaatgctgaggagaatcaaagcttgcttggcattgaacatcaaaatccaaattaccaattcaggcagcatgatgttcttgatctggaagaaggaagtacatatacatttagcttgtagataatgttgtttgcgttaatcttttataaatcaatgaattcacatacaaattcttttctatgtaatatgaaaacacatccatggggtgcaaccaaagaacgaccaagaaatttatgtgttctgtaatataaaagcaagaaattgcatagacgatagagaagaatggtatgtcactatgagtattgaaaggttcatgtccgttcttctcttaaaagaaaaggtgaaaacaacatgatgtatagacaactcatgatcattaaatagaaacatttaaataagaagataaggacttgccacaaaatcaaagatatatatactgtaaagcgagttacattggattgtcatggggaaatttctccccaaataccgccgtgtatgggtcaggaccatcacactcctagagttggtcgtccaatgaagggaggcgatcgtccctgacaggatttttttttcttctacacagagtaggtcatctctgcatgcctgatttgacaagaaccataccaaattagtagagttattcgtaattttgcgacgcgctcaccagaccagatggagtcggcggcggagtaggaacagcctgcggatggcgtagcggacagctccctcccagctcccagaggatggaaggaacggaggacttctggtagacaccatgtatggcggctgtggcggagacaatgacagtctgcgcctccgacgacgccggcggaggcacgggaggaagggttccagccgccggccgctgacctgcttgagacagagagagagagagagagagagagagagagagtgggtggggaggatgatacgtgaagggctgaaggccctcgagacacattgagccttgttggaaggccattagagaggagaaggcctagtattgggcccttttgtttaggctctttgcgatgagcgaactgggccgaaactgtacgagatggaataagtctactgtctggtggactagacaagctacctactcccttttcacttggtgtaatacacatcccggatcaataaatataaatataaatatagtagggtcatttttcacattgaagatctaaatctgaatagggggatgctttacaacggaatcccgttcgagcgggatgataccggttaggtatcaggacatgatacctattagatatcatgcgatttctaccacgtatcaaatgatacttgcaaggtattagacgattcctatcaggtatcatgtgattatacttacgaggtatcatgtgatacttggtattgacttattctcgttgataccagatcgataccgactgatatcaggtgattctactgggtatcaggagccaggcaccaaggcatcatcgtcggtggccgtgtcctccgcgtttgagcaagtcctttaccgtcactccccacgctggagctcggcggcggcggcctcacgtcccatgccggagatcgacatcctccgccatccatgttccacgccggagctcatcgccggcggccgcgtcctccgctgcctcgccctacgccgggctcgtcgctagcgcgaccacgacatcctccgccatccatgttccacgccggagctcatccccggtgcagccacgacatcctccgctatccatgttccactgttaacagtgaaatttggtaatcggcaaagacgtcatcggctgagaatcattatcggctgcagcatctcggaatcagccgataggagttatcaagtcgccaatagtcggattcctgctatattcggttaaggaaataaatctactaaaggaagcttatccctaagtgacagagtttaaagaggatgcggcatggcagtttatctattaattaggaataatttgttagtttccttttatctttaggaaagtgtgtttattgtccgataaggacttgtatcaacccatgggtataaatatgtacacaccggggtctatgtaatatcttcacgatcaatacaattcggcgcatcgccaccctttttacttctacttttgtttttaagttccggtgggacttggcacccgacgcggggctgcatcgtcttcgatctccggcgaagggataagtccaatgttccgccggtccaggcaattgtatcgtctacgtcgacgttgttcaaggctgcatcagtacattcgacctcttggattgctctggtttggatgatatatttgcctacctatttatcatgtctctgttaatctagtcttagcatgtcaatttagctctatcggctgcttctcattttagggtttctgccggtatcagctaaatcgcgttgctagattagattagcttagacatctaccaccctgaaaactcagtcaacggcttgattgtctaggtattatgtttcttttcatacttagtgctgcatcagttaagtttgatctactaagtcgtgcttagaaccataatctctagcctgcttcttaattgctaataagggtttcatcggggtttcagccggtgagttatctggatgttgcatcggctcataatgattgcatatacatataaattggatttagccgatgacaacaaaggtttcactgtttaatctaatcttgtagatttcatgacatcggacctccagccgatgtgtgctttaaacctcggatcgatgcttatttatcatatcattgctagccgattggtttatactagattatattgcaatattatattatcatcagccgattgcctttatatcatcatctacattggacatatagccgatctatcaaaaccctatcgctatcggctggtattggcattagctattatcgatatcggctgagattgctccatcggcttgtcagccgatcgactgttttgatctactatttgcatatcttgtcagttgcaggatcaaactgactggcacgcccgcatctcatcaacctttggacctgcacaggagctaagcagatctcctaggctagtgtgttcgatttttttcgtcaacatccacgccagagctcatcgccggcggtcgcatcctccgccgtccatgccccacgccggagctcgtcaccggggccgcatcctccaccgtccacaccccacataaccgagtgttcgcatcggagcggtcataggcagtagcgatgagcaggcggcgaccgcgaccatgaagccatcatcatgtcgtcttgccacctactcgccgtgaacatactcattctcttgccatctcgccccgtcgggaggaggcgatatcgtcccacgcactcgggacggtatcccgtggtatagcatttctgaataggattagataaaatagttgtttctcacttttctacccccatactcatgtctaccaagagactcgaatattagggaaggacctaatatcaaataattagaagttgtgagactttgaacccaggttgtctagcccaccaccttgtggagctagccagaagaccctggcatttctcactcgtgtctaccttataagctgaatcttgtatactcaactatcgtagttaggtaaccagccgacagataccatttggcttcctctaccaccgtgaggttgagacgtcgtcatagcgttcaattgtttatccaccaacttacagtatacaacacatgccttcatccattacaatgcagacatgcagtagactcaaaaggaatctcgcggggactatccttttcagaaggaaaaaagaagggcaaattggcaataggcaaggcagttgactggaccaaaacagtgcaaagtggaacagatgctcggctcccaaattcttgtcagtgcaagtgacccacgcgacagtgcaagtggaacacatgcccatatgcccggctccatgctttaccgacgacgcaacagtgacgtcgaccccaaaaaccaatcaaacgacctcttcaacgatgaccgggagcctagcacgcatcttcctttccgatcctccaaggctccagctccaactaagcgcgctatatttattcggaaaccagcatgcgatgcaagcagagaaacgggcaaagagttagctaaggtaggatgtcagagataaggcacctgcagccgggtgtcgccatctcagccgtagtcttgctgttaggcatggccctggcgccggcgacaccagcgtcggctcagccattgcctggctgccctgacaagtgcggcaacatcagcatcccctaccccttcggcatcggcgccgtctgtgcccgcgggcccaaattccagctcgagtgcaaccacacctactcccctccgcgcctcatcgccgtcatcgattcccaatccaatttggagatccatctcgaaagcctgtccctcgccgatggtgaggcccggatatacaacaacgcgtcgcggagcttgtacaaccacagcacgggggacctcgtccgcacaaacgacgtcgtgtacttgttcttgggacgggaaggcccttaccgcttctcgtcggccaagaaccgtttcgtcgcactcggctgccccaacctcggccttctattagacgccacagaaaattacgtgaccggttgcatatccctgtgccggtcgtcgccgctcgccgtgtcagcaggggcgtgcgccggcgtgggatgctgccagagctcgataccctccggtctccacacctactacgtgaaccaggacaagcccaagaacgtcacccttcagtattatgccgccactgattaccgctacgtgttcttggcggacgccgagtggctcagtaccagctaccgcggtgacttcaaccggaccggcgacttcgccgtgcccgtcgtgctggattgggccatccgggaagtcggcagctgcgaagccgccatgcgcaacaaggcggactacgcgtgccggagcgccaacagcgactgcgtcgactccaccgagggagaaggctaccgctgcaactgctccaggggctacgaggggaacccctacctcgacggtggatgccaaggtacaaaattaaaaacgcctcccgtgaaataaactccattttaacagtgagttcaaaagctaattcccgtcgatttgggcgattcgcgaagacatcgacgagtgcgagcgagataaggacgcatgcttcggcaacaagtgcaccaacacgctaggagggtacttgtgcatgtgcccgccaggtgctcgtggtaacccgctcattgaaaaaggctgcgtcaaaactgatctaggtaactaaattaatcttcttatcattttggaatttatccagacatctaaattaattgaagatgctaaactaatctacctgagacttgagagtgtgctagctataatgtgcaacggaattttcgcccttatattttcacttatgcttatacttatgagtcaaaatttaaagttgcaaaatttgaattttcaactttaaattttgagttgattttaggatttttttatcgtagtttatttttcagtctttgcttctagatcgttaagagttaagaatatgtatataaaagttttattcataaattctttttcgtttgtaaataagccaaacgacggggttgttttgttggagagaacagtcgattgttcggccaagtaccagcacaaattactctgttccataaacaaacaaaagcagactacgatgtttttacaggctaatatttccataaggctgatttcttattaaccaactgttcggcaagtactggcactaacggttctcaattacaaacaaattcagtacgcctctctaatgaagaaaactttttttcccttctattgtgctccaggtttaactattggtattggagttggcagtggtgcggggcttttggccatggcattcggtgcagtctttttaacacgtaagatcaagaatcgtagagcaaacatgcttagacagatgttctttaagcagaaccgtgggcatttgttgcaacaattggtatctcaaaataccgacattgctgaaaggatgatcatccccttagcagaactggaaaaagccacaaacaaatttgatgaatctcgtgagattggaggaggagggcacggcaccgtttataaagggattctatcggatcttcatgttgttgcgatcaagaaatcaaaggtagcaatccaaagagagattgatgagttcataaacgaggtagccattctctcacagattaaccatcgcaatgtggtgaaactttttggatgttgcctagagacagaagtgtcattgttgatttatgaattcatatcgaatggtaccctttaccaccatcttcatgttgaagggccattatcattgtcatgggaagatagactcagaattgcaactgaaacagctagagccctcggctaccttcactcggctgtatcattccccataattcacagggacatcaagtcccataacatcttattagatggctccctaacagcaaaagtatcagactttggagcttcaaggtgtattcctgctgaacagacaggagtcacaactgttattcaaggaacactaggatacttagaccccatgtactcttacacgggacgtctcaccgagaagagcgacgtttttagctttggtgttgttctaatagagttacttactaggaaaaaaccatactcatacagatcacctgaggatgacggtcttgtttcgcatttcactacgctactcacacgtgacaacttgggtcacatacttgatcctcaagtcgtggaagagggaggaaaagaagttaaagaagtagctttgttagctgtggcatgtgtcaagctgaaagcagaggagcggcccactatgagacaggtggaaatgacacttgaaagcataagatcattgtttctgcagcaagaagctatacatagcatggccaataaaagttctaaggagaatcatgtctcaatgagttacccggcaaatgaaggcacaagtatggagtcgacaaaacagtatagccttgaagaagagtacttgctctcttcaaggtatcccaggtagtggaaatttttttaaaatataaagcgttgtcacaatgtacaaggtatgaaaggcacgcggtccaaagctatatgcacaaccgtgttttgttgatgttcatctgaatgtgtatttttgtcatctttcttccaggcgcatgaaattaacctttgtattatgttgataatttatgcaatcacattaccttcaggagggtggctatgattctcataagtactttattttttccctaatatataggtcacacatacaactagtcatatgctggattatttttttctcagataagtaaagattaacctacttgtttgaactattcaagaggacgaattctttaaaattcttgttcttgtgacatggaaacacatatatggtgctcacccaaagaaccaagaaatgtatgtgggctgtaataaaacaaaagaaaagcctaaagctgcatagaccatatagaccaatgatatgtaactgtgagtattaaatggttcttgcccattcttctgttaaaagggtaggtgaaaacaacatgttataaagacaacgaatgatcattaataacatttaaataagaacatagggatttgcaaatcatctctatataatactagatttaccaattagattaatagacttaactagaatttcaagttatctaggattacatgggattatgggaacatctcttatgcactatgtcacggcctattcaaaataaaacttactatgaatattctgaaatatttcttgatgtactccctccgtcccattttaagcgcaaccatgagtttccgtgttcaactttgattgtccgtattatttgaattttttataattagtatttttattgttattagatgataaatcatgaataatactttatgtgacttatgtttttttaaaaaaaaattaaataaaacggatgattaaagttgaacacagaaacttatgtctatgtttaaaatgagatggaaggggtagcttttagagttttaattgcagagatgtggcaggtacctcgatgattaattaaagagtaaatttctcaaaattgcaactatctagtcaaaactcactttgctactactttagctaaaattttcacaaaactgcagcgataggaaattattttatcggtaaactgcaacttttatcccctagctacgtgtttgacatgtgtgctcaacttgcaacagtgtaagtattacacatactagacattttgcgcgcgttgcgtgccctatcagaagtccaacaaaggggtaccattaagcatgttgtgggcgaataaaattaaagatccacactctcactgaacaacaaagcatcagaattaaccataagacataatcattactctcatagtgagggcatgacaaaatagtactacctccgtttcacaatgtgagactttctagcattatccacattcatatagatattaatgaatgtagacacaacattcatatataagttaatgaatctagacatatatatatgtgtctacattcattaatatctatataaatatgaacagtgctaaaaagacttacaatataaaacggagggagtagctgtttaaatgacagcatgtttaaatacagggagcattggttaccaacgtttttcttaaccaatgccattacagagtaaatggttcacttctagcactacatagctagtgcacaccataatttattttatagaaacattggatgaaggtagacaactgcatttagatcacaataatctttgataccttggttgacactaaaacttttcatcatatcatacataaaaaatcaacagatctctcaagatcacaaacacatattagatggcattctactataaatctttttttgtggagatactttaaatcgtcactgggagaaaaaaacatagatttctatgataaatagagtgaacattgtgttgaagttatgcaaacaaaattaccagaataacatctaagcacagaaacatgttcttttcaattcttgcaagacaacttctgtaatcagcaatttacacagtagtatcgcaaatacagagaacattatattgcagctatacacagaaataaccagcaaagcttctaagcatagataaacaggcattttcaatgttgtaagaaaaatttcgtgatcagaaagctaatagatgcataaagacgaattccgtgatcagaaagagccatataggctcatgctttgtattatctcaattcagaaagacaaccaggattatagatgcaggacccaaaagaaatgccatgtaagaattaaacgatctgaacacctctagccaatagtgaacccatagcccgctgtttaaatcatttaagatttaacagcaaatccagctccttaagcaccataatctaatcaaactaaaaaaaaaaggaaaataaaatgaacaaagaatggcatttctgcctgttgctccatgctatcgccaatgtataatctccttgccacctaaatgttgcatccaaacgtgcaataaatgagaggttacctacaagaatattgaattagtgattattctttcaatttggatgtggagtattagttaattatcaatgatttaatatggggctgtatggctttatttacttatcattaagctagagctggaagatcatagctaaaactaataatggcatagtagcatctagaaaataaaagtaccctgttattttcagaggaacattgcttctgctctattacaactgactgtccttttgaccatgagctaaaggaatgcagtaaaaaacctcttcattatggcagaccatgcctgctgtggttataggaattaaatttatctggttgtagattctcgaactcttcatctacagaacacacaaagggcaattttctaaaaccagattgggcgtcacacattatagaattatttgcacagtattggccacctaatgctggtgttttccttgaaaactcaatcaggaatctcatggaccatactgatttatgaatcacagggacaagcgacgactgattgcaattcgagaagttctttagctattgaggtagatagtcacataaatattctagccaaaaaagcagttgtcagcaatcattatatatgaaatgcatacatctatagaactaactacaaatgaatattttcaatgatgcatttcattagcaattttaactcttcccttgtattatgaatatcgatctaactgctaatattaaggtagtttcaaatgtttagagaaattaagtggaaagtaggatccaaatctagatcctaacaaatcattcgggcttacattacaggtcatgcaggcgtaactgatagctttaagatcgccacatcaccatgcttgtaggaaaaacaacgaacaccttgtaggcagggcatcacacaaaacaaacacctcaaatcttggtggggaatagaaatgaaaatcaaatacaagtggacgatggcgtgatgcgatgagggcaagcttgatgcatccagagaacggctagacgatggagacaactcctcctccctctgatgaccagaaaaaaacaggagcttgccactgctcatggagcccccacatcactcgaaaatcaagtcatgcgccgccagaccgactcctcgccttcgagaactccgtgccgacgccatcttctcgcaagctcgaggcgtccgcctcctgggcccatcggcctacaccaccacgctggggacgccgccagcaacctacttcaggtcgacgccgccgtgcgctcctcctcccttcgccagatccgatcgctgcacggcagctaccaccagatcggaaggcagcgtggagcttgtattgagtagacaggtaaatcgacgacgaggtagtgagaaggacgaagacctaacccgattgaatgttggatcgaccgactcgttgtcgacgtactgagcctctcaccattgagctcgagctcgagctcagcggcaccggcagcaaggagagagagagagaaaggcagtggaggacatgcggcgacgcacggcggtgtcggggccaggacaggcgtcggaggatggagcggcgctgcagggcatcggtggggcggggagaggcggcgcgaggagggtgaggctgcgcagcgacacgggggctagggtttcagggaggatggggagacagagttttatgttgtttcagaaaagccccttgatttgtgtttttcagagcgcagtcctattttcttttttcctcttctccgtataggattttcctggttatggaggatctatatgtaagaaaacagaacatatgatcgcaccatgcgagatctaaaacaaattatatattaattatggatttttttgcaaaatgtccaccgtgctaggaactacgaccgatctcggccgttgctgtgagggatcggacggcgccggagccgctcgcgcggacgctcgagggggtgtggaatccgcccgcctcccagcactcgcgagcgacgtggatagctccgcgtgcgaacacgccgcccctaatcgctctccgctcgccaatccagggcaggttttaatttaaccgatactagcgtgggacgcgagcttcgtgcgctgcaccggtggaggtagaatagggtgttagtgattacttgctgatagcattagcaaaaagaaaaaaaatgttgtttatctgatataagtggcatgattatgtttttggttgcaagaaataaaatggcgtcgggaaccgatgaaagcttaaggcaagaattgttatggaaggcacgtagtatgtagcgcttaatataggtatgactaagataaattcagaggtacattacaggtagagaaagggcagcataaatagaaggtattgtcatcaactcatcatccatctgataattatacataaataaatgtaaatgctactcccttcattttttaaatgtcatcaactcatcattctcgtatgtttgactattcgtcttattcaaaaaatttatgcaaatgtataagatataaatcacacttaaagtactatgagtgataaaacaactcataacaaaataaattataattacgtaaattttttgaataagacgaatggtcaaacatgtaaaaaaaagtcaacggtgtcatctattaaaaaacggaggtagtatatagagagggagaaagtagtgtataaaatagtccatctgataattgtacataaatatatgtacatctacaaataggagtgtaaaaagttaagaactactacaatgatattcctgtaattaaggtttgtaacaaacctcattaagtaacaaacattactattctgacagcaaatgacatggatccttttgatcttgtccaaaattgtttttacttgcatcgcattacactttcaaaagtgcacttgactctttgacatgtaaatctctatcctagactgaaaagcaaacaaggaagagttacacacaataatgtaaatatgaccagagcaacttcagtgtgtacttcttctcgagcgacctacagaacaagtgaaacactgatgacagcaacacaaaaatgaatcacatagctaaggtcagcggattagggacctgagtgcaggcacaccatcaacgcgacacgcgcactgttgcggagccctgaagccatttgtattcccctttaatctctctttattttcgtgaacattgcagctagatttctgctctaaaaaacaaaaaatactcatttttgtaaataaaacagagaggatacaatataaatttctaaactactctaaaatttagatgcaaagaaactcaattttgagatgccacattacttgcaaaaaaaaaaaacttgagatgtaaacctgagtgaatgatgtgcataccgggggcaggcaccacggtcacggtactgcagactgcgcagcaaatcgacgttgctccggctggatacatgagcagattacggcacccagagcaaacgagctggctttgggcccctgaaattcagagactgactgaatgtcgcatttcagcagctaacattttcattttcagacaacaaaagcatcttccatgcatcattttcatttcagacaacgaaactcagcagtaaaaaaacttccattttctcaacaaggagttctctctaaactttcaggatttctatgagcagaataaactgcaacctctgaaccaggaacagtaacatctgattcaagaaaaagctgtctattgaaattcagttcataagatttctagtccaaaagaatgcatcagggcgaacactatggcatgtaccaacatttctaggtgaccaaccaacatcagggaaaaaaaactcaaaatgtagctgtgttcttgcagtgccaagttggaatccataccattgggaggtgtaaatggcacaggagttggatatggggcaaggggaaccggcattgctgtgccagctgcctgaaccgatggcatcgcttgtagatgcttcacagattccagcaacagtcaggcaactgaaatcacctttcctttccctacaggaaagaaacctacagaaagattcaagagaagctaatgagaaagcaagaagaaaactggttagaacaccacttcagtttgcaacaagaagtttcaggactctttatgcaacagaaaactggttcagcaatgcacatcagtcgcaaaaaattttagcttcttggttgaatctctcatcaaatctgatgttcaggttctgtttacatgtacaaaaaaaataagaaccatcccataattgaaaattcattggtgggtatagcatccaggcaaacagctatttgagtacttttttttgtgctaaaataccaacaaaactcacatgaatttttattagtttggagagaatagccactcatgtaggaaagacccctacctgagtaaagctgatgaagtgaccagctcatagatgtataaattgcatcaagaacagatcaacttatttaagctagtaataacggggtagcataatgcagctaattaatcagccactaacctgccttacaacaccaaatagagtcaagacacaatataagaaaataatttagataaccaataaatatgtgccacattggtgccacaatttgctactaccaggaaggaagctataattttaatctaagtgtggtcaaggaaaatgcagtgaaaggagtaggtaaaattctcaccgaatgagcttaacacctcctggtaaataagtgaggtagataggagcgcaacaatcagcttcaaccagtgagcacatagagcaactcaacccctccccacatccacctcccttgccaactacttcctccgtttcataatgtaagtcattctagcatttttcatattcatattgatgttaatgaatctagatatatatatatgtatagattcattaacatcaatatgaatatgggaaatgctagaatgacttatattgtgaaacggagggagtattttcaaggtttttagtcaatcaacctcaagaaggtgacgtacagcaccgccatctgttctgctaggaaggggacaggaagagctagcaagcacagctgccaattcatggagagctgaaccaacagttggaaataaagttcactaacttgtgagctcgtggggatctgggaagcacaaatcaggagaagggatcaagtgatttcttacatgctaccacaatagcatccttcagtatatcaagcataaaccaaaccattacctaggggtacttttccgagaagcaccttagtttagattttaatagaaaaggagtagtagcagtagagaaaatggaggaggtaggaataggggctcttacccagggaatggctgcttggtggcatcgagctccatggggtgctagccatggcagttgagcctgaaactccatgcatgggcttctttagccatggagattcactccttggagctgtgggttggggcaaaataaaatagagaaaaaattaatgcaaaataaaatgtctaaacatgtccaattaaagtagaggaaaaattgacttgaagaaggcatatgatattgatcagcctatcaaagggtagcagttcgcagttcgcagttcaaacacctatatttacatgtagattagcatccactttaatgaacaaggatgtcaaaaaatggttttctctttgcagataatccaagatatcattgttacagacaaataaacaaattaataatgtactcagctacttaaggtaaactttgtatcaaattacttcctatggtaattaccaacctcttgaagccaccatgttttctatcttctgcaagtatagctctatcaactattacaccagttcttgaactgccaaataagataaaaggtgaaaaaaatcagattgagtgagctcaagctactgtcgttctatattgcgtaataataatggcaaattggaaatggtttatggtttattcttttaaaagtaactctccctttactattgtccataatagattccccaaagtacatgttttccctgtactatcctatgactgataagaaatgataattcatttgttttcttcctaaacactctcacctgttgtaacatagagaaacaatatcagctaacatgtttttttcctgtggcaacaaatacgcccgtgaaaaataatgcaaaccttgaggaagcgacggggatgaagaattgaagatttccttaagcggggctgctagtatctcctcccccaagagcatgcgactacggtgacatgagcttgctctattgctgccagggctggagggaagagaaaaatagtcaccgaggagaagtggtggctggacgcgtttctcgttaacctatgcacatcagcaaagtaaagaacaaagaaaaggggaaaaaatcaaggaaggcagaggattgagaaaccgagaaagagccaaaaactcaccggagtgattccaatcttgcagctgcgtgagggagaggatgaggagggacgcagcaccagaccctcactggggcgacccggctctaggacagtgtgatgacaggcttgccttgtgagtgagccatccagatcgaccgtagcgccagttgaccgaccatgttgccgccgagctcgtcggcagatcagcctagcgatgtacggttctcctcttctcgccgcagccaccgccttcattgatgccggcttcgtcaccaccgtcgtttcttcgatggcagcggcaacggagggcggatctgtacgcctgcggccacatggagcccagatccggacgccggcagccgaaggcggctgttggtagcggcggcgtgaggcggaggcggaagcggcggcgctcagcgacggcggtggccaaggcggagatggctgctcgcctcaccgaagggaggaggggactggcagcggcggctagggttggcggaggcagaggccgaggcggtcggcaatggggacggcgggaggcggaggtggcagcgcgatgggggacggcgatggcgctcggcggcggcggcggtggcggcgcgaggggtaggcggaggcggcggtgcacggcggctctcggtggcgggggcggcgggagagggagagggagggacgaagggagaaggggacactggaagcggcggctagggtttgggggtgggttgcgcggggttttttcgacaaaacccctcggcttctacattttagagcgcggtccctgttcttgtttttttgttcttcgcgtgaaatacctggatttcctacggaactaaatgtaaaaatatcatatcaggagcactgttgttgagggacctcgatagaattacatagaaaccgaagggctttcctgcaaaagttgcaaggacgacgcggccgcacgagagctcgcgaaatccagccattctccagcgcctgtccacgcgtcgcgacgcggcaggggccacgccagcgcaaaacgctgagggcgctgcattctcgggctggtttgaagactttagatgtgcctaagagcacccacaatggtaaagtaaggtgctatctataaaacatgtacatctcagcaatagactagattaatagtaaaccacttcaatggtatgtctacatgggtatctatagctctctaatccattgcctcgtttttctctataaactatctccaggttagtagatagatttcctctctctcttcatttaatctcttccaagtaggaaaatatgctgacatggatctcttgtagagagcctatagataaccattgcgggtgccctaacaggtgttcctggcctactagtggaacaaattttgcagttctaataaaaaatcattagctactgttgcagctttgtggaatctaggctatagttgcaacgaattaattgataagttttggcataatatttgcagtcttttgaaatttactcctagttaaagcctccattgtaggccatattgataaagcaagaatctttctaccaactcctttaggccatattgataagcaagaatctttctaccaactccttttggtagcatccttcagatcttgatcttagcctcaatggcggacgtaggattaaaaaga

SEQ ID NO: 80129 - DNA, 8120 bp, Oryza sativa
ccagatgaaaaagtacggccaaaagatttttctatgttatgttaataataaataaagaagtatttattggtaaaacttgttaatattgttataaaaatgtattgagttgcgcaatttcatatgttaagtgaggtattattttgtaccttattcgacgtattagtactcggataatttatataggcctatcgcagtctgggtcgtagaaacattatatggacttaaacaaggagaattatgttacatgaagaattatgttaaatttgaacatgatacaactatttgcattgcggttacatagatgatattagattcgaactaggagggaggtagtgcaatagttgaacacaacgacgatgtagtaatgggacagggaagcatgacagtagaaatttcaatatgccaagttgtccgataatagctaacccctacgtgaggatccctctcctctctcaaaccgcgctttagtaaccctgtattgctctggtagttcaagctgcacaacacggctaggtggagttagaacccttctggtgtctatccattctctgtattgacatctccttggtggttcctgggaggaatgaatagatgtaaagcaagcaaagttagtaaatgttgtgagaaaataaggattcatgtaatcaaaatattcttaccatgaaatcgtcgtcaagaatatttggacaaacaaagaaccttcgacccaatgttgtaggatttatggaatgaagaacctgacaacgatcaccacacctgcatcttggacgggcttcccatggagggagtgccgtagttagcacccgccagtcgctctgttgttcacgacattgtcgtttataagccgcttttctctgtaagtattgctcagtactttcggatgcgaaataccagcgaccttcttgtaaacaagtggttaggtcgagaacgggattttctgtatcgacccactcgatgtatgcgcaagccgtagtgcgggtctgccgaatagagtagtgttacgaagaataaagcgattgcccatacggaatgaataagcatacgcagataataaaatacctcacggtcatagttagggcacctaaaaaagcgccttcctcgaatatcaggattcctcgaagccattagttggcatcgatcaccgcataggcagagaggacgctgacaccaaggtggtagtaggtatacacaaggatcgctacgccagtttagatcctcaacacctcggcgtctagccattgacgaaagccggtcggatttgtaatgaagcaagtggggaagagagtactgaatgtgactgagttctgaaagattgtgaggcctcactcgttaaggcgacttatataggcgcaaaaaatcgagtgatacccctgacatgtgaacgtggtggggtatggtgggtacgcctgattggcgccgaaagatacatgcatgatcggcgccgacagttacattggtcgtatgcgccaaatggcgggcaaatactcgtatcacacgcgaataaaggaggctgcatcggtgcggcagaaagtagtcgtgcatgcgccgaaaggtatcgtgcatgcgccgaaaggtatcgtgcacatataacaacaacgtagtcattacacaagcatacagtactggaaagtgaagcaagtaaacaaagagaagactgctctactggccctgccccgcgccgcgaccacgcttggtcctccgggcctgtgctcgcacgtggtcctgggagtaggtgaaacgatccggtggcacagcacgggtagcacgagtgtcccgcggaggagtggcctgcgcctggtcctgcgtctgcaccggcggtgcgcctcccagctgtgaggggccgatgacgtcctctgtcgagcctgaagcgaagtcgaagtcggtgatgtcgaagaggaaggtggaaggcaacaagtggtccgacgaggtcccagcatggtccagtggtggaccctgactcgacgtgccgactgcctgtgacgaagtcccggtgtactgccagaactgcgctgagtgcgaggtcgacacagctgcctgagacgctgaccctacagcctgggagaagtgggcggcctgcgtcatagcgaactgggcgaaacctacacatcgacaacgggacccttgtaagctaagacataaaatgtatgtaaattgattgtcgaagtaatgttgtttttttaagtacctgtgggggcacaacataaggcctagctgaggaaggcggggtgctgaacggtgcacgaaaccctgaagcaatcggcaagtgaaacggctcacttatatgtgcgaggcatgtacagaaatagtaataaaaatacttacctccgtgcagagggggggtcggcctaggaacgtgcgcagctggacggggaccagttggtacgggtggccgctgtacagctgcgtctgcccgagcaacgtcgtctgcacgacaggtgagaactcggagaatcgagcgcatcgactccaccatccgcgtgtacgtcgtcaggtgctcctctacgggtaccggaatccccgcgcctaaacgttggatcgtcattgaaccatcaacgacgacccggttgatgtcgtcgacctgcatggttaatttgttcgtaaatattcgtaaaatttgacgaagagaaagacatgaaaacataaaggaatggtgcgatgcagggtactcacagcacgagcgaagtcctggtcgcggtgcctggcatagaggtctctagtgctcgcaacgtggggctgctgctccaagggagcgaaggtgaccctagtacgggtgcgtggctggtaccagcgtaggtaggcctggtacgactcctcagtgtgtggctctccctcgtggtccacgacctcctcggttgcgagcaaccagtcctcaacaaaagtcgccaacttggcgggccagtcgccagctgagtgctgacccttgcgcgagtacctgcgaattaatgtgtaatattagtgtgaaacgacagatgttacaaattattgtgaacaggcagattttaatgcaacaacggaaagcgtagtgcaagatcttaccggtgaacagcagctgggacggtggtcggaaacggtactggaaagggctgatggaagccgaactgccgcatcacgcggaaaggggcgtgaggctcaacgcagatgtcgaagaccatcggaaccgtagtcatccagtacgcctggtccctggtgcagagtgtggacagacccaacggcgcacgagcctgggtagccgctgcactgtagggctcccacacgacgtcagtcggcagaaggcggtcgaactccataacaaactcaggatacgaccgcctaacctggacgtgagcccatcggcgctgcaatacgagacgatcgatgtgatgtacaatgaacttagcaattaacttaacaatacgataagatcgatgcaacgtacctgacgacggcaccacagagtacccatcgtagggtagtcgacctctggtcgctcctcgtacagtgactcctcgtacgcgtgctggtccacctcagggcggccgatcgcaatcctctcagctgcccagatagaaagaaagagagggcacccaccaaaggtcgcgctgggatccgtcttcgtgcaagactcacaaagtgcacggtacagagccgccaacaacgcggaaccccagctccactgaggcacctcgcctaccgcggcgtcggcgatgctcctggcgtagtgcacgagtcccttgtcgaccgcgtgcccatgaccgccacagaacatcacccagccaaaaagccagagcaagtacgcctccaaacatcggctgtaggagtactcgtcggcctccgcctgtagctgctcaacctgcaagccgtcgataaaatgttaggcaccttaactgcggactaaatatgtaatacgattgtcatttcggtacaaaaacactcacggtgaactgaagcagccacctcttcgtaggtctggtgttgcggtggtgtgccaacggctcgagcgggaggtgcggtgcacgctgtactagtgcgaaacgtgccgtcagatcgtcctgccagtccacagccgtggtcactggcccaacagcgtctcccgcgagcggtagccccaacaagtacgatacgtcctgtagggtaggggctacctcaccgcacggcaagtgaaaagtgtgcgtctctggcctccatcgatcgaccaaagctgctaggagggacctgtccaccgtccatcgtctggccgggtccgcgtcgccggccgcagcctccaccagccgacacatcggtaggaggccggcctcacgtagcctgcaataacaaattaatatgtcattataaaaaatattacagtgcaactaacttatagtaaaacattgttcgtacctctcgacaaaggagtcgtgaaccgtgagtagctcaccgcacgtccgtgcccggaacgtcccaagctgagccccctgcaccgcagtaaggtgagaccggtgtcggtgatctatcgccgggtccaacaactgaggtgtatcctgacgtgccatctctgaaaaatatagtgtttcgtgttagaacaattcaaaaaatagtactgtaaaacaaaagataacttgcaaaattatgaaatagtaataaaatcatgagattaattatgtacaacaagagtacaggctatttaaatatagcaaacgttactaatggtacataatgatgacgtgcaatttaacatatatgtagagttcaataatataacataacattacgtgtcgaagtctgacatacatcagcatacctaaagacgttaggcgccttagtccgacgttacatcacgagacctaaagacatgacatgccgaagtctgacattacacgacgaaacataaacacatcgataagttcgaaacgaattacaagcaaatccacatgccgacatagaacataagaactacaccacgtagctagacgtggcacgacgacgcctaggacgtggtcgagtggaggtagtgccttcacccgtagggcgagctccatctgctgctgatcctgatagtcctgcctccgccgcacttggtttctccttgtctttaggacaatgcttgtaggtgtgcccatgttcatcgcatttgctgcaacgcttcaccctgccagcctccgactcgtccatatcgttgcggatgcgacgagtcctcctccttccagccttgcctcggagcttcgatgggtcaggaatattgagtacttcatcgttagtctctgtgaactccccagctatgccgaacccataaatctcgccgctccacgtatgatatattgcttgcttactgaagtactgtgacacatatactgcatctggtatgccacactccgctgcggcagcaatgacatgggtgcatggcctgtggagcagcttcggctttgcacaagagcaatgacatgtgccgtcggctttgagaacacactcctgcttcactctcttgcggtagatacccctgcctgccttatcttgacatagtatctcaaacctgtgctgttgggtaccttgcactagagctcgatgtttcatggcctttttacgcaactcctctagctttttctgcatgaaagctccaaacaaaatgctgttgttcggcatagagggaagaactacctggaaccgatccctaaaatacctgcatgtcccatgtaaaatgaactccactatgccaactagtggcagtccacggacaccgcgcatcacccagttgtaaacttctgccaaatttgttgtcattattccatatctagcaccacctgtgtcatacgccttggcccatttctcttttcgttcatgcagaatccactgagaaaatttctgaatctccaatccagttcttctaaccaatgttggactatccgttgggagaggtccaagagcttgaggagggtcagcaacggcggtcgatggagccgctgcacgctgatcactgcatttggctgtcaactcatctaatctcttccaaagctcattgaattttttctcctggttctgattgcacagcctcttgaacatgttcatgagctccttgttcttgaattgcttgaaaaaattagctcccatatgacgcatgcaccacctactctgtacatcttcccaaacaccggggtatcctcgttccatactcccaaactgcaactctcctatcgctcgcagaatgccagcgtgcctatcatgtatcaggcatacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctatcaagaatgtcccatcaatgcagagaacaggacgacagttcacgaatgccatcttgcatgcatgtagagctaagaacgccctttgcagcacactcttgccaggatgttcaattgaggggaatttcttcacttcgtaagagctcccagggtttctttcctcgataacaccaagcaggcgtggcaaattgtcatacgaagcttcgtaagttccaaatctcatctctattattttctgtttggccctccaggccttggcatagctaatagtatacttgtatgtctcttcaatgtgtcagattattgaccttggttcatatgtgagattatcgatgacatgcgcatacatctcagatgcaacaaatgcacatgtaatgttcctgtggtatttctgaacaccaggtagaaaacatgtatgcttggtaacaactgacactgtccaataatccttccatttccccttatacgtgtgcactctccagggacaaccatctttttccttaacacaccgaacttcatattgcgaccggttcgacttggcaacccaaaactctctatgaagtgacactgcaaaatgttttaccgcctccttcatatcttctgctctactataaatcgctccctgaataacctcattttctttgtactcccatctcacactatcctcttcagagacgatcagcccagaaaaatcctcactagcccattctgctggattaatatccgtctcatcatctgacgaatcaccttcctctacacgctcgttgtcagaatcctccctctccatttcatccacaatggcaccgacagtctccccctcgtcggccactccacctggttgaatgcccactggagctactacgcccccgtcctctcgtgcgttgacctcctccacagaagtctcgtttacttcagcacttggtccctcaccatcatccatgttcgtctgcacacctggatccttcgggtgaacaaacggaaccaaagctagaggccacccacattgcaatgcattttccaaataccatctccacactcgagagttttgaactggcattagttcccaataaaaaccctcagttgcccgacttactataacattgattgttatgtcacttgtttgtggatcaactctcaagcccctcattaaccatccttttatagaaggtacactcctctcagccggtctatcaattcccctttctgatacaataaaatctgacagatctaccccagttggcccgtaacggacgtttcctggtccatggtaaacttggaatatttgtttgttcgacatatctgtcaacgaaataactagatcatattactctttcatgcaataaacatctacaacgtaatatcttcttgtgtaagccaatgcaacggtaatgtattaattccaaattagcagatctacgtagttaccgatatctacaatacgcacttctagattagtacaactaaaaccctaaaaatataatgcatttattcaaacaaatttttaaagaatacacactatttaactcaatagtcacatataggatctatgaatattacctgaaatcggcgtctgaatccggcagggcttcgccccttcttctcttctcctcccctctcttctttttttttcactggaattgaggagagaagaatgagggctgggggctgggcagcaggccttttataggcagcgaggcctgccgcccggccagagggcggcaaggggccactgcaaaatagccggcccccactggctccccggcattcaggccccttgcc

SEQ ID NO: 80130 - DNA, 13870 bp, Oryza sativa
tccctggcgagctccccgcttgcgaagacagcccccgcgcgcagtcgttcgcgcgcgcgcgcccgcgtggttccccgcccgagtcgcgtcgtctgcgtcgtccgcgtcacccggccccgctgctctgccgcgcctgcaaccgctcggccccgcgagccattgcgcgtgcccagccgcgccgcccgttgtttcccgcgcatgcgtgccgagtggccgacctcctggtcgccgccgccgccgtcaccctctgccgcgccagcccgcgcctgtcgcccgtgtcgtcgcgccgctccaaaccgccccgccgtcatcgccgtcgtcatcgcctcggtcccgccactcccgcgctagcctccaagggacggaggcagagcctccctcctccctctgccgcgacgcccccgctccctcctccttttcccgaagaggcaaggggacaagcccccttttctctccctcttttcccctttttcctcccgccggcgtcatcctcctccctcctccctgtcgccgctttggccgcgaccgccgagcgctagccctctcctttgaccgccctaagtcggttcccaaaccgacattgccatcctataaacccgagctccccccctttttcctttcctctcccattcacctccgcgccattgccgcccctctgtttcgccgtcgccgttcgtcgttgcgcgtgtcggaggagccggcacgagcaaggacgtggaaggggacttcggccgcgccctctccttcctcttccccggcccgaggccggagagattactcccgcgccgtcggcctctcgtcacagcaccccgacccgcacggtagtgcctctctccgttcttcctcctcgctccatctcctccccttagacacgggtagtagcacgagtagcctccccgtagctagccggcgccgccccgaccgttgccgtcgctcgccgtgtactcgccgccgttgccgcccgagctccgtagcacccgctcgtcgccggcctcgctcggcgtagctccgcccaatccgacgctagcatcggatttccgtggccgcgtagatgctctcaccgccgggaatcggcccttcgtgacctcgtcgccgtttccctcttccctccccgccggttgccgccgccgcgattcgccgccgtcaagcttcctccggcgaatccgagccgttggctcgtttcccctcgtctcgtgcaaccacccggtgtgctcgctttcgcctgtatcgccgtggttcgctccgccgctcgccgctatcgtccgtcgtccgttccggccggtgtcgtcgtctacctcccgccggcccgcgtggcagccacgtaggcgccacgtcggtgccagctcagccgaggtcgggacgggccgaccccggtcagcccctcccgtgagcgcgttccaccgcgagccgtgaggctgcgcgtgggcccgcgcgcatgcaccgcgttcctcccccgcccgcgcgcgtacgccgcgtgctcgctccgcacagtgagccgtgtcaccgacaagcgggtcccacccgggaccgcgcgcggtgagcccggtccaccggctctctctctcctccctcccgcgcacgcgcgcgtcttgggccgccttgggccggtcggcccatttagctcggccggtccgctccatttcccttgggccgcgccctagccgcccgagaaaagtctattttccctccctcttttcttttcttttcttttcttttccaaaaaggatttaattaaatccttttcctttagacaaaaatccaataatcttagaaattcaatatcttcccaaccgtaaatccgtttgactccgttcaacttccaaaattcctcaaatctcgagatctatctaatggcacgcttagaggtcatcaatagggctttattttttttttgccgtttgttgagttgccccgcttcgcgtgtagtttcggagcccgaagacccgcagtgcgaggatttcgaggatcaagctccagatctcgagcaaggcaagccacctttgaacatcttgagcctatatttgaaatttaattatgttgcttgaaaaatattatgcattgataggatcgcacttaatctgttgtcccgtctgcaaggcagattggcggacctacctaatttgttgcatttgatctttcatttgttaattgttatgtcatgtccccttgtaaccatctagttgcgtctcgatattcgtgcaccctgtgcgggtatcgacggacgccttcaaacttaaaaatctgattaacaacttgggtaaaactagggttttacaaaagacttggaaaacccgacacctgggtcggtgcttgcgaactaaatgaatttccaaaaccacggaccggggaacgtactgggagtacggtttcccgctcttgcacttaaggaccgtttccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggccgatccccacgggctgggtgatccgggttagtaatgtcgtgtgggtaaagtgtaccccctctgcagaggttaacaaactgttcgaacagccgtgcccacggtcatgggcggatgtgaagtgattcctagcgtagttttgtttgactactgcttgtgaaattgctgttgtggaaaggggttcgatgtttgaaaaatctgcagctgatgggatcagctaggcccgggtggccgtttgaaagttgttggcccgggtggccgtttgaaaagctgttggccgggtgccaaccttgtttcaattctaaagactgatacattgcacatactccgaccggacgagacgcactgtctcacccgtgtcgtttgagaagcactcacttagttgtttttagaaaagagttcaaataaaatcaattgcaaaaacaacagcctttctttgaagcctgtattaaacacttatttcccatagcttgctgagtactcccgtactcacccttgctttatataaataatcccccccagttgctgaagaagatgaagcggatcctgctgatgaggagttcttccaggagcaagccggctacgatgagttttagggtttcggcctagttcccaagtcgcgcctgtgttgtttggtccaagtcctggcttccgtttcccttttgtaatgcagttgtgagctcgggatctgtccgcagcccaacatgactgtacctctactctataataaagagacttgtgttgctgtgataatccgtcttcctgtgataccagcactgttttctgggactggtatcgattaacaggttaatttggagcgtcacgggctagttccggtcggtactagttcggggcgtgacaatctagtcgttatcaacaagttcatctgttctctttgtactctatggttttctatatcaatcttatataaactggattagggctattaccttacgagggggttgaaccagtataatcctggtctcttttctgttttgatgacgtatcgtgtagaatctcgtaccaacgtactccaatactccatttgtccggtctatgggtatccccggttgacaaatttatcaaaagaaatttatgccttttgtattatatgttctttcaatattattttacatagcaacaattcacgactcagaattgcagtcatttaaaacttaaaattttctagtgcaaatcatacggcatacattatgtttatttgggatattaaaaaaacaaaaaaaaagatttatgagactggcacgggacgaagatgtaatccattttcattatttaaaaaaacaaaaaacagattttttttaaaattaaatggtctcaaccattggttatatccatgcatgcacgcatatatatacatgcatattttactaagggtaattattactttccttgttagataaatgcatttgtggaaggagaaaaaatatttttaattggaaaataaatcacaaaacaatcatcggctaggattttattatgttggagcacgttaaaaagagtcaattttcttttacgaactagaagattatccttgcagagttctcgggaaacctttactactagggtctgggggtaaaggaggggacgttgtgctctctatcataggcagtgttccgctgcatattgcagctgctgcaacgcagccagcatagctgctgcgatgacacaaactactgtgctgcgaggtggttgtgccacagctgcagtagttgggcgaagaataccagtgacattccgaagacaagtcagctctatcttgcccaatgcagtggttcacctctctgcccgaattagaagtttatctgggacaacaaagcacctctcaaggttcagtctttgcctggcttcttgctaaagatcggcttccaacgaaaaagagccttcataagaaaaacatcgtgtctgcccccaactgtgacctctgcaatttggctgaggaaacggtttcgcacatgtgcttccactgcccccttgctgatgccttctggaataaccttcgcatttatatcaacatctcgttgacgagcgagctggcgcatcttcctctacctcctcaaatccccagcaaacactttcgggtgtaatacctgctatgcttctggtgtctatggaatcatcgttatggggtggtctttaggcataaggaagcttccctatgttatgtatatgctatgtgtgtttcagaggcctctctctgggctgagcggtttaaattagatgatagccatgtaatttcatcctggaaggtcctcttctcttccacccttcactctcttaatatgtaataagataaactgaactatttttcccctcttttctgctttaatgaattcaggtggggaagctctcccccctgagagcaggtacaatagcaggctataagccagctacaaacatattttaagaagataaatgaggagagagaagagcaacgggctatagatttgtagtcagctgtagcacggactccaagacgcagtgtgtgtgtgacaggtgggaccatgtattaatagtgtagtatgtaactattgtatgaatgagctattagattggctacagatgaattggagctagtagttggctatactattaaacttgctctgatgaattttcaaaaaaacaaacagctgcagtagtgcagccgcacatgctcatggtttcaacaaggaaaggtttttatcagagtttatgattgctctcttaggggtttgaaaacaactttatcattgcttgaactaagagagtgatgcaaagagagatagatagcaacatcttaactggcgcaattaaaaataaattattgaacggattgttgctacaaattatctacttgattatagtatagattaaatattttgataaatgaacttaacaaataacttaaaacaagcgatccaagaatgcaacaaaaatatttttaaaaaatgtgaagcaaataatccattttaatattctgacaaaattctagaaagaaaagaagaggggtgataaaaatgaggagcaaattatctgacccgatccactccaaatccgtcaaaaacgaggatatggtatggtcttacataatccggcggatgtggatagtacactgcggattttgatgtgaatatggtatctctaaaatccagcagacgcagattatccgacatttctatcgaattatccgataggccgtttgtcggacaattcgaaattgtcaatccacaactccattttgtttgttgcatactgcaagagatggcacacatagactccttagagctcatctcacacatgcttaactgtttttttatattatagatatacatatattcatattatttagcacttaagcatataagttattcggatggatgcttcattttaattatattgttgtccgttgtatcgctaacttgatgttatattgattgcatatacatgttataactgacaatttcaatatattttcaaaccgaatccacaccaataccatatcatttacgacgtccaaaacaatctgctctgcattcacttcgaatcctcttaatgttgaatagtcccacattggttatggaagggtaaaggacctaagatataagtgggggagcccctcacctcaatggctagcttttgggatgggaaagaccctttacgatcctacaattggtgtcagagccaggctaggttaacatctctggtccgatggacacagtgtgtgaaggcctgatggactgtgcgtgcctgcggggcccgtatacctgatggaccgtgggccggtggggcccggatacggtgaaggggctgagggacaccaatgtgtgaagggggagaagggggagattggggatgtggaagggcaaaggacctaagatataagtggggaagcccctcaccttaatggcgatataagtggagaaaccaatcaccttaatggctagcttttgagggacaccaatgtgtgaagggggagaaagaggagattggggatgtggaaggacaaatgacctaagatataagtggaggagcccctcaccttaatgactagcttttgagatgggaaagaccttttacgatcctacacttaaaacatatgggttgtgatatggtattatcactatccattcgaatccgttttgtttttattcctataaagaaaccacaggggaagagtgtgtaacacaggaactgcgtaagataagatagagcttgtagcaagactacaaaggccttacgctgacacgtatttagctgaaaactatctaagctaaccttcaagtttcaaccacgaaacagtcagagcattccaagtcgctgcagcccttggatttgcacacaaacccatcgggccctggtggatttcagtaaaagctggaccattgtttcccttaattatgcttatgcgtgttggatttcagtaaaagctagacgcttcacagcgtcactacctcactcatttagctccttccccacttgaatccatgcgctacacttcacttctggttgcgtcatgttcgacacgatcgatatcgatcgagttgaggcgcgatgctggccatgcgttctcacggacgaggtccacgcagagatgatgaccatgcatatgccacgtagtcacttggctcccttaaaacgttgaaatttcagatgtttttcgtaaaatcactatgttcctgtagtaattaacaagtagcagcctagcagggagattaagctgtagcagagcaatctcaattctcatttctctaactagaatggtttccctaatattgaataatatgtccacaacgaataaaagattacgtgagaatatatgtactcctttaaaagactctaatggtgatggcagtaaatttgctacccaactgttcatattgtttttgcagtttttacaaattgtcccctgatatttattaatattgtgaaatgatccactatttagttcaaacaaatggataacatataatcaaatgagcaaacaagtgatattaagatatttgataaaaaaaatattttgctatggcatattatgattcttctgttaatagcaaaatatgggtattttgctagtaagcatgaaatgaggaaagagaagaaaaggacatatttatacacactatataagcgagaaatgcgtagttttaaaaaagcatatcaaaatagtaatgtttgtattagcggagtattaatgtgacgtggatgattaaaaaatattttactaatagtatgcaactatttaacatataaataacgatagaacgttctcttgaaagtttaaaaacaactctcgtcattagatgaaagatctttcttatttgactttacatgaagagagccgacagttcacaaacgcactaccacatacgtattgggacatcccataaaaaatcaacctagtactgaatatgacatatcctactactataaatctgaatatatctctatctagatttattatattagaatgtgtcacatccagtcctatatgcctttttttgggatggaggttgttcgcattggggaaacctgtttacacgtacaggtacgcgcaaattaaacaacatgatgcgcagtactccctccgtccaaaaatataagcatttttagcatagtgacaagtcaaatatttttaactttaatcattaatagaaaaaaataaaaaagataaattgattttactagatttatcattaaataaactatcataacatgtaatattttttatttaaaacatcatacttttatagatattgttagtgaaagtagcatatcagaaaccatgtcaagatttaaaaatatttatattttgggatggagtgagtagtatttagcaggacaagttcaggtgggaaggaagtcaattaaaggaccgaggtacaacgtgcaccagagcggcctcccaattccgaaacaaccgagccagcagtaaaatcagtgaacttcggtgatgtcgaccgtcgacgaagcgcgcgctcgcgttcagaccaatgtcaacctcgtcaatgaagctggcttaatatatgacaattaatttttttttcttaatcttcaactaacagtattatttatttatttatttactcagctaaataatgccatcaaaagtactttaagcatttgtctatttgcaacaatatttttatataagtcaaatgaattaaaaaggacaaccgaggtagtatgtcgtcataagcagcactatcatctactcctaactggagtatttatatgggtatgacagccggcaacattagcaagtagagcaacgaggctagagtttagctaccatgttagaaatggctaccactaccctgtgcctgcagggtgcggccctcgtcgtcttgatcgtctgcctggcgccggtggcaccagcgtgggctcagcagccggcgggctgccccgacaagtgcgggaacaccagcatcccctacccattcggcattggctcccgctgtgcccgcgacttcaacttccggctcgtttgcaaccacgcctactcgcctccgcgcctcttcgtgtctgaagtcgagctggttagcctgtccctcgacggcgaggcccgggccctcatcaacgccagaaactattgcagcgacggcacaacctacatcagttacaatgctttgaggagggacagccagggccagctgccgttgtctgatgtgtctttcggccgtagcaccgcctaccgcttctccgcggcgaggaacaggttcgtcgtgctcggttgccccgtcctcggttacctggttgacgccgaggagtactatgtcagcggctgcatatccatgtgccgcaagtcgcaagccggtaatgatcacctggtatggctgccagaacaccatacctcggcctctcaacttctacaagccttacatcctcagcttgaataagtcggcagaggagaaccgcgtggaacccatctaccatcgcctcaactcgacggcatgcaattacatgttcctggtggaggacaagtggatcgacaccacgtacagctatcgcgcctacttcaaccgaaccgacgacttcgacgtgcccgtcgtgctcgactgggcgattcggaacgtccgcaactgcagggtcgccaagcgcaacgccaccaagtacgcgtgccggagcgagtggagcgagtgcttcgacgccagcgacggcgtcggataccggtgcaggtgctccaatggctaccagggtaacccctacctcgacagcggatgcacaggtaatcattttaacccaatcaactgttacttgtctctatggctcccatcgtttggttattcacggaataaaccaaacggcatatttgtaaacgaaaaataatttgtaaataaaacttttatgtccgtgtttttaacactttaaaagcaaagactgaaaaataaacttcgacgaaaaaacctcaaaatcaactttaaatttaaggttataaattcaaattttaactaacaatcataaacataagtgaaaagatgggactgtatattttcttggatatataatgctgcagtctgatcagtttgatgatttttctgggcaaacggaagacatcgacgagtgccaagacaaagagaaatacggatgctacggagactgcacaaatacgataggagggtatacttgcttatgccctcgggggactattggaaatgtccacgagaagaatgtttgccgccctaaggacaagttcacgtttgctctcaaggctgttacaggtaattaatgatcgaactaacccatcatgtatgcaattatcttaactttcaatggttttagtctgcaatttcttcctaaaattagcctatgtatatgcaacgttatgattaggggttggcctcggcgtgttcatgtcggtgttcatggcattctggctccgccttaggcttcagaagaggaaactcatcagaacgaggcaaaagttctttgagcaaaacggtggaatctttctgcaacagcagatgcgttcctatggtggcgctggcggtggagtgggtgggttcaagattttctccacggaagaactcaagaatgcgaccaacaacttcgcagttgatcgcattcttggtcatggagggcatggcattgtttacaaaggcgtcctggaggacaacacggtggtggccatcaagaagtcaaagatgatggaggaggcccaaaccaaggagtttgcaagagaaatgttcatcctctcccagatcaaccatcgaaacgtcgtcaagctgcttggatgttgccttgaagttgaagtgcctatgttggtctatgaatttgtctcaaacggtaccttctaccactacatccatggcaaagaccccgaagttgacatagcacttgatacccgtcttcggatagcggcagagtctgccgaggcgctctcctacatgcattcgtcggcttcaccaccaatcctccatggtgatgtcaagacagcaaacatcctgcttgatgataagttcaacgccaaagtttcagattttggagcatcaaaactagcaccaactgatgaggctgagattgcaacattggtgcaaggaacttgtggatacttggaccccgaatacctaatgacatgccagctgaccgataagagtgacgtatatagttttggtgttgtcgtgctggagcttctaacaagaaagaaggcattataccttgacggaccagaggaagacaggtgcctggtgtcatgtttcaccacagctgtgaaggttggtcgtcatcaagagcttctggacagccaagtaaggaatgagctgagtgacgaaatgctccaagagattacatacctcctaatgagatgcctaagcatgattggggaagaacgaccggcgatgaaagaggtagctgagaggctggaatcgctgagaagatatcagcagcacccttgggctaaagctgaaggcaatgaggaggagattcagagcttgctcggcatggaacaaaataatgcaaattaccaactcaggcaacaagatgtcctgggtctggaagaaggcaatgcatatacatttagcttatagatcatgctgatcgtgtcaatctttggtaaatcaatctgttctgatacaaaatctttaaaattcttttccgtgtaacatgaatggaaacactcatatggattgcaatgaaataaccaccaaggaatttatgtggctgtaataaaaaaaaagaaactgcatagactatatagaccaatgatttgtaactgtgagtattaaatggttcttgtttgttcttctgttaaaagaaagggtgaaaacaacatcatgtaaagacaacatgtgatcattaaatagaagcatttaagtaagaacataagagatttgcataccatctctatgtaattttatataccttttggagttttagttggatagaggtttttttttaaggggaaggagggagctctgccaatttcaattaagtagggggaaaaacaaagttttacaacatacaacctccatccctggagagcgtggagggcaggcacataagtttaaggtaatgcaaagcaactaataacaagacgcgcagaaaaatcatctaagttatttgggcttcatcaaactccttgcacatatctatgatggaatcaactacctgaagcacggaattgtatatcccattaaagattattccattcgtttgtaaccaaataccccgagccgtgtggatgaaaaggccatcgaagttgcgtaccatttctttcctgcaagcttcccacgaacctagcatgtctccagtgaagagggatggtgaaggcgtgtggaggcccaatttcctccatatggagctccatacttgtcttgtgaatgaataatctatgaggaggtggtgggtagtctctggttctataccataaaaggggcaaatctcactgttatcccattcccgaatctgaaagttgtctgcagtaaggatttttcaatggatcatgagccatccgaagaatttgctaccttgtaatagcaaattcaagcttcccctgctaagtgaatacatatcaggtcatcatggctcagctttccgtgctgagccatttatagcgtgtgcccatttcaatccaaccaaagcaaacccaaatacaaaaccaatccatttaacccattccaatccagtccattagcaggcttacccctagctatcgtcgtgtatggtcaggagaccatcacactctaagagttggtccgtccaatgaaatgaaggaaggcaatcatccatgagaggaaaatttgttaattaaagagtgggtgtgggtgagctccgatttgactggcacagtaccaatgcacttcactaatcaagcaagtaagaaaagattcatgatgctagccctagcccacactgcgatgtgcgggtgagaccgactgaagcacacggacaggagtagagaagacgaccagtagagactagagtgaagaaagattagtagagctaaccataatttggcaacgcactcaccctgaggcctgacggaggcagaggcgcagagcgtgggaaacccggcggagggcgtcccaggaagtcaacacctccggcggcggtatagatatcctccgcgtgcggtgcggatctgatcgcccccgacgacggcggtggcggcggcgacggcggagggaggggttccggccgccggctcgctgctgtcgtggttgagagagatgacaaaggtttcaaggctaacacgtttagcccatttttaggcccctttacagtgacaaactagttgggccgaaatggaatttgcactaggttgatatggtgggcctaaactgggctctcgctaacgcgcgagccgaattaggcctgagcacgagattcctgcgaatgcgtggtgggttgggctggaataggtctaggacggcaaatgtgcacggtggcctcccttgtcctgggctctaatgaatctgggccgtcttttctcataagtcccacatggaattttcgaatttttttcgtttttagatttttttttaatatttacagaaataatctatcgaccaaaaaaattgcagaaatagcccctgccgccctaatggtgggcggcaagctgacgtggcagacggtgggtcgaccgcgccgtctgccgccgtcggccaaaattgcgattaggcccttgccgcccgtacagagggcggcaaggggctaattgcaattttggccgcccataaagagcttgcggccgtacttttttcatctgggtc

SEQ ID NO: 80131 - DNA, 24185 bp, Oryza sativa
  unsure (1)..(24185): unsure at all n locations
ttcctgcagcccagaaggataaagataggatgaaaattcttaatcctagtactcgatagattttaacagtgtatatatacggaatttttttaatttgtgaaagtcacattccataaaacattttttagaaaaaaaaaagaaagcttggtgaatgtctttttaataagccaacaatgaataagtttttatggaactttaagggaattaaaatattttttataaattatttgtagagtaattgttacagtctaaatgcgctctatgttaaatacatagtatccgcgccgcctccaatttagccatactttaatgcatattggttagcttattttgcataaatggttgatcagccaaagcatttggctatccgatgaggccctgtaaatatacgtagtgcagagtaggcaaagagtttaatgttggttgtttcatagccattcgagttcaaggacaccccggtcagatcttcacgctaactttccaatcgctggttcttcctgcttgcgactatgttgcttttgcttccccggttctgatcgcttgcgcgcacgagagatcggaacaagcaaggcctctggaaccacaccttcgcctgagatctgcaccgggtaggcgggtgatcaggtttttggggagtgcttccgcacgactggtcctcttcctctgttgttcgccgtccgttcgtttgcatcaccatgactgctggagatggcacaaacggacctacagctggcacaccgatcgacaacaccaacggaggcagttctgcatcacaatccagcggagggactttcacagggtataactttctaccgctatctttgtttgtgttccttatgttagtcgcaataatattgcgttctctccgtgaagatgatgcttattctattctaagcatgctcctggttatgtttaattttatcactagatcatcttacattgttcataccaatatgctattgccgatatatgtctgtatttccaacagtatccgcgctgcctctaattcagctatactttaatgcatattggttagcttattttgcataaatggttgagcagccaaagcatttggctatccgatgaggccctataaatatacgtagtgcagagtaggcaaagagattaatgttagttgtttcatagccattcgagttcgaggatacacggagagtcgatcatgtcagcttcagagaagagcagcaagaagcaaaaaatgctgagaaaagaaaaacaaatgaaatggacataaaaagcagaactgatgcagaaaatgctgagaaatggcaacagaagaaaaaaagaacgccgttgccggggatcgaacccggatcacccgcgtgacaggcgggaatactcaccactatactacaacgaccttgcttgctttctttttatgtttctttttaaagatgttaaaagtgtccaactaaattaggtacagcatgggggaaaagccgctaccatctttaatatgtgaggattacattttataaaactatcattaaactaaaaatttaaagtatcatatcacaaaattgtagatttactgataaagctatcaaaaactacatatcttaactctattgctttttaaaagttacaaaatctgcaattttgtgataaaattgataaatttgtagttttatgatgagatgcctcaaatctatagttttataaaaatatggtgctaaatttgtagtttttttaattaatacacatccttatatatatatatatatatatatatatatatatatatatatatatatatatatatatatatatatatatatatatatataaaatctttcacaacgaggtcagcctacctagcacaattcgatgatcaagaagctgacgcagtggtcaaaacaaatttagaagacctgggctccatcaaaatacaaaatgtttacatggttacttaattatgaaaaataggatcgggatatctgaccgactataacgaagagagtagctgaaaaatattacttctctcagctttgccatcgcttcaagaactgcccagcatcacaagaaaatatatggcaagcagtggcgccaaaactgcacaatgatcaagttaacactaaccattacgccaatgataccttgcttgagcaatgacagatgcacagtgcacacgccaggacagcaggggaaagtcaaaagcattgtgaggatgacaccaatcctggtggcttgggaaatttgaagcgaatgcaacaggataatcttcagcaagaaacaaatagaggcgtctgaaattgctggcggaataacagaagaaattatcactagggctatgtgtgacaatattggattgaggtggtgtttgggtccagggactaaactttagtccatgtcatatcggatgaatttggagtattaaacatagactaaatataaaactaattacataaataagagctaattcgcgtgacaaattttttaagcctaattaatctataattagcacatgtttaatgtagcatcacataagctaatcatggattaattaggttcaatagattcgtctcgcgaattagtccaagattatggatgggttttattaataatctacgtttaatatttataattagtgtccaaacatccgatgtgatagggacttgacctaaacttttaagtccctatcattccaattccattcgtgatacgtgcgagcgaactcattcctctgtgatagcaaagcaagcagagtactccagatttactttcactttactctttttctttaattctgttggaaaggaaaaaaaaagacttattccatataaactgtgtaagttagaagcatgtcgatcgtggatcgctagatcaaatgcacactatatatatatactgctgctaccattcattcagcaattaacaaattattgcagcagcaagtcaagtgtgtactgcatccacgacacatatgcattatcgatcgtagcacaggtgcgacatttcaatcactcaacctctaattattccttcctattgagtagctttgctatatagctcgcataactctcttaaagatatattcattcgtttcttgcatattttctaaatagctaatgtacaaaaagtttaagaaaaaaataacaagataaattaatgtataacatatcagcttcataaacataaaaattcaacttcggcttttactgttgcaaataaattaagctgatgtagctcgtatgtgtatatttatagtcatatttaatttgtttgttttgtgcaaattatataaattaaatttaaatttgtatgtttgtgtgataatatatcacatattaatctatctcatcaagtttttatagtttcttttataagtatttagacgacacgaaaaaaatatagtagtttcctgcgtatgtatgttgttgggaataaatcccatgttagttaattaaggggagttaaaccaacttaaatataaaaggagtccctcacctcttgccttttttttaacaaattagtccttttcagcgctaaaaatattggcgctaagctctaatccgagatggcatgaattcgctgagttatcgtagctcagcaccaaataacttggcgctgaggtcccgacgagttaaattaatgcggagggatttctagcaatgtccgactgatagcacaatggttgtagagttctactctaatctaggattaagcagggtttgattcccatctgtcctattttttttctttttagttttcctttttcttctctctctcactctttattaatatgttttttttttatttttgttctctcgttttatttttctatctttatttttctttttttttctcgtaatactatcttcaaaatatattttttttgaatttagaaaaaaaaatattaaagtggcatattatatagcaaatgagaacttaaactgaaattccaaatcaaattcaaaataaaacaaattatagaaatttgaaaagaataagagtaagtagtcaagagaacaaaacttattttgtaaaacatattaattctaaaagaatgctaggaggaagagaaaacatattaattctaaaagaatgctaggaggaagagaaaaggaaaaaacccaaaaatacaaaagaaaataggagaggagggataccaggattccaacctagcaccctagggctcacagcctaagccatcaaccacctgctataacggttttgcttccatatgttgcctgcgcaactatttaaatcgtcgcgatttatttggcgctgagctatgatgactcagcaaattcgtgccaccttggattagagcttagcgccaataaagttggcgctgacacgttatatctcagcgccaaggtctatggcgctaagtccacggcctatttttttgttgaagtttttttctgggactagtttcgaaataagtttttgaaaataatcaatttgttaaaaaaaaggcacctcttgagctagtttttttaaggtgtagtaaggcttcctccagattttttttggggcaaacatatgtatgtgcacaacaatcaataatgccaataattaatgcaggtgtgttcttccgttcttctcttgtttaccatataagggcatgtacaaaggtagagtcagatataagctctagttatctagagactagcatcctacaacagttataaataaaatggtctctaatcattaatgtatccaaatacgttttcttacttttctttcctttctttcaccaccatgcaacaaaatttgctctaataaattctaagagtcgactctgagccgttgtcatgaataacaaccatactcctttctctttcatccatgtcatcaaatttacttgcatggtaatagagagaccactaataaacaccgttgtacatgccctaagagtatatactcccatccataatcatgaattcatgatatctgtcttagttaatttaatttaatttatgttgggtggacgtggatgcgcatgatgagcgctataggcagctgagcacaagatcgatcgatcgatcgaaataattaaaaggaaggaagggatctagtggccggtggatgggtttcaatccgccggtgccgcagaaggacagcgagtgggagatccgggtggctgtgctgctcagcctcctccttcaggtcatcctcatcttcgtggggcccatgcgcaagcgcacctcccaccctgtcccgtgcttcgccatctgggcatgctacctcctcgccgactgggtcgccgacctcgccctcggcctcctcctcaacaacctcggcaacatcggcagcagcagcagccacctctctgccggtgccggcggcggcccgcccatcttcgccttctggacgccgttcctcctgctccacctgggcggccccgacaccatgaccgcctactccgtcgacgacaacgagctctggcgccgccacctcattggcttgctcttcgagctcttctccgccttggtcgtcttctcctgctccatcaggagcaaccccatgatcccggccaccgccctcatcttcgtcgtcggcgtcatcaagtacggcgagcgcacctactcgctctactccggcagtgtggacggtgtcatcgccaaaatcttccgggcccctgatcctggccctaactacgccaagctcatgaccgtgtttggcggcaagcggaatggcggccttctcgtcgagatcaccattgccaacggcgaggccagcaaggccaaggaggtgttgcagcagggcagtgaggttcggctggtggagacgaccaaaagcctggaggcaatagcgtacgagttcttcaccatgttccgggtgctgtacgtcgacatcaacctcagctacaaggagaggaggatcagccaggcctacttcctggaccgccgcgacatgacggcggacaaggcgttcgaggtgatggagatagagctcaactacctctacgacatggtgtacaccaaggcgcccgtgtcccacagctcggcaggctgcgtcctccgcttcatctgcaccacctgcctcgtcgtcgccatcgtcctcttcgtgctcctggacaagaccggcatcctccccgtggaccgtggcatcacctacgcgctgctgctcggcgggctggcgctcgacgtggccgccatcctcatgctcctctgctccaaccggatgatcgtcttcctcgaagccaagcacatggcgtggctttcccgggtggccagggccgtgcggctgcagccaaggcggtggtcggagcggacctcgcagctgaacttcatctgctactgcctaggcaagcccaaggagcaggagggtcgccgccgccagtgctgcaggcggaagacgatcccgccgagtgtgatgcggttcctcatctgggtcgccaacaaggtgggcgtcagggagaccttggacgacttcttctttatccagcgcaagccggtgacgatggtgagcgtcatcgggaggcggggacgatggtgcaactgcaaggagggngatgagagggcgccgacgaccatcgatgcccttgcgtatgtcttcgttggtctccagagggaggccataaaattcagggactccgaggactactacttgaagaagctgcgcggctaccgcggcgaggggaccctattggatgacgagggcctcttccgaaacatcaagatggagctgaccaaggcaacacgagaggagctcaaccttaggcttacggaggaggagagctcgagctcaacaaccaagaagaaggaggccgaggagattacacatgacgtcctgcagctggccgacaagaagaagaaggagatagacgacttggtgaaggagaagctggatggcgtcctgcggaacagcatcgggagggagttcgacgagtcgctgctgctatggcacatcgccactgacctatgctgtcaccgagagcgggaagggcctcggatgctcgacaccatcggcttgatgtccatcagcgagaccctgtcggagtacatgctctacctcctcgtcaggcaaccggagatgctgtcggccaccgccggcatcggcctactccgctaccgggacacgtgcgccgaggcgcgccgcttcttcaagtcggcggaggcgtgggaccccaaccacgacgacgcccgccggatgctgctttccgtcaacacgtccaagaagccggccgatgtgaagggcgaccggagcaagtcggtgctgttcgacgcctgcatcctggccaaggtgctccgggagctggacgacgacaccatgtggagggtggtggccggagtgtggagggagatgctgacttacgcggccggcaagtgccaggggagcacacacgtgcgccagctcagccgtggcggcgagctcatcaccatggcatggttcctcatggcgcacatggggataggcgacgtgtatcggatcggcgagctggccggtgactccaaggccaagctcatcatccatgatcaatagctagctagccatactcaatagctcatcgacgtccaatcttcaccaagaaataatatagacacgtacctcaaattgctagcagaataagagcataaattattaattactagggcaatgtgcggagcaaaagatttagcgagaatattgagctgattaagactattggtactatgcatagtacgtgttttccttaagtgtaaatattgctgcctgcccctacttaatatagcaccagcaattgttgtcttggattcaaaaaaaaagtatatgtagttttgtgaaagattgaataaagtatgagtagtttgtgaaatttactcataaattcactagggctatgtgtgtggagcgaaagatttagcgagaatataatattggattgattgagacagttggccgcgctatccaagcatagtgcagctcaccttggtattatagtgttttccttgagtttctgcctacaagccttgcttgcactttaatttgtaatatattgctgcccctatttaatatagcaccagcaattgttagcttggattaaaaatatatatatatatatatatgtagttttgtgaaagattgattaaagtatatatatatatatatatatatatatatatatatatatatatatgtagtttgtgaaatttactcatatataattaagttattaaattatttgtgtttttctatgtttaaatggagcttgttaattagtttataaagtgatgtatgacaccaaaatatatgtggtcaaatgtttgtctattttgttttcaaaaatattttgatggcgtgcatgaaaacagagccctagctcaagcctctgaaaaggggtggcacaacattttgtagcgaacacgattgaatagcatctgtgtggtgtactcaactatgtaggccaaaaaagaaagacatctcaaacaaaaagtgaaaaaaaagactgaagcaaccaaaaggtacttcctccgtttcaggttaattatgagatgttttaactttggtcaacgtcaaactgcttcaagttttactatagacaatttaagtaatatttacattaccaaattacttttattaaattagtaattaaatatattttttataataaatttatcttaagtcaaaaagattactatttttttttctataaacttggttaaatttgaagcagtttgacttctttgaccaaagtcaaaaatatcttatattataacctgaaacggtgggagtacttacgtaggcctctctgtgatgtgagtgtgatatgcaaattagcctacgtacgtgcgacatgcataacatacacgcattgcatttgcatgcatgctacatagctatcgcttgcatttcactccacgaatgagtatatttcctgtgcaaaagagtacttgaagttataccttacgaatgggtaacaaagacaattactgagtcacatatcaatgcacaagcaaacaatatcaaatttaattaacatagagagaaaaaacataataaatcattctttttcaaaacatagtacaagtattaattatgcactcctatacacttacgcacacccactaatataatataaacatacacgtacaccatacacctccgaagaccttcgatatatctgagatagataaaatcatcaacacaagtgtcgacgtttgatgtcgcgattccggtatttacatagtatggggatcgttggtactaggatatacgcgggactgaggtaaaagagacggaggcgaggatttttatacatgttcgggccactgaattgtcgggtaataaccctacatcctgttggccgaagccggtcgttgctcttattcaccataatcacacaagtacaatatttagggtagcctatctaactattgtcgacatagcggtctgaaggtctgactcgtagtcgacaacagggtagtcttcctcctcgagttcgtgcccgacgagatcagagatagtgctttcatctctcctgacagtatccggagacaccgtaggggactagccgtgcctatctctgaagtcgatatccggcgtcttgtcttggcgtatgtaggcttgtattggcttatggctttgtggcatctatgttgtccgtagattgtggtgggtgttgattgtattggttctccccctctcctcctaggggccttgtatttatacccatagatgtcctcttgtccaagtagaactagggaaaccaatatggatacaatccgagtagtccttgtcgttttcatgtataactctggttgtctttccttatccggaactcatcctatatccgcagtttgtttccatataggacatggtatgtggtgggtcctgccgagatttagtcaactactattaggtatgtggtatccataaccctgacagtagcccccgacttcaatgcaaatgaacaaattcatattctcaaccgcagaccttggagtaactgttatcgagctcacgtgaccgttctcggtgagttcagagataacgttagacttcctttattagcctcgtgcgggcacctaaagggtttgtctgagtcaaatctccgtcgtcaaccaaaaaagtatagagcatacgactaagtctcccatcttgctgtaatcgagaatttagattgaagtcaagaaattttatctcggcgggtacaccatctcttcattccgtaatccttgtcgagatccactaaccgttctcgagtgatcgagaaggcgcagaatctgcgacggagccttgtcaacatttgttgtactcgccttagtcgatcttggtgtagaaccatagagacatgaagtcttcaacaatgtcgaatagaattttcctgaaatcaatactcagaaaaaaatattagatagaaatagcccccgagcgaatgctcaaagggtgacatgttataatatgtatgaaaaattgaaaatgaattaaacttacagaccaatgttttgtatatgagcgtcttctcttttaccgacttcgatcagtcagtttgttgagtcatacactctccttagcccctagccttgtcgtcggagaatcgttctcggaggataaggctcttagaccttcgacctgcctcggttgaataagcactgatcctaacccccagccgtgaagttggaaagtccatttccaattacacggcttggttaatacgcatggcgagaactcttacacgaccagatcttacatggtctttcgtctctacaggatccgacaaggccttatccgctctgggcgtccccagccgaagttcccttaggttcctcaaaggccttgtcaggacggcgtaaagggacatgaggatatgtttcaactataggtgccgtcgtggtaagggatctctgggtaaaacacttggcgatattgtgtaccagataccaactttgttgaggtacaggtagtgggagaatcgctgcacctctggtcaaggactaggtagtagtcataactcgatcacttgaagtagaaatagtgggagattgctacggtttactggttcgagaaccaacgcgtagaattatctctcgagcaccaacggaagtcacggtgtgagggattgctacgggtttgctggttcgaggaccagcgcgtagaattatctctctagcaccaacggaagtcgcggtgtgagggattgctacaggtttgctggttcgaggaccagcgcgtagaattatctctcgagcaccaacggaagtcgcggtgtgagggattgctacgggtttgctggttcgaggaccagcgcgtagaattatctctcgagcaccaacggaagtcgcggtgtgagagattgctacgggtttgctggttcgagaaccagcgcgtagaattatctctcgagcaccaatggaagtcgcggtgtgagagattgctacgggtttacgggtttactggttcgaggaccagcacgtagaattatccctctagcaccaatggaagtcgcggtgtgagagattgctacgggtttgctggttcgaggaccagcgcgtagaattatctttctagcaccaatggaagtcgcggtgtgagagattgctacgggtttgctggtttggggaccagcgcgtagaattatctctcgagcaccaatggaagttgctagagttggtttattacatgtgtatctcatgtggccagcatgactcacatacccaactcgtagcatatccggatgtccgtccgcgatcatgtcgggtgatcaagccgacatcgttcgcgagcaattatcctttaacagccttttcccgagtagtccagccatggccggtgctatgagataggttgtcggtcttcgttggtaggttgggagcgacgactatgcatttgtcaagaacgttctcgacaatacggtgtactcgaccacatcctactcgagtgctcaattgttcctgaaaaatattgtctagaaggcaagacatatagcagataatatcgagtatgtactcaaaaaactgcatggatcttctagtactatctggatgtaacgagcagatgtaaatatcaggcattatatagaccggaaacaagcatgatttatacagaagaaaatagagcgagcccccagtgttagaccgtagtcgatttaacatcggggacactcgcgcaacagatattgtataaaaaaacatgctctaggtaaacataacagattatagatctgacaattctgtatgatctgaataggtacgataaattgcatataaaatattgcgtacctttgtagatacataccggatgtatctacgaaattagtagattaatttaaaaaaacaatctaccaattaccttgtagcgtactcgttcgacatcacatgatctgacatcttttggtacgccgcgtatcttgaggctcggtcgatctcgagagatcgagttgttgatgacgatggttccgatctcgtcgagagacatccccacggcgaagttgtcgagtagcttattgtcggagaatccatcttttgaacccatcttgtcaaaatcctgaagcaccaaaatccccctacctggcacgccactgtcgacgtttgatgtcgcaattccggtatttgcatagtatggggatcgttggtactaggatatacgcgagactgaggtaaaagagacggaggcgaggatttttatacatgttcgggccactgaattgtcaggtaataaccctatatcctgttggccgaagccggtcgttgctcttattcaccataatcacacaagtacaatatttgaggtagcctatctaactgttgtcgacatggcggtctgaaggtctgactcgtagtcgacaacagggtagtcttcctcctcgagttcgtgcccgacgagatcagagatagtgctttcgtctctcctgacagtatccgaagacaccataggagactagccgtgcctatctctgaagtcgatatccagcgtcttgtcttggcgtatgtaggcttgtattggcttacggctttgtggcatctatgttgtccgtagattggggtgggtgttgattgtattggggcttccccttttcttcctaggggccttgtatttatacccataaatgtcctcttgtccaagtagaagtagggaaaccaatatggatacaatccgagtagtctttgtcgttttcatgtagaactctggttgtctttctttatccggaactcatcctatatccgcaggttgtttccgtataggacatggtacgtggtgggtcctgccgagatttagtcaactactattaggtatgtggtatccataactctgacaacaagtatctcatagtcgacagatccaagtctaccacttacaaaataattagccgtaaatatgatcacacctataaatccaatatttagatcacatccgtacaacaaataaggatgcattctcaaaggctcgaattctaattaaaaaaaattgaaggtagaggcgtccctacattttttaagaataaattgcaagcgtgttggggattgaacatggaatgaaaccgcacacaaattccaattccattcgtggccaggctcgacggcaacggcccacgggatctagagttggcgacccacctcttcgtcgacctccgtccaccctcccgccggcgatggaggatggacacgacaatggcttcgtggagctcgattttcatttctttttcaaaatctggatccgatttctattttttttaatccaaaaaatgttttcactggcggttgtctttatcttgccgcggttatcttagcatgcctcctgttaaactcgattttcgctagcagctagctggccgctagtaaaaaaacattattttcactggcctttggtcattggcggtgccgttggccgctagtgaaaatccattttagccgtcagcgaaaatgattttttagtattgggtgagaaaatatctgtttgggtgtgagcatgagctcaccgatttttaaaatattgtgtcacgtaagattaaaaccactttgattgaaaagggggtaattcgtctggtttgaagagtttaatttaaggtgtaacatgtttggtatttgtattgaaaggggtattttaggctgttgtttgcttaagacaagtatcatcatgttgtttgcttactagatgtttatcttttgaggaggacatgtgcatggctgtcgatccaacgatcatcaaattcaaaagtcataagcatgatggtttcaaagggtcttgtcaacatggatcaacctttaagagcactcatagtggctagaccatctgacagctgctgcatgccctttaccgagcagggaatccatccaacttcgattctcatgtgctccttgccttttgctgctagctactccctccgtccaatatatctctagtcgtaggttgctatattctgggacggagggagtatctatctctctcatccgtcctaagaggatatcacagatagatcgatgagcattcaagtttacaacggataagtctgttatccaaagtacatactctccccgtctaaaaaaaagacaaaccctgagtttccgtgtccaacgtttgaccgtccgttttatttgaaaaaattatgaaaaaaaattaaaaagacaagtcacgcataaaatattaatcatattttatcatgtaacaacaatgaaaatactaattataaaaaatttcatataagacggacagtcaaatgttggacacggaaacctatgatttatctttttttttaacggagggagtatatatgctgttttgatctgttcgcgatgaaaatactacttatgatgctgaaagaattacatgtttccctagtcatgtttgttgtcctggtcgtgatataaaagacaagtaagagaaaaaaaagttccttacatacgtaaccatgcattgatacatgtcattggatttcttctatattaattcctaagaaggaagaagataagggagggtgaaagaaagaagatgaacttgatggggtgggtctcatgtatagatggtaaaaaaaaatgaaaaacgtgacggcgatgatatgggtttaattttgcaaattttgatatttatctgaatagttatatttgcaatgatacggatcaaattaaccaattaacaaaaggagagaaaaggtcgtccaaaacctccgttaaaatagtccgacaacaccaccaccattaactaaaggagagggcaaagtcgtccataaccttcgctacaatagtccaacaataggtattgtcaacaaccgtatagagcatttcaactacaagtattatagaactagagtgagttctgaagatgttacaaaattgctatgttttgacttcttttttcagcccttgattaaagctaatttttttttacagttatacttccatatgcaaaatccgattaagcaccctttgatcaatgttgcttaggtatgaccatacttactacttccatatccaaaatatatgatataccgttcgactttattaaaggacgataatcctaccatatgaattttatgttttgcaaactaaatattgatgaataatgttttaaaattttgacataataaagtcaacaacaccatatatttgaatacggaggaagtatttacaatgtcatatactcctatttatgaacgatgacagtatttttactacaaaaggagtgacatataacatattttcctctgtttcaattgacaagctggtgtgcaagttgcatagtgggagccaaaatatattcgcgtgtcccctgtgtgtagagatatggcatgaataatgagcgaaaggaatgtatatatagttggtggtacggtgtacgtaggtagggatcgatcgtgtccattgctggaatataatctcattatcaatcaactcgaggttcttcttcttcttttttttttacacatctcgatcccgattctgcggtgagctatatatattttttcacttgcgtggattacaaattattattcttccttcttcaattatccacggtccatgcgtgcgtacgtatacggccataattatgtactcccttcgtattttaatgtacgacgccgttgactattttaacaaacgtttgacctttcgttttattaaaaaaaaattatgtaattatatttattttattgtgacttgatttatcatgaaatgttctttacgcatgacataagtatttttatatttatataaaatttttgaataagacgagtggtcaaacgttggttaaaaagtcaacggcgtcatatattaaaatatggagggagtatcagctaagtacatataattaattaattagtacgtatatttgtacctatgtgtttgacttattagactggcttggtagagtatagtgcgcaagtttggcgaggaaattttcctggttattaattaggggaaccaaacctattcccttggccctaattggacctactagctagcaaacatatccgcgtacaaattaaatatccgagagaatggtttttttttctctctctcccgatatgtcagtgtcaagagaagagttatagacgtacaaagcatctaattaatttcccgataaatgttaaggggaaattaacaaaagccgcaccattgatcttgagcagtgttgtctttatcaagagagatacacacaagtacgtcaagctagcaaagatacctaattgagaaatgccatacggccataccgtaccattgatcctgagagttctgtcttcatccctaaatatttgacaccattagtttttttaaacatgtttgaccattcgtcttattccaaaacttttgtgaatatatattattaaaaacttgagtagtgtagtatatttaataataaattaaatgataggaaagaaaattaataattacttaaattttttaaataagatgaatgattaaatatgtttaaaaatttcaacgacgttaaatatttagagacggagggagtacgcagcgaagatcttgaatagtcctaattaactagtcactttcattgcagaattaacggaagggaaaggatatgcggaactgcagacagagaattttacacaaaacacctttttctgaaattgtatcgatagagatgctcatatacacgtgcaagcactataattatctgtcaatgtatacccgctagcttatcctaaatatacacctttaaaaatcttattcgtccaacatattttgagatcgatggaattattacaaattgccttggcttgtacttgaagtgattaggtaaactttttgtccaaaacaacaacaataattagagaactagctagtacacccatccaaaaggagagcgacactattattgcccatgaacacaaaatgaatatatggacgatgtcattttccaaagttgtgagttttttccatggcatatattgaagcgatgtcccatcgtctcgtggtggtattttaatttcaagctcgatgagatatattattggattaatgcgattattacatccacttttttctcctaaaaagggcaaatctttttgaaagatttaaagcaaacatatatattgaagttgattaatttcgtacagctagtctagctaagcatctgctatatatcattttgtcctaacaagcgaataactgaagagatgtgctagtgcactatacatatgatgtccttttctattctgtacaagattctgtttctaccttgggctttctctaaaaagccggatcaaagaaatgatatactccaagggtattgctagctctgtattgagagattatattgctcatgtaaatatatcctcgtgttgtttttctctttttcttacagctatttttctgccttgtaactccaatgattggatctaaggccttgtttagttaggaaaaattttagagtttcgttgtcacatcggatatacggatacacatttaaagtattaaatatagtctaataacaaaataaattacagattccgtcaggaaactactagacgaatgtattaagcctaattaatatgtcattagcaaatatttactgtaacaccacattgtcaaatcatggcgcaattaattttagaagatttgtctcgcaatttacatgcaaatttatgtaagtgggttttttcctacatttaataccctatacatgtgtccaaacattcgatacgtcagcgtgaattttttttaactaaacagggcctaataaaaaacagaaaaaaaaagggaggaaaaaaaaacaaaaccgttgcatcaagagtgaagagccctatagtgctagttgtggatggagtcgacagagtacactagcggtagttggctttgttggctccatttactacaactagtcttccaataggccaatgtatatatgcagacaaaagaagctgtggtgggccggctagctactcatcatcatagacaacacatccataaataagctacagtagtgcgttatggtctccacctgtgactgatttgagaaagatgctacaaacaacaataataatttcaattaagttaggagtagctagcaaacccgtgcattattattaattcatgcatgtccaagtccaaccatggagtagaaccaagggaaatgtggtgacacgtttcactacttttggcaaataattatatttctagcatgaactagcactagcggtatatatgtatgtagctgtcatgcattgccatgaaaaatacatgcatatttatatggaggactactatacaaataagtatatcatatttccaaagagaatctatatggatcggcccaataaaggatagaagaaatccaggcccacacacagctagagcctagcatgcaatggccaatcgctgtcttttcctcctcctcgttgcccatcagattcccaagaattttcagattgtcctgttctatattttcccaaataagtttaagaaagatcgctccagacatgcagcaacaaatggagttatgaagtggttggattgggagaatagcactctagaaatacttatatttacaggataattttcaaatgctagaaatgcttacatagtttcaacttattgcacttatgtaatggaatctttacatatttcagttaaaaataaaaagaagctacaaaagctaactgctctcctttcaccagcttgaccatttagctgctccgactgtcccatacctgcacagtcctacgtcatcttgctcctagttttttccccttattatgctaacttacagcttttaattatctactctggttggttagcaataacctctttctaaatggaacttagcaataacattgtgcacgatgagcctcattttctttttgaaaaaagaagaagagagaattaactaccgtgcaccgtaatatcggatctatatatcctgctctagctcttattgttagcttagtgatgctacacatctatcgtccttaattgtttttttttctccatttcgttcactctaactccctaaggagtgggtatatatgtatggtgatggtggctagaagggctcaagggctgagaatggcggtaaatgtgacctgacgactatgccaatatacttcaatttagggctttctttgaaataaacactactgaaaaactgatctttcctgggtcgacccaaatataatctttagtcctggtttatcccctgtcagtagcctgtcaggagccgaggatcgggactaaagatcactactttagtgatcttgattatctttagtccaattgaatgcatggtatataatccctctcccttaccctctccaccacaaccggtcccctcacacttatcctctcctccacaaccggcctctcctctcctcagatcgatcccttcctcctcccctcccctatcctccgcccccctcctccccttcctcctcccatccccggctttctccccctccacccctcccatccggtgccagtagccggcggggccgcgcccgtggtgagtggcgagaggtggcaggtggcagccgctaccaacatcctttctctttttcttttgttttttttttacaatttgtgatttacttagatgtatagttttgtgattcgttgtatggatctgagatatataatctgtgatgtatttgatttgtgtgtaatttttttaagatttgtgatgtatttgatttgtgtgtataagtaacttaagatttgtgatgtgaatgttttgggatgttactttgatttgggatttggggtttgatttggggatatgcatcccactcgatttgggagaaaatacagggattaaactcctaaagaaacaatgaaaaaaaaaagaaaaaagagacttactgggactgtcgctaccctctttttagtcccggttggtactaaagatacattctctctagtcgcggcaaccgggattaaagatggatctttagtcccggttatttcaaccaggactaaagatgagcatctttagtcccggattcctagtcccggttgaaaaatcgggactaaaggggttaccaactgggactataaacggtttctccaccagtaaaaggaaattcataggaaattttgagggatcaaattctttgaaaaaaaattcctatagtatcctttggaacaaaggaacatgattgcaaaattcctatggattacttccctacacccacattccatagaaaatttaacatgagctgcatacagcatacctcatgttttattttcctataagtccccactgtaaattctatcttcctctctcttctctctctctcctccacaaagaatttcctgtaaaattcctgtgttacaattcccatgcaccatccaaagacatcacttatatttttaccctgttttaaaatcctagagcattgcgtagcatgtgacaaactatttttacattttaaaaatcatgtgttccaaaggagctagcacttatattttcctttgatggacggatatggctattgtaggcttctaaaatatattactactccctctattcatgattatatgcttgttttaatttaaataaacattaagactaaacttttaccattaacttctcctacaatatatttatagtatctacaaaattataaaactaatattgtacgaaattaccttaattaggtatgaatctaatggcacaaatcatatatatatatacaataatgcgcacttgaaatgctaaacagtgtatttttttctaaaactttctatatcaaagctattcttttaaatcaaataaaatcaattctttcaagtatatagtagttaatacttaattaataatgtgctaattatctatagtgttttccgagctggtgagtagctaaaccaatcagctccatagaactcacctaaatatacttacatgttacttcctctcttttatactattataagtcattttgacttttttctagttgattttttttaggtttgactaaatttaaagaaaaaaatagcaacatttccagcaccaaattagtttcactaaatatagcattgaatatattttaataatgtgttttttgaaaaatattgctatatttttctataaaaagtttgactagaaaaaaaatcaaaacgacttataataagaaatagagggagtaactagctaattattggtcaaaatctttcaagtatggctttctagaatcaaaatatatacaattccttccgtcctataatattgcaacatacgatcggataggacacattctagttcttcgaatctggacatttgattttatgttgctacattgtgggaccgagagagtgtgtacgcggtaaaagtgaacggagagagtatctcttgtgccgttaacgttgtgcgatattttttaagcatcactagcaagctactgaagtcctgaagctagctactctctagctgctaatggcagtagcaatatatagctggttagacatcactagcaagcgtcatgtcgcctcttgacagctttattttatcaattgacagctttattttctttgcttgatctcatcatattattgatgaaataaactaattaatgctattaatttcgtctttcaagtcaacatcaaaattaagaatccttcggaaagatcaccacacgggaaaagccatgcagtgcacattttgctctccgtccatataaaccaatagtatctacatatccttggaaatttctatagaataaaactaaacatgttgacttttcacttatttttcaacaataatatatttccccttccactatggtcgtcgcttgtacgtgactataataggtcctgttagaaacgctagaaatgttgagaagcaaatgatgaatagccaactggtgagaatctagaaaagtgtgtttttacttataactttatagagtagaaaaaatgcccgtgcattgcaacagtaaaaatatttttttatcctatacattatactcccttggttttggaccaaatgcttccttggttttggactgaacgctcattccttcttcattttcagctctagtcatagcccagtccgctgcctccctctgctcaacctacctctctttggctcagcgcgcccacaagtagagctgtaagcccaactcgaatagtcccgtgcctgtaccatgacggagcctatcctctcatcaaatccgataatccagtcgagctcgcatagtcctgtgcccgtaccatggcggagcctatccttccatcaattctgataatccgatcgagctagtcctgtgcccgtaccatgacggagccgatcctctccattcaaagggaatatgatgagagagtagtggggaatcggtttttgcaatcaattagaggaggaaacgcatggagagacaaatcgacgtggcggtggcgctagggttcagcccgacgaaaaaaccacgaaaaaaatagagacaaaagaaagaaacccgaaaaccggtgaaagaaaaaaaagagggaacagtgaaaagaaaagaaaaaaaaggaaaacggtgaaaaataaaataaaacggaaaaagatgggaaaaaagaaaaacaggcgaaaattataggtggaagcatatgtattttttattaggtatagatttctagattctatagcttttgatccttgtaatctagatgaaaagcttacgggcctctttgatttagaggataaacataggaattttggagaattttaatcctatataaaaaaattatataaatacatttgaaacaaaagattgaatcctatcatatcctatcctattaaagtcctatggaatgaacaattctacagagattttggcggaaatttagcaagagcttcaacctcttggaaattttcctttgagtctatctctcttatccgattcgtactttttcctatggtttaatcaaatggttatttctaagatttcctgtgttttacaatcctctgttatgcacgaactccaagaagttatgtgttataaggttcacatcctctgttagtagttgactgtactattaaactataccattaatagcatagccaactattaacttcacatcatctatcaaaaactctctaaaagacagggccacatactcagggggtgtttagatccaggggtgtaaagttttggcgtgtcatatcggatattatatagggtgtcgcatggggtgtttgacactaataaaaaaactaattacagaatccgtcagtaaaccgcgagacaaatttattaagcctaattaatcagtcattagcaaaggtttactgtagtaccacattgtcaaatcatgtagcaattaggcttaaaagatttgtctcgcaaattagtcgcaatctgtgcaattagttattttttagcctatgtttaatacctcatgcatgtgttcgatatgacggggtgtaaaattttgggtgggatctaaacatggcctcattaaaaccaaccattgacaaggtctagtgtggatgtaaagtgtgtaaactagagtgctctgtatgtaaagatgactaattttatactccctccgttccaaaataagtgcagttttagcattgttcatgtccaacgtttgactgtttgtcttatttgaaatttttttataattactacttttattgttattagatgataaaacatgaatagtactttatgtgtgactaattttttttaatatttttcataattttttcaaataagacgggtggtcaaaacaatgaacacggatatctatggctgaacttattttgagacggaggtagtacaattattgtattgggtatatatatcatttgtgcaactactagtatacatacgtagtactccctccgtcccatagtgttgcaaccta

SEQ ID NO: 80132 - DNA, 2668 bp, Oryza sativa
cctcggtgggcggcggctagggctagggctaaaacaaaaaaaaatgaatggaaaaacagggggtgttctaacttatataggagagggcagaactaaaggaggtgcggccggtgggaggcacgacagagggggagagggagtcggactcagataggggaagagagggaggcgcgtgcacggcaaagggagagggggagcggcggccgatttggaggggacaggaggagaaaaaaaaagaaaaggattaggatagggaatttcccaaattggaaaagtatatatttatagcatagtaggagtctctcatgctgttttgtggcgaccccaaaaccctcgtgggtccggaggccacagtactatacctgtgtaacatgcaccagccccaggatacacaacctggtacacacagaacatcggtgatccaaagaagtctaataatattacattgctgggatagtccttacataagttgccatcgtggacagaccccagatggacaacgacacgacacagaagataataacaaaagcgacaacaacggagtggaagcgaacagcggaaggcgacttaacgactaaatgctagtctaggcacctatgcgactaacttattccacaggcatggtttgggaactaggcccgaaaccctaaaagtcttcatagttggcgtgctcctgaagatactcctcggcggttggatcatatccttcttcttcatcttcaaagcctaatataattatatataaagcaagggtgagtactttcgtactcagcaagccataggaaagatgacatgtgcggctaccaaaggaggataagggttttatttgcgaaaactagccattgctcaaaaggtttctttttgcaaaactctagtgtgtcaagttttaattatcggaaagaggctcatgcctcaatccattccacaagttgctttgtaacaacttgtcacaagtaattagtgaatatatgttcttctaccaacaccttagatcttctcttgcttctccaacttttgcacttgtctccacttgacttctccacgagccgtctcaactcagagcacaatgagccgtctcagctcagaacaccacgagagcaccacaagccgtctcagctcagaacacctctcgaccaaacagtccaactcctattcacactatgatgccaatcgacattccagatcacacggacctgttccaaaccactcaggtttgccgtctgccacacaggctgagtctggaaacgatccccatcccacaaaccaatttcacaaacgtttacaaacaacactacgctaagagaatcaccttacattcgcccttaatcatgggcacggctattcgaacagtttaattaaactctgcagaggttgtacgctttacccacacgacacgaactgacaccggtcacccgtcggcaccgggagttcgctacaaggtttttccaaagctggtccattaaaaatccctataccacatagtaggccgagtctcatgacaagcatcaggcagtctcagccctcgtctactcagggtacactagggacgctcctacacctcatcggtaccgtatcgccacaatagaggcggggccactcacgaccatagatctcatcaaacacacacaacttcgtctcctcatctccagtgtcccactactactggcatacaagataatcaaggactaactaagtactttttcaggggtatcccataatacccgtgtggtcgcatagtaagatgcttggatggaattcccaaaggaatcggtccttaatgacaatacatagccagccacacaggcttagcctacatgccatcagggtttgagaactagttttgcttcgcaaacacaccgacactgaccatcaggtttttgaatagttgattggaattccaagtttcccacacgacaatacattcgtggcatggctaagccaaactaccttgatgctcatacccataaggtaagacgtcgacgcgtaatatgtgaagctatcaaggacatgtcatccaatatccaacagaatataagtgtgactaatcggtaggtccatcggatgcgttcgcaaaccgaggccgaacagtttaacgtgcaacctaagcatgcacatttacaaacaacataattttgcacatataggaagcaatatggtcaaaggtggcttgccttggtcctgtggaggttcttcctcgacgagaacagcttccggatcgtccgcgggatcggcaactatacgcgaaagagaaaaaaacacaagagctaataaagtagctcaaacaataagatactatactgccattagatagatctcatttttagaaaaatcatggaagtggaacggagtcaatcggagtcacggtttaggatatatgaattttcaaagattatatgaatttatgggcaaggggaaaagggatttcttctattaaaaaggaatactccgagggaatatccttgcgtggcccgctgtcagtgacacgggaggagccggcgcacggcggacagtgtccacaggggcgcgacacagagaggtggtggactgggctcgtggtccaccggccggtgcgcgtggggcccagccgtcatagagccggctcacatggaccgagtgtacacacgggtgcaccgagttggatggatacggtgggacccgtatgtcatta

SEQ ID NO: 80133 - DNA, 3843 bp, Oryza sativa
cctagaagttcaaagtgtatttaatggaatttgattcgggaatttggaattggattcaaagattgtaatggactataaaagggactgtagactttggtattctgggagttatttgtggacttggaatgagagatttgagatctttaatggcacatacactaatattcaaataagaaccaaattttgaaaatagttttgtatgtaaaataggtttttaaaagaaacggaaaatcaggatgttacaaacataccccccttaaaagaatctcgtcccgagattccgctgctaggagaacagctctaggtgctcagctcaaagacgatcttcgcgttcccatgtggcttcatcttctgagtgattactccattgcaccttataaaactttatggtcttccttcttgtacaatggtcctttccttcgagaatccgaatcggttgttccttgtaagtcagatcgtcttgtacgctgattgcctctaagggaacttgctcttctgggatgcggagacatttcttcagttgagacacgtggaacacgttgtggacatctgtcagtcctacgggtagatccaattggaaggcaacttctccacgtctggcgatgatgtgatatggaccaatgaaacgtggtgccaatttccctgccataccgaatcttttcgttccacgtagggtgatacccgaaggtacacgtggtctccttcttgaaactcaagatcccttttgcgattatccgcatagtcttctggctggactgggccactttcaaacgttctcgaataatcttaatttgttcttcggcttccttcagaatatctggtccgaatatcttcttctcatccacatctgtccaacagagcggggtgcgacacttgcgtccatacagggcttcattggaggccatttgtatactggcctgataactgttgttgtaggagaactctccatacggtaaacagaggtcccaagtacctgcgaaatccaatgcacaggctctcaacatatcttccaatacttgattcactctttcagtctgtccatctgtctgaggatgataagctgtgctgaaattaagattggtgcccattgcttcatgtaacttcttccagaagtgggaggtgaactgagtaccacgatcagatacaatcttcttcggggcaccatgccaacaaactacgttggtcatatacaactcagctagcttcttacctgaattggttgtcttgcagggataaagtgggcaactttggttagtcgatccactattacccacatggagtcataacctgcaggtgttctaggcaatccggttatgaaatccattcctatttcttcccacttccattctgggattttcaagggttggagcaatccagctggcttctggtgctctaccttaaccctttgacatatatcacataaggcaacatactcaacaatatcccgcttcattccagaccaccaataatatggcttgatatctaggtacatctttgtacttccggggtggatggaatatgcggattcatgggcttctctgagtatcaggtcttttaattccttcttgttgggtacgcaaatgcgtttaccgaacaaaacaactcctttttcatcaatggaaaagcttatggctttatctttcttcatattttccttgatagtattgatttcttcatcactttcttgagcttctctaatttgatcttctagggttggctgaaccacttaggtcgctagggttcccggcttgaccaggtttattcccatcttttccaattgttgacggtcgttatcgatcagtttcgaccgtcaatactaccaaaataaaggagaactagtgatgcttgcaatgcataaatttgttagaacaataatattccactagtattaggtctactaaccttttgcagagaatgacaataaagtgaaggagaaatgctacagtggtatgttcgtgcgcttgcggatgaaatctgtaaccataatataccagaagtatttctgcgccattactgggaattatatttctagtaatgtcgttaagaaataccaacaaccacacaaacatgatacaaaagacacatctttattatatcgataatatttacattattacaaattcacttcaggcctgacaatcaaaaataaacagcagcggactagcgggcctacggctccatcttcaaaggcgctcaactagggtataagccaggactccacctaggacttcttctcaaagcttctcttactgaacggggggaaagatagagcaagaatgaatacaaccacagtacttagcaagtcacaccgggagatgcatgattaatgcaagggggtacaaggggtaataataggggttaggttttgcagtaaacaacatttgaaagacacttagttgcccaaagctattttgtaaaaacgatcctagagctacacaatattattaatcaaggccgtgaacccacatgaacctgcctaacccaaggcttacgatgattcaaaccgaactggcaatccgacctgggtcctagctcgtcccaagccaacccaggccaaccattccacattttagttgttaagcaagttttaagagttaaaccactaacttgggtacattgctaggcttgcccataaccgagagcgcggttattcgaatagattatactctgattagaggtgtacatctttacccacaaaacacatctttactctgcattccaaggccttggaacgcgtcgtaaacatgtcacataacccttcacccatgctagccgtgaacaaaagtaccgacccaaccttgcctacggccggtatcccgggacaggcaggccaggattgagcccctagcaacaggacctagaccgggtgcaccacacacataggggtgagaccacctgcgtactagtctagtgccacgacatctcgactaacggacaccggcccgtgtagccttcatttgcctagacatctcgattaccgagccgtaactcgcgtagccttcatttgccttagagatatccatcgttgcaacgacttcatccatctctatccgtgtccttttgttcaggactagactgagcaccgagttaagccttacccattagacatgtggttagtacggtagtgctttgcaaccgtactttgtagcagaggcccgaagaccggtccttatggtagccgaggtgcttctagcaaaaccatgcacctcgagcccagcctaaaaccattttgggagttttgaatagagggggaaggtgtgtgttcaattccatcacaagccaaccattccataatgtccaaatgatatgagaactcccaaagtctaaagttataaaaccatctagtgttgcctaattaatcagcgaagcatctacctaaattcatactagtggaaccattaatagagtacccactagttggggttttgttttcctagggtaagcaaggtgataataaacaatagcaatgatacggctataacaaggattgatagatattgctaaataaaaccatgataacgcgggaatttaaataaagcggtaatgcaataatttaaatcaaaatagttttataaactaggattcaatatgctcaagggtgatgcgacttgccttgctcagagagaacagccttccgaaccttcggcaacgaccacgaactgcgctttgagaaccttcaaaacgatagaagctacgcgaagcaccaagcaaagctacaagcctaaaaagaagcaataccaatacataaaaagaaagcacaaggttctttaggttataacaaacattaagagacttgaacgggtcgattcagagttcgtatgaccaagatatgatcatccaaag

SEQ ID NO: 80134 - DNA, 6835 bp, Oryza sativa
tatttaagaagctcactctcttcatttcaatacacacctcaagcaagagctctctcattcctctcaagtttagtttagtagtatctagctggtgaatagaattagaataggaatcaggagtccgaagccttcggaagagttcgggtatggctctagtagctttcctttcctcttttgtaagctttgtacttttattagaatactcttctaaatacatttatggtactgggatacttcccaagtatatgagtacctactttacattatgttcatgttatactgagtatactgctagcttatctgggagatgctttggtgcggttatagtgtttgctgatgcaattactctatgtcatgacgatgatattagagtagtatctggtagtttagacgtggtgtctagattacgggatatcattatttggggttatatattgcggatgagaggtgggccactgatggtgacagctcagtacgggtattcctccgcgcctatatataatcctaagttattttcctggggagggtattccttcgtatttagcctcggttggatggttatgacgggctgtcgtaaggaactcggtagtcagggatggcttctcgaagtaccaggagggtatcggatagagggtattagctagtaaaccagttaactagaatgtatgtatactatgtatattagaagtataggaatagattctctttctcttttctttccacctagcttagattaattattatgaggatgagtagtaatgcttgtgtgtcactctacccttggattatcttaacccctgcttagaataagattatcacaagtaatatataagttaatagttgagttctctctatatgatcttcccacgggataaaataaatacgatacctttggaatactctcgggtgaaatgctacaatggtatatctgtgcgcttgcggatgaactctgtaaccataatataccagaagtatttctgcgccattgctgggaattatatttctagtaatgtcgttaagaaataccaacaaagctatgggtagttggagggtaaatggctggtttggagtttggatagcaggctggctggctagggtttcatttgattaagccgatatcgaggtaggacgaatattggctggacaaaatatagattttgaatttagatgaatttaggtccaacattcactggaatcggatttacggtttaggagatatgggctcctaaagaataggatttgaattaaatctagaaaatacggaaaggtactttttatgggcccacctgtcagtctttttcccttttctttttctttctcttcttcttcctcccgtctcttccttcttcttctcttccagcacaggcaaacagggaggatggggaggaggggcgccggtggtagagcggctaggaggtggcgactctggaggccagtggtgttcccgagcatcgcgcatcctgggagggtggtggccggcagagggagagaagggtatgtccggaacgggctaggggaaaagcttatctccggcggcaaggagaggtggtggtggtggcttatttcgaagggggaaaggaaggggaagtggggaaatgggtttgcctcgtcgaggcgaagctagtggcgcgagggttgtgccaatggggcaccggtgagggagatcgaccggtggcggcaatggccggatatggagaggagagagaaggagctcggagaactcgatggtgtggagggaaaagaggcgacctcgccagtatttataggcgtcggaggtcggttcttcaagcggttcgcagaggagaaagatgaggaggatacggcgccggtggagtggagaagaaggagacggcgccggctgtggcctgtgattggtcggcgacggtggcggcactactttgcggcgacggcaaggcagcggcttggcgtgggcggcaagttgacggtagcgacggcatgggaaagaggacgacggcgccggcttttgctttcttagcggcgacggaagggagttggcggcggcgtgcgcgtgtgcaacacgtgcaccagcaagaggaggaagggcggctcggctggaggctgggccgtcctaggccgaagaaggagatgggccaaaaggaacaatgagaggagtttcggcccaattacaaaaaggaagaagtctaatttgaataattgatttggattgctaggttttgcaaagaatttgaattcggagagaattcacaaaagagatatcttaatttatttgagtgcaatatttggaggtggagtttgagggaatttatttggaagcactcaaataggaagagaaactaataatattcctcaaaatatttttggtaatatacaagggaattaattgaggggaatagataggatttgaattctaaaattggtattatgtatatttgtggttaaaaggggaagttgagtgaagagtataaattggaattttcttagcacaagagcaattactcacaatatttgcaataatactattcttgtgtcgaagaggaaatcaagccacaaagattaaattggtggctagatccaaaggaggaatttggatatttggattgggaatcaaaggatgggtttaagatcaaaggatgggctaacaattaattccaataaaattggaattgctttggtttaggttttagcacaatataggaaggtttcttggaccaaattcataacagtaaaaagggtttttcaaactaaatttaaataaaggatgttttaggcgaaagaaggttttagattaaaaccaaatcaaggaatatttcaagataaaattttaaatgaaaatcacaaaggcttttgaatatcaaagagggattttatgtaggttagctttaggaggtctcgctaattataatgtcctaggtttaaagtggttattaaaaacataagacccgacatgatgcaagattagaaaatagtaaattttcagaatgttacattcagctacattttgtgagcaaagtcgatgcacgtattcaggggcggactgttggtattttttaatgatgttactagaaatataattcccagcaatggtgccaaaaatactcatggtatattatggttacagaattcatccgtaagcgcatggatataccattgtggcattttacctgagagtattcaagggtatcgtatttatttaatcccgtgggaagatcatggtagagagaacctgactaataatttatatattactcgtaataatcatagtctaagcaggggttaatataatccaagggtagagtgacacacaagtagggagctactcattctcataaaatatctaagctaagtggaaagaaaagaaaaagagaatctattcctatacttctagtatacatacatcctagttatccgatatactagctaataccctctatccgatgccctcttggtacttcgagaagccacccctgactgccgagttccttaggacaacacttcatgaccatacaaccaaggctaaataaggaggaataccctccccaggaaattaacttaggactatatatacgcacggaggaatacccgtactgagctgtcaccatcagcggcccacctctcatccgcagcatataaccccaaataatgatatcccgtagtctagacaccatgcctaaactaccagatactactctaatatcagcgtcatgacatagagtaattgcataagcaaacactatacacgtaccaaagtatctcccagataagctagcagtataattagcataagatgaacatattgtaaagttggcattcatatagtcgggaagtattccaataccataaatgtataaagaagaatattctaaataaagtacaaagcttacaaaagaggaaaggaaagctcctagagccatacccgaactcttccaaaggcttccagactgcgatttctactctattcctattccactagcttaagactactaaactaacttgagaaaatatgagagagttcttgcttgagatgcgtgagtgaagtgtggatgagagctccttttatagcctcccaatgacggttgtggcagttggaaaggtcggtaatacccaccaaccgtcattggggagccatcttagccgtccaagagaaacctggatcgaacggcgctgcgggggttcggccgaaccatgtgtcgggccggcctggcccaaaatcggcaggtggcctcctccgttgctctcctatgcagacttgtgaactttggcccaattggtcatgtgaattctgagttctttgcccattcatacataagtctgattctcgacatcgtccaattgatttattgtctgatttgatgtcgattctccttcactttatggttattctctacaaaaggttagtgaaccaaatactagtggaattttattattctaacatggatatgcattgcaagcatgactagttctcctctattttggtaatattgacgggcaaaactgatcgctaatgaccgtcgacaaaacccaccaagcttgaacctttgctcgtcccgagtaaaggatgaatggaacaaagacttggttgctgattaaggagtttctactatggtgtatatctcaaaggtacaagtgcaaggtatatatactctgtctctgattaaataatctttggcacggtggcttacccttacccctgattcccacgagacactgcttctcctttacttgggcggtggaaagatagaacagcaactagagcacaaatcacccaatctttattcaacttttattccagaagttttcaaatgattttgcaaaagaaagccaagttcctcatatgattaactcagtctctccaagtgtatcaatatgaattcctcaccatttttgcctttttgattcctactctaaggtttgatatgtggagctcggtagggatcaaacatggcatacttgcattcacatttattaccaaatcaaaaactcagactaaagaaaatgattaaacatactcaagatcaagatcgtgcaagtgtgtgtgtgatataccctgtttccacaacaaaagtgaaaataaccaaggttagcctacaaagggcagtgattatacagtggtaaatataaagtattagttctagtaatctctattatgaatcttcctcggcaacggctccagaaatgcttgttggtatttcttaacgacattactagaaatataattcccagcaatggcgccagaaacactcatggtatattatggttacagagttcatccgcaagcacatggatataccattgtagcatttcacccgagagtattccaagggtatcatatttatttaatcccgtggaaagatcatggtagagagaacctaactaataatttatatgttacttgtaataatcatagtctaagtaggggttaatataatccaagggtggagagacacacaagcagggagctactcattctcataaaatatctaagctaagtggaaagaaaagagaaagagaatctattcctatacttctagtatacatacatcctagttatccgatgtactagctaataccctctatccgatgccctcctggtatttcgagaagccacccctgactgccgagttccttacgacagcccgtcatgaccatacaaccggggctaaatacggaggagtaccctccctaggaaattaacttaggactatatacacgcgcggaataatacccatactgagctgtcaccatcagcggcccacctctcatccgcagcatataaccccaaataatggtatccgtagtctagacaccacgcctaaactaccagaaactactctaatatcatcgtcatgacatagagtaattgcataagcaaacactatacccgtaccaaagcatctcctacataagctagcagtataattagtataacatgaacataatgtaaagttagcattcatatactcgggaagtattccaatccccataaatgtataaagaagagtattctaaataaagtgcaaagctttcaaaaaaggaaaggaaagctactagagccatacccaaactcttccgaaggcttccggactgtgatttctcctctattcctgttccactcctttaagactactaacctaacttgagagaatatgagagagttcttgctgagtgaagtgaggttgagagctccttttatatcctcccaattgttggtatttcttagcaacactactggaaatataattcccaacaatggcactggaaataatcctggtatattatgattacagatatgatccgcaagcgcatggatataccattgtagcatttcatctgggagtattcgaagttatcgtatttattttatcccaagagaagatatgataagagagaactatactaacaattcatatattacttatatatgtcaaagtctatgcaggggtcagttcaaagggtagggtgacacacagaagaaagaactaagaaccactctcactaaaatatagtctaagaaaagtatcattcatgtacttctagtatacacacatctttagtctatacttgctagtatacagtcatgcaaccaatacctcgtacccagtgtcctcctggtgtttcgagaagccacccctgactgccgagttctttacaatagaccgtcataaccaaaaaaccgaggctaaatacggaggagtaccctccccaagaaattaacttaggactatatacacgcgcggaggaatacccgtactgagttgtcaccattagcggcccacctctcatccgtagcttataaccccaattaatggtatctaataatcgaagcaccacgcttacattactaaatactactcta

SEQ ID NO: 80135 - DNA, 24176 bp, Oryza sativa
agtcctatatatgtagcccatgctctcggggagagagagagacacagatagagagagagagagagagaggggccaattggtgttgcgatcgaggctaggtcaggtcatgacgcaatgcaaatgttatatggaatggatcagagtgatagaggagagagctgtcgagctgggattgcagcatctccagcgccaggagcaccagttgccgtaaacaacaccacacagtttttcccaccaaatataaaagatctttcttggcacagtgcgttcaacagttgcaagcaataatattattggctaattagtactgacttttattaatattcgcctattatacaattgataccacctccgatccattcctaaatatactgaccaatgtcatatgaaaaaagaatagagagagtagtaattaatgaactatatcagtgaacattgacagacaaaaataaaatcatactagccatactgtgcaaaaagcaccatatataatttgaaaacgaccggtatagtttacactcatatatactactccatccgtttcagtttataatgcattttgactttagtcaaagttaaactgttttaagtttaactaagtttgtagacaaatataataatatttataatactaaattaattagagtcatcaaattaacaattgaatatattttcataataaatttatcttggattgaaaagtcaaaacgtaatttgactttgaccaaagtcaaaacgtcttattataatggagtaactttgtaaatcacacttgagtgtattgcgtgatttcttaggatgctacgctatctcacaagcgacttacgtactataaattaatgcagtgaacatacttagagagttgaattttaccacgatttaatttcgatggactaattaaagaaaatctcaaggtttcgaaaacgacatggtacgtcgtgcgcgtatatgtaactatggaccatgtattcatatgcacgaattggtacaaaagggtgcacaaattctgcaataactgttggaaatgtatatatattcatacatatgtgtgtacactgctctctccatctctaaaataccttatactccctccatttcatattgtaagactttctagcattgtttatatttatatagatgttaatgaatttagacacacacacacacacacacacatatatatatatatatatatatatatatatatatatatattcattaacatatatatgaatgtggccaatgctaaaaattcttacattgtgaaacggatgaagtagtatttagctggtctcagatatattagtatggttgtgaaaagacgaatatgcacttcattaagattatatgcttctattatactacatgtttagctagacttttggcatgcccaagctctaacaaatgatttttgcacctaaatcgatttcaattaggtgggcgagagtggggtttaaccaatagagataaaataaggacaataaaaacagctagtggaccacatatctccacacgtctcttaaaaaaagatttattttacaactgaatttgaagataaggtattttgtaattgagaaagtaaataccaatatactccctccggttatttatatttatatttagcgttagaaaagttaaacttagttttcccatctttaaatatatatagtgaatggatcgtatcgtaaaaaaaaagacaaccggattatagttaaataattggccatgtattgatatggtgcaaattaacaaaatttcgcagtaatgattggccatgtattcatgtgtacatttatcaatatatcaataaaaaagacaagaggataataatagtaataataaagaaatggagaaaaggagtcgaggggttgggagttcgaccgtacgaggaggtagcatagcagcagaatcgaccccaagctttccttctcacgtaacatgccgttattatattatatatattaaaataattaatccaattattttttaccagattaatattaatgtaatccgtgtgtcagcaggcttgagaggctgcaggtgggccccatgattccgggaccaatcacagctcgacagcatactgacacccgtccccaaaagcaaagaggcctctctctctctctctcgccgatccctctcctcctcctcttcttcttcttccactagctagttcgtcttcctccttcagctagcttgtagcagctaaggttaggtcggatcgagatcgggatcggccgccggcgagcggcgagcggcgaggatggggcgggggaaggtgcagctgaagcggatagagaacaagatcaacaggcaggtgacgttctccaagaggaggaatggattgctgaagaaggcgcacgagatctccgtcctctgcgacgccgaggtcgccgccatcgtcttctcccccaagggcaagctctacgagtacgccactgactccaggtacacctatagcctgatcgattccttgccatttctggagcacctgagcccgcctgagatggatgaactcaataattctcctagctttttgccgtttctggccggccgcttccatggatttcagctgctgctctctgaatttgccatgtttggtttgtgcatctggttgcatgtgtgctacagctgatgattttatgcttcactagtgctgcaacacatgcaacacagtccaatccaagctagctcagctactccaggaggaggagtcagctgcatgcctcctcatttcgggaaatcatctctctctctttctattttttccctttcctttcttgtttcccctttttctttcctgctagcttgcttctctctctacaccctgcataccctttttgggattgatggccggttttaattaatttcccctcctttctttagttaattactaccctactactaattcatctcctcccgatcctctcaatttctcatcatatggagtactactaaaatatatatatgtagtacgcacttggtgtggccggtctttgttaacatcatgtgcttgcttaaattcaaggggattatatatataagaggatctactactaagtgtactttgtgattacatcagctatctatgtagctgatgatcttgctttggtcttttgctgatccattgagctagtgctaattctcatcacccttccatttgatgtactgcaaatagttttttattcattcgcttcttctccctcttccccatgtgatttgattgctagctccttcctgacttttatttgggttgatttcgtcacatcttcctctcaaattaatctcatgcgcgtgcctttgttctccacctgtcaagaaattaattaaagaatatatcacacgaattacgaggagtccaccaccagtgtcatgcactcctccctattgttcacagtcacagctgatgcatgcaaaacatcttctgtttctcaagtaattaattcccctcttcttgtgaggcttggcttaaaattactcaaacagctgtttttcttgcttatgcatcatcttcctcagataccaaaacgttggagatggacagatctggcctttcctcttcccttctctctcatcctcttctatgtttctgcctcttcttatgatgaatctttatttggtattattcacgttaagcatctctttaaagagccctagatcaaatttgatctatctcttttggtttaacttcatggccagttgcttgtgtgttttggtctagaacgaccacgtacgcgagatatttccttttctgctcagctgattaattaataatgatgggataattcactaattattctggagttagatcaagagatgtacttaaacatcctgtgacacgatgacttcaaaaaataatcttgctctctgtaaaatcacataatagctagccatcgcgcgtgtttcagaaaaataatttatcttgcttgctagcttttgctcaaaatgcgtttctgacgtctaggtaaagaggacttttacggtcgtctgtgttgtactggaacagtgccctgcacactccccagcgtcaagatcagtctaaggcgcttcatttctagctcagaaatcttcacttatttgatcttaattatagatcttcctgagatagatctaagggtgttccagtaaaacagaagaagtcaagttcttcaggatcctcgtgatataattaaactgtagtctcacaatcttactgatcatcaaggagtctgtaaacacctatacgtacggctataggattatggggaggttggtctaaaataaaggtgttaaattacttgcaattatcaagatgtgcaaatcatcacccagtaattcaatggtgctattatatatagtctgttttgaacagttccactggttttgttagggtccttgctgatggctgtttaacggtgctgttatatataatcttgattattttttttgctaaattttcctaagcaacccacttcaaattttggaatgggtgaattcttatgttcacaccctcatatcacatgtgtcatgaggagcttttttttcgtcacacagtcccatacaacgtccctgttttcttgaagataagataattcatgcatgcacttgaatataaccgagtgttttcatgtgcatgctttttatttggctgtgtcgagtgtttagacagcaaaagagctcttgtgcatacaaatgccgatatctatatattagtagtcttaatccacatttcagctttaattgcttggaatagtttggtaggcattcctagcttcagaccatttaaatatacttcctaaacgttgtcatgagaatgctgaatgcaaagtatttacatatatagtggactaatttcagattctgctcatgatggttttccctgcaggatggacaaaatccttgaacgttatgagcgctattcatatgctgaaaaggctcttatttcagctgaatccgagagtgaggtaaaacacagtaggttgtatgatatataacttttacatgaagggaatattattgttccttttctattgcattagcatttcaatcatatcatttccttgtggccttttaaatcacatgttaacaaagcagtttttctgaattctatcgttctacttgccaaaactagatgttggtaaccttctgttttatactttttaacttcaaacctcgtgtcttttgcactctggcatatttcttaaaatttctacttattgggatatcatgcaggagagtcctcattcccttcatttaatcccctcaaattttatttattatggtcatacaattaatgggccacatgcatggaagtcgatcgccagcttgcgatcagcatcctatcattaatgttatgatctatactaattcttctgtaaataaattaaaattgcactagtttttaactaaatgctactattctatttttttatccatactccgtttgagtggtttcttttgtgtttcatgaagcaatataatatgcttaagaaaacatagaaacatgcacaatacaataatagcgctggtagaatccggttggagaccaaatgtttcgatattctaagtgcatatttatatatactaagtaaaactgtaatcataaacatgcatatggactgtgatcgatgaaatgtttcttcattttttttttcaagataactcttccccagttgacaacatgcactgcatccagaagtactcatggtatttgttttcagtactgtttgatgagtaaaactttggtaagtgttaaaaaatgatgataagtgcaaatatttgttcctttaccacttccaccttcttggagtaaagaaaaaaatgtgtgtggtttggcaaagttgttgcatatatcacggcattagtgtgcggataatgcgaataaatgcatcaataagcactaggagtaagttaattagttctctaccttaattgaaaagttcatgtacatttaaaaaaattaaacatgcctctttttatcatttgttgaatttctacatttatcaagacagcaaaggagttctcatctactaataaattaatttaaggagctataactcccttaattttatcaaatattcacatacacggttgcatttgaggattttctatatactccactaaatgaggatgcatttaggttctttataatattttatttccatcgtttcatcatctgtttatgtttacagtaatttagtaatagttctctaattttgacagtaatggttggctcacagaaaacatcaaccaaccatatatattggtttatactgacaaagagtttttttttgtacagggaaattggtgccatgaatacaggaaacttaaggcaaagattgagaccatacaaaaatgtcacaagtaatcgatatatatatccaatttctataataatgttaaataaatttcgaactaattgcactaattattatttttaaaccaatttaaaagagaacttccggtattgactgctgaagatgacgtgaaactaacttatgtatcttgtgtagacacctcatgggagaggatctagaatccctgaatctcaaagaactccaacagctagagcagcagctggagagttcattgaagcacataatatcaagaaaggtagtatttttttggatagtggaatctttttatttgaactcccgacctctacacaccaaatgtacagaaaaaaaggagcaaattattaaaagaaacgtagtaatatatttagcatgttctgtttcaaactggactgaattgaaataattcatgcatgcgcatgcctgagttacataaatatatatccaaatgtcttgttgtcactgctactttgaaacaaatgttcttttttttttcctttttgagaaaatatatgagtaaatattttcagcacattctggaggaacaattaccaaatataaactttttagcacattctggagtacaattaccaaatatgacggactaactagaacaatatgtttgtgtttgcagagccaccttatgcttgagtccatttccgagctgcagaaaaaggtgaccaattgaactgcactactgtgtatgcatgtatatatgaatcgtgcatgcaaaccgttgttagctagtagttagttatagtttactcttggttagtctcaactgatagtgcagttttcttgcatgagtgcaggagaggtcactgcaggaggagaacaaggctctgcagaaggaagtaagttgtcgaaaatatagtatttactgctgcttatattaattaattcattctgcttgactagccaatggaggcactaaacataattaattcatgcgcattggttttgatcaattgatttatcttgttgacaattttccaatctatccatgggtttaattactagttttgtcaatggaggcattagagataattaattcatatgcgcactcgaaagtttgaaattgctgtagtttacttgttgggtggatcatatcgccaataattttttcccccacagttgaccgcaaatgagaagtaattttctttgccttctagacttgacggctatttttttagcgtgttggcaattgaacatatgaccttgggttaaaaccacacatcttttatcattgcgctatcaaatacatctcgataaatttgtcccttactagcggtttatgtggtttccttggtggtcggtttgtgcctcttagaaaaaaatcgtgatgtttgtagtgtgcgcatgcagctggtggagaggcagaagaatgtgaggggccagcagcaagtagggcagtgggaccaaacccaggtccaggcccaggcccaagcccaaccccaagcccagacaagctcctcctcctcctccatgctgagggatcagcaggcacttcttccaccacaaaatatctggtacgtatatgtctgcattcatgtctcatcagttgctattcagttataaattaatctgttactgcactaattaagatcgatcacacccttgttaagttctaagtctctaattaattaactgcatgtatataattatgcacatctgtgcatagtagctacccgccggtgatgatgggcgagagaaatgatgcggcggcggcggcggcggtggcggcgcagggccaggtgcaactccgcatcggaggtcttccgccatggatgctgagccacctcaatgcttaagatgatcatcgtcgtcgtcgtcggccaaacagctgccgtatgcaccgtgaatcatgggagcaaccttgaatgaattgaagtcattggtatcgatcctagcgataatatatatgattctcctaaaatgaaattgatctcaaaaaaacaaacctagcgattaagctattcttatatatgtgtttgcctgctgccccctaccctacaggctacatatgatttgcaagaaattaattatgagcaaggatcaggatgtgtctttgtgtaatcatcagcacgtacctagtgcttcctactgatatatatgcatgcaattgtgtgcatataaatatatttgcatgccatgctcccgtgatggttaattaatttatgattgtgtttatacgctaattaactgcagatgcaaactaatcaatcgaattatatatcttttgtgattggatatatggcaggggattacatttggtggtttctcaattaattcattattatggaaatttaagagttcaagataatttatatgataataggtgtatatagataatcgttagtatttattagtgactacaaatgaatagatatgtactactggttaattagaactgcaagttatgcatgtatatatattgtctccatatatttattaattaacacgactcattatgaaagagaagaactattccatggtaattgtaccatcaggtatgtgctaaaaattgtttctcttttgatgggatcgagatattcacattgaaacataaatgagtgaactgatcatccttctctttctagctgattgaacttttcattgaattgtctagtccacagcagaacatcacgttgaaatatataagtgaattatatgttttcttgggttacatgtaattaatacgcacacacatcgtactcacacccacatatacaccctccaaatatacttaaaagtgacgaaggccagcgacatttaatttacaggacttcattggagggagcttctagctgttacagtttctcgcagaatcagaagctccccaaatagtctagcttttggtttagattctaataagttgtagtggtagaattcagaaaatgaactagaagccaaaagctggcaaacctagttttttcaaattctcagaagctggctaccaatcagttacttttcaaaatcttaagctcctccaaacaagctctaaaattacgttgaaagtgttgcttgtcgtaatagtgctgagggtagatgggctgtacaccccgaaaaagttttgcgcaaaacaaaacatactgtataaatgaaacaatttatattcgacaaaggaaacctagctattcaagggaataaatctataccgtacgagccaatttgataatctgttggtaaatgtcactactatatctaatttatcttgccatttaagtcaaagttccatcgttgctaggattctagcagatgaagtcgtgtatccagaatactaccatcacattaccagtgttattcgaaattgtctattcttttttgcttgaccaccgtaaacttttacaccaaattggttaacatattaaaaaaaattattgtaaacggtgcaaccatgcatatgacaccatgtcatacgaagggaaagaaaatactgctacacatacttaaaaaattcttacataattattagatggagattacaaatatctagatttacttatagcatgccacatttaataaaaaaaatgtacttacatccttttccgaggaaaaaataatcacgatatgctttggtatgtggtagtgagaaaatcagcattgatattgccggactaaactgcaaatcaaagaaaatctttaatgttgttacagccccaattttcatttatttatatgcttatctaaatcatgtatatagcaaacaaaaagttatctgtgagtaaaatttttatatgcgtgtctttaatggttcaaaagcaaatactgtaaataaactacgataaaaaatttaaaattagatttaaaaattaaattttaacctataaatataagcataagccaaactacgaggacgggcttcctgtgtcgctctcacacaaaagaaccagggtttcgacagaaaagagaaaaagaaaggaaataatgggattggatggatgggtgtggtgtcttgtaatgccactgggccgacatgattgagaaggccagccaataagatttagggcccattaacaaaaatgatctggtgtaccagggtttgccacgtccacattgctccatctctggacagttccacacacatacacacacactctctctttctgtctgattgcctttgccttttctttcatctgcagccatttgtgtccctcggataataatcattcacttgctttgtgcaaccttttgcccctttttctacttcctcttgaagactgtgcaaccttttttgttcagataaagctgcaatttgaacaccacacatctgtcccccattttagtgtaaattaagtaattacttttgaaggttttggtgtaagttaaatactactttcgcaggttttcgtgtactagagcttaaggtgctttggggcaaatcttaaatactactgcattgcatctgtctcatattacttatcgttttgacttttttcttacaacgtttgaattagttattttatttaaaaaattagtataaatataaaaaataataagtcaaacttaaaaaacttttgataataaaacaagtcacaaacaaaataaataataattccaaatttttttaataagataaataattaaacattataaataaaaacttaaagcgagtacggaggtagtacatcactaactttatattttggaatagaagaaacatgtaacacaaaaatttcacattagtggagtaatttttacatgctactatatcagtttagtatagtactcctaacaagtcctactcctacctagtaaaaaaaaaaggcaaaataggttatacatataattttagacaaagaaaatgttatacaggcttcaatttggacaactactaatttcaattgagtaatttacatcagtaaatgtacagtaggactaactcttggaggagtatttccaagaaagaaagaaagaaaaatggcggtgaaatgaaatgtctaacgcagggaaggcggcgggtccggagtaggctgggcggcggcgaggtcggcgggggagagggtgccggagtgatcggcgtcgaggttgtcgaactcgtcgaggaactccgatatgtcctcctggctgatcttgccgagctccttgagcttgtacagcacgaagtcggcggccccgacgcggtggtcgccgtcgaggtccgccgcctccaggtccatgttggtggtccggcgccgcagcacccacctcgccagctccctctgccgccgctccgtgtacagctccgccgcgtacaggaagaagagcgccaccaccaccgtgctcaccgtgatccacgccaccgcgaacgcgcgccccccctccgacgagaagctccggtcgccgtaccccagcgtcgtcaccgtcgcgcacacgcagtagaacgcgtccaccgcccgcatcccctccaccttccacagcaccaccgtccctgacgccaccgccgccaccagcagcagccccgccgtgtagagcttgtacctcaccttgttcatctccatggcgcgcaccatcgtgtgcgagtgcagcgcgcggaagaggagcgcctcctgcttctcgacgaggtagtcggcggccttgctgaggaaggtgccgacgacggcgacgccggcgaagacgaaggcgcaggcgaggagcttggcggcgtcgctggcggggacgaggtcgccgtagccgacggtggtcatggtgacgacgcagaagtagagggcgtcgagggcgcgggtggtgcgggtgccggacatgtggtccatggcgaggtagaaggcaatggtgccgaggaggaggtacgcgacgaggaggaggccgacgagccggaagctggggcggccgccgccggtgaagagcgtcttgggaggcgcgtcggccgccgaggagttgtccttgtccgtgggcggaggctcggaggagggcgccgtcctgcatcgccggaaccttcttgccgctccttccggcggcggcttctggtcgccgccgtcgtgaagcagcggttgttggtcgagggccgccattgatttggtgataattgaggtggaatttgagctaagattcagaggtgcagcgatcgatcgatcatcgatgtgtgtgaaatagaaattgggaacagaaacaaaggagatagaggtgtgtctgtgttggattggtttcagcatcagacagcaggcaggaagttaatggatggggtggtaattaatttaatcagtcactaagagcaattttaataatataccccactgtttagccctcacattttagcctcaaattagccctcaagaatccaaacagatgggctaattttgagctaatgtgaattagcccccctcaaaacattagcccctcccagggatgctaatggggctaattttatatggggaccatcaaaaagctaggccaatatttagcctaccaattcatgactaaacattagctcttaaaattagccctgggctaatcttccaaatatggcatcaatctaataactcattcatataatagttagctgtagaaatacactacatcattaatacataatctacccatctttctcacatggtttattagagctcgtgctgcagctggctacagatctgtagcccgcttttattctctctctcctccacacaagcaaaaatctgacatggcaacttgtatagcccgcttatgtcaactctctctaagagcaagtttaatagtatagtcaacctgtatagctccaaatcatctataatcaatctaatagtcagttcatacaataattacctttaaacatatactacacaattaatacatggtcccacttgtcatacacacatatatcttggagttcatgctgtagccggctacaaatttatagccccgctgatcttctcccttatcttttatcttctcgaaataagtttatagctggcttatagtctgctatggtgtagtactgctctaagtaggtgattactccgcagcatccggattggataggttttgcttaggtgtgataaatgaatgggtgtgacgtgtctgttgtgatgccgatgccggcggggaggtggctggttgctgtgtcggtacggacctattcttttcttcacatgtgcgaatatattggttactgctccagctgtgaaggcaaagctgagttgtaaacagctacccggttcattttcgttaagcacatttttcgatccaaatgctacacggtgtgtctcgtaaaatatatatataaaaatttctttaaaaattaaacaaatatattttgtaaataaaaaaatgcttactaattgattagtcgtgcaactaattatctatatcatttatgtgtgcctgattagcttagctaataaaccttaccaaacacagtataaatgatactctcttttaggagtacataggatacatttttcttttctaaaaaattctaaataaaatataaaaataaaaatttccaaatttaaattccttggaaaaaaaataacacgagtaaattttatactcctaaattaatcccttttatttaattatgcatgccacctatatgatcaggggtggaccgggcctcaagccactgggccatgaccctgatgcctcctggactgcaagcccactgtgctgagtatgcaacttcttaccatgcaaacctcgagaacttcaaaccagaactcgatgcagttgatgggagcatggattctaatttagctatggcgaataacaattcagcgtcgttatctttgaatactttttagtcagaaatcatcataagcaattcttttacttgtaagtaataagtcaatgaaagcctttattcattggatatacgtgttacatgtactatatatgaatcaaggccatgcatatccatgatccatatggagagctcgatcgagccaccaattaattaattaacggtatttagaaacataactaaatcagttaattaatccaataaagggattaataacaatgtcgacaacgttatttattcattaattaactaattcttctgtatgcgatcgagctgcagccatagacgtcgacgtatttcttcttctttttcgtcgtcgtcaagctaggagcagcttgtccttcttcttcctaggcagagacgacagggtaggacggcgccatggcgacaccgcacgcgccctggctgccgacgtccttctccagcttcatgtatccgccgtccccccaggttgttccccacgagttcttgatgatccagtagccgccgccgccgctcccgtccgcctccgcgccgtaccccaccaccgccaccgcgtggtccagcttcgtcccgcagctgtccgccgtgaacaccccgctgccgtagtgccggaacatggcgccgctcccctcgatggccaccgacaccggctggctcgccacggcggcggccagcgacccctcgtcgttggggttcacgcgctggtagccgctgatggtggcggcgacgcccgacgccgacgacgaggcgtcgaactggcacgccccctgcgcgccctggtaggcgtaggccgcctcggtggtgacgccgccgctgttggccatgtactggaacgcattgtcgaggctaccgccggtgcagccgccgttgtcggcgcagtcgagcagctgctgctccgacagggacaccagctcgccggtggtgatctggtggatgccctccacggcggccaccgtcgagaaggcccagcagcaccgcaggatcgttggttcttgacgccggtgacggcgccttgctgccgccagtcaacctcggccggctgctggtcatcctccgacgagaggcgggtggtggcgttagctgcggcgtacatggtattggccgggttgtagccggtgtacatggcggcgaactcggcgtcggtgaggtcggtgaagcggttggtggcgaggcggtagcgcttgttgccggcggcgttggagcggtcgatgaggtccacgttggccttgaacacccggaaccggcgagccttctcggcggcgtccttgtacgtgcgcccgtgctccgccatccacttgtcgtgcctcgcctccatcgtgccggcgcggctggccatagtcaccttcgccattgtcgacaggccgccggcgacgacgagcagcagcgaggctgccatgacctgcagcttactactagtacgagccatatgatgattaatcaacgacttaattagttacctagtgtaactaattaatgtagctagctagcttattactcgaagctattagaggtgtgtgtgctgtgcgcggtgtggtttggtttggttttggaggaggggctagggtttatatagattgcatgatcgatcaagtacgtacactacacatgcatgggagtaagctgaaaacatcacctgtaatcctgcattatttatgttttctcaagtcctccccctgccacattaatgtagaaacttaccaggtttgatcaattccatagcagatcattaactagctagtaatttcaaccaaagtaattgagctaactcatctagctagctggcataatggagtggagtatatcttacgatgtgcctcgaactagatgatctcgcgcgcagtcctgaatgtggatggtggactttctagattataattccattaattccgagccgtcccctccccgcccgagcggatcatttcctgcctaatcaatttgaccggaaaattaatgtaagctcatatatgtttcaactttgaccactaacttattaataacttttagattatatatatatatatatatatacactcgtgctccatggagtatgggctctaatagaatccaccgtatacgtgctttgagatccgtgctacataaaccggagtattatacatcttaacgggttaaacccaattagatctttccatcagcaataggcatgcatgatttgcatgcatgcatgtactgacgtgattgagtttccatttatacgttcactcctattgtttccatataaactttcatgcacatactttccatttgaaatattaatatgattgcgtgataattgattatcgaaatttaaaatgactttccatatttgaaatattaacattatcacgctaatatttatttccaaaaatctgagattgcactaaatcgaatccactaatttttgatttttttttgcttatttccatcaatacgagtagacatgtcatttcattctaatacacactccactttgggctccacgctgttacaccgccgcacgtcggcgaacttcttcatcgccgagtcgttgtgctaccagacgtgcctgagcatcttcgtcgtgggctgctgattgttcgtgagagtcttggacgtacgcagccggttatccacaatcttcgtcgccaatcagttgcgccgccgaacatccacgagcttcttctttgcgcccgctcgtcgttcgcgacaatcgcagcagtcgcttgttgttcgcgactccatcccaagctcgctcctcgccccacgacgtaattttcggcttccagttcctccgcttgaatcttatcagcgaaccacgttcaggtatgtgctccatccatccatcttttctggtttatgtttcatgtggctgaggcactactcaatatattcaatgttttattccaatatattcatgcatcatgatcagtacctattgttatttttcaacgtccagtgtaatcatttcccattgtttgttttttataggagacatatgcagatatcctcgctgatgtcaagattggagttgatcctcccaagttgctcgttcgtcatgatagggatcaatttgaagatcaggcaaaaccagcgaccctgaaagcgtgcgtggattgcaacccatctgacaacaaataataatctatgttgctcctttgtattaagaatcatatattgtaataatcacctcgtggcacctactccctccgtcccaaaaaaatgcaaaccgtgggttcccgtgccaacgtttgactgtccgtcttatatgaaatttttttataattagtatttttattattgttagatgataaaacatgattaatactttatgcatgatttatctttttaattttttccataattttttcaaataagacagatggtcaaatgttaggcacggaaaccagggtttgtctttttttgggacggaggaagtagctttgaacaatgttaattttactttagttgctggacaatttttcttattgtattattccaatcgaaatagtataactgtttgcccaaatttcgtgtctgttatccataaattagctaaactttcatatttgtattctgggtcatattccgggtcatagtatacctaagttttagatcgcatacccagatttctgtacacacatagggtatgtacgtatatttgggtctgtattttaatcttgttcccattaactgaatacccggtatatttggggacatacttatatttgggtctatattttaaacttgttttcctaaactgagtacccggcatatttggttatatacgtctgtttgtgtctatattttcaacttctcccaaactgaaaacttggtatatttgggtatatattttcaactcttgcgtatatacacgtcgtacgtcatataagtatagctaattttacttcgaatacccaaattttttatcataaacttaatacataataacatgaaaatttgatcatggtctgtgatttttttcccttacatacacaatctttgagtatatgcccatgacacatgtttgtactcataaccttatataacaaaccacaatttttgcataaaccgaataaacaatacacatgtcttttgttttaaattttaaatagaactatttggatagatgtcatattgaattttaaacccaaccttttggcaaatagaaaatgcgagaaattcaatatgacaaccatatatgaagatacatttttcatgccgtgcgaatttatttcaggcccattaagaactaatatccgcgttcatacctaatatttgggtatatttggttccagtaatcaaaaatcaagtgtgtatattctatgtataaatatggaaatatagccatagtgcatattttgtacgtctaatagctaaattaatgacgccataaatggaagtatataggtatggatatattaccatatacccagccgtaatatatttccaaatacctagtttcctttttccaaaatgccgctgatcagtatttccatatacttagttcccgtgttgccaaataccgaggatcagtttctagaattagatacttagtttaggataattccttttgtttttccatataattagtttcaattttccaattttcgcactttccatgattcgtacatatattaccatttattcaaaccccaacttcgggcaagtgattttccatattttcgtgatactattcctaattgtatggcattaaaagtttccattttgaactttacacgcaattatggaaattctatcatccgaattgcatgcatgcattgaaacgtattaattcagtgtatttactatctataactacgttcaaatatatggaattcattcactgttaatagctatattcttaacgggtgtataaccattaagctaatataccaaaatgactgcaccgatcatccacgatcctacggctcccgacattggagcccatacttcatggtgccccatccgggcgtcctatatatatatatatatatatatatatatatatatatatatatatatatatatatatatatatatatatatatatatagagagagagagagagagagagagagagagagagagagagagagagagagagagagagagagagagagagagagagagagagagagagagagagagagagagagagagagagagagagagagagagagagagattaatgcttgtataatcactagtattgtacaccatgacattagagaaaaatttgtgcattccactaattcgtgacatgcatctatctgcatctgggattttctgaaaatagcacgctagacatataataaatcctccaaatgtgccaaacaacaggagccatgcatgagaccttcaacgcaagttccaaaagaaaatggtctactcctctaataattaatatgaggtcacaatctcttaaacatttctggccgctaacaaaaatgggaaacacgcatgaatggtaactgatcgatgctaaatttcaataagacgaacaacggacagtgggttctttcttttttctctgcattttaataaaggcaaggaagagcaggacaaggaggaaattaaagatgtctgatcttccagggttcctgagcgtgagagtgctgcgaggggtaaaccttgttagtcgtgatgccggcggcagtgatccctatgttgtgcttcacctggacaatcaggtagcctgcctcttcttttctttagctatatattaatcgttaaaatctattaattctccgatttgttcataatttttgagatccacaagcacaaggacttgaacattgacattatatatactgttttggatgtgctgctatatttttaagtagttaactgtagatgcactttaatgttttatactattgcaaattaattttaactgtggggacaggacagtaaacaaagcccatgtttagttcgtgtgccaattttttttaaagtatacggatacacatttaaagtattaaatgtagactaataacaaaacaaattacagattccgcttctaaactatgagatgaatttattaagcctaattaatccgtcattagcaaatgtttactatagcatcacattgttaaatcatggcgtaattaggctcaaaaaattcgtctcgcaatttacatgtaaactgtacaattggtttttttcgtccacatttaatgctctatgtatgtgttcaaacatttgatgtgacgaaatttttggaagtttgaaggaaactaaacactgtcaaagtacaacaacgttcacctttcttttttttttttacaactatcgaaaacagaaaagtaatggtaatgtgcacaaggaatccatttatttctttacctgattatccaatagtactggtatgcccagtaaagaagacttaaattacagatagactaaataagataacgagttgatgagatgtgatgtgctaacctatttgacaacaacagttctttaattatagcgtcaagtttcttcatcaacattttgtatcaactctaatttgtcattttatttgcctacacagaaattaaagacaggtgtggtaaagaagacaacaaacccagtttggaacgaagagctgactttagctgtcaggaatccagaaacacctatccagctagtaagcatctgtatctctatacttatatcaaatgctcaaacactaaactaagtagacagttcttaccactcttactgaatttttttttcaaaaagacaggaaacttacgatataggctgcctctttttctcaaacaggaggtatttgacaaggacacattcagtaaagatgaccagatgggtgacgcagagttcgacattgaggcgctgatgcaaatcgtgaggatggatctgcaggacatccgcagtggcaccgtcgtacgcaccgtgcgacccggcagacagtgctgcctagcagacgagagtcacattgtgtgggagaatggtcagattgtgcaagacatgcttctcaagttgagaaatgttgagaccggcgtggtgcacctgcagctgaaatgggtgaacattccaggtatgtactctgcacaattataaggctggggtgctggattcggactcatgatacgtcaacatttagcataatagcactagatggtcaagtacaaaagatttggcataaagagatcaaaagattagaacagattgtccactgtttactattattaccggattcatgctagaaatgatgcattcagattagcaaaacaccattattattaatcatgttgaaaccagtagcaggtttaatttgtttaacatttttattttatgatttatcttgttgaaccaatagcagtaatggtagaggatttgtatcaataacaacctgcatgacatagtgttccaacttgaatcttcagagagtaagcctgttgcaattgaatcaagagtatttggacatcgatcttacgagaaaaagaaaagagtatcggacatccagtcttgtccattgttcattgctattgcctaaaatcctagcatctttcagactaacttttttttaaagataataacggattaaacaatccagcctacacagccagtctttcagactaagtagtaattaggatgattttatatgctatctcttgcaagctgcagcagttggcaaaggtaatctaacgaattttctttcacattaggctgaagaagaatctgaatttcggtacattcatgcaaaggtaaaatgttatagagtaaatgtaatattggctttattaagttttcctcctctagacctgttgatcattcatcggcacatcggaaactaatctaacataagcaatttgatggtgcagatattggttcctcaaattggtgaagaaaccggtgttgttttgtttcagcattttgccatacacattaattgttgtgttgttcttcagactgtatgtagctgcctgtatatgtatgtaatttctgtgacaatgttgatcagacttcagagtatatgcattttgccatacacattgctgtgctgttgttgttgttgttcaagactatatatatgtacttcagctgcgtgcatatgtaatttctatgacaatgatgggaattccaaatgcaagtcttgtttgaaacaaagatacatactgtggttgatatgaatggatcgataaaaatgaatgcattttactggagcagagctgaagatgaacacgtacgtactttccgtcggagtcgcctagaaccgcttgcttcctactgtcgcggcggaggggacgtcaccagccggagctcaggagtggagccactcaagggattgaaagaatcgcccaattcgaggaccggagcggcaaatcctggagaaactgatgaagtcaccatatgtgtctcaccgtcgatgggtacgtcgcctaccactgaaagcacaacgtcgttaaatcctagaaaattcgctcccatggggagtcgaacccaggacctcaggtgctactgaggctcttgtaactactaggctacaggccctttcgcaagaatcgcccaattttcctaagccgatcaagtggtcccgatcgagagtgagggatggggaataatcccttcggcacggaaaacgaagcagaccattcgagatttctaattcacacgtacgcgccccgggcgcgcacttctggcccacggcccacgcgtgtcgcggtgccgtcgacgctatgaatcgcgatgccgttgatgctctaaagatcagtttttttctggtgctttttttaaagtaacgtaactaactatattagttaaggataataatagtagttaaggaaatattttttttctttttgggagattttttttactaatagattgaaaatttttaagttacatttgaaaacttttgacttaagatttaaactttgaagttaaattttaaaaactttcaactaaggtttgaaaactttcaactcgagatttgaaaactttcaactttcatctcaaatttgaaaaactttcaacccagatttgaaaacttttaactcgagatttgaaaactttcaacttttatctcaaatttgaaaaactttcaacctagatttgaaaactttcaacccagatttgaaaactttcaactcgagatttgaaaacttgcaaatcagattaaaaaattttaagttaagatttaaaaatttttaagtcaagattttaaaactttcaactcaaaacattcaaaaaaatatgtgtgctaaaaagatttaaaaaagtaattagaaaaaaggacaaaaaaaggaaaataatcattgtaaaaacgaataaaatggcatgggggagccgggacgcgccagcaactttgctggcgcgcacgcgcgaattagcaacacctcagaccattagcacgtgattaattaagtattagctaaatttttttcgtaaaatagatcaatatgaatttttaagcaacttttatatataaactttttttttaaaaaaaaatacacagtttaacagcttgggaagcgtacgcgcgaaaaaggaggtggcgggaagcagcgcacccaaagacgtaccaactggaggaaaaaatacacccaaggtccctcaacttgtcatcgagttacaatatcgtccttgaaccgcaaaaccggatatgacgcatcccccaagttacaaaaccagtgcaaactatgtccctgggcggttttgactccggttttgtcctatgtagcagctgactcagcgtgggacccatgtgggccccatgcgtcagccacttcttccctcccctctccacctctctttctccctctcctctctttcccaatctgcacgggcggcgcgtgaggagcagctgcacgggcggcggccggcgggcgcaggcggcttggggaggagctgcgcgcgggcggcgagcgacggaggctgggcgggcgggcgacgtccggcgggggaggagctaggcggcggtgcacgagctcctcgccggacgaacgctagaccggctccgccatgtcggccgcgaggaggtggcgcgcctcgtcggctcgctcagccggagtgccgccgacgacgtttacgcaaatgacctgagaatttgagatcattgccatcttgctgttctcttcaagccctatcaacaagattgacacgattaagcactggatcgagatatgatcgatcgagcagcaccgacgaactagccgccgatcata

SEQ ID NO: 80136 - DNA, 25995 bp, Oryza sativa
tgcggggcggagcggattggagggagagggggagagggagcgcgctgggggaggggagagggccgagggagaggggaagatgggccgagagaaattcggcccatcgaccccgggggaggcaaaatagacttttgcggaggaatttgatttggaaagatttggattcggatttgaacttgacgatagatcggggatttgagatctgagatggcacggacactagacaacaagcaaagaaacaaatttcacaattagggtttttaagagataatttttcccgctaggcgccatgacggaacgggcgctacatagatccctgtcgagattattcgacgagatctcccagcggcttcggcttgagtccttcggctttgtagactacggtgggtgtgttgacgctatgattcgatgatcctaaacccctctgggggtgtgccttttataccgtgagttgccttagtctccaagtagaactcgtagacaatgaaaccggcacgatatagaacagtcccggtccttttcgagtaggactctggtagtctccagcccgtaaggacattttccataatgtctatatttccttatcatgtacgaaaacatattgtaggatatgaggtatgtcaatccagtataattggtaaatcgtaggataagaagtactccctccatattttaatgtatgacgccgttgactttttaaccaacatttgaccactcgtcttatttaaaaattttatgcaaatataaaaatacttatgtcgtgtttaaagaacatttgatgataaatcaagtcacaataaaataaattataattacataaattttttaaataagacgaaaggtcaaacatttgtaaaaaagtcaacggcgtcatacattaaaatacggagggagtatgtattatttgtaacctgataaaatttcccatatgatttgattgtaaaaaaacaagaagttattcgttcgtgggctgtgtgagtcggggtggttgattaggcttatgggctttgctttgttaactggggtatatttagttcacgtcaaaattaaaagtttggttgaaattaaaacgatgtgatggaaaagttgaaagtttgtgtgtgtaggaaagttttgatataatggaaaagttgaaagtttaaagaaaaactttggatgtaaactcagcctgaagctcgagaaagcattgaaaatagactatcgaggcttactgagtacttctgactactggagcggcgtacatcctaaatatttcgcatatgttttgggtatgccacagtgcataccaggaacacacatctgtctcttggaataaattcccattaaatcttctaggaaagattaatcgaacgagagctaaagggttaaagaaacattagccatttgattaatgtataatggacggttaaaaatattttggtgtagctgaaaaaatccaagggtgcatagcaattgactgggccagactgatcacgtgcaagtggaacgcatgcacatctccctgcttttctgagaaatccttgcaaccacactggtcgtattcgtatcaatcaggcaggcagcttcgccaacgaagaagcacgtgtgcctaagcatacatcttcttttccactccaatcttccaactaatgaacgaatcgcgtgtacagtactccctccgtattttaatgtatgacgccgttgactttttaattaatgtttgaccatttgtcttattcaaattttttatacaaatacaaaaatacttatgtcatgcttaaagaatatttgatgataaatcaagtcacaataaaataaatgataattatataatttttttaataagacgaaaggtcaaacatttgttaaaaaatcaacggcgtcatacattaaaatacggagggagtaaaatctataatctatttatatggaaatcaggcggccatttaagcaaacagagcaacgagacaatagttttagctatcatgacagaaatgactaccagtgccctgcatctgcaggtgcttgccttaaccgtcttcctcgtctgcgcggcggcagtgacaccagcggcgtcggctcagcagcagcagctgccgggctgccccgacaagtgcggcgacatcagcatcccctaccctttcgggatcggcgcccgctgcgcccgcgaccaatacttcgagctcgagtgcaaccgcgcctactcccctccgcgcctcatcgtgtctacccaccggcaacatctggtcaacctgtccctcgccgacggggaggctactgccctcatcaacgccagacgccagtgctacaacagcacggagggtttgatcggtgatgccaataattatgtcaacaaggatatcactcttgtcggcagcaatgcctaccgcttctctgcggcgaggaaccgcttcgtcgcgctcggctgcccaaacatgggctacttcgtcgacacctacggctactacgtcagcggttgcacgtccatctgccggccatcgcaggggaatggtgcgagtggtgcctcgaccgggggatgcaccggcgagggatgctgccagagcaggataccgaccaataccgactactacgagctgtacgttcaaactttcaaaccaggggaaggggaccccatattacgtggcggtacgactgcttgccggtacgtgtttctggcggaggacaagtggatcgacaccacctaccgcggccacccggacttcgaccgaaacgacgacttcgcggtgcccgtcgtgctcaactgggccatccggaacgtcggtaactgcagcgccgctactcgtaacatgacggactacgcgtgccggagcgtcaacagccactgcatcgactccattgatggccccggataccgatgcaactgctcccagggctacgagggaaacccctaccttgacggtggatgccaaggtaaaaaaaataaccacacctcccattaaataaagggagaatttgaaccatgccacacaaattttgcaaaatttatgatataccaccctgacctacatgtcattgactcatgtgggtcctacatgtcattgagatacgagtggtatatcttaaattttgcaaatatagggtggcatggttccaacaaacccttaaataaaactagcatggtgacccgcagattgcgcggctagcatcattgtattttctctcatataatagcatatatgttttctcattatattattcaaatatattaaaatgacaacataattttaaattttgcaataactttataaacctactaatgtgtaatattcatattatattttatatacgtgttagttattaattatttttaatatcaaattttagttatttgtaaattatatatattcctatatggactctagactcgtcttttaatatttgtttttttaattccgaattttctgtaaattgtatttctatatagactctatgctcttcttcccatattatttatttttatttcagaatttttgttatttctaattgtatttctatgtggactctaaactcatctttcaatattctttaatttttaatttcgaatttcagttacttctaaattgtattcctatattgactttaaattcttcttctcatgtttttcttaatttcgaattttagttatttgtaaattatattttatacggactcaaaactctaattttaattttattatgtttattccaaattttagttagttttaaattcctatatggactctatactctacttctaatattccttactttttaattccgaatttctattttttttcttaattgtatttctatatggactctatactctacttctaatattccttatttttaattccaaatttctattattttctaattgtatttctatatggactctatactctacttctaatattccttatttttaattccgaatttcagttatttcctaattgtatttctatatggactctagtctcctcttctaatattccttattttttaattccgaatttcacctatttctaaattgtatttctatatggactctagtctcctcttctaatatttcttattttctaattccgaatttcagctatttctaaattgtatttgtatatatggactctgctttttctttttcttcgattaatgtgagaatttttaggccatgagagcgaacgtggaggctcatttttctattcctttaataatataactagcatggtggcccgcacagattgcgcggctagcatcattatattatctctcatataatagcatatatgttttctcattatattattcaaatatattaaaatgacaacataatttgaaattttgcaataactttacaaaactattaatgtgtaatatccatattgtattttatatacttgttagttattaattatttttaatatcaaattttagttatttgtaaattatatatatacctatatggactctagactcgtcttttaatatttccttttttttaattccgaattttccgtaaattgtatttctatatagactctatgctcttcttccaatattatttatttttatttcagaattttgttatttctaattgtatttctatgtggactctaaactcatctttcaatattctttaatttttaatttcgaatttcatttacttctaaattgtattcctatattgactttaaattcttcttctcatgtttttcttaatttcgaattttagttatttgtaaattgtatttttatacggactctaaactctacttttaattttattatgtttattccaaattttagttagttttaaaaatcctatttggactctacactctacttctaatattccttattttttaattccgaatttctattttttcttaattgtatttatatatggactctatactctacttctaatattccttatttttaattccaaatttcagttatttcctaattgtatttctatatggactctatactctacttctaatattacttatttttaattccgaatttcagttattttctaattgtatttctatatggactctatactctacttctaatattccttatttttaattccgaatttcagttatttcctaattgtatttttatatggactctagtctcctcttctaatattccttattttttaattctgaatttcaactatttctaaattgtattcctatatggactctagtcccctattctaatattccttattttttaattccgaatttcagctatttctaaattgtatttctatatggactctactttttctttttctctgattaatgtgagaatttctaggccatgagaacgaacgtggaggctcctttttctatttctttaataatataatagatagattatatttctcatgtgagtttaaaagctaattcctgttgatttgggtgatttgcgaagatatcaacgagtgcgagcggccagataagtacgcatgcttcggcgagtgcaccaacacgctaggatcgtactcgtgcatgtgcccgcgaggtgctcgtggtgacccgtccattccacaaggctgcctcgaaaaggacaagttcactttagctctgaaagtagttacaggtgaaaaattataactgtcgtccatcatggcaacaccaatgcacctttttttctctctctctctctcgctctaatgattcttcgatttctgatgagtgacatcttcaggggtcagtgttggtgtcttcctgccactgctcatgtacttttgcctatacctagttctccagaagaggaagctcatcagaacaaagcaaagattctttgagcaaaatgggggagtgatcctccagcagcagatgcactctggcggaggtgctggtggattcaagatattctccacggaagagcttgagaaggccaccaacaactttgctgatgaccgtgttctcggtcgcggtggtcacggtgttgtctataagggtgtcctggaggacaacatggtggtggccatcaagaagtcgaagatgatggaggaagcccagactaaggaattcgcgagagagatgttcatcctctcccagataaaccacaagaatatcatcaaattgctcggttgttgcctcgaagtcgaagtgcccatgctgatctatgagtttgtctcaaatggaacactctaccactacatacatggcaaggaacccatagctcacatatcacttgatacccgtcttcggatagtagcagagtcagccaaggcactcttctacatgcactcgtctgcttcaccgccaatcctccatggagatatcaagacagcaaacatcctacttgatgacaagctcaacgccaaagtttcagattttggggcatcaaaactagcaccagctgatgaggccgagattgcaacgttggtgcagggaacttgtgggtacctagatcctgaatacctaatgacttgccaactgaccgataagagtgacgtttacagttttggtgtcgtcgtgctagagcttctaaccaggaagaaggcattgtacttggatggaccagaggaagacaggagtctggtgtcatgcttcatcacagcagtgaaagctggtcgtcatcaagagcttctggacaaccaggtaaggaatgagatgaatgaagaaatgctcacagagattgcacacctcctgatgcgatgcctaagtatgaacggggaagaacgaccgacgatgaaggaggtagcggagaggctggagatgctgaggagataccagcaacatccttgggttgaagctgaaggtaatgccgaagagaatcagagtttgcttggcattgaacaacggaattcaaattaccaactcaagcaacatgatgttcttgatctagaagaaggaagtacatatacatttagcttgtagatcatgtttgtttgtgttaaccttttataatcaatcaataaattcaggtacaaattctttaaaattcttttatgtgtaacatgagaacacatctatggagtgcaatgaaagaaccgccaagaaatttatgtgggcagtaatttttttttaagggaagacggcaggagctctgccaatttcataaaaggaggagcagacaatagaggtcgttttacaagccagccacgcaagctgagggcaagcacatagcttgcgagattaaaaacagatgggaaaccccaatcttgagaaagtgaactgcaacaagaagaagaaagcgtagaaaactcatctaggaactaagggcttcatcaaactctttgcacaaagcaatgatgaaatcaacgacctgagctaccgagttgtaaatgtcattgaaaatccttccatttctttgcagccaaatgccccaggtagtgtagatgaaaaggccgtcaaaattacgtctttgttccttaactagctccttcctgcaagcctcccaccaatctagcaaacgtcccggaaaaagagagggtgaaggcatgtgtaggccgagcttgttccacatggagctccaaacttgtcttgcgaaggcacaatccatgagtaggtgattagccgtttctggttcaatgccacagaggggacagatctcactgttatcccagccccttagttgaagtttatcagcggtgaggttttttctgtgaatcatcagctagccaaagaatttgcatttattttccattttggccttccagacgaaagttgatctgttgtcctgtatacttcttagaaactggatcctgtaagccgagctagccgaatagcagccattcggggtccatctccatgatatggaatcctcaatgccatcctgcaaatgaatttgctgcagagagtgccaaagaatgatgaactccctgacttggactgtgcttttcattctctgcatctgacgaagccagcgattatcgccaagttcctgggcaaccgtcctgtttttcctggatgcgatctgaaataaggatgtggcaatatctttaggagctttaccttccagccatcggtcatgccagaatttgactttgtttccatttcctaaggagatgacggtggaggccctgaagagttgcttatctgtttcatcacagggaaggtttgagccctgccacggtttgtcctgagctgtccaatcataccataaccacctcagtctgagtgcacgaccaaagagttccaaattagtaatgccgagtccccctaaatcttttggtctgcaaaccctcttccagttgactagacagtggcctccattagcctgctcagaacctgtccataagaaagccctgcgaatcttgtccatctttttctctgcccatttcttgagggggaacaccgtgaggtgataggttggcaaagctgagagggtagacttgattagaaccgctctacctgttttgttgagaagttttcctttccaggtaggaaggcgagcagcaaatctatcaattaggggttgaacatcaagcctccgaagctttctgatgtgcagaggtaggccgaggtaggagcacgcgaattctttcaactgggctgggaagggggaaagaatatcctggaggtccagatcttcacatctgatggcgtaaacctcgctttttgttaggttagtgatcattcccgttgttcgtccaaagtgaaggaggatagcttgcactgcctgtatctcatccttgatcggcttggtgaaaatgacagcgtcatctgcatatagagccatgttaaagcgggcagttctcctatgaaggggctgcagcaagccttcatcctgtgcagccgcaagaaggttttgaagtgggtctatagctagaataaagagcatcggagataacgggtcaccctgccatagacccctgccatgcatgaaactgttaccagctcttccatttaggaggacattagaagaagaagaaccaagaatggagcagatccaacctagccatcttctaccgaaccccagcgtcctaagcctgtcaagaaggtaaggctagctgactgagtcgaaggctttggcaatgtctaatttgaggagaattgccggggtcttggaagaatggagctctttgaccaagttgttgacgaagaggaagttgtcctgtatgtttcttccttttatgaaagcgctttggttgtgggacacaagctgttgaagtttcggagctaatctgtttgcaaggagcttagaaaagagttttccaaatgcatggatgaggcttatgggtctgaattcactgacacgaagagcattctctttttttggaagcaaagcaatgtaggctgaattcaaaagccatagcctgcgtgatatcttcctgaatgatgtcccaacattttttaaaaaagcacctgtgaagccatctggacctggggagttgtctgaacgggattgaaaaattgcacttttgatttcttcaactgagaaaggtgcttctagatcagcgaggtcaaggttgtgttcctgtaagaaggagggattgatcacagaggttcgagacctatgttctcccaagtgctgcttgtaaaagttgaaaagttcttgtcctttttcttcatgagagtgaaccatcccggagtctgtcaggaggtgttgtatgaagtttttccttcttctcacgctagctttgatttggaagaaccgagtgtttgcgtcacctgctttgatccacaattgtctggatctttaacgaagtcgcaccctgtctagggctgccagacctaagagcttctgcttaagggatcttctgaaaaggatctcctgagctgagaggttcctctcttcctgtgctaagtctagtctgaagatcagctcagtagctatctccattctcaactttagactcctaactctgcatctgctccagtttcttagtgctttcactgttcgggctaacttgataagaattcttttcagggcatcaggcgagtggaccggttttgaccaggcagactgcacagtttcaaggaatcctgggagccttatccagtatttttcaaacctgaaaaggttgcatttaggcctagaagggtttgcagttagcagcagaggacaatgatctgagaccatcgtagagatagctgaaagcaagcaattttggaacctttcttcccactcatgtgagcaaaacaccctgtcaatttttgttaaggttggtatttctgtttcgctggatcaggtgtatcgacggccatttagttttatttcaataacttccaacatgtttaaagccgccctaaaagactgcatcatgcccctgttaagattgctgttatttttgtcggagtcctggacaatgaggttgaaatcatctaagatcatccacttttgatttactgtgttctttgtttgctttagttcctcaagaaattctcttttctcattgtctggttgtggtccatacacccctgttatgctccaagccaagacatcttctttttcttttaagtttgccgtgatcgagtaaacacctgtttgcacactttcaatcgagtattttgagtcagacaccgccagcaggatacctcctcttgtacctgtagccggcaggaaacagaaattatctgcaaacgatggacctagaacctgttgactattgcttgatcaaagaactctaatttagtttcctgaagacatacacaggagcagtttatgtccatgacaaggtttctgacaacctgctgacgggccgtggagtttaagcctctaacattccaactcaaaatggcacagtcatttgtagacatttaacgggaggggcacctgcagtatcccaagcggatggaagagcacaacctatagaaatggtgaggcttgaaacatagtagagaagcaaaacacagtcgcagggagagatgaggtagagcttggccggtagaggcaactgagcacttcattttctgcagagacataacctggatacataactgaaggaccatccttactagatcgaggtctaactgggtacagggggagcatgaggcacagcatagaagaacaaagccaactactcgagctacaagagctccaaaagaaactaaactgctctaaacccctcaggagaagcaaacaacccatttcagtactacaaagactcatgatagcaaaaaggaacagcacatcaacaagcggcgaagccaactaagtcttcttcttgctgtcaccaatggcgcagccggccaccagagcagagaaggcatctatgacctcctgagagagaggctgcttgaaaagcttgacgtatttggccattgcgtcctcagtcttcttgccgtcctcagggagcaggccagccttcttcatcagcagctcatgagcgaggtcaccttgcttggccggagaggaacgagcggctgccttcttggccaaccgagcactcttgcggcccgcctggctaagacgggtcgggatcttcttcaagagctttcccttggagacctggcgcgtgggagttttgagcagaggaggctgcaccgccgcgaaggcctgggtcaggaaatctgcaagcttgtctggggagatcatcagaggcgactgggaaggctgagattgggcagcctgagagacctacaccagcacggcggactgggacgcctggtcagctaccagctcctccagcatagggtcagcctccatcacgaactggttggcctgaagaggggtggcctgggtgatcgggtcctgtggggatgtagaaggggggcgagacagctggaagccgccatccttcatcactgcaggaaccgacagcgacggcgggggggatgaccttccacgcggagacctcgagcgagcggccctcaccggagaacaagctgccctgcggtgaccacccccgtaggacccacctctgttctccgaagacctggaagaggagcgcctggggaaagctgagctgcgagcaggagggacatcccaccccaaggggcggcggcgctccctcgctggcggagagcgggaacgtgagcgtgagcgatctctgcctgggcccgggctagggaaagccggaggctgagggggaagagtgccatccttgacgccaaggctccaaataaaatcatgatgctttgggatttcttctgtcatcgagacaggggagatgattccactggcctgactccctagactattcatccaagttggctcagttggcggcgggttgaagtcgagcacctgatcgagatgcacgagcaccgggtaggccagcagcttgggaggggaagtcctctgccgagcctctccgtccaggtcccagcgtgagtctggggagcgcggggacagcggttcttcaagctcgaagtgcacctccttcgggatggagtccggatcgtccgcccacagccaggcgcagaggcaagccgtctcgttctccgttcttggctcatcaaggtcctggatcaagcatccttcatcaagcagtcctgtaactgtctctgccgaccaagcgtggctggggatgccttcaaagcagacacgaatgctgaagcaccatttgaccagctctgcctggacgcgtctcgaccacgggagcaccgagaggtcaatgtcctccacagcaaaagggctcgccgcaaccatcatgtccctgagcgaccgagaggtgcaggtgaccaggtagcctcctttggagaagacgacaacattgaggtcctcacgaggaacctgaaacctggacgccagtaacctgttgatctgtctcatgttcgtcactgggagattgcctgtaacctgtaccaccgctgcggtgcgagaaaggaaactttcatcctcacggatggccgacgtcctgggcaggacgcgctggatgctgtccggcctgttggctgggtcccctgggcgcgacattgccgggagcggagggaaaactagccgactggctagcggaggagcaggagtggggcgaggaggctggaccccccctatcccgtcgtctgtctcccgggcaccagcgggctttgtggccagaactgccacagagaatgcacctcagggggtctctacaggaagcaactcggtggtcctgagctagatagcggaagcagtgacccaccgccttctttttaaagagctcgaggaagctgatccttgcttgaagaggcttggactgcgagaggaaaggttggtggcgaccagtgaatgcggagggaagctgaggaggagcagcggattgaaggtgcatgaatgccgaaggccgttgggcatgtctcttcctccaccaatgctttggcttcactgtctgccaaacttgaagacgggtggcagcctcagacggaagattttttgggattgctttgggaagctgcgagggcgaagccattcatcttgctgcctgaatgaagctatcctgaggagtaactccctgtaccttcaagccggagggcacaggaggagtaaatccttcacccaccctgcgcagtaaaaccggggctgcttgaaaacttaaagaacctgtagaggggggaacctgctggatcttggctggcaccagggggacgcgcatccgctgcctcactgaccagatttgccaggaggaattgagggcgaagcagatctggcagatccccatccgagtagctgccagagagggagccgaggctgactctctctagaaagggaggatagccgaggatgaaacctgtgctagcgggggaggacactagggccggactggtcggtggaggagggggtgggcgcctgggccagagtggcacccggcgatagggcgagaggaggaggaggagacgcgtcgaccattcggtcgtgaagttgccaggaagatgactgtccatgtgggcagtaatgaaaagcaggaaactgcataggctatagagaacaatgatatgcaactatgagtattgaatggttcatcaaatccaccaaacacagagcttaagttgtgcaactaacaaacaccttggataggcaaaagaaaaatcaaaagaattgttgttaatgctcacaatgccgacccattaccatcgtgtgccgtggtgacagatagagacagttataattttggtcctttttccactaacacgagaaatatggcctggatttcggccctaaaacaaaaactcatgccatgtttgcgccttttttcttggttttagtaccacctcggtaacggaaggcggaggagggcgcttcgctatgtatataagcaggtgggcttgttcaaaacaactctcggccttttggctaaaatcaagggtttgtttggtagagctaaaacttctaaatttaggtacaggagttgagtctggggtagagctgtttaaatccagctccacttttttagtttattttgtgagataactctgctcccatttttggtagagcttaaaattgtttagtttatttctagtttattttgtgatacagctcctctagttcattttgtgatacagctctactccactccctttttggtggagctgaaattgtttggctttatcttgtgagacagctccacctagctccgctcccatttttggtgaagctgaaattgtttggctgagattcagctttagaagaggtgggactagagttagagctgtgccatctgtggaccatatatccactgtgatattgaatttattttttataggggagggtccatcacagtgtattgctactgggggccctcacgtgtcgcctaggcgttgcactgatgccagggcctggcacacccccaaccaaaacagcttttaaaagtttgatgatttctcatgctgaacgctgatcctctacgtctgtttaagttgtttactgcaggaagagttgagttgagtactgatgttgagtgccattaatttgctacgaaattggtgatccatgaaactcaaaatttcggatagctttcgtcgtaaatttgctaaaaaattggtcactgacctgttgacccatgaacaaaaactctgcaagagtctgcccaaaatctagacatcgtcagagttcagacttcagatgtgtccaactcttataagggcgtttacaatatgcggacgtggcattcagcctccaccccaaaaaccgaatattccttgccacatcatccaaatgcacaacttccttagctcctagtagccaacattggctacccgttcttcgtctccggtgggacccacaggcgggctagaggagagaggggagatgggcaaggcagcagacagggatttggatcgtctgccttcgcagagtgaaggcacgagcatgcagtcagccccttatccaccattgaagtaatccaacggctcacgtcgcatgtgcgcttaaatagacgaatgaatttgtctgtgaaagaccacgatggttctatcgcaaaaaaaaaaatcccacgatggttgttttggtctgggaagtgtacgcgagctaaagaaacttacaaactatattagtgctaatacacatgaaaaaaaatggatgatatcaccaaattaaaaatacaagaaaactgaaagtttcaaataacaacactaattcattacaaagtagttctccatctttttcatattataagtcatttgactttttttctagtcaaaaatcgttaagtttgactaatttatataaaaaatagtaatatataaaatatcaaattaactttattaaatctaacgttgaatatatttttataatatatttgttttgtgttaaaaagtaaaaaaaaagaagtttgactagaaaaaaaagtcaagcgacttaggccttgtttagttggagaaaatttttgggtttggttgtcacatcggatatacggacacatatttgaaatactaaacgtagtctaataacaaaacaaattacagatttcgctaggaaactgcgagacaaatttattaagcctaattaatccgtcattagtaaacgtttactgtagcaccacattgttaaattatggtgtaattaggtttaaaagattcatctcacaatttacacgcacactgtgtaattagtttttttttccacatgaaaagtttttattttgggaactaatagagggagcatgacgcaatgtcaagtcacatcataaaaagcaaaagaaaaattatgattagagcataggattgataagaaaaattacaaaatttataatgcaaacatcattggtattcggactgaaatatagcagtagtgcttcgtggactttgacagacagatatccattcagacgtgcacaggcgacgtgagccattggattatttgaacggtggatgaggtgccgactgcacgctcgtgccttcaagccgtgaaggtagaggatccaaatccagcagacagggagagaggagcggcagcgccgcccggcatcgtcgtcgctgcttagcccgcctggcggcgcctccttgctgacgagccgcctagcccgccgtcgccgtgcacagccgacgagcccgccgtcgccgtccgcggccagatccggcgagcatggcggccggaggaggaggggacgcgcgacggccggaggagggaggcgtggcggctggaaaaggaggggaggaagtgcggcggccggaagacgaggacggcgacggggctccggtcggcagcgacctccgcgaggacgaccacgccgccgctcgtcgtccgcgaggaagacgccgtgaggaagacgccgacgccagatccggctggatctggccgtcccatcgccgctccgcccggcgccatcactggatacgccggcgctccgtccggcgctgggatcgccccgccgcctctccgtcaaccgcctgggccgccgcgtcgtccgccgccgccccccgtgtccgccgctccattcgccgccgcctgtgtccgccgctccatccgccgccgccgcctgggagagaaagaggggcgccggcggcggagtagaggaggggacgcgccggctgggttcggcagagagagaggagagaaaaagttaggagagataacgggtgggacccagtgtagggaaaaagtagaccacatgcattgtggagcttgttgcttatgaagtttctcagtctaggtggcagttttggctcctcaaaactacgttacgtgacgcattgtgactgccctaagtatcatcagatttcgctgttctagacttcagataacttcaattttaccgaaacatttaggccctgtttagattccagcttttttcttcaaacttctaacttttccgtcacatcgaactttcctacaaacacaaaccttcaactttttcgtcacatcgttccaatttcttcaaacttctaattttggcgtggaactaaacacagccttaggccctgtttagattataatttttttcttcaaacttacaacttttccgtcacatcgaactttcctacacacataaacttccaacttttccatcacatcgttccaatttcttcaaacttctaattttgacgtggaactaaacacagccttaggttcgatatgctccgcggtaacattactacactgaatactaggaaatcgcctcacaaaataggaaaaattacaatgatattcaaatttacatccagaaacccagaatacaaatcaaatccatatttgcatttaccattccctccatctccatgggactttattgttcttttcagaaagattaatactaatcaaatcaaatccatatttgccgttcaatgctagcctcgatgtgcctggctgaaagttcaactatggtcgacattccgtcttctgttggaactcacaacggcacgttcggatttaaatccccgccaaaaaaaaaaacctggcaatctggtactccctccgtttcaggttataagactttctagcattgcctatattcatatagatgttaatgaatctaggcacacgtatatgtctaagttcattaacatatatatgaatgcgaataatactataaagtcttatataatatgaaacggaggaagtagcatctattaccatggtctctactacggggatttatggggaaatattccaaatcttgcacggcagaagctattgtcatggtcattggtcgtgccatcatgtttgacttaacaccaccggtggtaccaaaaaacgcaaagaaccacttgtcatacttgcgacagcgatggcatgtgaacgaattccgccgaaaagaacctccaatctaaacattcagcgttcaaatagttttgaacgacaaattctcgacgtcttcaattcgtcctcgcgttcaatagtgggccgtgacgtatagagacaggccttctccactagtaacaggccaacagaaataaatacggcccatatttcggccccgcaaaaaaaatacggcccagatttcggcctcaaaaggaaaactccggcccatgtatgcgtttaaacgatagcacctgacgggatctggagatggatggatggttcttcggtttagtaccacctcggagacgaaggacgtacgagggcgttgcgctctgtatataagcaggcaggattagacgaagcaactcatacctttctcggccttttggctaagatcaagtgtagtatctgttcttatcagtttaatatctgatacgtgggccatgtgtccactttgatattaaatttattttttgtgggggagagcccaccacagtggcttgccactggggccctcacgcgtcgcccaggcgttgcactgctgcccgggcctggcgcaccccaaccaaaccaacacaatgtttgatcgaaatttttagtttttgtactttgttagtttcaatcgtgtagctggtgaatgcggtagagcattgaaaaatccatcagcaaggaaaacaattgtctctagatctgcaaacggatatctgagttcagatgcccctccaattctgaataatcgatataccttcatcagatatctttttatctatgatgggtgttgcctgcttgatgtccagcacgcacagtctttcaaagggaacggtgccgacatgatgcccaccaagtgctcgacgccggtaccaagctgtggcatcaccaagtctgatgccgagagcacacctaccacactggaacatgtgttcctggccaccatgaatccgtctacaccctcagccgcatcagcagcagcggtgccaccggtttccctcaccgcgaccaaggaggatgaggttgacatgggcaaggttgaggacaaatcagataagaccttgcatgatttgtgtgtagagataaaggagatgatcaatcaaatgcttgagacatgccgcaacagtaaagtggaaccaattgtgggcgatgattccaccggagtggcagtagtgccatgctctgttactaattcagttcccattgcattggaggccagtcaagaaattgttgccgatgagagtgatggcaacaacttggccagggaagaggattgtgtggagaagaccacagagggaccaggctttggagaacacttaactttttgtctgagcccaaaggttgatgttcccattcttgacttgattgctaatcagggcatgtcaagatttattcacaaggtggatttggaaccttggccaaatccagggccttgtcaaggtaacggaggcatggtggtgaagatctcacgatatgggccacctcatcctcgagctaattacaaagatgtttgtgctaagcagcaacttgaaccctgggctgatctatggttgaatcatggcaacgaaggtgtggtggtgaaactcttacagccctggccaccacctattcaagcagaagctaaagttgaggttggagtactactattattcggtgagtcccacaaaatctccttggactacagattcaccaagttcatgagtagaacgattattgtcagtgctggcttgttgcaaattctggttcctggatggtgtattggctatgcgctgcatctttctagcacattttggaattcctaccagcatatgcagcttttagcctatggttggtcatttgatgatcatgttttgttcctcccactaatgctagttttctggccaattcatgacacctggagtgaatgcttgcttggttatactaatgaagatcacgatgtccaaaaggttttgatctgtgacaagaatttgcggggagtgctaattcctacagagctcaaaattccatggccaccaccaaacttgactgttcaaaaatatggagtgttggctaaaatactgttaccaacaggattgatcaagttgaaggttttggataacatattgcgtgcacaacaatggtattgcagctccttgggagaatcactagaagatagcaccaatggtttcaccaagttgcagagtgttgaattggttcagtacaaggttgattttgctagtagctccttgcttgatattgtagtattgcaaggggatgattctctgccatttctacttcctggaagagcggttttagaatatcaagaatttgtgactcatgttaagatgacagaacaatcagtttcgaaaggtgaaacggatgtgccgaagctttgtgttctcaagttcagtttggacaaattttcaaattattcagttggagatacaatgattgctgtgttgcttacgcaaacttgtgtacaattagttccaagctacaatcagtctttatctgggagcaaaaatcactacaaactcttgatgacacaacatatgtcagtcattgcaaactatgaaatgatttggtggaagtcagagcttggtgggggcaagattagcttgtgtgcatcatggaatttctgggatctgtgtttttgttgcaagcaaatgtctacagaaattatggctgttggattatctggtgtgaaggtatggctgttgtttgctatatcagagctgtggttacaaagaaaacagctaaaacttgcattattagaggaacatatcaaggtgctctgcaattctactatgttattcttcctgcaagcgacaatacaagcatgactacaggactatcttcgttccatcttgcacaatgcccttacatatacttctgaccaagaaaaatatgatgcacagaacagaaaatatgatgcacatatgctccgtggtaacagttcactgaatactcggaaattccctgcaacatagaaaataaatacaatgatattcaaatttacatcctgaagcccagaatacaaatgaaggccatatttgcatttgccgttccctccatgggaccttattgttcattacagaagggttttacatgtgtaagaacaaaatataaatgcctactacacttgcacaaataaacaatctcagagcccttgtgtttccttttttttcctttgttttttccctgttgctctctgtttcccatcgcaacagacgaattcgtatttttatcttgattttataggtaagcacgttttggaacgggataaatcagaggcaggtgacccttctgctgcatgcataggaccgcctcattcaaactcttcctcagtggagtgaactccaaacccaaatccttgagcctctggttcgagaacttatacggcttcgccatcggcttcccatcatcctcacacctgaaaaaaaaatccaagaaacacacgcatgagaatttgagatcgatcgattgcatctcacaagagcaatgaagcaatgcacataagcaaatcaatggctaatatctgcatactttgcagtggcagggtaccgtgggaagagctccctgagcatccggaggagctcggcgcggtggagcacggtgccgatgcagaggtagcggccgcgtgcctcggggcgctcgtagacgaggacgtgtgcgcgggcgacgtcgcggacgtcgacgtaggccgcgacggcgttggggtaggacttcttggtgcccatgaggtagcgggcgacgtggttggtgctgaagttgagcgtctgctgaagcatgggacccatcgtcatcgacggcaccaccaccgccagctccagccccctcttcgccgcctcctccgtcgccgtcatctccgccatcatcttggcgcagcagtacaggttctgcatgtacgacgagaaaatttgccgagatgaatttattgttcatgtaagcaacgctgttggagttggtagaaccgtagaacggagcagagtaatgtgcttacgtctgtttgcttgcagaattcgtagtcgctccagcaggtctcgtcgaggacggcgtcggggctccggttggggttcatgtgcacggcgccgtacgacgacgtgaacaccacgcggcgcacgcccatgtccgccgctgcgttgatcacgttcctcgtcccctccactgcaaccggaacaaggtcctgcatcacggagcagcattagtaaaagttggaggaggttaaaggtgccattgtcgtctcttttgggctcaggaaccaggctagtgaacttacagggtcgttagacaccggggaggcgacatggaagacgccgtggcacccgctgaaggcggcgcggaggctggcggcgtcgaggacgtcggcgcggcagagggagagcctctcgtcggctccctccagctcaagcaggtgagcattcttgctgtcagctacagatacgcgcatgcaagaaccgatcaataaatcaagcacaacacgcaccaaatttatgcaaacaccgtgaactaatagtactagtacttaccaggatccctggctgttcccctgacgtggtagccacggatgaggagctccttcaccacccacgacccaatgaagccacctgctccggtcacacagaccagctgcttctcgccattgttgttgttgttggcctcaaaattggacgacatggtgagagacgctgaccagttactgtcactaaccaaatgctactctgaacttgtgagagaactttcgatcgagcttgtgttggctgctgctcgtatgtcactcgaactccgtatgttggtgtgagactagcgtgtctggacacggccgctatttatacctgcagaaaccgcgcgccgccatgcgacggaggaggaggacgacaagaggaagatagctagcgtaggttggtcagcaggtgaggggtgggggaggcgcagctgcgaccgcgcgaaacggagtgccgtcgccttgtcgactcactgttcgtccattcttcaggattcagtatttcagctgcgcgctcgcccgcaatactgggcatcacatcgcaaggccgaattcgccgatgggttggggcgtgcgcgtaggagcagtagagtatattccattgcctttctggacgaggggatcacgaagccaaccctggcacgtaaaccgtctcaggttttcgctcaacctggcgaatcttctctccaagtctacaacttgtacttttttaaaaaaaatatctgctgtcagaacgaccgacgattcgagtcagactggcacgattgactactgtccttttaaacctgacgttaatagtgctaccactaatactcctcctttttataatgtaagtcattttagtatttcccacatttatattgatgttaatgaatctagatagatatatatctagattcattaacatcaatataaatgtgggaaatgctagaatgatttatattgtgaaacggatgaagtactattttaatgtataacgtcgttgattttttatgcaacgtttgaccattcgtcttatttaaaaaaattatgtaattatcatttattttattgtgacttgattcatcatcaaatgttctttaagcatgacataaatgttttcatatttgcacaaaatttttgaataaaacgaatggtcaaacgttggccaaaaagtcaacggcgtcatacattaaaatacgataaaaactataggacggtataccgtctcaacggtatagtttataatttatacttaccaatcactcaccgattctttttctctctaaaagcgtgtcatgtactgtcctttcacatgacggctgctgactagtgacgactgacgagaggtctcttttctcctacattacaaaatagctatgaaatactctagtacagcactacttctacacctctttaggtccatatggatctgacacctgcttcaactagcaaagttagaattaagcactagagctagtagcatgagcctaaacaaagcatgtcagcagcacatgagcaagtttggctgtactttctggcctagctatgcatggtccatctttttatttgattgttgaataggagtatataacccataaatatcagaattagtggtatcacatctgaagtctcgtgacatcacaccctatatttggtatcagatccgctactaagatgtatcaacccggtatctaggtattggatccgatattcataggtattaaacctaacctaggtatcgaatccggtacttataggtatcagacccaatacctagatattagacttggtattcataggtatcatactcggtacctgggtatgcgacccagtacgtacaggtatcggaactgatactcataggtaccagatcagatacccgatacccgggtatctaatccgatactcataggtatcatacgcgataccggattcggtactcataggtatcaaacctgacctaggtatcgaatccggtactcataggtatcagacccgatacttaggtatcagacttggtattcataagtatcatactcggtacctgggtatccgacccgttacgcataggtattggaacaaatactcataggtatcagatcagatacccgatacccgggtatccaatctggtactcacaggtatcagacgcgatacctagttatcggatccggtatttataggtatcagacccgataactcggcattagatcttgtatttataggtttcatacttggtacctaggtatttgacccagtacctggatatcagatatcactggtggagaaaccgtctttggtcggttgcccgaaatccacaatagtctcggttccactaaaaaccgggactaaagatgatctttactcccggttggtggctacagcgggcatatttgatctttagtcccgattggtgttaccaaccgggactaaaaataatctttagtcccggttctaaatctgtcaggccttgtcaggccccccgagatctttagtcccaccaaccgggactaaagataggatctaccaaccgggactaaagatcccagggatctttaatcccggttgataacatcaaccgagaataaagcgtacgcacagcccacgcacaagcgcatgcgtagcccctctctctctctctatctcccatccttatctctttttcttctccttccttatctccatcctctccatccttctccttccatcctctccccttgctcttctctcaccccctctcctcctcccctccccctcttcctcttgcagaggcagccgacggcggcgggatggaggccgggcgcaggctggcggcggccggccggcggcggcgggatgggggacggccggccggcggtggcgggatggcggcggccggccggcggcgtcgggatggcggccgggcgcgggccagcgggatggaggacgcccggcggtggcccggcgcaggccggcgggatggaggccggtcgccggcggcctcgccctcccctcctccagatccggccggaggggaagcggcgggatggaggacggccggcggcggcccggcgcgggccggcgggatggaggccggtcgccggcggcctcgccctcccctcccccagatccggccggaggggaagcggcgagatgggtggccggccggtgagtcgattttttttttatttttttttaatttgttgtttggatgttttgatctgtgaatgaatctatgaatcgatattgtgaatgaatctgtgatgttgtgaatgagtatgtgactcgatgttgtcaatgaacctgtgaatcaatattgtgaatatatttgtgatgttgtgaatgaatatgtgaatggatattgtgaatgaatttgtggtgaatctgtgaatcgtgctgtggagttgtgatgtggatttggggtttgatttgatgatatacataccactcgattcgggagaaaataaaaaagaaaaaaggaccagctaatggactgccgctaccctctctttagtcccg

SEQ ID NO: 80137 - DNA, 15565 bp, Oryza sativa
aaaaccgggactaaagatcgatctttagtcccggttttttcacccgggactaaagatacccggattggtagtcccggttttacagggggttacgaaccgggactaaaaagcacttctccaccagtgtatgataatctagcatctatgtatcacatactagagtttctaagatgtagtataaccaagagcccaacatgacatatctaattagaatccattgtatccatatataatctaggtaattatttgtctggtctaatccgtgcatggtataggacacatgcaaatagatgcaaccaatcttagacacatagctaggctactaggctctgccataacaagtaccctacataactagggtacgggactactagtagctattacagggatttggtatgcacaacaagctagtagtacctccggttttatttactagctaggctagtatcaaaagcaggacttaagcatgctgagtactagctagctgtcaggaacaaaactatacactgatacacacagcaaatgtgcgtgatgataatcctagcagcacgcgacatactcgggagaagccggcacgtggggccgcggcatggaggataagtggtataccgttcaacggtataccgttgtgtagtctttctctaaaatacggatggagtatgttcgagggaatttgacgatatttaaaatttatcatggtttatctcggtgatacgagagaaaaacatcaaacaaccgatgctaccgcctacggtcttgcgaataaaaaggtaaaataccgatggtgcacaaaatacatataactacgtaaaaagagaaaactagcataaatctgcaacattttatgacataattaatctggaacgtaaaaaacaagagaccgtaaaatatatattttatattaagatgtttcgtttacttagagcacaaagcagaatccgctgtgctcaagtatcaaaactggagtacttagtggactaaaaaccaaccaaagaattccgtctgccgttgaaagttgaaactaaactacgatttgggcgcgtgttagctgcacgactcgcggctttcgaaaccgaacggcacggcacggtcggagataacagaaacccacctggttatctgttaccgtgttctgaaatctgaactactacccaatgtttgagactagctcggtgaggttcgcaacatcaacctttttgacggctatcggctcgtgtcggctggatgcttcggcttgcgtcacccggtgggcgcgccgccagccgatcgaacgggaaggtgaggtgcaattccaacttctcctccgcctcccgtgggctgggctacctgttccatcgccatatacacagtccccaccgacacatgtccatggctttgctagtggtataatttcactttgattctctaaactggttgtcggatccggttcgtatccctaaactataacatcggatattttgactcctcctcaattattaaaatcagaacaatttgactccctcgactgttttgaagagacggttttgctgacgtgatagtgttgacctggtttcgtcctacgtgatattgacgtgatgcttatgtgatattagaattaaaaaaatatgtgaaacccgtttatcattaataaaagaaatattatgggattcacatgtcatcctctctttatccttcccttcttcctcatgtctctctctttctctcccctttctctaccccttcgtccgtctatgggaagagctaaagcggtggcaacagaagtgcaagggattccagggcggcaatggtaccgcagtcaggcgtagggacgaaggcggtggactacgaggtggagcagcgggatggtggtcgcgtggtgaagaggaaggaggccggcctcacgagagggagccatggaggagtgccggtcgcaacatcaagtgttgggtgagtgctagtgtcgatcgcaataccaccaccgccgagatccggctcttgcccaccatcgtcctataatattccttctgtgaatgacaaatgagtcctacattttaaaaaaaattaacaccacgtcggacgaagaccaggtcaacaccgccacgtagttaccacgttagcgaaaccgtccttcaaaacaattgcaggagttaaattgtgtcggttttaatagttaggggttgagatatccggtattgtgatttagagataagaatcagattcggctattagttaagagagtcaaagtgattttattcctttgctagttgctgatactacttgcgggctgcggcacatagacagatcacttaacaccaaccaggcaggccagtctccaagagtccaagcccatagccttaggccgaggccaggatgattctaatgggccttgtgccacacatgggcttcacagggcccgaattcacacattgccttcttcttcctcttcttttaataatcgtattaattcacatacgtgctcagtcaaccggaacggggtcatttaacttaactgatgtgaattgagccattaacatgtggaccgtagtaaagtgagctcactggacagtaactcaactgcatgtgtagttatgggtgatctgtttcccagtcaacccatatgctcccccatgcactggcacataccccgtccagagattaatctgggcaaatgcttgttaagattcatgatcagatgttgaggttaagtccagaaatagtagaatactcatgcatgatccccacaaagaaaggagggagggagaagaacatgcatgtggtactagtcaactgtagatatatctgtaacggcatgaagctgcacatgagaagcagttatagttcgcactatttagagacctatagcttcggtggacatgccaacggcaacggtagaatcgggcactatcgatcggacagacgactctaactaatcctgtaccgtaatgagtgctactgaagattttagaatcatccactccaggcgagacatgcttgcagtttcagacatccaagcagagacaccatatgctcagctcaatgcggcgagcgttccaggtgatgatcatgatctacaaacaggcctcgcagcgacaatcatacagacccaggatgtgaacagaagataaaacagctcaaaagcaagcaggcttttctccttcaggccgggctaatcaatgcaatgcagcagcacggcgtctgcacacgcaatgcacaactctcgcgcagtcgcagaacgatctgaaatctgaatagagagcagaaacaacaacggagatcgatcgatcaatcgatcaccgatcaggtgaaggcgtgcataatttcagagattttgcaggagcaatccatctccaatatgttcggtcattcaccgacgctttcagaggaagcgagtgatcgatgagctgctgctgctgctcaactgcaggggaagctggcagacagggcagatggggaagtctcccaaccgcgagaactttatgtcgcccatgcttgttggcagctgatctctctgatgagcttgctctcacacccatccatcagctgcgccgtctcacatcatgcacatgaaccacccgacaccagcaaagatcacggcaagtgagagcattcaaggctcggtagctgcagcagccagcagcagctggtagtagtagcttggtccaaaccgatcagcccagtgagtgatgggttgccatgcctacctccctcccattcatgtgccatggccatggagttctgaatgctgctcagtgccgtttcttccgctgcagcttgcaccaaagctaacagaattcagatcgaagctgatagtacgtgctagtttgctaccaagttaacagcaatccaacagcacacacaacggggagggaaaaggggatattacactttggtcaaaagccatcttgcaggagcagcagcagccaaacatctttggccaaaaggaaacgggagtatgatgatggatgagaccttgagggcatcgaaagaatgaaagatcctctttgctaggcatcgccccagcacgcttaagttcgttcccttccccatgcaggcatgctctcgcgcgtttttttgagcaaccacatctccgtttctaccaaaagccatggagattgagatgagaacaatagggcattgcagatgctcttttgccaacatttccagtacaaggatggaagaactgcttctgaaaatgcaacgatcagagataaggaatttacacaggcttataccagtaaagagtaaaatgggagagatcgtgcaggtttctttaatctatgagtaaaacgcagaaatcgcaatgaatagcctggcccgagagaagaaatgcaagtactggtcacctgaacaatctgacataagctattatgaacagtaataaaccaatctgacagaacaacaatatgaacaattaactcctgatccggactagcacaacgcaagatgcaccccaggagaacaagatcatacaagctgcaatgctgcgttacaaacttttcatacgagacactatgcgaagctgcaaacaaaccactgtaaggcaatcttcatgcaaaatcagaactcaattaatacaccatgctcgcacttgagaatttcgacacaacttgaaccaaatctgccgaattgtctgaggcacgtccatatcagaaatcacgcctatagccaatacctaccccagatcatacatacataaatgcttcagactggcttcccgtgaacaaccacagggaaacactgtacttgtacgcaagacctattaagtaatgacaattactccactgatcacaaagatcacctttcaatacactgaatcactgattcacaaagatcaacttgaatagcaacaagatacgcaacaaaggaatccatccatccatctgcaccttgatagtatttgctttggtcaactgaccaacaatgaacatactgaaacctttgtgatgccattgttaaaaagaattaacaaatagaagtaacaccttaagacatcgttaatgaactcatccaataggctaatataatatccattatgtccagaaagactatgtacatctaagcacaccaagaactctagtcgcatatcatgaaggccaaaaccaaaactctaaacaaaagagagagagagaaaaagaatattataggtaaatactagagacaataacgaatccaactgacatattaacgcatattgacggactagacagagaaaattgccaaactcttttttagttttttaacccatcggcggcgaggttaagatactggcatgctgctcaggaaactgttggtttcaccgccaccggcttggctgggtcagtgccgagcacggtggccgccgccggcacgccgctgacagccgaagcatactgggggaggacgctggtgtagtagatggcgtggccattgctgtcatacgccacctgcggcgcgtaggcctgagcattcgacgcggcggcgggggaagggccattgccgctcgcattggcattgccattgtgctgcgcgacggcgtagacggcggggaaggaggtggcgccggggccagcggcggtggtgaagtagccatgcggcggcgcggggatgaagaagacgggggcatggtcagcgccagagccaggggcaacagatgtataccttcccggcaccggtaggaaggccgtcggcggtggagcggatgatggaggcggagcagcgggcttctcctggtacttgggcaagtagtactccggcgtggccgttggcggcgttggggtgacggtggcgggagggtaggcgcgggtgagggagtcgtcgctgccatttctcggtagggccgccggcggcggcgcggcggtagcgggagcaggtggtggtggtggttgctgcgcggcggtgtcggcgaactgtagcttctcgagcccctggatctggcgctggaactcgccgggagagacgaccggggagacaacgacgtggtcgcttacggggttggtggtgtggcggtcgtcgttcttggcggggatctcgacggggacgttgtccttcaccgtcggcgggtcaccggcggggtccttcaccttcaccgcgggcggcgggacgaagccgttgtcgaggccgaacaggtagtcggggcccgtcggcgctggcaacaccggcggcggctgcggcatcggcacaaccgctggtggtggcgactgcacggagaccgactcctgcttcggctgcggtggcgacggtggcggcggctgatggacggagttgagcgcgtcgacgaaccactggcgttgctcctgcttgggctcgaggaggccggacggctgcggcgggggcggtggcgtgggcgactggacggggaagaggaaaaccctgagcctgggcgtggaaccgccgcgggacgagccgccgccagatcccggcgcggggcggagcaggtggaggcggtcgtactcgaggacgaggtgctccagatcctcgtcgttggtgacggagacgagcgcgtcgaggtcctcgccggggagctggtacttgacgcagaagtcccccggagaacccgcgaggccggccaaccgcgcggcgaagtcggcgaagcggaggggcctctcgagcgacaggatcttcgtctcgccgttgacgtacgagagctggtggtcgtgcggccgcggctggatgcgccccccgtagctcaccatcaaccgcaccttcgccggcggcgccggtggcgggggcgccgcctgcgccgccgccgcctccgagccctcgtggtgcgcgtcgtcggtggccgcggcggagtgcggggacgagtcgccggagtcggccatggcggcggcggcggcgcgcgttagggttggggatgatatgatgggggagagcggggtgaggggagagggaggctgttataaggtaggtaggggtgggatgaacgggttttggtgcgattaagggtggtgattagcgatcttaattctgtgtttagtctctaaagaggggaggggattattgactgcggattttggcgggggtttggcatcgggagatgtgtggggacagttgggattgaggtgtctactgtggatatgtgtgcctgctgtggcgggcccggctttttccatttctttcttttttattatcctgcttcttttcgcgtgatctttttctcacctggagatacatgcacgataggatactttgcaaattctaatagtttggttttagtattactgattggattagcatccagcaatgttgaatcagaaatgtgacgccgttggacagatcgaaatgcacctggcgaattttttcgaattggaaaaaacggcagcatttaaattttctgttcgccgatgcctggtctattgtggaggggctttttttagctgctgtgcggagcgtcagggcgtgccgtgatggcgacaagcggacggaccgatcgaaggaagcattgggtgcgtctggttgcgctttacgacggcccaaactgcctcgccgtcgccggtgtcgccggtgccagcccgcacctgagaattcaccccattttacaagtttggaagaaggaaagcgggcgcaagtttcgatgcgtgggcgcgcacccacagtttccacttccaaccgacagggtgcactcgggcgcccgggtgtgtgcatgcgtcgcacgatcgcccaaggccccaaaggccaagaggggtggtgtgctggggccgacgtacgtccatgtgtcgcgggggtgctgccgctgacgacgcgcagtcgcaggcgcagggccatgtggatgtgtgggcgccgtcggagttaattttggcagcgtgttaggcagagaggccgcggcagccaccacaaaaccggtcgcttctcctggtcaaaacctccgcatctcaccgcagccgcacccacgggcgccaccacaccgctgcacctgcactgcccatgcgccccgcttcgcatacagaaacaactcgttccactgaaattctgacgcatggatcaataattttagtagaagtactgccctttcctggtgaaccggatttgtttccccaaaattatcctgccatgacaaatttgttcgacatcgatggtcacatttccacaggtactacttatggtgatgaatatgtgtacgttgtatttgaggttagatatttgccaggtagtatacgtgataggaggaagaaaaaaaaaacaaaatgataccaggagtacttatttgcactactattaaaatgaggatctgacattacggatacagccaaaccagccgtcaaacgagtgaccgcggaagatggcgagcacccgatgatccagctattgacctggccctcttttcggcgcgtcacagtttaacttagcatccctaaaaactgccacgatcacggatctagccagctgcttaatgacctgggagagtgattacactgagcagtgggtcccatcaccaatagaggtccgtgggcccacgtctattttttctgtgcagatttccttcattctctttttcagcacacacgaaatcgattttatctatcacaatatcttttcttaccaaactcagcgcgtgtgatcttcttttctggctgctttgtttgaagagaagtgcacgattacagtgacgtcgttagtatcgatcccagatgaaagccggatactatattatcgccattagattagactatttgtttcacaacgcatgtggcaagccagttggtagttagcaggcatgttagccggatggattctggcaggaagttgtgtggatggagtatattagtagcactccttgcacaaaagatatactattagtagcaccaaattaacaatgctggttaatccatccgggcaatgtaataatgtacacctttgtgtttccaaccaactaatgcatgtgtgatcgagtagcagggcctgtgtttttttaagcatgcaaagaaggttaaagaaatcattagaaacctgacaatcaaggtgtctaatgggcaaccaagcaaagcaagcgagtgaatcctgcatcaccgttgcatagctggaaaggataactgatgatcctacatttttaataactgatagaaagtggcgtgccgtgggtgacggcggccatgattagctgtgcataattaccactttacaagattgctaatcagcgaaatcatgctgtttttttccttaaataaaactgcagaaaatttacgtgcgtacgtgcactttaaagcccaatcagttttttttttcggatttactcggctacagtttctgtccatgagaccaggggagaggcattgaccgagcgtcatctccttaatgggcccacgtggcagtcacagcgaaatatgggcccaccaggccggggagtggggagggtgacgcggcatgcatttgagctggtggcgtacgagcggcgcggcccacccaacacgttgctgcatcatctctccacacatatgcgttcacaggtgtagtaaagttgactcggtaaaattgactaagtaattcttactgtaacttttttttagaaaaaaaagataaatttaataactgttggttacttcgtgttagtgtagtattttcacgattgataatgatataagccgacaatattattaaggatttaagggcgtgtgaaaagaatagtggacggaatggccgaataggttctccgccaaagaggagatgctgctgatcgcaaagaagaggagtacacgtacgctttgcctcaatgagatttagagagcgatgtgcatataatgtgggtctcgattagggatggcaaccggggacccataacccacaacccgatgggtttttactctattaggagacaaatatgttccaaatattacacccatggatctcttatcgggctaaaacgtcacccatcggttgggccgggtcctggaacgttctccatccacccgaacccattaacccgtgggttaaaaatacccataggcctcagcccagaaaatacaagtagcccaatgcccaacaacaaatctaagcatctaagtctaagtgtctaaccctagaaataaaaacccatttcctctctctctcactgattcacttctcctccctccccggtactgtgctgctgtagggtggccgccgccacaaaccctacggcgcctctcgcccgcgccggcgcacgcccacgccgcccgcgccacccgcgctgtcgcacgcctgcgccgtacggccgcacgcccccaccgcgctagccgccgccgcacgccagcgccgcgctcgccgcacgcccgcacgccacccgcccaccaccgcgctcgctgccgtacgcccccaccacgcgccgcacacaatacaggcctgcgcagctgtgtgttctgcacgcagcatggcagcggtctccggctccggcaacgacgacggcaagtgatcttcttccctctttattaactgttgcagctatatctaatgggtatgggtacccgtcacccgtgcgggtgtgggtatgggtgaatttttcacctgtgagcgggtgtgggtattggagcgggcatatttcattttaatgggtgtgggtatggtgtcggtgaatccaatgggtacgcaccgttgccatcgctagtctcaaatctgtaaagaagattagagtaggaattaacgcgtatatgtatagtatcagcgttccaattagacagcaactctttttttttttttggcttcaaattctactaaacgcaacctatgtaggagtagcacatgcacctccagcttactttggttgcacacacatgcgaatcgccttcccgaagttaagttgagtgtgttattcaaaccagctgcaattatggtcagtctacgcagtctctagtctcacaggtcctctttctttaatatgaaacggatagaactgaattagagcaggtataatagcaggctgtaagccagctgcaaacatattttaaggagataatgagaaaatagaaggataatgggctacagatttgtagccagctgtagcacggactttaagacgtagtgtgcgtatgacaggtgggaccatttattaatagtatagtatgtaagtattgtatgaataaactattagattggctatagataaattgaagttagtagtgggctatactattgaacttgctcttagggtgtacgtgatttagaagcaaacatctcgtcagactttcttgcctgcacacgatttagggattgtttagtttaagtcaaaattgaaagtttaattgaaattggaacgatgtgatgaaaaagttggaagtttatgtgtataaaaaagttctgatgtgatgtaaaagttagaagtttaaagaaaaaattaagaactaaaccaggcctcattccttctctctgtttgttttgttctggggctatgaagaaacagaagaaagtttcttgcggcgccacctcaacgaatatccttgttcgcccaaggcctggagttggactgaacaattctctggataacctcaacaagaccgattcgtttgtcatcatactacagtatcattaggatcagggttttcaatatctgaagatagcccttgacatgttcagctgattgcctgaaactgacaggtaattggtacttctagatgattttatttcagcttttgagccgggatatctacctggagaagattaccttaattaatttcttcaagtccgctaatgatatagtaggagtactatactagtatactggtactagatgatcaaaatggcaaccacctaaccgttaaaacataggagtagtaggaggagtagctacgtagcctgaaacctcggaagtgtagatggagacctcgcagctacacactactgaacaaacgaacggtccaaagccttttcacagagagcaacctccaaaccgggacaagcatctgctgccgtccatgcggcgccaagcaaagcccatcaccgtcgtgttggcaccatcccagccgtctgtccctctcagtctcacccatcatcatcatcatctcgcaagcgtcgtggacgcgaaagtgaagcttcatttgccgatgtactagcaaacttcagcctcagctacatcgtgggtacgctgcatctcctgctccatcggtcccaaaaacaagtatagttttacgcggttcatatctaacgtttaatcattcatcttattttaaaaatatttataattaatatttttatttttattaattgataaaatataaataatattttatgtgtgactatttttaaaattttttataaatttttaaataaaatggacgatcaaacgttaaatacggatactcatggctacatttattttacgacggaggttgtaccaattaacatgatctaaattgttcccatcaatcactatcacggccttaattaaaagagcaagttaattaaaccctctatttatggggctaccaaaaatatgatgatgggagcagatgcagagtactcggttaacttagctccgattgttaagctttaatcttcacatgcgtgcaagtaccagattgagctgttttgtgacttgtttagggtcgagagcctcgagtcccgagacacgtaggcaattaggcatgatgggtttaaccaagatacacatgggttagtgcaaatcaggattaaccaagtactctcacctgactagataaacatggaagctagtactacaagtcaccagccagagttaacaaacactgctctgggtcttgcgatccatgtgagctgaagtgtttgaagttccttccaaacgcattaacaaattctgccctgctttatcactgttataaccactcggcaatgtactgtaggagcagtagttagtggtacaggactatcggtaaactcgaattaggagtcgtggttgattgcattgacgagcgtaacacgagctggtgcagttggttggtacatctgcactcttcacccgtgtctgaatttctgctcgtctgctgtgctgtcgtcgtgctgcacagtctacaggaatagctagtggaccagtggagtaggaggatttacattttacaatctcgatatattgcctaggagaattgcgtgatgcatccacgaatagtactagttgctcgagatcgaggagggagacaaggattgtgtgctattttactggacttcgtgtatcctgtttctttcaccctttgctgctactgcctactagtactagtagtagtactagtttgcttgtgccttgcaagttgcaacatgttgtacgtatgcagttactcgctcagtcccaacaaaaaaaaaaaaaaaaaaaaaaaaaacataggtttctgtgccaactatccgtcttatataaaatttttttataattagtattttcattgttgttagatgataaaatatgattaatactttatacgtgacttatcttttttaatttttttcatagttttttcaaataagacggacggtaaacgttggacacggatttccactgctgcacttattttgggatggaggtaggggctgtttggtttaatgcttcaacttgccacaccacactttagactgccacacctccttagccttgtgtttggttcattaccttaattatgccaagccacactttcttaccatcttacccacatgtcatagactcaatcttttgcctaactttaccacaaatgtggcttacaatttgtaggccacaaaaagtgtggcaagccacacttacctaacattgtctaaagtgagttatgacaatgttagttaagaaccaaacatgctggtagtacttcaagaatttatctggcaggcaacatatgctactggacgctgatatttggcaccggattcagcccatctaattttgagcccaaccagatcttatcatatctgtcaaagtttattcggcccaactatatatcattacgaggcccaccagtggcagtgctcccctccctattggaccggagtacaacaaagcccaattgaagagacggcccaatgaatgggctgcagaacaaggcccacgccgcaattgctccgtggaacatagggaaggaaagcctcgcaagcagcaggcgaagaatcgaattgcggcctgcggcaatttgtcatcaaaactcaaagacatatttcagctacttgtcaatttgtcatcgcatacaaagcatcgtcttcttgtcatcagcaacttgtttgcgtacgattatgagctatgctttggcctacttccatcagcaagtgtgcaatacgttgagctagcatccagtggtcactggttagttagcagtagttgtgtactgccagtatagtagtagctaacaggaaggcacattcagtgtgtcagtcgacgagtccatactaagtcataacctggttgtccgttagctgcaggccggacccgatgcgtggaccaaaagagtatcggaattcagacacgccacatgattttattgatcggtacacgctgcaagtatggctgggctggtccaagcccaaaattattaagagcaatgacccggtttcagttgcaggcagcaaatggaagagaatacttgtagtatccaggaaaatcttcctctcaaaaactttgaaatatattagggcattgtttagttccaaactttttctttaaactttcaactttttcatcacatcaaaactttactatacacataaacttccaacttttccatcacatcgttccaatttcaaccaaacttccaattttagcgtgaactcaacacaccctagtatttgctgcagaactgtagagaaggattattagagcatgtaactgatgatgagaatgctgaattattgatgcaccaactcttcatccgggactgattcaaagggatttagtcgatttttctccctcgattaaatggaagacactggtcttctactctgttatcatctgttcaggaaacaggactggagtagccacatttaccatctgtaattataaatttataatatgctcatttgacagaaatgacatatatatcatccaatgcaatggaacatgagcagagagtagtaatctagagtaaatgcccatctgtttgtacattatcttaccaaggatttttatcaaatcctacctgaacgaaagcaaagccgaaaagaaaaaccatactaaaatagaagagagatcagggaacaatacacctaaactgcaagctgagagaagcagcactgaagaacaggacacgacatggatctatctatcatcatctattggaatctggattcgggccactcggaacctcatgcttgctgtcgtcgatgccggccgagttccacctccgtggccggaacctcctcgtcctcgccgccggcagcagaaggcgccgtccaccggccgggaccgacgtcgccgccgctggcaacgacgacgacctcacctttgcttcttcttcttcttcccccggaggaggagccagcgacacgacgagcataacggcgcagagaaacgcacagaggccgagaagcggcagcgcagcagctggtcttcttccatctccaatccatcgagctcttgccatgcaagaatcagcttgcagtaaagccttcgatctccccgatctcacaagccaccactaaccaaaactcccatgggcatctgccagaagacgagacgagagcttagctgaaatatcgctct

SEQ ID NO: 80138 - DNA, 4103 bp, Oryza sativa
ctcactctcactctctcagcgtgtgtgagctcagctagctcttgtaccgtggagacaatgcaagcaggcagctgttctattctttccaggattcacacatgggttggctacttggcttctctggagtctggaccaaaagtttgggtttcttgctttgcttgcttgcttgcaggtgaaatgggagatgaccatgtgtatgcaaaggcacggagcaggggtggctgcttcttatctactgcccgtgaagagaagcagctgagagagctttgtgtgatccatcgtgtatctgacagcatcatcaccatacatcgatggctttgtagacgcctcagcaagacatgcccctagattgtactgctactgtagctatatccattgcatgcatacgcatgctaattacttgcagtatggagtacgtagtactatgactgtatgagcgtgaatcaacatctgcattgtactacgtactgcagatgtatgattgcactcgctaggtgtgtgagaaatttacaattgcttcgagtatttacttttgtcggtcgcgagctcgcaggaaaaagttgatcatggaggacggagcagcaaaaggacgcaaaggacgcgatggaaaagacgtaagacggcatcaactgagagctttgctcatcttggtaaggctgtaaagctccaatccaacaaaatatttgacgctcattgacagtgttgctgatctttcattaactaatccatctcccttttaattctcatcttatttgtatatctgtcaagaacaaaatgatgggggtgctacgatgttagctctgccattcaacgtttccacaggctaagctagcaagcatgataaaaaggagaagattgtgaaagcctgaaaggagtagtagcatgcatgcatgcagtgcagccaggccaagccaaacaagaatgcttttccatggactgacgacaaacacaagctgcatctacacaaattcatgtccaaccctgtagcagacaggcaatgttctgcagttgtctcgtcacctcctctgtagggactcgctacagtcaccacacggaccttgcacatgaactcaggcaaatatatcatcacatgaactgtaaaagattgatctactagatggacaaacacaaacacttcactgttcgccatgtagatgctgccggatcgatcgagaatttgatttgccgtttttctcttcgagaggggacgagtggggcgcgcatgctggatgaaaaggttacacgaacttcaaagcgggcatggttaattatcatgggctctagagagggcaagagctgactgaaactggactaatctccacctatcgtctaatcacaactcattctgtcgccggccatgaatgcctcgtgattcgggatatatgcaaacggaggaagcatgcactgcacatcctgtatgctactggagtactattatcagcaggttacttttgtgcatctgaacgtggcaaaccgggcttcacgggagcaggcatcatcaagagccaaaacctcccactataattcttcttttcgactctattcttcaggcttttgtattaagcctgcagcaccctctcaatacttcaattacaataggatcggtgaccacagcttactaggttaggggacacaaatatataacttgtcccaagttaacatttgcattgtgcatctgcttttgtagcagtagtagtagccgtgctaatgcaattattgtggatggaacaattcatgtaacaatctcatgatttggatacccacggcggcaagcatgccggccgatcatcctagctactcgtaagtatcatttcagttgcatacagtacaatactccctccgacccaaaataagtgtagccatggttttctgcgtccaactttgaccattcgtcttatttgatttttttttttaaaaaaattaaaaacataagtaatgagtaaagtactattcatgttttatcatcttataacaacaaaaatgctaattataaaaaaatttcaaataagacggataatcaaagttggacgcggaaactcatggctgcacttattttgagacggagatagtagtattgtctgttcagttaggcttcgggaagtgtactaaaatattacaccaaaggttatcaaaagctggccttaaatacataataacttagcagcgcgttactactagagtactccagtatttaggaccctttaaatcacaggaataaaaaaaaatgaagaaataggaaaaacataagattttgacaagaatatagatgtaaaactgtagcgcccgttccgtcgtggcgcctagcgggaaaactatctcttaaaaaccctatttgcgaaatccgtttctttgcttgttgtctagtgtccgtgccatctcagatctcaaatccccgatctattgccgagttcaatcccgaatccaaatccttcccaattcaaatccctccgcaaaagtctatttcgcctccctcgggttcgatgggccgaatccctctcggcccatctccccctccctccctggctctctctctctctctccccgctctgccgtaagccgcgccgagccctccctcccgctctcacagccgcttcccgccgatgccgcccaaatcgccgcaccgcccgcgcgcgcgcgcgccgtggtggccgaccggccagtcgccgccgccgtcagcgcctgccgcgcctgccctgcgtctgccgcccgtgtcgccgctccactccaaaccgccccgccgtcatcgccgtcgtcatcgactcggccccgcctctccccgcgcgtccctccaagggacggaggctgagctccccccctctgccgcgtcgccctctctccctcccccttttccccaaagcggcaaggaggcaagccccctttctctcccccttttttttttctcttttccctcccgccggcgtcatctttccccccctcctgtcgccgttttggccgcgagcgccgagcgccagctcgctcccttgaccgcccaaggtcggtttccaaaccgacatcgccgccctataaacccaggcttcccccctttcctttcctctcccattcgcctccactccattgtcgccgcctcccgtgctctgttcgctgtcgccgttcgccgtcgcgcgtgtcggaggagccggcacgagcgaggacatggaagaggactccgggcgctcgccttcttcctcttccccggcccgaggccggagagatcactcctgtgccgtcggcctctcgtcacagcgccccgcctcatctcggtagtgcattcccccgttctccctcctcgatccatctcctccccttagttttcggtagtagcatgtgtagccttcccgtagctagctggcgccgccccgaccgttgccgccgctcgctgtgtgctcgccgccgtcgtcgcccgtgctccgtagcgcccgctcgtcgccggcctcgctcggcgtagctccgcccaatccgacgctagcaacggattcccgtagccgcgtagatgctctcaccgccgggaatcggcccctcatgacctcgtcgccgtttcccccttccctcgccgccggttgccgccgccgcaatccgcccccgtcgagctccctccggcgaatccgagccgttggctcatctcccctcgtcccatgcaaccccccggtgtgctcgctttcgcatgtatcgccgtggttcgctccaccaatcgccaccgccgtccgttgtccgttccggccggcgtcgtcgtctacctcccgccggcccgcgtggtagccacgtaggcgccacgtcggcgccacctcggccgcgaccgggtcaagcagaccccggtccgccgcttccctccgcccctcgcgcgcgcggtccaccgcgagccgtgaggctgcgcataggcccgccgcaccgcgtcctccgcgaaccgcgcgcatgcgccgcgcctccctccccaaaccctagcacgccccgcgtgcacctcgctcacggtgagctgagtcgccgacaagcgggtcccacccgggaccacgcgggttggacccggcccaccggctctctctctcccctccccgcccgcgcgcgcgcgttgggccgccttcttgggccggccggcccattaagctcgg

SEQ ID NO: 80139 - DNA, 564 bp, Oryza sativa
ctacaggccgaattctagctcggtaccgtgaggcagttggggacttggggttctttcgggcgtggcatgcggctggcatgcatgtttttttgtccctagcgtgtccgtccaccgccgagccacaccccccaccccgggaacagccaaagcccactcccatctcatgcgcgcgcggtggtgtacgtcgcactatcgtaaaagcctcgccccccaccggcgggatgcttcccccctcgtcgtcgtcgtctcgcgcgcgcgcgcggtgcatctgcgtgtacgcacgcatttttctcttggtttgttgcgcacacatcctgccccgagcggcccgcgcgtggctgctcacgtgggcgctcgtgtgttcggcaaaaatccaccggcccccgtgttgtggacggcatggccgtgatcgctcggttgaatgggcgtggaggagatctaacggtccgtggacaaggttaaaaacatactactgttacaggcactagatatacttccttcgaaaaaaacccaaactaatattagacgttttggtgtactttttttttttaaggatggagggag

SEQ ID NO: 80140 - DNA, 7207 bp, Oryza sativa
ggttcaaggacaatattgtaactcgacaacaagttgagggaccttgggtgtactttttccccaattggaccacaaattctttctttctgttacgtgcggcccatatttgttgggccgtaacggaatttggaatttatgcggcccaagaacgggactgggatttgttgggccctcccgcaggtgcgctcagactcgccgtcgctcccccaatcggccgccgcctccgccgcgtctcgtccacttgaagagcaacatctctttcactcctcgaaccctagcacctccaaatcaatcattctcgatctccgcgcgagaatgagatcctcctccacctccagcctccaggtacgcccccgactccattgctctcatttgtgagggttgtatgacatccatctgcggcggggcggggcgggtggagacgccgcccatttcttctcaacacggctagcatgcgacagaggaagccctcaaactgatgggctaggatgcttggcttcgattcgatgttggtgctatatgattatcacaagacttcgtgttaatctttctaatcattacccatcaccaactgctacttcattttacacttgctgctttaatttatttaccttacattttgctactcacataaactttgttccagaaacattgtttgaaaatatggtgatttttttaactattgttgataaaaacttggtgctgttatggacctggcctgatctgtggtggcgaatgagtgaggggatggcatcactctatatatgcgaaaagccgaaaacagccatgtgttctgctctttgttcctttttgtttaagttttgttgctgggataacactttgtagcctgcctctcatgaatcatgatggaaatggaaggggtctccctcttctggctataatacatttgcttctcaaatattacagtacatttctaaaggaaagaaaaaaaaagatatggtaaattgaaacttccatgcctttttccatatctatttataggttttgcacgtgttgtccaaatgtgatcctttatagaggtcacacctttatccaggtttcttatccgagctaatcgaaatccaagaacaaaaatactactgtggcaaaaaagaataaggaagaacataaggaactcccacatgtccaaaaatggaagcaattagtttggtttcaatacaggccacaaaagaaatggtcagctcaactcctacggttgaggctcacacctcattcaccctgtcctgagcaatcctttttaggctccttcctgcaaggctgcaactatataggccgatgaggacagaagggggaaaaaacacaggcgcattctaccgagaggcacaggggttgcaagaagtcgcctaattctcctattgaattaggcacatcttcgcccccacattgcctctcattgtaaaatagtatcaactgataatccacaggaactaaacaacaattaaatccaattatggacggattggtaggcctcttgaaaatacgggtggtgcgtgggattaaccttgcctaccgcgacacaagaggcagtgatccatatgtcgtccttcgcctcggcaagcaagtatgattacttttttgtttttatatctctagcgatttgcctcatctccatctcttttgtttgagtatatattgttctcagtgtcttaccgagttttgtgttttgatcatattacagaaagtgaagactagtgtaaagaagaaatctgtgaatcctatttggcatgaagagctaactttgtcgatcatgaaccctattgcaccgattaagcttgtgagtggatgttgttttcttacaagcatgtgtactaactgattatgatatttcatgttcaaccctgtttttttttaatgaatgctcacattgcggattttcttcttctgttgaaataaacagggggtgtttgacaaagacactttcagtagagacgacccaatgggagatgcagaaatagacctggagcccttcatggaagttctgaacatggacccggagaacattcggaatggttccatcataaaaacaattcgaccatccaaccagaactgccttgctgatgagagtcacctattctggaggaatggtaaatttgtccaggacattattctccgacttagaaacgtcgagagtggtgagctgcaagtgcaactgcaatgggtgaaaattcctggcaggcactaagtgtctcatggccattgggagatcttggctactgagatatcattgacatttccgaatgccaaaacatatattgtgcgaaatggatcatgtcaaccattggggctgtaaatactgtgcaaaaaatgaatcatgtcaagcacgttttgatgtggaggttgtgaccagcaaagggttcatcaggttagtcaatgtctgtaggaaaggaaaatgatgttaaaatgttgttgccgaaatgtattgggagcatgatcagtaaagcttgggatgacataatcaaatagtacaaacgataggaccatgtttgcctgtgcttttgcaacaaatcaatcacaaatactgtttctcatgtggaattcttcttcagtgtcgtggcaatcactatctgaacttttgcctgaacctcaacttttatcatcttaaacagtattatatcctgttatcttgagaattgcttgctgcttaacgtggctcgatgcagtcaagtgggcgaattcatttttgcgattctgaaagtgaaccccttctctagtagcagtaacattttttttgcctgaatttctacggagatgagagtaagggacaagttcaactgaaagggagaggcaaagaagacgatgatgcctttgttcgtcgtcgtcgtcggcgatggctgtggaccgcaggcgaggtgataacccaaccagtggccattgatcctcttatcctcccgcggcgacgacgagcggatgccatctcctcctccccgcattatccgcagttgcagcgcacggggcgcaacaggacaataggataaattccacaattccagtagcctacaaattctcacctgctcccctgtttcttggttccccttcctctctcatcagcacacactgtcaccacaacagccaccaactcctctcaacttcttgatccggcggcggcggcaagatgttcggcggcggcggcggcggcgggaggaagccgctggactacgaggagctgaacgagaacgtgaagaaggtgcagtacgcggtgcggggggagctgtacctgcgcgcctccgagctccagaaggagggcaagaagatcatcttcaccaacgtcggcaacccacacgcgctcggccagaagccgctcaccttcccccgccaggtcactactcctctttctttcttcttcctctactactagtagattcgatcgattgatttctccctattctgttgtgttgtgcaggttgtggcgctgtgccaggcccccttcctgctcgatgatcccaacgtcggccttatcttccccgccgacgccatcgcgcgggccaagcactacctcgccatggcacccggtggactaggtatcacagtcacacacaactctagtgttcttggcaaacctatcatgtatcctttcctcaatcgaaatgctcccataagttgtcaactttagcttccttgcaaaagcctttttagttgtgtatgtagttcttctctcgtagcccatacacgcgagctcgttgactcaggttttatgtaatcaggtgcttacagtgattcccgaggtatccctggtattaggaaggaagtcgccgagttcatcgagaggcgtgatggttatccaaggtcagaatgatcaagagtactcatgacaagtctcaactggtggtgttcttttacatcatagctttcttgggccatattctcacacctgtatcctatacctattgcagtgatccagaacttatttacctcacagatggtgccagcaaaggtgtgatgcaaatgctgaataccattatcagaaatgagagagatggggtatgttattattccttaaaagctatatttgccctgattaattcagtgctatttctactgaagactaatttcaccccatctgattcaaccgagatgtgtaccttccttcgcagattctggttcctgttccacaatacccgctttattctgctgccatttccctctttggtggttctctcgtgccatactacttagaagaagaggctaactggggacttgacttcgtcaatctccgacagactgtggcgtcagcgcggtcaaagggaatcactgtgagtgttttacagaaatttgggagtcacggtatcttattcagtcattcatgcaattactgtaaatgagttcattaccatgttcctgcatacaaaaaacaataccccaagtaaaatagcaatatcaatgtaatattgatgagttcaagtctctctaagtggaaaatggtcactggaatcaacctcctcaccaccggccatcggcgtgttctcttgatcagttcaaatctttgagtcatttctataaggctttgttcaataattcatcaaaaatagaaaggcttatatgaagttctaaagcatgtatgattgaaacatgtcccttggagaggaaccaccgaaccacactcattctgtaatgttatactcctgtgtaagcagtaaggggtacatattgtttttgcatctggtggaaagctatccttttcttaaccagttccgataatcatatcctcatgttatcttcactggctcacctaaaacctctgctagctcttggacagaaacgctagccgttaggttggaggaacactttgctagtcattatctagcatgcaaaaagatgcccacttgatgatttatgtccatcagtacactttgttttggttcctcttttccatgcttatatttcttcccctttcttttattttcaatcatgctgtttgcataaaaatgtagcatttatactatctgtattcagctttgatgttattttttcttccataggttcgagcaatggtgattatcaacccaggaaaccctactggccaatgccttagtgaaggaaacataaaggaacttctcaaattctgcttccatgagaacttagttctgcttgcagatgaagtctatcaacagaacatttatcaagatgagcgcccatttataagtgctagaaaggtaacttttgatttctgacccgtgatgctttatcatgaatacaacatttcccaaccttttactttcatgtggtataccaaaaattaaaatgaacataataagttgccttcaagtaccagatggaaccaagttaattaatagctgctccttttgatgtggaaatttaatagtttttttcacttataaataactaatacatgagtttatgccctaatattgattactttgatcaattgtaaactattctgattgctgatgttaacatggactttctcaatttcttcaggttctgtttgacatgggtcctcctatgagcagggaagttcagctggtttctttccatactgtgtcaaaaggatattggggggagtgtggacaacgtggagggtattttgaaatgacaaatcttcctcccaaggtgatgccattatagaatatgtgattgatctcaaaagatcgtgattcaaatttctagtctttactatatagatttatagaatgcagctacacaaaaatgtagatgcagatactagaaaagatgttacattcttcatgccatgttgcaaagtctaatagagaatatgctagtttcttgttgttatatttggtccacagtaaaatagtgtatatgttgaactatgtaatataatccagtagcccatcctgctaactaggttggtgtagttacatttgttgcaccgaaatattcccttactagagtggtctttgtcagtctcagaaacttgagtatgaacaacgtaaactggagtttgcaagtttgcaactcttaggtttgtccaatttccaaactgtaaacttaatgtttgacaaattttgaagagcctttggcagttgaaatattaagcttttagataagattaagcactcgcacaagattggttatagatcatgtaatgtaagattttactttgaagtttggatagtagcacagataccatttttctgtttgcttgtgatctaattacgttcctcatttcatatgacagacagtagacgagatctacaaggttgcatcaatcgcactcagtccaaatgttcctgggcagatctttgtaagtcaaacaatattcattgtttttgtgcaattatctaaaacagctttccgttcttccagtggccaaaccacaagctttaaaactggaaatatgatatccttaatttatccatggagcattactcaaaatttcggtgccctgagatgcccaaaaatatccagattttttttccatggattgcaacaataatagatgagagcatctaaataatcccttatttggtcagtccatatgttggtgatgagcacaatggcttactttattagcatataatgctgcaccttgaaaatatgtctctgtgggctacagccttacaaggaatagcaaacatgcatttctttttgtgttagagttattcaatgtggtcttagttcctgaaacagtttagttgcaactgtactaattttcttgaagttatgttactttgctttaacaagttaataaaaatggttttaatgtcatttacagatgggtttaatggttaaccctcctaagcctggagatatctcttatctgaagttttctgctgaaaggtatatactttcccttctcatcattttaatccatgtctgcattttcaaggaaaagaagacctacacgggtattcagttattcagtatttatttcctctggtagtaatttcgagtgttctatgtataatgtgcctcctgatgatgttgcagcaagtctatcctcgagtctttgaggaggagagcacgcctgatgacagatggtttcaatagttgccgaaatgttgtctgcaatttcacagaaggtgacattaacatatgagccccttcctttatggcaataggagaaaatgaagcagcttctctaataatgctcttccaattatgttgttgcaggagctatgtactctttcccccaaatacgcttaccaccaaaagctatagatgcagccaaaagggctggcaaagcggccgatgttttctactgcct

SEQ ID NO: 80141 - DNA, 1964 bp, Oryza sativa
ctttctttagacgtgtacctttacttaattatacttaatttggcgcagtttaatttagctttgcgtggaatataataaacgtgattaatggtgatcgatgctagaagataaatggaattaatgattagagaatatgttcactggagatggaaatatcatgggaattaattaagctcaccgcgacggtgattcccctgaagacgtcgagcgacacgaggcgctgccgcgtcgtcgtcgccgcagcctcgccgtcacggccgaggacgcctgcctcgacgtcgtcgtcggctccctccttggggtattcttctcgacgattgttgccgccatggacgctgctgctgctgctgatgcacttctccgtcgtcgtcgtcatctccattgatgaattcacaagctagctagctatagctatacttgatggcgatcaatcgttagttgttgccgtcgatttggcgatgagcagcagctgcatatatatatacagagaagtgagctctagctagtgttgcattgcaaggtcactctatactgtagattcgcctttctgtctccatctcaagaacgtatgggaagttgtagtgctacacatacgtggctttttaatttgtgcgtcactcacccgcctcacgcgtgcaaatttacagtcccctctgctaatttcttggttttgttgttcaggacgcggatgcgtaagtgactgaaaaatcagaaaaatatgttccattgaatttgagtaggagttgagtaggagtgcgcctcgtcgcatgaccagagttttcactttcgattttgctaaaaaattcgactatttcagtagcattgaaacccccgaaatttgaggattttcagccctttttagaccaaaattatttaaaattttaacataatttaactaaatttgaataaattttaaccaaattaaaaaaacgaaaattttagacgagataatgatttgccgggggtccgaaatttcgaaccagagttgcattcactgcacgagacccattaacattaacaagaggcggttttgtctttttcgacgaaaactcgaaaactaattaataaaaggatcgagatgaattcagctaactagacagtttgatggggataaatatcttttaggcgtgattagggttgggaccatcggtccaattgctgtatctaatatcaaaatcgttaggtcactttggcatggttttgttccagttcaaactggactcgatcgggaacatgcatgtcagcatgttatctcgcccgacgatatctactcagcattagagctacattttgtccaaatcagccttccaactttactgtaattgagaacttagcatctcagtcttaaaatataatatttttaacatactcaaacatttttaactatgactattaatagcaaaaaaaaaagattaatcatgtaaaattaatgttactagaattaaagaaactatcataatatgcaactttctttattttaaacatcttacatttataaatattgtttgttaaagtagtatctcgaagaccatgtagaagtcctagaaaagcttatattttgaaacggagggattatacaataagctctctgagttctactactagtaaaaaaattattcaactattcagatgatagtataaataaatactacttcgtacctctgtttttaatatatggcaccattaattttttatatcatgttttattttaaaattttactccatctgtcccaaaaatataagcattttggactctgacacggtctccgagatgctaatttgaccaacaatatctagaaaagtaagaggttttaaataaaaagagttcatattgtgatagtttgttaataataaatctagtaacatcaattttacaggataaatcttttttattctttcgttattaatagtcaaagttaataatgtttgacttgtcactatgctaaaaatgtttatattttggg

SEQ ID NO: 80142 - DNA, 636 bp, Oryza sativa
attgtggtgtacttacgttgacgaagcagtcgtggagaagaggcggaggatggccggcgccgtgcgggggttggcggcggcgtggcgctccatgaccgagcgcacgatgctctgcgcgttggggcacgtctcgtcgtagtaactctccgtgaactcctcgtgaccgaagggatttggaaatccctgagcggcggaggcgagagccgcgacagcgacgagcagagcaacccaagcgacgccgcccttacacctaaacgccatggctgatggtctccctccggcctcgagagatcgatcacgatcgacaaagctccgaaacgagagatcgatcgagccctaggcccctagcttaatgattagcttcgccttggtactgacaaactccgaagtgatggtgagctctgctgctgctggctgctgctgattgcagatgttgtggtggatgatgatgagtaggaagcatgcgttatatagatggccagttaacgcgtggcgaacgtgcgcacgacggggtccctggtctctgcaagcgcaagaccagcaaagctcgtgcggcaactcgtgacgaggtcaccaacaagagaaaaaaatgggaaagtatagagaaaagaaaagtaggaaacgaaccaaaacaaa

SEQ ID NO: 80143 - DNA, 802 bp, Oryza sativa
aggaaatgtggaccgtggtcgccgagacggcggaccgcaccagcacgttaaacctgcagggcgaggtcatcgtaatacttgttgtacccgttgagcagccgggcgaggtcgtcgtagtggtcggcgccgccctggtcaatgaagaagtcgatgccgtccaccgccgcgtcgtcgccgaaggggcggtgcacgccggcgcggtggccgcctaggtaggcgttccagatcaggttgtcggcgacgtcagcggcggaggccttggtggggagggagtagccgccgccctggccgccgatggagaggagcacggtgatgcccctggactggcagtgcttgatgtcggcaccgacggcggcgagcgggtggccggagatgtcgagcgagtagcggccgtagccgaagacgttgtagaaggtgatgatgacggtgttgtagcggccggtgtcgcaggcctctctcagggagccttcctccttgtggcggccccagtagacggcgaggcccgggtcgtcggccgtcgctggcggcggcgtagcgtgctgctcctgctaaggggaggagtgcgtgcacgaggcccatgtgtaagttgctgtgtgctagctaggttgatggttttgccatgtatttatagagagatttgcaggtgaagcttcatgtcctcttgtgttgtggtgttcgtgcgtgatgtgcatgcgtacaagtttaatggattgattcgtccacgtggattgaagcttttgagatgtgagcatttgactctatgatcggcggctagttcgtcggtgctgctcgatcgaatcat

SEQ ID NO: 80144 - DNA, 2888 bp, Oryza sativa
cggacgtactccctccgtcccacaaaaaaagaaaaaacctggtttccgtgtccaacgtttacccgtccgtcttatttgaaaaaattatgaaaaaaataaaagacaagtcacgcataaaatattaatcatattttatcatctaacaacaatgaaaatacaaattataaaaaaatttcatataagacggacagttaaagttggacatgaaaacctatagtttgtctttttttggatggagggagtaatcctctattagtttctcatcaatactagtagtacgtactaccgctagtccgctactagctaaccgtgcctctggccttttaagcaatactccataagcaaggatcattaatacagaacatcacatatgtattgcctcatatgtaccggttcagaatttctagccatacaattggtcaaagttgagattctttagaaaaaaaactgatacatacaatggtgccactcatatatgtatttctaaactaattttttcatataaagttggatgaagataaatatattaaaattgtagagctaaaactttgtaggtgatgactttttatttgagattatttagatgtgcgaaaatctgctattaagtcacggatctatttggataagtgaatttttaaagttttcaaatgacttatgatgaatacaaaatctatataaaagttatagatcttgtcgatatctacaactttttggttgacaatatttttatttgatcttgtctacgatatctaatatgtattataagcttcatatataagagtagtcaaaagaataatatctgcaactaaaacaacaaatgcttaattcgtgaaatggtaaggaggcttcttaggcctcctttaatggttgagctagtgcactagctcatgcttgtccacctcatacaagagatagcaaaaagtctacctttccaatagattgtctcatagcacattgtttaaaatgctttgggttccacaattcctctcacattttctttaggagcttagctcttgaagaagagatagtgtattctctctccttatcttctctttcttccacatcagacaaaaactgatgtggagatttatgagctagctgactcatccttgttggaggaggccttatggagagaggctcggggttcatgattcatcaagtcttataaaccgcatgcgtacatattttaggagaaaaatcgtgagttgtgggaaccgaagcgtgactacatataggtaaaatacaaaataaaaaacaggtacacccatcgattctaaactacaccctccgtctcaaaaaaacccattcctaacatcccaaaatagaaatagtagagagtgagaatacctaaaatgcccttaatcattgaaaaaagtagtaagagtgataagtatataaagggtattgaagggataaaacttctcgttttacgtgctgatggtagataggatgatagaagttggttttttgtgggacaaaatttaaactcttttttttttggaacggagcgagtagacactaataactaccagtttcagaactagtactaactaatatccctcattagtgccctttttatggtgttggatctaaaactggtatctataaaggatttagaattagcactggtaaaaggatgtttgtactaatggttcacttatagatcattatcgcgagcagtcccatatgttagtttgtgataatggtcggtacgacaaggattttttattagtaaatacatgcttccaagctaagcccacatattagacatgaaaagtaccaataaccaagttcacgagtaagcccgcttacaccccctacttttaaaaactattggccgagtccatttatatctctcgtccaaatatccatgtgaagagttttacagattagtacataaaaagtatcaatatacgagtttacgagtcagcccacttacactcctacttttaataaccattggccgagtccattcataactcccgtccaaatatccatctgaagagttttaaattgttatactgaatgtgtccatatactcgttctcctatattcattgaacgatcaaacaatttcatactaagtttgtccccatcatttggctagttgttgtaatccgaagttaacaactccctgcaagtgcacgcgggtcggcaacctatatatgccgacaatcaagaatgatacaacccaaccatgcgatggtgctggtgacgaaggctaattagcatgcatctccactaaatcctaacatcacacaccacattatgatatctagctaactcttgcacacacatctgcactaatcagcaacttcctaccctcgtaccatgtacttttcaaatggacaaaaccaaaaagggcttagctcttaatcacctctcattagctggtaactgaacatactaacctaaattgttaggtacacatgagcatcttgcaacttactccgtactatagtatcttctaccgtcatcgttcctgtggcaaattgctgaggacaggatgagatatttaaaccggggggagatcgatcgatcgctgggattttgatctcgcctgcctggacgcttggcgggtgcgactgcttcttcttgtttagtttttgaggtaaacgacatggagataagctaacttagccatggagggctgcaattaatttggcggtgatggtgctaatgggtggttaagggttttaatttgggtcgtcagaagaggcgattgctgatgctgatgccttgcatgcctggctggttgggccggtttgggtttggattttggtcgtttgggcgattcgggagccgtttatcttttgcttaaatttagccaaaatgtcctgcctaatctcttttgaaagaattgtttacgaactataaacaaaaaactgt

SEQ ID NO: 80145 - DNA, 20315 bp, Oryza sativa
tgccaagattacacgcggtggacaagaatgaccgatttgcgaccggtctgacactgaccatatcgtcagcgcacagccatgctcccacgacgcgctcacccccggcggaagtggaggtaggtgtgggctgtcccatcggagcgtcattcggacagcaaccgtgctgatctccgcccattcaagagaaaaagaacagtccagtttggaaagagaagggtgcatgtggtatccccttgaagtataaaaggaggaccttgcccatagagagggggttggttgattctttcccagattatgagcttagaacgggggagaagtcagctgacacttgtagctcattcatacacagatccaccaaaacacaggagtagggtattacgcttctcagcggcccgaacctgtatagatcgtcggtgtctcgtgttttctggctggcagacgatatttccacatacagagagagcgagagcttgagatttcaccctaagcccccggccgaactggcaaaggggggcctgcgcggtctcccggtgaggagccacgagctccgtcatctggcgcgccaggtagggggctcagcgtgtgctttcagagctctcagactcttccgtgtgccccaagtttttcttgttcagcctaatggccgagcaaggaaaaacgcacgacctctcgccgagtgtgagcggcgacgacggggagccgaatccacgccgtcgagctcgtactcctccacctcctccgcgccaaagccctaagcagggggaggcgcttgagagggtcgacaagtccgcggcgtcaccggccgcaggtgatgcaggagaacggcgagacggggagcgtcgcctcctcgtctacggcgacggcagcacgcctcagggtgcgcttcaagctgctggcgcgctcctacgacacccgcctgtcgtccatgacccggagtctccagcccaacgatggctggaagacgtggccaacttggtcatgacggcacagcagcgcctgggtgctggtggacggtccgccaccaccaccaagacctccggcgccgctaccaccggctccgtgtcatcaaggcggagggcgcggcgagcggcggcggctgcacgtcattcggctgccactccctcgtctacaccgtcgactcgggaggatcagcatggggagccggatgcccgcctcaacatcgggcgccggtgtaatagccggcgtactccccgtgcaacggagggagcctcctcgtccagagtgtcacctcgacatggacgtgaagatcagccctccgtgcccccggccggtggtgttggctgtagagcctttgtggcgagtcttcggaatgtccgttggcccccaaggttccggcccaccatcaccgagaagtacgatgggagcgtcaaccccaccgagtttctccaggtctatacgaccgggattgaggccgctgggggtgacgacagggtcatggcgaacttctttcccatggccctaaaaggacaggcgcggggttggctaatgaacctgccacccgcgtcggtccactcctgggaagatttgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaacactataccatgcatccctgcacacgcggtgatctacgcgttcagggggggcgtgcggcacaaccgcatgctcgaaaagatcgcttccaaagagccccagactaccgcggagctttttcagctcgcggaccgagtggctcgtaaggaggaagcgtggacctggaactcctccggttccggagtggcagcttcggccgcccccggatccgccgctcagacagggcggcgtgataggaggaggaagaagaggtcggaccgttccggcgacgagggtcatgtcctcgccgtcgagggcgctccgcgggccacccgaaaggggaggcctgcgagcgacaaaaagaaagaggctggtactcccggcagggagcgccccgccggcaggtggtgctccgtccacaacacctccctccacgatctcgcggactgtcgtgcagtcaaaaacttggctgagcgaacgaggaagtgggaggaggacaggaggcaggaacgccgtgacggcaagtccccggcggttccttccgacaaacggcgaagtgaggccaagaagaaggcccccgctgttgacattgatgatggtgatgatgatctaggtttccaagaacctggagccaccattgccaccgtcgatggaggagcatgtgctcacgtctctcgccggagcttcaaggctatgaagcgagagcttctgaccatggcccctacccatgaggcgatgcgtcgggcgcggtggtcggaggttgctctcactttcgaccagaccgaccacccaccgtgcattgcccggggagggcaggttgcgatggtggtttcccccaccatctgcaacgtgaagttgggacgtgtcctcatagatggaggagcggctctcaacatcctttcccccgcggcctttgatgctatcaaggccccggggatggtgctccagccgtcacaaccgatcatcggtgtgacgccggggcacacgtggccgttaggtcacatcgacctaccggtcaccttcggtggacccgccaacttccgcacggagcgggtgagcttcgatgtggtggacctcagtctgccctacaacgcggtcctggggagacccgcgttggtgaagttcatggcggcggtccactacgcctacctccagatgaagatgccgggccccggtggccccatctctgtccgtggcgaccttaaagtcgcgcttgcttgcatggagcagcgcgcggaccgcctcgctgctgcgtccaagcccgagggtggtgacgagaggcttggcccctctgcccccaccgccccgaggcagcggatggccacttgcgacgaggtcccggtcaaggaggttgccttgggcgacggcccatccaagaccacacggatcggtggttttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaagccccggaacgtcaagccttcatccgcgaggaggtggctagacttttggaggccgggttcattcgtgaggtcatccacccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggagtgcgaccttttgtgttttctagatgcatactctggttaccatcagattcgcatggctagggaggatgaggaaaaaactgcgttcattacccccgtaggaacctattgttatacataaatgcccttcgggttaaagaatgcaggtcctacttttcagcgtactactcgaatttctttgggtagtcaaataggacgtaatgttgaggcgtatgtcgatgacttggttgtaaaaacgcgcaaccaagagaccttactttcagatctagcggaaacttttgagaatctccgctccgcccgcataaaactgaaccccgataagtgtgtgtttggtgtacctgcgggtaagcttctcgggttcttggtctctgcccgaggcattgaggccaaccccgagaagattcgagctatcgagcggatgcgcccccccagcaaacttagggacgtgcaatgcgtcaccggttgcatggccgccctaagtcgtttcatatcaaggctgggagagaaggcgctacccttgtttaagctcctcaagcgctcagggccgttcacttggacggaggaagctgaaaatgccctcgcccagttgaaggcgtatctcagctctcctccggttctagtcgccccggagccaaatgagtccctgctactttacttagcggcgaccccccaagtagttagtgcagcgttggttgtggagcgcgatgaggacaatcctcattctgcgcacccccgctctgtgccgacttggcccgggagcaggcagggaggagaggcccccgagtcgaacggtggcctaaggcccccgacgaccggagtcggccctccacccgcttgtcaaacggtgctgggtgcccccgaccctcaggaaggccccaaggccactgagggaaggctgcacttaaagccctttggccccgaggctaaccctgtgctgactcgacccaggaaagagcagggagaagaggcccccgagccgaacggaggccagaggcccctgacgaccggagttggccctttgcccgcttgtccgacgatgccaggagtccccgacccccaggacggccccgaggccactgtgggagggccgctcctgtcatcctccgaccccgaggtcatcagcgcagaagacgagttcgccccgaggggccacttggacgaagaacgccccgggggtacggcccctaacgaggaggatcggccccgccgaaaggtgcagcggcctgtctactttgttagtgaggccctccgggacgccaagacccgatacccacaggcccagaaaatgctttacgctgttctgatggcctcaaggaaactgcgccattatttccaggcgcatcgggtcactgtggttacgtcttaccccctcggtcaaatcttgcataatcgggagggtactggacgggtggtgaaatgggcaatcaaactttctgagtttgatttgcactttgaaccacgccacgctatcaagagccaggccctcgccgactttgtggcagaatggaccccggctcccgagctcgtctcggtccccgaagccggctcgggtccctcgcagctgcctcacaccgcccactgggtgatgcagttcgacggctccctgtctcttcagggcgccggtgcgggggtcacgttgacctctccgagtggagacgtcctcaaatacttggtccgcctcgactttcgagcgaccaataatatggcagagtatgagggactccttgccggactcagagtggcagctggactggggatccgccgcctcctggtgttaggcgactcccagctggtcgtcaaccaagtctgcaaggagtaccggtgctctgacccgcagatggacgcctacgtgcgccaagtacggcgtatggagcgccattttgacgggattgagcttcggcacgttcccagacgggataacatgatggccgacgagctctcacggctcgcgtcctcgcgagcccagaccccaccgggcgcctttgaagaaaggcttgcccagccgtcggcgcgacccgaccccttaggggagacggatgcgcctgaccggcccccgaggcccgtcggagtccaggcctcgggacccaaggggagtgctcccagctcccttagattgattacttggatcgccgagatccaagcatatctcacagataagactctacccgaggaccgcgaagggagtgaacgcgtccgtcgcatctccaaacgctacgtgctggtagaagggaccctctatcggcgcgcggctaatggaatcctcctgaagtgcattcctcgggaacaaggcgttgtgcttcttgccgatatccatgaaggcgaatgcggagcccactccgcctcgcgcaccttggttggtaaagcttttcgccaaggtttctattggccgacagctctcaatgatgcggtcgacctggtccgccgatgtagagcatgtcaattccacgccaagcaaatccatcagccggcccaggccctgcagaccataccactttcgtggccatttgctgtctggggactcgatatcctgggaccgtttaggcgggccccgggcgggtttgagtatctgtatgtcgcgatcgacaagttcactaagtggcccgaggcttatccggtcgtcaagatcgataagcactccgcacttaaattcattaagggcatcacggcccggtttggagtgcctaaccgtattattacggataatggcacccaattcactagtgaactcttcggcgactactgcgaagacatgggcatcaagctctgcttcgcctcacctgcccaccccgaaagcaatggccaagtggagcgcgccaatgcggaaatcctcaaaggccttaaaaccaagaccttcaacatactcaagaagcacggcgattcatggatcgaggagttgccagcggtgctctgggcaaaccgaactacaccaagccgagcaaccggggaaacacctttcttcctcgtctacggcgcggaagcggttctcccatctgagctcaccctgaagtctcctcgggccaccatgtactgcgaggctgatcaagatcagcttcgcagagatgacctcgactacttggaagagcgaaggcggcgcgcggccctccgagccgcgcgctaccagcagagcctgcggcgctaccatcagcgtcacgtccgggcccgatcactctgcgtcgacgatctcgtcctacgccgcgtccaaacgcgagctggattgagcaagctctcaccaatgtgggagggtccgtatcgagtggtcggcgtcccccggccgggctccatacggctggacacgggcgacggcactgagctgcctaacccgtggaacatcgaacaccttcgtcgcttctacccctgaggggggggggtcgggtgtcaggtttcgggctcgggccaaccccgcaccccctcgggcgtgcagggttggccgggggctgccacacatgcactttcttatttctcttttttcagaatttcaataaaagcagtttcaatttcctaaaggttgtatctgtgctgttttttccttttgaagaatcttgacttgaaataggtcactcgcgctcaatcctgccctcgggggctcgggtcggctaaaatcgccaaacggggcccagaaccgagccgtgccccggggcgtggtgaactccgggggggaatcggcaaaaacccacaatcgggtcacccataaccctcggtcaccacgttcccggcctggccagtctcgacatgtggatctccccaggcactagccccgacccgcgccttttgaggaccagaacctgggcacgagcccttattcaagctaaggcacaaaaggactatggcacagatcatcctcatctcatactcacagcaagatgaaattgacacaaaaatttcttcattttttgattacagattaagttgatctatacaaagcccgaaggccttagaagaaagaaaagaagaaaaaactgaagaatggcgggggtctgggggctcatcccgatgcgcccggatcgccggcctcgacgtcactgtcgtctacaccaccggcattgccctcatcgtcggagttgggggcaaacgcaagccgaggggccgagccctcgaagctgtcgacgatatagtcggcggcgtcccggacttgcgcgcgcgcgcggttctcagtcccaggagggaactcatccagcgccatccatggagagaagttggggtccctggcctggtaactcgccaggacgagctccaccgctccttgggcgaggtccctcgaggatgacttaattgtcttctcgagctcctcggggagccgttggagagccccggccatcttcgagaggtgctgggcgaggcctccctggttgtcggcgtactttacggtccgccctctccagaggcccacttgccgaccggcgcgatctaggcgggagacggcgtcccaaagcatgccgggcccgacctcgcctgccaagcggagggcttcaacctccccggcggacgagtccagcgcgccctgcagaacggcgatggtgtgttcggcatctgcgaggcgggcggctaagtcgctttcgcccgcggccgccccgccgctgagcgccctcgcttccagctccttcgcccgcgcttcgagctcagcggcccgttggttcagtgcggccctctcggcgcgggcaccctccagattgcggcgcgcctgctcctcctgcgctgcctcgcggagggacaggctgtccgccagctgttgcgccgcggcctcggctccctcgagagctcgctcccgctcgatgagcgcgtcctcgcggaggcggagcgcgagctcttcttcggcgcaggcagcgtcgtgcgccgccagcgttgcttcccggatggtaacggcggcctcgcggtccgccagatccctctccacgacgcaggcgcgctcttccagcgccatggcgcgcgcctcaagggcctcttcgcgccgccgggacgtcgcttcggtctccgccgcccgctgttctcgggcagcggcagcgtcaagcaccccctgggcggcgtcgagcttcttccttagctccgcctcccagctcccgtattgaaggcggagggtgtcctgcgcctcgttcatcacggtggtggcgatgagggcagccccccgctccttctccacttccttggcgatctccgccagcaccttcttgcgggtttcaagctccgagacatgccggcggtgagccttacggcccacctccaccatggcctccaccgagcgtcgcccctcttcgacacgcgcccacgcggcgtcgagctccgcccgctctgcctgcagggcctccacctgggcacttaacccgtccaacaccgtggtgtttgcggcggccaaggcttgcagaaggggctctgcgctcagtagggcagcagaaggcgtggggaaaagccgcctcggagaagatgccacgcggctcggcccgccgatggaagtgccggactcggggatgtctcccggacccgtttggtcctgagcgtcgcccgagggagtgggcccaagcgacgcgcccgccgcctcgtcgccagctgccccggaagttgtcgcctgagcgtcgcccgagggagtgggcccaagcgacgcgcccgcagcctcgtcgccagctgccccgggagttgtcgcctgagcgtcgcccgagggagtgggcccgagcgacgcgcccgcggcctcgtcgcgggctgcctcggaagtcgccatcgtctcgtcctggcgaaatccggcttcctcccgagcagcttcctcggcctggtgggctcgggcggcctcatcccgagcagtttcctcggcctggcgggcccgggcggctccctcccgagcgatttcctcggcctggcgagcccgggcggcctcatgggcggcctcctcggcttcccgtaggcgatccgcggcgtcgcgccggtcagcttcccgcctacgggcctctgcggccgccggatcctcggcctcagactggccggacttggaatggcgggagggacgcgacgggatctcgctgaacaaaagaaaagaccagaagacgaacaagatgggtgagtgaaaactcgcgttgagagaatgaatacagccacgatgggtgagagacgaacctgcgagggggtcggttaaacgaccactttggaggggaaatgaggtttccccgagatggttctgtctcctccatcttgcggggccgcttcttcttgcgctccccctcgggctgcgatgctggcgcggccccctccgggcgcttgctgctggcacgcgccgccccgccccctcggggaggagatgggggaggtgttcctccctgcttcctcttcccccgggcgtcggcagggcggctgctccccgggcccctgccacgggacccagaagcacgaccccctctcggggtagattgttccccccggcggctcccgcctgcgccgtcgtggccctttggagctcgctcctctgaggccccgaccgccatcataatggtcaagatggaggcgcggtctggatcgctgcagagggggaggattccttggggaatgagggccgcctccacggagttgagattcagcacccgttggaccaatatcttgaagtcctcaggagcccagtcccatctcactccctggtgggtcctcatgaagtcttcggacccggtgtactcccaggcgccccgagcgcgccgctggagcggcgcaatccgacggcggaggtagtcgccatacaccatggtccctgtgagcccctgggatcgcaggcccgccaggcggtcgaggacggcgtcatagccatcccccagatctaccggcgcccgccagctggaggcctgcgccgggggctggctcggaagtcggaggcgcgcttcgtcggcgaggggagtgtagaaccagtcgctcttccagtcgtcccacttcttgcggagggcgcaggggatgtagcggttcagcgccggcccccgtggctggaagtagcagccgccgactaccgatggcggcgacaccggctgcacggtgaagaaccaccggaacagccgaagagatgggcgcaccccaatgaacatctcgcacagatgcgcgaagatggccaatgacatcaccgcgttgggggtgaggtgcgccatctggagatcgtagaactccagaacatccatgaagaaagaagaaaatggcggaaccagccctgccattgcaaaggggagaaagaagacggaccgccccgggtagtctggcgccgggcgtccctcgcccagcgtaactatctgtcacaccccgaagttttcctccctagtcaaaattgcaatttataattgaccccaagaaaatgcagaggaaatcaggataaaaccctaagaaaataatgcaaataataatcagatttgacatgtggaatttttcttgaattctacatgtcgaaattcattaacaggatttttagtggaattttcagagctctagaaataattttaaccaaataaaaatcactaaagtgcaattgttaattccagggaaaatcctttttctttttctttttcctttttccccttttttccctcctttttgtccaatgggccgtcggcccatttctctttttcctccccctcctctctgttgggccggcgcaggccaaggcccagcccgacagccggccgcccgcccgcctcctctcggggtcgccgacaggtggggcccacctgtcggacccgtctccctcctcccgccgatcccgctcgtgccgccgccgccgcaaccgacgccgcgcccacgtctccgccttccccgggccacgtcgaccacgcccgcgcgtgcgccgcattccccgcgcccgttcccctctctctcccactcgcgcccgcgcccgagatggccgggattcgaaaaccgaatcccgcctctctctcctccccactcccccacgtcggccgtcgaatcccgccgctcccggccacgtccggttcccccatcccctatttaagcatcgccggcaccccctctcgctttttccccattgcgccgacctctcccgagccccccaacgcctccgcgccgtgcaaccacccgccgccgccgcttttgctactccggccgccgctagccgccgctaggctcgccgccgtctcacgccgtcgccgccgttagcttcgcgcggccgaggtccacctcgtccacccctcctccgtcgaggttcgtcgccggaaccccctccccacgtgcacgggtgagcgtcacctctaccgccgccttcggccatggatcccgatcgccatggtccatctctctctctctaatccctctcttctccttccttagggcacgccggagctcgtccgctatccgacgccgtcctcccgtgacttgccgtcgccgtccgccatcgccttcctccgcgccggccaccctcggtgaggcatcccctcccttcttttcccccttcctctcctcctagagccgctaaccgccgctctccgccgccggacgatcgccgtcggtcgttgctttgcgccgctgccgcatgcgcgccgccgccgtgtgagcgccgcgccgccggcgccatggtcgccgctgtctcgcgccgcgcccgcgcgccccggccgcgaggtcccgcgccgccgtccgagggtagatcggggccgtcggttcggccgccacgtggcgccgccgcccctcctttccccgtgccgctgaccggtgggcccgcgcgccgccacccccttcctctctctcccggtcgctgaccggtgggccccgcctgtcggcgccgagccgcgccccctcgctgacgtcagccctggttaatattgcgcaataaatgatttaaggtttttcttttatagtaataaacacagtgaatcttctaaaattcataactaattcatccgagctccgtttaagcccattcaagtctcagtaaatcaaggaaaatgtgtagaatccattaaaaatggttttgttctctgtttcagtagtcttatagcctgtttgcaatgtttgctttgtatgtcgttagattccgatccctccgacgctccggtgtacttcgagatagtcgccgaggtccctccagcagcagagcaaggcaagtcatgcttgtcacttgatcatattgatcctatattgcaaatgtcctaatgttttctttcaaatatcgcatttgttttgcaattatactatgggagggttacctattgttacagctatgccttttgataccatgctcctttgttagcttgggttataacatgattagattttggactaggaattgcttagccatgcttagttcaactagcacacattggggatcttatttaaaacctagactataggtttatatgataatgttggtttaataccaccgctctggtgttggttaaataaaatgaaccacatggtgggctgtgggtgcatggttttgctagtcgcacccatggcagttaaggaccggttcgcgggatgccctggaagaatttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgtcgcccgctggggacgggggtgaaacctgaggtgtggtgtgcttggctagagggggttatgcgaagggtcctgtcacggcctctttccggtatgtcgtggtgacatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaacttggatagttcaggtggatggctgggcctgtcgcaacgtgggttagcgttggacagcggatgtttaatactgcttaattattacaactgttttcgcattaaattcctgtttataaatgccagtatttatgcaaatgaaccactctagctcttctttgttaattccctgcatcatacccccattccggtatgacttgctgagtacagtgggtagtactcagtcttgctctatttttcccaaccccagaggacgggtatgtgtcagatgaaggtttccccgaggagtaggcttcgtccgtgccgtcgaggatgcctgtggagtggtgttcccgctgcggtttagtcaaggcttaagctccagtttcttttgttttccgctgcatttttgtaagacctttataatgtttgtaagacgtggatctgtatgtcaacattgtcgtttgtgtaccccggctggtcctggacgggggttttaatacacattctgcttggaattctattcgggaatttctgggcgcgacaagttggtatcagagccgaccttgaccgtaggacaagccaaatggaaagacctaagagccctctgaatccttttcattgcatatcttctttgcaattggattttgtcccgggaaaatggggatctgttcttgtggttcaagggaaaaatcttgtcgcttgtttaagtgagatttttcaaaacgagtcagtctagggttttagtaaaattattgggagtttttcggcagtcagttgggatgtgatgggtgaaatgcattaggtcctagctcggtatcatgggttgcaaggtgtttatacttcgtttgttattattaatatgtatctaatttctcattattttatcgttatgtgagtctgtcttatttattcgctctcatgtaaaatgatctatgcataaaattttgctcttatttgattcctttatttgagtctttattgctttatttaaatttggatttgagcatgcattgatcctactcctttgtcttctctagatggccggtcacccacccaaccaccgcggtgaaggcatgatcgactttgtggcagagctggcacgcatgacactggtagtgggctaccccgacgcgccggagtacacgacgattccgccgctcagtggcgagcttcctcaccgtgtccgcttggaggtccatggttacgtggggacttgcctcgctaacatggcggtcgaggcgtcaggaggcacagcagatcacgcttgtcaggaggcagcctacctgatgatggccagactacgggagcgccacaactacattttccacggcacggcgtaccgctaccaccccagtcgagcccacggtgatggcgtcagctccttccgtccaacagctggcgagaacgacaccacctttggccacatgtgtgcggtgatgaggggtttggacaggatgcactcggatctgcacaaggcgaccaaggccttgaatgatgggaagctcatgaggatcgtcgctctgaaggacgagatagcgcgtctgaagaaggagaacgctcagctgaagggtctcccagcgccaggaggagtccggatccgcactacgccccgtaagaggacgactgcacctgtgcgcatccagcttgcgcccaggaacccacctccaccagcagcccccgcagcagctccagctccgcccgcagttcctgcagctccagctccagctcccgcgttcactctctccttcgctccagcatcagccgccagaggttcagccagtggtaccggaggttggctgtctgctactcccagtggcagcggcgagactgatccgtcagactccaggagtcgctcagagggaccgggtgacgagcaggaggacgccttcgactccaccgaccgcaggagccgttccgagcattaggctcgtttttccactagttcatcgactgtctagtttttgtttgttagtttgtgtgtttaggttgcttgtttggggtcagtcgacggtcgatatcatgtgcctatgatatggctgtcttaataaggatgtttgcttgctcttttaagtgtttttaattcagatcagaacaattgcagttttaattcctatataataaagcttagttcttgagcatctgtttttcttcttttccccgtctgttcttccctccagatggtctacaccaggactggtaaccgcacgacaggcgagggcagcaacggtgaagaacgcgttgatggtgtgcatcccaacggcgatcccggcaacggtccgccaccacctcccgagaatccgaccctggcccaagttatggcgcatcagactcagatgatggcagccatgatgcagcagatgcagcagcagcaccagcagatgcaccagaggatgatgcagtacgctgaacagcagcaccagcagtttggtccccctcccccgcaatccaagttgcctgagttcctgcgagtcaggccacccaccttctccagcaccaccaaccccatggaggcaaacgactggctccatgcaatagagaagaagctgaatctcctgcagtgcaatgatcaggagaaggtcgctttcgccacacaccagcttcagggtcctgcgtccgcttggtgggacaaccacatggccacccgcccaccgggtactgaagtcacatgggcagagttctgccgtagcttcaggaaggcacaggtgccagatggggtcgtggcacaaaagaagagggaatttcgtgcactccatcagggcaacaggacggtgacagagtacctccacgagttcaatcgcctcgcgcgatatgcaccggaggatgtccgcactgacgccgagaaacaagaaaagtttatggcaggcctggatgacgagctgaccaaccaactgatatccggggactacgctgactttgaaaggctggttgacaaggcaatccgtcaggaggatcagcgcaacaaaatggacaggaaaagaaaggcggcgcagttccggtccaaccaaggtagtcagcaccgaccgcgcttcactcctggacagcagggtggacctaccaccatgatcgtccgtcagcaccgcccgttccactctggcaacttccaccagggcgctagcggcagtcagaaccaccagggaggccagcccaaccgcggtgcagctccacgcccaccaatggcaccagcacagtcagcccagcccgcgcaagccaagaaggagacgggagcaaaaccagggtcctgcttcaactgtggcgagcttggccacttcgctgacaaatgcccgaagcccaggcgtgccggaccaaggtttatccaggctcgtgtcaaccacgcatctgcggaggaggcacaagcagcaccagaggtcgtactgggtacgtttcctgttaactcaatccctgcaacagtactttttgattctggtgcaacgcattctttcatctccaagaaatttgtcggggtgcatgggttaataagagaggaacttagcacaccgatgcgggttcataccccagggaatagctcctcttcggttcaattcagcccttctataacaatagaaattcaagggtcaccgtttctagccaacctcatccttctcgaatccaaagacctagatgtcattcttgggatggattggctgaccaagtttaagggagtcatcgattgtgcgaatcgcacagtcaccctgaccaatgagaaaggagaaaccgtggtgtacaaatctctagtctcgccaaagaaaggagcctcgttgaatcagattgagacggaaatcccagtggacaccgaagagaagaacttgagaaaattggaggacatacccatagtctgcgagtatccagaggtgttccccgaagacctcaccaccatgccacccaagagggagattgaattccggattgatttggcaccaggaaccgctccaatctataagagaccgtacagaatggcggccaacgaattagcagaggtcaagaagcaagttgacgaacagctgcagaaagggtacattcgaccaagcacttcaccttggggcgctccggtcatttttgtggagaaaaaggataagacaaagaggatgtgcgtcgattatcgcgcacttaacgaggtcacaatcaagaataaatatcctttgccgcgaatcgacgatttatttgatcaactgaaaggagctaaagtgttctctaagatagacctgcgatcaggctaccaccagttgagaatccgggaagaggatattccgaagacggccttcaccactcggtacgggctatatgagtgcacggttatgtccttcggacttactaacgcacccgcattcttcatgaatctgatgaacaaagtgttcatggaatttttggacaagtttgttgtggtattcatcgacgacattcttatctattcaaagtccgaagaggaacatgaacaacatctccgtctggtactcgagaagttgaaggagcaccagctatacgccaagttcagcaagtgtgacttctggttgacggaagtcaaatttctgggtcatgtcattacagctcagggtgtagcagttgatccatcgaacgtggagtcagttaccaagtggaccccaccgaagacagtgtcgcagattcgaagttttctaggactggctggttattaccgtcgtttcatcgaaaacttctcaagaatcgcccgacccatgactcagttgcttaagaaagacgagaagtttaaatggacagctgagtgcgacaagagctttgaggagctcaaaaggaaattagtatccgcaccggttttgatcctgcccgaccagacgaaagacttccaagtctattgcgatgcatcccgtcacggacttggatgcgtcctaatgcaagagggcagagtggttgcatacgcctcgcggcagttgcgtccacacgaaggaaactatccaactcatgacttggaattggcagcagtggtccatgccctgaagatctggaggcactatctgatcggcaaccgctgcgaagtatatacggaccataaaagtctgaaatacatcttcacccaaccggacctaaaccttcgacaacgaagatggttggaactaatcaaagactacgacatgagtatccactaccacccgggtaaagccaatgtggtggcagacgctttaagccggaaaagttactgcactgctctatgcatcgagggcatgtgtgaggaattgagacaggagcttgaacatctcaacatgggaattgttgaacacgggttcgtagccgctctggaggcacggcctacgctcgtggatcaagttagagccgctcaagtaaatgatccggaaatagcagaactgaaaaagaacatgagagtcggaaaggctcgggatttccttgaggatgagcatggcacaatctggatgggagaaagattgtgtgtaccggacgacaaggaattgaaggatctgatactcaccgaagctcatcagacccagtactccattcatccaggcagcactaaaatgtaccaagaccttaaagaaaaattttggtgggtcagcatgagaagggaaatagctgagttcgtcgcactctgcgatgtttgccaacgagtgaaagcagagcaccaaagaccagcaggtttactccaacctcttcaaatcccggaatggaaatgggaggagattggaatggactttataacgggactgccccggacatcatcgggacatgattcaatttgggtagtcgtggatcgactcaccaaggtggctcactttataccagtacataccacctatacgggaaagagattggcagaattgtacctcgcaaggatcatgtgtttgcatggggtacccaagaagatagtatccgaccgaggtagtcagttcacctcaaagttctggcagaagctgcaggaagaattggggacccgtttaaacttcagcacggcctatcacccgcaaactgatggtcagaccgagcgtgtcaatcaaatcttggaggatatgttgagagcttgcgctcttgattttggtggagcttgggacaaaagcttaccatatgcggaattctcgtacaacaacagctactaggccagtctacagatggcaccgtttgaagctctatacggccggaagtgccgcacaccgcttttctgggatcagacaggcgaacgtcaactgttcggaacagaagtattagcggaagcagaagagaaagtcagaatcatcagggaaaggttgaggattgctcagtctcgacagaagagctacgcggataaccgccgaagggagctcacttttgaggcaggagattacgtgtatcttcgtgtcaccccgctccggggagtacaccgctttcagacaaaaggcaagttggcaccacgcttcgtgggaccatacaaaattttggaacgaagaggagaagttgcctatcaactagaacttccgtccaacatgatcggcatccatgacgtgttccacgtatcccaattaaagaagtgtttaagggtacctgaagaacaggctgattcggaacacattgatatccaggaggacctaacatatgtggagaagccggttcgtatacttgacactagcgaaaggagaaccagaaataaggtcaccaggttttgccgtgttcagtggagccatcattcagaagaggaagcaacctgggaaagggaagatgagttgaaagccgcccatccgtacctcttcaccagctcctccgaatctcggggccgagattccgtttaaggggggtaggtttgtcacaccccgaagttttcctccctagtcaaaattgcaatttataattgaccccaagaaaatgcagaggaaatcaggataaaaccctaagaaaataatgcaaataataatcggatttgacatgtggaatttttcttgaattctacatgtcgaaattcattaacaggatttttagtggaattttcagagctctagaaataattttaaccaaataaaaatcactaaagtgcaattgttaattccagggaaaatcctttttctttttctttttc

SEQ ID NO: 80146 - DNA, 1118 bp, Oryza sativa
gagatatttaaaccggggggagatcgatcgatcgctgggattttgatctcgcctgcttggacgcttggcgggtgcgactgcttcttcttgtttagtttttgaggtaaacgacatggagataagctaacttagccatggagggctgcaattaatttggcggtgatggtgctaatgggtggttaagggttttaatttgggtcgtcagaagaggcgattgctgatgctgctgccctgcatgcctggctggttgggccggtttggcgtttggattttggtcgtttgggcgattcgggagccgtttatcttttgcttaaattttgccaaaatgtcctgcctaatctcttttgaaagaattgtttacgaactttaaacaaaaaactgttaacagtttggcattcacctgacaaaggaatgggagcccaaatcagcattcctaccacagcaacactggaacattgtcatattcccgtgttcaattcgtctctataaataaagtcgttgttatgattcaatagatgttataatacttgaatttcagtgctgctacttgcgacatgatggaaatcgtgagattagcatgccatgccccccaccccaaagaaatgaattagataagcaaatgggtgaaaacgaaaggtcaaagtaccgtagcattctcaaaagtgttttcaatgtggtatggcatcaggttgcacagggtctaacgatgagaacataaacagagtttgttcttgtttgtcaacactaactacacatttctcattcaacatgaaaatcgcatgcaagatctgatccgaatgaggccacataaatatctatatgagtctttcaaaccccatttagttttaaaggggagattcatgagctagcaattatatatacatttctcaaaatcttacccctcaaaatttcacttgacatgctgatggctttgatcacatgcggacatgcccacatataacttaggtaatgaactcaaaatttgagacagaatacagatgaatgttttgtacatcgcacgggttgtgaaaagagggtgtagagagctataaaattcacctctgacctcttcgttcccagcttcccaaaaaaccagaagatgttggagtatgccacag

SEQ ID NO: 80147 - DNA, 1678 bp, Oryza sativa
tttagttaccaaaagtttttcttaaaacatcacatcgaatctttagatacatacatggaccattaatatagatttaaagaaaacctaattgcacagttaagggggaaatcgcgagacgaatcttttaatcctaattagtccataattagccataagtgctacagtaacctacatgtgctaatgatggattaattaggctcaaaagatttatctcgtggtttccaggcgagttatgaaattagttttttcattcgtgtccgaaaaccccttctgacatctggtcaaacatccgatgtgacacccaaaaattttcatttggcgaactaaacaggctagtaacttccaaagttagaagtttggtttgaaattggtatgatgtgactgaaaacttgtgtgtgtatgataggttgatgtgatagaaaaagttgaaagtttggatctaaacacaaccctttttgttctaaaaaaaactccatccatcccataatgtagcaatcccagatttgtagtcctaggatgggtctcatcccatcctagattgctacattatgggacggagtatctttttattttaaatattttaatataaattaagatttaagtaaaaaattactatagtatccttattaagtaatatatataagttatgattggattttggtagttaaaggatagtataatagaaaaaaattaaacgaaaggagagacaaatgaaataagtagtacagtactttagagtaacacatattttaaggtaaaatttaaatagtagaaagataactattttgggacagtggtaacactcacttccttggtttttaggggctggttggatctatacagaggttgccgctatgtgccatatttttatgtttgcctaaattgcgattaacaaaaggacactgttacaatacattctactacaaacggtgtggtaggatttaaatctaactatcgatttttatgagtataaaagtattttaatctatacgcactatcaaatgtagggtgtgtttagttcacgctaaaattgaaagtttggttgaaattggaataatgtgatggaaaagttggaagtttatgtatgtaggaaagttttgatatgatgaaaaagttggaagtttcaagaaaaactttagatctaaactcgaccgtaacagagtacaatcaaatcaaatccattggatctaataataaaaaattagatggctcataattatttataccttagaaaacccctgataaaaagcaaatcacaaaagaatattgtgcctcacattttcaaattgatgacatatatgctggaatcctgctataaatatagctaagtacggctaggaatgaattaaagaattaaaatggtatgataaacttagccaatgtttggaagtaaaccaaacatccccttaccatttgcatggcacctttaatttggctgtctcgttttataattagaaaaaccaattgcaaaatctgccgatccactaccgtctagtagggatgaaagtggttcggatactttccatccgtgactttgaccaattttcagattcggaaaaattcggtcggaaatatccggaatttctcggattcggaaacgaattcggattttttttctcggatacgaaaacgaatacagtaagggtgatatccgacggaatcggaaaacggtcggaaa

SEQ ID NO: 80148 - DNA, 661 bp, Oryza sativa
actaggagtgtacattggcacggctttagctgtagcgcccatgggcagatgcaatgcaaagcacctgccagctcaacagtattaccactgtacgtatacgtcggactagtataatgtacagtacgtacacaggttcatagccccggactcacgtgcagaccaccaccacgagtacgtacgtactccctccatccttaaaaaaaaaaagtacaacaaaacgtctaatattagtttggttttttttcggaggaagtatatctcgtgcctgtaacagtagtatgtttttaaccttgtccacggaccgttagatctcctccacgcccatccaaccgagcgatcacggccatcccgtccacaacacggtggcccgtggatttttgccgaacacacgagcgcccacgtgagcagccacgcgcgggccgctcggggcaggatgtgtgcgcaacaaaccaagagaaaaatgcgtgcgtacacgcagatgcgccgcgcgcgcgcgcgagacgacgacgacgaggggggaagcatcgcggcggtggggggcgaggcttttacgctagtacgacgtacaccaccgcgcgcgcatgagatgggcgtgggctttggcttgtgcgggggtggggggtgttgcttcgtggtggacggacacgctagggacccgtgc

SEQ ID NO: 80149 - DNA, 103202 bp, Oryza sativa
  unsure (1)..(103202): unsure at all n locations
aaagccatgaatcccttttatgcatatctggatctggatcctgcagaacaaacatatcggatgagtagtatctgatataaatataatactcgagaaaaaatcaagtattttaaaatatttataaatatgtatttctcctcttatcaattgtgatttccccgagcagatgactctgtacatttaaacactctgtccgactagtcatagcccacaagcatcgggagtcggcctaggcatttcccaaacatgcatatgagtgatatgagttcgtcattaatggaacaaagtttcacggatcagaatttactactcgggtacttttgcaattattaagagcagaaaataaatttatctcgtctctatgcttttgatttattccgaataatacttagcaccttgcgttactcggtccatcgaacgagcccccgggtgctaggaatcggcccaaaggcaaccatccaatggcaaaccaaacggaaagcataggaagatagaactccataactcgataggtacttttgtactcagattatgtcgcaagcaatcaagataaatattataaaaaatatgatataacatctatagccctcgactcactactcaatggaagaccaattggtgtagtgaggcagaggaaaaggaaaaatatcatataaaaaataaaataaatgatgacttagctttgtaatattccccttggtgatggcagaagtgaccaatgtgggaacaaagtcgtccatcaataacaatgaagacaccagtcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaagccggcggtgaagtcgtagacgcccaacagcggcggcataataggccagccgtgtaggcggaggcaccactcggcggcgacggaggcaagccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgcaggcgtaaacaccagtcggcggcggacgagacggccggtcggtgaagacgtagacgcccaacaacggtggtgtgaccaaccaaccatataggcgaagacaccagtcggcggcgacggaggcaggccggcggtgaagtcgtagacgcccaacagcggcggcataataggccagccgtgcaggcggaaacaccagtcggcggcggacgagacggccggtcggtgaagatgtagacgcccaacaacggtggtgtgaccaaccaaccatataggcgaagacaccactcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataacaggccagccgtgtaggcggaggcaccaatcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgcaggcggaaacaccagtcggcggcggacgagacggccggtcggtgaagatgtagacgcccaacaacggtggtgtgaccaaccaaccatataggcgaagacaccagtcggcggcgacggaggcaggccggcggtgaagtcgtagacgcccaacaacggtggtgtgaccaaccaaccatataggcaaagacaccagtcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataacaggccagccgtgtaggcggaggcaccaatcggcggcgacggaggcaggccggcggcgtgaagtcgtagacgcccaacagcggcggcataataggccagccgtgtaggcggaggcaccactcggcggcgacggaggcaggccggcggtgaagtcgtagacgcccaacagcggcggcataatagaccagccgtgtaggcggaggcaccaatcggcggcgacggaggcaagccagtggtgaagacgatgtcgctatcggcaacggcggcggcacacaccaaccgtggcagcgaggccgcaagcagtgaatgattgtttgatctcgactgccatccaatgcatgcgaacaaccatcgctccagcatacatgtagattaaatcgacgtatacacgtgcttgctcctggtggccgagtatattcctgtgtcctgtgccaatctagcagcacgtccatctgcatggaagggaagagaggagcactcggacacggcaagaggcacccgagtggccgagtaggcgacgatggcggccgtgtcgtgatctcaaccagcatgtgaaaaacaacaaaaattgccaggaaatcaaaacggccggcgattagggattaattaataatcaatctaataaaaattaaattggaacagccaacccaagttgtacggcgtggcttggatacgtcgtgcgcgtcgatcagcttgggtcgcaatgcctcgatcagcagtagccggcggaagccatcaacggccctgcgacctcggagagtcggcagcatgtagatgaccgaccggggcagctgtaaagcctaatgataacagctcggaggcgaccgactacggagacggtggagccggtcggcgctgacggatatagccggcagtagatacggccggcggtgtacatgcaagacagatagcaacaaaataattgctggttagaatcaactagtaaacagattaactctgtagatgtaatgtgcatgttggttggatcgtgcatgtatgttgatcagttgaatcaactcatgcagtgttttctcctggtaaactgtgcccagcgatggccaccacatgtccgccggcaaagcacgaagaaagtctcgatgcgtgagggcgtcgtcgacagcttcggcttgatctccgccgaccgacacaagatcgacacaggaaaatataccagaagattgatctatgatagaaaaaaaattaatctaataaaaaatagattggaacgacaaacccggtccaaagttcgagccatcgaattcggtgagattgatctcgccgtttcttctgaagtggattccatctcacttttcgacgggtaattcgacgcatcccctacctggcgcgccaactgtcgaaacatgaattcggcaataataaaagggggtagcggacgagacctaaagtggatggatgcagagacaaaggatttagacaggttcaggccctctcaatgagaggtaataccctactcctgtttggggatttgaatccgccgagtgtgtattgatctgacgatcaggttgtctcatgccccctagagggcctcctgcccaccttatataggatggggggcaggattacaagatagaaaccttaaccaatacggtatcggtttcctaaatctattttacaatattatcgaatcaggactttaggccgctccataatataaaaggaaacgtaatacccaagtcatgatcggttacatattccatagatatatgttatcccctattactagtcggataaccatgccgtgtgggtatggggtacccataatctccacagatatatttactagtaactttctgacaacaaagtccatggaaatgaacgtctatatatacttccatagattcaccgttcaattgagctcagtttggaagcacaaccttttgggactaatattgggcctttttcactaacaacagagaagcaaatcaggcccatatctgggcttgcaccgatcgtgggtgtgacggatcagagcgacccagtgatgggcctttttagtacccagggcccagtgttcgtctcaagaagagagctgaggcccatatttgagtttgagcttttagtaccacctcggagacgcagagctgaggcgcgcaaggcgctctgtatataagcaggcagggttgcacggagcaactcatacctttctcggccttttggctaagatcaagtgtagtatctgttcttatcagtttaatatctgatatatgggctatgtgcccacttcgatattaaatttattttttgtgggggagggtccactacagtggcttgccgctggggccctcacgcgtcgcccaggtgttgcactgctgcccgggcctggcgcaccccaaccaaaccaacgattaatttttaagtatgcagttgcgctgatagctagacggagtatcgatgcctgatgtgttcgtttgtgtgagatagggtgagaaaatacctcgttttccgcgcgcacgttttccaaactactatgcgtttttttaaaaattttctataggaaagttgctttaaaaaatcatattaatccatttttaaaatttaaaatagtttatactcaattaatcatgcgctaatggctcatctcgttttacatatcttctcaatcctctatatctcaaactcacccttagtgttcttgtatatagatgatatccaatttgatgttgatgtgtttaaagtttgatttcttcttggctaggctctgaattatgatcctctgcgccttttacattcacatcttcctgcaggaagagttgtcactgatgttcggtgtcgctaatttgctactacctccgtctcaaaataagtgcagccgtggatatccgtactcaacgtttgaccgttcgtcttatttgaaaaatttatgaaaaaaattaaaaatatataatcacacataaagcattatttatgttttatcatctaatagtaataaaaatactaatcataaaaaattttcaaataagacgaacggtcaaatgttgaacatgaatagtgcaaaactgcactaattttgggacggagggagtatgaaattggtgatccatgaatgttcggtgtcgctaatttgctatgaaattggtggtccatgaacacaaactctgcaagagttcggatagctctcgtcgtaaattcgctattatgaaattggtcacggacctgttgatctgtgaacaaaaactctgcaagagtgtcagaattcggatactatccaactctcatgattgatcagaatgtcagcgctcgctctacggttcagataccatcgatgacatcgtcagagttcagatacctgtccaaactatgaaaagtgtcgtcagactttagtgctctggagttcagataactctccaatttctgccgaaacactgtaaactcgacgtgatctgcacacacatttaacacttcaactccatgcgatctgcagggagagacatttaggttcggtactgcactgtatactaggaaattgcctcgcaaaataggaataaatacagtgccattcaaatttacatcctgaaacccagaatataaatggaatccatatttgcatttacaattccctccatgggaccttattgttcattacagaagggttttacatgtgtaacaacaaaatacaaatgcctactacacttactcaaataaacaatttcatactgaattctcagagcccttgtattttcttgttttttttttctccctgttgctctctgtttcccatcacaacagacaaatccgagtatttgtatctcgattataggtaagcacgttttggaacgggataaatcagaggcaggtgactcttctgctgcatgcataagaccgcctcatgcaaactcttcctcagtggagtgaattccaaccccaaatccttgagcctctggttcgagaacttgtacggcttcgccatcggcttcccgtcatcttcacacctgaaaaatccaagaaacacacgcatgaaaaatttgagatcgatcgattacatctcagaagactatttcagcaacgcacacaagcaaatcaatgtctaatagttgcgtactttgcagtggcagggtactgggggaagaggtccctgagcatccggaggagctcggcgcggtggagcacggtgccgatgcagaggtagcggccgcgtgcgtcggggcgctcgtagacgaggacgtgcgcgcgggcgacgtcgcggacgtcgacgtaggcggcgacggcgttggggtacgacttcttggtgcccatgaggtagcgggcgacgtggttgctgctgaagttgagcgtctgctgcagcatgggacccatcgtcatcgacggcaccaccaccgccagctccagccccctcttcgccgcctcctccgtcgccgtcatctctgccatcatcttggcgcagcagtacaggttctgcacgtacgacgagaaaattttgccgagatgatcaatttactgttcatgcaagcaacgcggttggagttggtagaaacgcagcagagtaatgtgcttacgtcggtttggcggcagaattcgtagtcgctccagcaggtctcgtcgaggacggcgtcggggctcctgctggggttcatgtgcacggcgccgtaggacgacgtgaacaccacgcgccgcacgcccatgtccgccgccgcgttgatcacgttcctcgtcccctccactgcaaccggaaccaggtcctgcagcacggagcagcgttagtaaaagttggaggaggttaaaggcgccattgtcgtctcttttgggctcaagaaccaggctagtgaacttacagggtcgttggacaccggggaggcgacatggaagacgccgtggcacccgctgaaggcggcgcggaggctggcggcgtcgaggacgtcggcacggcagagggagagcctctggtcggctccctccagctcaagcaggtgagcattcttgctgtcagctacagatacgcgcgtgcaagaaccgatcaataaatcaagcacaaaatgcagcaaattaatggtaacaccgtgaactactagttagtaacttaccaggatctctggctgttcccctgacgtggtagccacggatgaggagctccttcaccacccacgacccaatgaagccacctgctccggtcacacagaccagctgcttctcgccattgttgttgttggcctcaaaattggacgacatggtgagagacactgaccagttactgtcactagccaaatgctactctgaacttgtgagagaactttcactcgaactctgaatgttggttgtgtgagtctgccgtgtatggacatggccgctatttatacgcgagctgcgagcacctgcgccgccatgccacggagcacgaggaggacgacgacaagaggaagattgctagcgtagggtggtcatcgggtgaggggtgggggaggcgcaactgcgaccacgcgaaacggaatgccgtcgccttgtcgtccatttttgaggattcagcggcgcgcgcgcaaaaactgggcagcacaaggccgaattgccgatgggttgggcgtgcgcgtgggctcatctcacgggcgcgtacgagcagtagagtatattccattgcctttctggacgagaggatcacgaagccaactctggcacgtaaaccgtgcgaggttttcgctgaacctggcgaatcttctactgtactaggatgcaacttgtactaaacaattgcatctgctgctggaacgaccgacgattcgagtcagactggtacgatcgactaatgtctttttgaaaccttgacggaaatagtactatagtagtacgttcgagtgaatttgacgattttttacgctaagtcttatttagttcctaatttttttctttaaactttcaactttttcatcacatcaaaacttacctacacacaaactttcaacttttccatcacatcgtttcaattttaactaaacttttaattttagcgtgagctacacatgctaattatgattgtcttagagatacgagagaaaaccaatgaacaatggcaaattcggtatattgtggttacaagttccgcgattacaatttccaaaggtaagtaaaataccgacgtagtgcaaaatacgatactactaactgaaataggagaaaactggcacaaatcaacaacagtttatgacataattaatggaacgtgaaaatagcatataagaccgtaaaacaaacatatttatattaagatgctttgtttacttagaacacttagggcctgtttggcacagctccagctccaactccacccctcctggagctggagctcagccaaacagttttagctccaccaaaactaggagtggagttgggtggagctctctcacaaaatgtaatagagttgtggagctgggtttaggcagctccacaacttcactccagagttggagctgtgacaaacaggcccttaagctgaatccgccgtgctcaagtatcaaaactggagtacttaagtggactaaaccaaccgaagaattcagtcgggcgttgaaactaagatccggcgcgtgttggctgcacgactcgcggcttttgaaaccgaacggcacggcacggtcggagttaacagaacccacctggtatctgtttacgggaagccccatgtttgagactccaagggaggaggtgagcttggcaacgccaacctttttgacggctcgtgtcggctgctgcctgcttgcgtcacccggtgggcgagcgccagccgatcgggagcaactctaagagcaagtttaacagtatagcccactacaagctccaatttatctatagtcaatttaatagccaattcatataatagttgcttactatactattaatatatggtcccatctgtcatacacacaccgtctcttggagtctatgctgcagctacctacagatttgtagcccgctgcttttctctttcatcttttatatcattaaaatatgtttatagctagctaatagtctgctattgtacctgctctaatcccaacttcacccccaataccggctgaaccgacgggggcttatattcattctcttttcttttttttttaacttttaactcagatttacaaatttttaagttaagatttgaaaatttttaagttaaaaaatttaaaactttcaactcatatttaaaaactttcaagtgaaatcattaatatttaactcaaagacttaaaatttttaactaagatttaaaagctttcaactcagatttgaaaaaaaatccaagtgaaaatttgaaaacagtcaactcaggtttacaaactttcatctcaaaattcaaaacatttaactcaaatttaaaactttcaaccgaaattaaagatgaaagattcatttctttttttaaaaaaaaggtgaaagaaaaagtcccacgagggcgcagacccacgggtcacacaggtgtgtgcgccagcaagcgagttggcgtgtctccgccagttagtttttgtgttgtaccggtgcttgtattcacgctactcggttaagttatgcacttacgcgtacataagaaggaagtcgctgacacgtggttctcatttgttaacgagacaaccatggttaactggccacgtcaacaaaaaaatcattttcaaaaacaccgaagtagtttatttgtatcagtttttaaagatggaggagacgtgctatatcccgttctgtagccaagggagatattcattcaggatcaagaggacgagggagatcaaatagacttattcaaagagtgtggagtacataatacgtggggatttcattccagcccaattcgttgcaaacgtcctttgtacctatccggcccaactcaccaccgtcggctacggagacgacccggttctcctccgatgctactgctgccggagccggactcccaaaaccctcgccccatctccgcttggctttgagaccgctcatcgcggctgcagcagcgtcggcaggatccaccgccttgccgtcttcgatctacccggacgctcggcctccggcgacgactttaggcatgtccagcgccgtcacgggcctcgtccattaccatggtacgtcgtcgattcctcgtccactttgaccttctcactccctcccctttgccgctcgtccggctcaactaggccgcggtggcttccaatgttaggtagttgggaggaactgtgttgcagcctggcttgatgcagactaactgcttgctgtcttccgcatttcttgttgtttggagcataagtctcaaattattttcggtgatgatgtgatgaacaatccacaaacgtacatgccacctcttttggagcataagtaagcaagttatgggcttctaaactaatcatagtggtgttgaacttttgatggtcttccagccaattgatggatgttgagcaatcgtcgacaatggaattttgtgcttctataggtgtttgttttttttttttaaagaaacgcttccataggtgttgaggatgaagttttcacataaaaaaacaaactcaccgtagttaggcctgaccaactctaaaatttctcgggtctgctactattccagcccatgccattcaattgaaggcctaacactgaattttatccctgtttagcaccatcgtttaaatttgagaaccaattgattgctaattaaatggatcagagtttcataaactactctactcgaatatgtacacaataaatgtcatgcctacttcacctgcagtacaattgtactgcattttttcggagttactacctccgtttcacaatgtaagtcattctagcatttcccatatttatatgtaagtcattctagcatttcccatatttatattgatgttaatgaatatatatatatatatatatatatatatatatatatatatatatatatatatatatatatatgaatatgggaaatactagaatgacttacattgtaaaacggaggaagtagtcatcttgtcttattattgtaatctgtgatgccaatgccctcaatgcaaatttttagaagatgatatcgcatttataaaatctgaggcctctcagcttaatgttttattctaaaccaaagctggcgtgtgcaaaatggaacttgccgctaacttaagccttttatatccctagattcatgcagaggtgctagtgggaggagatagatattttacctgcttaatttacctgaagaactcaaggccaagatcaagacactgaaggatgctgacaaaaggtgttggttgaaagatttattggtttatcactatggccttgttaacagtgaaatttggtaagtccggagtagtcatcggtttagagtcagcatcggcttcgaagtcctgagattagccgatgagagttgtcaagtcatcagttgtcggattcttgctatattcggttaaggaaattgatctactaaataaaacttatccagaagagaccgagtttaaagagaatgcggcatgacaagttatctattaattaggaatagtttgttagtttccttttatctttaggaaattgtgtttagtgtctgacggagcgtggggctccttaccgggagaccgcgctggcccccctttgccggttcggccggggaccctgggtgagattctaagctctcaatctgtatgtggaaggttcgcgagacaggaagcacagaagacaccggcgatgtatacaggttcgggccgctgagaagcgtaataccctactcctgtgttttgggagatctgtgtatgaaagagctacaaagtatcagccagcctctcccttgttctgggttcctaatctggaaaggtccagtccaagaaaaagctctcttcctctctcagtgggcaaggtcctccttttatatcttaaggggataccacatgcaccatccccccttctcgctggggacttaccctaccttttcataaatggacggagatttgcatggttgccgtccgagtcaccttctgatgggacggcccacaactacctccactttcgccggaagcagacgcgtcgtggaattgtggccgcctgctgacgacatgaccggagtcagaccagtcacgtcggtcattcttgtccaccacgtgtcagcttagcaatcaaaatgttcgcccttcttcagacaacattttgcttgtaatggttaggatgaagcctggcatatatctggtcaggactaacgtgccatctctgggaggtaacacgctagctccagctggggacgagcgcctagaagccctcgtcctgacgggatggggcgaggcgtgcgtcagaccgcctgtcgccacctaacccgcgatctgaccggtctgtgactggtcacagaccggataaatgagtgcaatgcactacgttacatgcgtcgtgacacgctcagccaaaccgcaataaatgtggttaggtgagccccactgtgctcacctaccccatacacgcggagcgaaaacccacgaggggtcggggcgcctcggccctcggggccgaggggggtgcagcccgaccccctcggggggactaagaggagggcgaacacatcaccctcgggcccaacgtcccccgagggtgccaggccacgttggcgattatgtctgcctcaaacctctagtcatgatactcccgatcccatgtcaccgacagtagccctcggcgttatgccagggcgttcgccctccttaagggaagcggtcgggcgtgacgccactcctaaggcccggtgacaggtgggaccggtctccacaattgggcagaaacccaacggtcaaaaatcacgcacatcggcaatggtaactcggctgtcaataatgagcggtctcttcaagactgccacattactcgagtagcacacgaatctggacatggcgattcgtttcatctggagatatggtaacgtcgcttcggttggcgagcgtaattaacgcgcgcacgatatgatctacctcgactgccacaaccgcatatccacctcatgcgccgcaagcgggcgaatgggattagtggaagcgtgggcgcgagaaacgagggggcgaaatagtgggcgcgagaagcgaggagccgggcacagcgttggcaagggtataaaggcactgaggaagggatttgtttccttcctttcgccattattccccttgtcttcgccgcttgcgccctaactccttctttcctgcgccctaccctcgccacacgcgctcgctcttaatcttctcttcctccggcgtcatggcacggggctccgctctgctcgatggtagcgtgctgccgccttcccgcatcgtgagcgagaggcaggctgggctgccgcgccgcttcatgccggaatctgccaccggccgggagatagttacgctgggcgagggacgcccggcgccagactacccggggcggtccgtcttctttctcccctttgcaatggcagggctagttccgccattttcttctttcttcatggatgttctggagttctacgatctccagatggcgcacctcacccccaacgcggtgatgacattggccatcttcgcgcatctgtgcgagatgtttattggggtgcgcccatctcttcggctgttccggtggttcttcactgtgcagtcggtgtcgccgccatcggtagttggtggctgctacttccagccacgggggccggtgctgaaccgctacatcccctgcgccctccgcaagaagtgggacgactggaagagcgactggttctacactcccctcgccgacgaagcgcgcctcctacttccgagccagcccccggtgcaggcctccagctggcgggcgccggtagatctgggggatggctatgacgccgtcctcgaccgcctggcgggcctgcgatcccaggggctcacaggggccatggtgtatggcgactacctccgtcgtcggattgcgccgctccagcggcgcgctcggggcgcctgggagtacaccgggtccgaagacttcatgaggacccaccagggagtgtgatgggactgggctcctgaggacttcaagatattggtccaacgggtgctgaatctcaactccgtggaggcggccctcattccccaaggaatcctccccctctgcagcgatccagaccgcgcctccatcctgaccattatgatggcggtcggggcctcagaggagcgagctccaaagggccacgacggcgcaggcgggagccgccggggggaacaatctaccccgagagggggtcgtgcttctgggtcccgcgacaggggtccggggagcagccgccctgccaacacccgggggaagaggaagcagggaggaacacctcccccatctcctccccgagggggcggggcggcgcgtgccagcagcaggcgcccggagggggccgcgccaacatcgcagcccgagggggagcgcatgaagaagcggccccgcaagatgggggagacggaaccatctcggggaaacctcatttcccctccaaagtggtcgtttaaccgaccccctcgcaggttcgtctctcacccatcgtggctgtattcattctctcaacgcgagtttttactcacccatcttgttcgtcttctggtcttttcttttgttttagcgagatcccgtcgcgtccctcccgccattccaagtccggccagtctgaggccgaggatccggcggccgcagaggcccggaggcgggaatctgaccggcgagaggccgcagatcgcctacgggaagccgaggaggccgcccaggaggccgcccgggctcgccaggccgaggaaactgcttgggagggagccgcccgggcccgccaggccgaggaagctgctcgggaggaggccgcccgagcccaccaggccgaggaagccgctcgggaggaggctgtccgagcccacaaggccaaggaagccgctcgggaggaagccggatttcgccaggacgaggcgatggcgacttccgaggcagctcgcgacgaggccgcgggcgcgtcgctcgggcccactccctcgggcgacgctcaggcgacaacttccggggcagctggcgacgaggctgcgggcgtgtcgcttgggcccactccctcgggcgacgctcaggcgacaacttccggggcagctggcgacgaggctgcgggcgcgtcgcttgggcccactccctcgggcgacgctcaggaccaaacgggtccgggagacatccccgagtccggcacttccatcggcggcccgagccgcgtggcatcctttccaaggcggctcttccccacgccttctatcgccccactgaacacagagccccttctgcaggctttgaccgccgcaaacaccacgatgttggatgggttaagtgcctaggtggaggccctgcaggcagagcgggcggagctcgacgccgcgtgggcgcgtgtcgaagaggggcgacgctcggtggaggccatggtggaggtgggccgtaaggctcaccgccggcatgtctcggagcttgaaacccgtaagaaggtgctggcggagatcgccaaggaagtggaggaggagcggggggctgccctcattgccaccaccgtgatgaacgaggcgcaggacaccctccgccttcaatacgggagctgggaagtggagctagggaagaagctcgacgccgcccagggggtgcttgacgctgccgctgcccgagaacagcgggcggcagagaccgaagcggcgtcatggcggcgcgaagaggcccttgaggcgcgcgccatggcgctggaagagcacgcctgcgtcgtggagagggatctggcggaccgcgaggccgctgtcaccatccgggaagcaacgctggcggcgcacgaggctgcctgcgccgaagaagagatcgcgctccgcctccgcgaggacgcgctcaccgagcgggagcgagctctcgagggggccgaggccgcggcgcaacagctggcggacagcctgtccctccgcgaggcagcgcaggaggagcaggcgcgccgcaatctggaaggtgcccgcgccgagagggccgcactgaaccaacgggccgctgagctcgaggcgcgggcgaaggagctggacgcgagggcgcgcagcggcggggcggccgcgggcgaaagcgacttagccgcccgcctcgcagatgccgaacacaccatcgccgatctgcagggcgcgctggactcgtccgccggggaggtcgaagccctccgcttggcaggcgaggtcgggcccggcatgctttgggacgccgtctcccgcctagatcgcgccggtcggcaagtgggcctctggagagggcggaccgtaaagtacgccgacaaccagggaggcctcgcccagcacctctcgaagatggccggggctctccaacggctccccgaggagctcgagaagacaattaagtcatcctcgagggacctcgcccaaggagcggtggagctcgtcctggcgagttaccaggccagggaccccaatttctctccatggatggcgctggatgagttccctcctgggaccgaggaccgcgcgcgcgcgcaagtccgggatgccgccgactatatcgtcgacagcttcgagggctcggcccctcggcttgcgtttgcccccaactccgacgaggagggcaatgccggaggtgcagacgacaatgacgtcgaggccggctatccgggcgcatcggattgagcccccagacccccgccatccttctgttttttcttcttttctttcttctaaggccttcgggctttgtatagatcaacttaatctgtaatcaaaaatgaagaaatttttgtgttaatttcatcttgctgtaagtatgagatgaggatgatctgtgccgtggtccttttgtgtcttagcttgaataagggctcgtgcccaggttctggtcctcaaaaggcgcgggtcggggctagtgcctggggagatccacatgtcgagactggccaggccgggaacgtggtgaccgagggttatgggtgacccgattgtgggtttttgccgattcccccccggagttcaccacgccccggggcacggctcggttctgggccccgtttggcgattttagccgacccgagcccccgagggcaggattgagcgcgagtgacctatttcaagtcaagattcttcaaaaggaaaaaacagcacagatacaacctttaggaaattgaaactgcttttattgaaattctgaaataagagaaataagaaagtgcatgtgtggcagcccccggccaaccctgctcgcccgagggggtgcggggttggcccgagcccgaaacctgacacccgaccccccctcaggggtagaagcgacgaaggtgttcgatgttccacgggttaggcagctcagtgccgtcgcccgtggccagccgtatggagcccggccgggggacgccgaccactcgatacggaccctcccacattggtgagagcttgctcaatccagcacgcgtttggacgcggcgtaggacgaggtcgtcgacgcagagtgatcgggcccggacgtgacactgatggtagcgccgcaggctctgctggtagcgcgcggctcggagggccgcgcgccgccttcgctcttccaagtagtcgaggtcatctctgcgaagctgatcttgatcagcctcgcagtacatggtggcccgaggagacttcagggtgagctcagatgggagaaccacttccgcgccgtagacgaggaagaaaggtgtttccccggttgctcggcttggtgtagttcggtttgcccagagcaccgctggcaactcctcgatccatgaatcgccgtgcttcttgagtatgttaaaggtcttggttttaagacctttgaggatttccgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgaacttatcgatcgcgacatacagatactcaaacccgcccggggcccgcctaaacggtcccaggatatcgagtccccagacagcaaatggccacgaaagtggtatggtctgcagggcctgggccggctgatggatttgcttggcgtggaattgacacgctctacatcggcggaccaggtcgaccgcatcattgagagctgtcggccaatagaaaccttggcgaaaagctttaccaaccaaggtgcgcgaggcggagtgggccccgcattcgccttcatggatatcggcaagaagcacaacgccttgttcccgaggaatgcacttcaggaggattccattagccgcgcgccgatagagggtcccttctaccagcacgtagcgtttggagatgcgatggacgcgttcactcccctcgcggtcctcgggtagagtcttatttctgaggtatgcttggatctcggcgatccaagcaatcaatctaagggagctgggagcactcccctcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggatgcgagccgtgagagttcgtcggccatgacgttatcccgtctgggcacgtgccgaagctcaatcccgtcaaaatggcgctccatacgccgtacttggcgcacgtaggcgtccatttgcgggtcagagcaccggtactccttaccgacttggttaacgaccagctgggagtcgcctaacaccaggaggcggcggatccccagtccagctgccactctgagtccggcaaggagtccctcgtactctgccatattattggtcgctcgaaagtcgaggcgaaccaagtatctgaggacgtctccactcggagaggtcaacgtgacccctgcaccggcgcccagaatgaccgacgtgactggtctgactccggtcatgtcgtcagcaggcggccacaattccacgacgcgtctgctcctggcgaaagtggaggtagttgtgggccgtcccatcagaaggtgactcggacggcaaccatgcaaatctccgtccatttatgaaaaggtagggtaagtccccagtgagaaggggggatggtgcatgtggtatccccttaagatataaaaggaggaccttgcccactgagagagggggagagctttttcttggactggacctttccagattaggaacccagaacaagggagaggctggctgatactttgtagctctttcatacacagatctcccaaaacacaggagtagggtattacgcttctcagcggcattccgttcggctcgggggcctcttctccctgctctctcctgggtcgaatcggcacagggttagcctcggggtcagagggcgataggtgcggccttcccgcagtggcctcggggctgtcctgggagtcgggggcacctgacaccgtctgacaagcggggagagggcctgctccggtcgtcgggggccttaggccaccgtccggctcgggggcctcttctccctgctctctcccgggccaagtctgcacaaggtgggggtgcgcggaatgaggattgtcctcatcgcgctccacgaccaacgccgcactaaccacttgcggggtcgccgctaagtagagtagcaagggttcatttggctccggggcgaccagaactggggggagagctgagatacgccttcaactgagtgagggcacgttcagcttcctccgtccaagtaaacggcccggagcgtttgaggagcttaaataagggtagcgccttctctcccagcctcgatatgaaccgacttagggcggccatacaaccggtgacgcattgcacatccctaagcttgctgggggggcgcatccgctctatagctcgtatcttctcggggttggcctcgatgcctcgggcagagaccaagaacccgagaagcttgcccgcaggtacaccgaacacgcacttatctgggttcagttttatgcgggcggagcggaggctctcaaaagtttccgctagatctgaaagtaacgtttcctggttgcgcgtctttacaaccaagtcatcgacataagcctcaacattacgtcctaattggctacccaaagaaattcgagtagtacgttgaaaagtaggacctgaattctttaacccgaagggcatcgtcgtataacaataagttcctatgggggtaatgaacgcagttttttcctcatcctccctagccatgcgaatctgatggtaaccagagtatgcatctagaaaacacaaaaggtcgcaccccgctgtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaggcttgacgttccggggcctggcgccgcactttctgccggaccggccttgcgcccggccgtacggcgagacggtgctcaatcacctccctggggaccccgggcatatccgccggtctccatgtgaagacgtcagcgtttgcccgcaggaaagagacgagcgcgccttcctatttgccgtccagaagaccaccaatccgtgtggtcttggacgggccgtcgcccagggcaacctccttgaccgggacctcatcgcacgtgactatccgctgcctcggggcggcgggggcggatgtgccaagcctctcgtcgccaccctcgggcttggacacgacggcgaggcggtccgcgcgctgctccatacaagcgagcgcgactttgaggtcgccatggacagagatggggccatcggggcccggcatcttcatctggaggtaggcgtagtggaccgccgccatgaacttcaccaacgcgggcctctccaggaccgcgttgtagggcagactgaggtccgccacatcgaagttcacccgctccgtgcggaaattggcgggtccaccgaaggtgaccgggaggtcgatatgacctagcggccaagtgtgccccggcgtcactccaatgatcggctgggacggccggagcatcatccccggggccttgatggcgtcaaaggctgcgggggaaaggatgttgagggctgctcctccatcaatgaggacacgccccagcttcacgttgcaaacagtgggggaaaccaccattgcgatctgtcctccccgggcaacgcacggtgggtggtcggtctggtcgaaggtgagggcaacctccgaccaccgcgcccggcgcgtcgcctcatgagtcggggccgcggccagaagctctcgcttcatggccttgaggctccggcgagaaacgtgagcacacgctcccccatcgacagtggcaatggtggccccaggctcttggaaacctaggtcatcatcgccgtcatcgatgtcctcagcgggggccttctgcttggcctcacttcgccgattgccggaaggaaccgccggggacttgccctctcggcgctcctgcctcctctcctcctcccacttcctcgtccgctcagccaaacttttgactgcacggcagtccgcgaggtcgtgaagggaagtgttgtggacggtgcaccacttgccggttgggcgctccctgctgggagcgccggcctccttctttttgtctcccgcaggcctcccctttcgggtggcccgcggagcgccctcgacggcgaggacatgaccctcgtcgtctgaatggactgacctcttcttcctcctcctgtcacgccgccctgtctgagcggcggatccgggggcggccgaagctgccacaccggaaccggaagggttccaagtccaggcctcctccttgcgagccactcggtccgcgagctgaaaaaactccgcggtagtctggggctccttggaggcgatcttttcgagcatgcggttgtgccgcacgccccccctgaacgcgtagattaccgcgtgtgcagggatgcatggtatggtgttgcggacttgacagaaccgctgaatgtacgagcgaagtgactcatcatcccttcgctgtactgcgtgtaagtccgcttcttcacctgggcgcggatatgagccctgaaagttcatggtgaactgttggcacaaatcctcccaggagtggactgacgcgggtggcaagttcattagccaaccccgcgcctgccccttcagggccatgggaaagaaattcgccatgaccctgtcgtcacccccggcggcctcaatcccggtcgtgtagacctggagaaactcggcggggttgacgctgccatcatatttttcggcgatggtgggccggaaccttgggggccaacggacattccgaagactcgccacaaaggctctacagccgacaccaccaaccgggggcacggagggctggtccccgcgtccgtgttgaggtgacactctagacgaggaagcgccctccgttgcgtgggcagcacgtcggtcattacgccggcgctcgatgctggcgcgggcgtccggccccccacgcagatcttcccgggtcgaaggagtcgacgaaggagtggcggccgaatggcgaacagcggctgccgctcgtcgtgccctccgtcttgacgacgcggagccggtggtagcagcaccagaggccttggtggcggaggaccgcccaccagtatctaggcgctgccgtgcagtcatgaccaatttggccacatcgtccagccaacgttgggctggagactccgggtcatgggcgacaggcgggtgacacaggagcgcacccgcagcttggagcgcgccctggggcgtgctgccgtcgccgtagacgaggaggcgacggtccccatctcgccgcccctttccacctcctgtggatgtcgaagtcgcggatccttcggccctctcgagcgcctccccctgcttaggactttggcgtggagggggcggtggagtacgagctcgacggcgtgggttcggctccccgtcgtcgccactcacactcggagagaggtcgtgcgcctttgcttgctcagccataaggctaaacaggaaaagcttggtgcacacgaaagagtgcaagagctcagaagatcactcgcagagtcccctacctggcgcgccagatgacggagcgtggggctcctcaccgggagaccgcgctggccctcctttgccggttcggccggggaccctgggtgagattctaagctctcaatctgtatgtggaaggttcgcgagacaggaagcacagaagacaccggcgatgtatacaggttcgggccgctgagaagcgtaataccctactcctgtgttttgggagatctgtgtatgaaagagctacaaagtatcagccagcctctcccttgttctgggttcctaatctggaaaggtccagtccaagaaaaagctctcttcctctctcagtgggcaaggtcctccttttatatcttaaggggataccacatgcaccatccccccttctcattggggacttaccctaccttttcataaatggacggagatttgcatggttgccgtccgagtcaccttctgatgggacggcccacaactacctccactttcgccgggagcagacgcgtcgtggaattgtggccgcctgctgacgacatgaccggagtcagaccagtcacgtcggtcattcttgtccaccacgtgtcagcttagcaatcaaaatgttcgcccttcttcagacaacattttgcttgtaatggttaggatgaagcctggcatatatctggtcaggactaacgtgccatctctgggaggtaacacgctagctccagctggggacgagcgcctagaagccctcgtcctgacgggatggggcgaggcgtgcgtcagaccgcctgtcgccacctaacccgcgatctgaccggtctgtgactggtcacagaccggataaatgagtgcaatgcactacgttacatgcgtcgtgacacgctcagccaaaccgcaataaatgtggttaggtgagccccactgtgctcacctaccccatacacgcggagcgaaaacccacgaggggtcggggcgcctcggccctcggggccgaggggggtgcagcccgaccccctcggggggactaagaggagggcgaacacatcaccctcgggcccgacgtcccccgagggtgccaggccacgtgggcgattgtatctgcctcaaacctctagtcatgatactcccgatcccatgtcaccgacagtgtcctataaggactttatcttttccttttatctttaggaaagtttctttcttgtccgacaaggacttgtatcaacccataggtataaatatgtacacccagggtctatgtaatctatcttcacgatcaatacaattcggcgcatcgccaccttttaccttttctactttattttatcgtccgacgggacttggcacctgacgtagggctgcatcggtgttcgatctccggcgaaggggtaagtccaatgttccgtcggcccaggcaattgtatcgtttacgtcggtgtcgttcaaggctgcatcagtgcattcgacctcttggattgctctggtttggatgatatatttgcctacctatttatcatatgtttatgttaatctagtcttagcatatcaatttagctctatcggctgcttctcgttttagggtttctgccggtatcggctaaatcgtgttgctaggttagattagcttagatatctaccaccctgaaaactcagtcaacggcttgattgtctagatattatgtttcttttcatacttagtgctgcatcagttgagtttgatctactaagtcgtgcttagaaccataatccctagcctgcttcttgattgccaataagggtttcatcggggtttcagccggtgagttatctggacgttgcatcggcttataaggatagcgtatacatataagttggatttagccgatgacaacaaaggtttcactgttcaatctaatcttgtggatttcatgacatcggacctccagctgatgtgtgctttaaccttcggatcgatgcttatttatcatataattatttgccgattggtttatattggattatattgttattttattacaccatcatcagccgattgcctttatatcattggacatatagccgattgctaaaaccctatcgctatcggctggtatcggcatcggctgagattgctccatcagcttgtcagccaatcggctattttgatatactatttgcatatcttatcagttgcaggatcaaactgactggcacgcccgcatctcaacaacctttggacctgcactggagctaagcagatctcccaggccggtgtgttcgattttttcgtcaacaggcccatgatgggaggcttgaattaggcatctgtcaaggaagttcattgcacacctctccaatttaaaggtacgtaaagaaatatttgtggaatatacgtgtgtgttttatgtttaatgcgccatgaatgcacaacttaccttcttatttagtcatatttaacttgactatctcattaaatatgtttattctagtggctgataaatctgaaatacatagagatggttttcaaatcccttatgttcttatttaaatgtatctattctagccttctacaaatggtcaggatttgtctttataccatgtctctttcaccttttttcttcaagaaagaatgtacatgtgccatttaacgttacacagttacatatcgtttgttggaatcacacaaggatcgttggaacacacacgaacgcgagagcaagtggcagagcttgaaatgcttgacaatggcaacaaatgccgccttttttgtatttaactcggtggccaacaatacgatgaacatgtgcttttataggcccagcgcgacgcacaacggagcacgaactccatccccgacctttgctcgcactacccgcacgacccggctccatgcgacgaacgcgttaacaacaaacacacacacacgacgcacgcgcggactgacctgacacacaaggtcaggtttatttcctaacatcgttggtctatatcattttgtgatttcctgcaatcttattacatcccacatgaatttctacatggttctttcattgcaatttattatgcatgggagctatattaattgtccaagaaagatttacatgttaagatttcatttgcaaactctttgtcctttctgcaatggccataaatttgctttttcatgttcatagaaaaagaagtcatatctgtgttgattgatttataaaacataattcaaaacagcgtgatctacatgctaaatgtatagttacggccttcttccaaatacaagacattttgttgctcgagttggtaatttgcattctgttgttccctgccgagcaagctctcaatctcctctgcattgtcttcagcttcagcccatgggtgctgctggtatctccttaacatctccagcctctcagcaacctctttcatcgttggccgttcttctccattcatgcttatgcatcgcatcaggaggtatgtgatctcttctagcatttcagcgctcatctcattccttacttggctatctagtagctcttgatggcgaccaactttcattgctgtggtgaagcatgacaccaggctcctgttttcctctggcccgtccaagtacaatgctttcttccttgtcagaagctctagcatgacgacaccaaaactgtaaacatcgctcttatcagtcaactggcatgtcataaggtattcggggtccaagtacccgcaagttccctgcaccaacgttgcaatctcggcctcatcagttggtgctagctttgatgccccaaaatcagaaactttggcgttaaacttgtcatcaagcaagatgtttgccgtcttgacatctccatggaggattgggggtgaagccgatgagtgcatgtaggagagtgcctcggctgactctgccgctatccgaagacgagtatcaagtggtatgtcagctttgggttccttgccatggatgtagtggtagagggtgccatttgagacgaattcatagaccaacatgggcacttcaacttcgaggcagcaaccaagcagcttgacgacattccgatggttgatttgggagaggatgaacatttctctcgcaaactccttggtctcggcctcctccatcatcttcgacttcttgatggccactactgtcttgtcttcgaggacgcccttatagacaacaccgtgaccaccacgacccagaacacggtcagaggcgaagttgtgggtcgccctcttgagttcttctgtcgagaatatcctgaacccatgggtgcctccgccggagtgcatctgctgccggaggatcactccaccgttatgctcgaagaacttctgcttcgttctgatgagcttcctcttctggagccccaagtagagccagaagcacatgaacactgacaagaagacaccgacgctaacccctgaacacgacgccattgtatacccaatattactccgttagatttccatttttgagactgaatgtaatttttcatgatggacgacagttataattttttttacctgtaactactttaagagctaaagggaagttgtcctttgggcggcaaccgttcctgtcggtccaatttccactagtcccaggagggcacacgcaagtgtgacttcctaacatgtttgtgcagtctccgtagcatccgtacttttccggacgtaagcactcgttgatatcttccattcacaaagcaattaatttcgtcatatttgatcatcagccaaattaatctatggaaattaattgacagagttaattaagatgactgctacctgtgcatccaccgtcgaggtaggggttgccctcgtagccctggcagcagttgcaccggtagccctggccgtcgatggtgtcgaagcactcactgttcgtgctccggcacgcgtagtccgtcgcgttgcgcttggcggcgctgcagttgtagacgttccggattgcccagtcgagcacgacgggcacggcctcgaagtcgctccggttgaaatccttcgtgtcgttgtacacggtgttgatccaggtgtgctccaccaggaacacgtacctgcacggcgtcgtgccgccgcggagctcgttgtccaccgccgccgtcccgttctcgaagttgaacatccgcggcacgtagaagttgagggtaggtggtatgatgctctggcagcaccgctcgccggtgcaccgccccggcaaccgcggcactgtatcattgcccagcgacgggcggcggcacgcggacatgcagccgctgacgtagttgccggagccgtcgacgatgtagccgaggttggggcagccgagcgcgacgaggcggttcttctccggcgagtagcggtaggtggtgctgccgttgatggacgtgtacgaggaggtggggacgtcggaggacctctcttctggaggagggtagcacttgctttccggtttgaggaggacccgggcctcgccatcggccagggacaggctgacgagctgcgggtgttgctcgaactgaagcgtgagtaggcgcggtggcgacgcgctgtcgtcgcagttgagctggaagccttcatcgcgggcgcagcgggcgccgatgccgaaggggtagggaacgttgatgtttccgcacttgtcgcggcagcctgtcagctgctgagccgacgctgctggtgtcaccggcgaaaggcgacagatgagcaagactgctgctaatgcaatcgcctgcaggtgcagggtattggtagccatttctgaaatggcttgcttaatgtccggatgctacaattttataagagttaattacattagcggtcattaaacttgcaacgaagtttcacttagatccacgaacttgcaaaacacgtatcgagattcttaaacttggtttaatgtatcatcccggtccaaagcctagtttaaccgtggtcttctctatgtgacatgccacgtggacgatgacatagctaaattttttcccttttttttcttcccatcttttttctccttcctcacctcgtgtggagaaaaatactgcggaagggagaggaaggaggcaaagtggagaaaaaaaagataagaagggggaaaaaagagggaagaaggaagaaaaaataaaaaaaattcatgtcatcgttcacgcagcatgtgtcacaccccaatccggcaccgccgtacaacggcacctgataggagcgtgtcgtaggaataacggcgcgaaccgcttcctacgaaaccgcgatctcgttaccagtcccaggacatagtgctggtacccacggtgacaaatatgaatcattgcaaatccttaaaataaatagaggacttatttaccttaacttaggttgcagcttagaacagcccgagaatgcaaccgacgtcacggacgaggaaacaccaacaacagcagcagcagcggaaccaagagcagcccgagaatgcaaccgacgtcacggatgaggaaacaccaacagcagcagcagtggaaccaacggactaacacccaacgccacaggcgacggctgggaaccaggacgaaaccctaatcttcacttcacttcatcttcacttcacgacggaggaactatatatacatatatagagcaagggtgagtactttcgtactcaacaagccacgggaatttaggtgtttaatgcaagcttggaagagaggcaaggttgttttgcaaatcttttatttgaaatccattttgaaaccactaagtgatttatttcttttcaggtttgggtcgaaaagagacttgcgtctcgattcaactttaagagatgtttttcaacaactcaattgataatgaccgacctcccgggtcagatcattacttctcggctcccagagccatttcacttgattaagcggctcccagagccttattcattttctcggactcccagagtccagctgcccagcagcacaacattccgcttccactcgggaagcctagtctatgatgcccgtagacatcccgaatcacacagattcgtttctgaccactcaggccatccatctgccacataggctgattctggttacgattcctatcccacaacaacttttcacaaagcacaggcaaacaaatctacgcaacgggaaccacctcacatccgcccatgaccgtgggcacggctgttcgaacagttagttaacctctgcagaggggtacactttacccacaagatacgaacttattccgaacacccgtcggtatcggaggttcgcaacaaagcctttcccaagccgacccagggatacctcatgccacatagaaggatcaaatcctcacataaatataggccattttagttttcacaaatcaaactccaaccacctcgatcggtaattcagcaagcttctctttcttgcttaccaggaacccggtttggctccaatcgaccccgccccggcgttcccaactattggcatgcgaggtttccctgaaccgactagttacttagccagggtgtcccattccaccttgtggttgcactttgttatgcttgatgagtttcccacaggaattggtccttatatgcaaatacgagacagtgccacataggcacggcacccgcatcgcgaattttcacaattcattttattttcaaacacaccgacaccacatgtcgggttttcaaggcttctcaaacccatttcccaaattttcgacaatcgacggtgtatgtggaatatttggtatacgcactcagagagcacgaataccgaagtaccacaaggatggagcgacaaggaatcagggtagtacaacctacaggaattagtgcgactactgggtaggtccgtcggtttgtcacgcaaaccgaggccaagcatgttatatgtgtgtgactctaaaaatgcaagttgcaaacaaaataataatgattttccaattataggagaaattgatcaaagggtgactttccttgctcaaggtcttcacgaagcttcacgaatctacgagaaatccctgatcgacgaaaatccggtaaccgcggctatacgcaaacaatcaaaacctaaacgaaagaccaaaagaaagaccctatttagactaattaatagtgccattaaatatatctcaattttacggcagtaccggaagttgaacggagtcaatcggagctacggattgagagatatgaattttggaagctcgaatgggattttccagactaggaaatgatttatcagaattttctggaatgtaaggaatggtttatggaatttatagaaataatattctcaagaatattattgacattcactgatgtgtgggaccaaaggaattgatttatggaatttcggaataataaggaattgatttatggaaaaggaaatggacgagggatgtatattagactttttcgggcggcaagggcgcagcccgagtgttgaaggaggctcggccgagccatttgggccggcgtgggcgcggggaaggcggcccattagggcgcgcggaagagagagggagcggtccggtggaccgagtgcacctcgcgggtcccaggtggggcccgcttgtcggtgacacggcccacggtgggatgggcgcacgtgagggcggcgctagggttcggtggggatggcgcacgggcggtgcgccggatggaccgagacgcgtcgggcccacgcgcagcctcacggctcgcggtggaccgcgcgcgcgagcgggagacggagggagcggcttaccggggtcagcttgacccggtccggccgagctggcgccgacgtggcgccttcgtggcagccacgcgggccggcgggaggaggaagaaggggaggccgagatggacggcggacggcggcgcggcgagatacttgttgttttgtgtaccctggctggtcctggacagggatttaatacacaaaatagtctggaaatttgggctaaatttctgggcgtgacaaagtggtatcagagccaactcgactgtaggttgagccaaatggtcaaaccctaaggacaagttttctgaaaaccctatttgcaaattgtctcctctcgcccttcggcaattctttgtcaaacagtttttcaaaattctcctcccagtctctccaattcttttagttgtcaaacctagaggaccagctgtcagcttcatgtctgttcggaagtcaagtcaattcgagcctcaagcttcgtgcaaggagcgagaagatcagttcagagtcgtcgttctgcgaagatcaagtgatgttttctcggagatgacctaaacccaatctttcccagaagagtagttccgttagctttctagatcgtgtgttgtttgcttgtgtgtaggggtatggtttgcatcattggtggggatgcgaccatactaggttgtttgcttaagcaacttgaagaataaaagtctactcacgacagatcagtaggcaagtggtttagtaccttatctttagcaacccctctcttcctcctctcttccgccctggcagaagatagtcagtgttagagagaagagcaacgacggtgtattaaagtcaccaatcaatggttcagttgaaagctacaaggtatcccagtgccagaagaaccctgctcgtgatcaacatttggtgtccaagattagatgatggatgtattgatgcgggagatgcaaagtccgatgcaacagatgcaacaacagtgtctccaacaacaagtacaagctcagatgcaagccggaatcaggatcagagcgatagtcagtttgttttcaaagaggaagcacccgcaacctcagatagtacgccaccaagtcctcagcaaatcagcacagctaagccaccaccaatcccaggagtaatatatgctacctattgtggttatggttttcaagcgcagtttttgcaaagtgtccatggaagatgtatgacagggcacatcttagagggttgttccccggtaagacgtcagcgtcatcacatccctaactcctcaagttgtgtcagttccaatgcagagtcgatcagttcagttttgaggaatcaactatgcaactcgacaccgaagtcaagctagaagcaggacagtcatgccagtagttagaacttatgggaaagttagtcaagagtcaatgtgtccctgagctaaatgagagtcacttttatgtggaatctcccatcagcaactgaggattaagttccaaatcttgctgggatgaaagtgcgccgtcattactctattttgatgaatcggtgaagtttcagttttcaaagtgagggcctttgtaagcaagagaagtgttggttatttttcaaggacaatagtccaattgttcctagtcaggagaaagtaagactactccctgtaagggggtaggtctcggagatgagttttggctcacttcgtcgctgttttagttgaaggttcaacccagtgcaacaatccgggtagtacttgaagaagccagttgcaaggtgtcagcagagtcaccccaatctcaggtcgacaggttcgattctaaggtacacctgtgaagcatgtcaacagtttagcttagaaaagcaacagcgaggacagttgtagtacagacgaaaggcaggtcaagcaggttttcctggaattacttgtcatttgaattgggaccagtcgaagcggacatagggtaaatgatttacaaatgccagattcaattttcatcctcttatagccagcgtggtgaattctaccaaaattgccaacctcaacagttcagtccaagataagtaagtttcaggagcatccgcagtcctagtctgggtcagttcaagcagaaccagtcggtccagttttggcaaagcaaaggaacagaaaggtcgaatccagccagttcaatcgtgcaggtttgatcaaccagtcaatcaatcagttcgaagcaggatgtggcagttcaatgtgcagatcagtcagaccgccgaccagcaccagctttctttctagccatcccagaatctcgggacgagattcctgtaaggggggtagatttgtaacgccccgattttcgttcgggattaaaaatcattaaataatgcattttctagaaattaaataaaagttaaatcaatttatccaagtgaaataatgggagaattaaaattttcccttaaaaatcattggccgggaatattttgcaatattctttgtgccctaaaatactctccggaattttccgtgaattttcggagctcgagaaatagttttaaagtcacaaagatcatttaaccaattaaataaaaagaaaacaaatttaattctcctttcttccccttcctccctttcgggctcggcccaaattcctccccctccttccttctctcctcgggccgccggcccagcgcgcctcccctccccaagtctgctttgcgtccctgcgcgcctcctccctcccctcaggccgacaagtggggccgtgggacccgcttgtcagacccttcctctacctccagcctccctcatccaaaccgctgtgccgccattgccgcccacgtcgcccacgattccggcctcttccgctcgcgccctcgcgcccaaaccgcatgaaatcggttcccatccacctcctctacactctccccatgtttcccccaaaaattgtgccgggatcgagctccacttcgcccacgatgtcacccacgtcgcgggtcattgccgccccaaatccgccacgcccggcaacggttttccctccccgagcttataaaatccatccccgggctcccttctctcgtttcccctcctcgccggcgcttccctcgccttctcccgctctccccacgccgctcccgcgcgccgccgctctccggcgagctccggtcgcctctagccgccgccctctgtggtcggtcgggccagccctggctgtgcccgtgccctgccaccactcccctcagctgcccgatcggcttggcccgatctgggccgtccatcccgtggaccggcggtggaccgtccttgtggtcccggtccacggtgcaccgagctccttgacccgctgacgtgtggggcccgcgtgtcggcgccggctgccccttgctgacgtcagcgaggtcctttttcctttgtaaaaataattaataattgcgcaataaatcgagtttaattctagaaattcatttaaatggctcaaaacttctaaaattcatatctaattcattcgaactccgaattgagccattcaacttgcaaaattcatctaaaattgagctctacatgtttgtttactttttatgtactgtttccttggtttttattagagtttttcctcgttttgcgtgccagcgtgtagtttccgtcgtttcggaagtccgcggtcgcgaggaaaagagttcggaagatcaaagtgaagaagcaaggcaagtcacacattccccttgagcatgttgatcccaatttataaatgttttaccgtttacaaataaatatgcatgttttgctaattacatgggatccgggtattacctatctgctcgcttgtgccatgtttacttgatatctatcctttgtcaaccttgggtaataaattgactagcttgtgttacttatgtgacctagctagaactatatgcttagccatgcttaattaccactagctcagtcgatgggataattgcagtattagacattctagtatcttgttgagccgcgtgctcgagacatctggccatgttttatggtcgtaattatccaactaaaatgcgactgaatggtgggctgtgggtgcatggttttgtgagtcgcacccatggcaattaaggaccggttcacgggaaaccctggaagacttacagtgcttaccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtctcacccctaataaatcgacccaatgcactgtagttcaggtgggttggttgggcctgttcaacgtggtgtagcgttgatcagtggagatttaatgttactttaattactcaacagttttactgttttgctcaataaaatgttttacaaccgcctttatgcaaatagccacaaaccatccttggatccccttgcacgtctgcatcgttggtgtggcttgctgagtacggtggttgtactcaatcttgctattattccccctttttcagaagcgtagtgcttctgggctgaagacgaagttagaggaccaaggctcagaccccagttgagttttgcctgtggagtggagctgaagccccgctgctgctgcttttgtttcggtgtgaggactaagcgcctcttctgtaagtattttacgctttatttacgtttggaactgtatattacttgtcgttttgtgtaccctggctggtcctggacagggatttaatacacaaaatagtctggaaatttgggctaaatttctgggcgtgacacatattaaaccaagtttagagatctcgatgcacgttttgcaagttcgtggacctaagtgaaacttcgttacaagtttaagtaccgctagtgtaatttactcattttataaatagactatagctggcaggtgaaatatctaggattttttttctcaaaatgaaaatgacgtatctagatttgtacacgctcataattaattaattgattggagatttttctttgggaggggggaggggggttaaaaattgcatgctaggtgctttcgttgaagaggttgtttgtttgagttttgacgcacgcgcttcgtcgacaaataagatgcttagcagggtgtatactattggttgactactaaattttgagttccattgataacacagttttcgacaaatttcgaccggtttttgataaattttgactgaatttcgaccaaatttactgtttacccttcgaaattccaatcgaaaattaattccgagccatgtcaaaacgtcgaaatttcgtagaattcgaccggttttcgttggaattgtgaaccctgatgcttagttttccaataaaagttgcgtgctgggcactgtttgtatcagtcatcaacagatcgatcttatagcacaaaacaatcttatagcacacagcatacagcaacacgaacatcagaataacaaaacaagcacacatacaagacttcctataaagcatacgtacttcacaacccggtgtccacagtcaacggaagaaatcaacctttgagcctttcaaaaccaaactagtctgctctacatcagcctctacagatggacatcaacgaacaatttatatggaaaaactcggcactccccaaggtccaattttttgcttggctactgacaaaggataggctacccacatgcaagaaccttcacaagaaaacaatcatccaattgccgttgtgcgctatttgtcagtctgctgatgaaacttcaagccacctttgcttcctatgcccgtttgtggtcagcttctggaattcaatccacagatatcctggaggcgtgcacactcatgacctgcacttgattgctctaccaaacaatctgccgcaggcacatttcaaaaccttctatctgctttgcctatggagtactctctccgtccttaaaaaaaaaaaagacaaaccctggtttccgtgcccaacgtttgactgtccgtcttatttgaaaaaaatatgaaaaaaattaaaaagacaagtcacgcataaaatattaatcatgttttatcatctaacaacaataaaaatacgaattataaaaaatttcatataagacggacagtcaaagttggatacggaaacccatggtttgtcttttttttttgagacggagggagtatttggaatcaccgacaagaagttgtcttctctgaccagcaatcatccttacatcggcttcttctccgctgtaaggatgagactactctgtggacagaacgacttcttctgcgcgacgatcgcctagttgctataacctggaaatgtattttcaacatcgcaattaattctctacacatgtaatgcgtgccgctggttacgtctgaactctatacttgtaaacctcttcaaatggtaatggaaattcaggtgggaacctctccctcctgtgattattccaaaaaaattgcgtcaaatttttttttacgtaaacaaaaaaacccaaactagtactgtacaaaatcgtacacgcttcgtactagtttctctggtggaaggtcatcagggcctcggttcctttcaaaaggcttattcgtttcaaacgaattgtaaaggaaaagtgcaggactatgcaatcctttgaaatgaacactgtattgacatttgtttcaaagaaatgcaccaaagaaaaaagggaacatatcctaagcacataaaaaaattttcgtgcacaccaactagcaaatgtcacaaaaaattctagaaaaaaaaactaaagatgtactcttaatagtattacacatatctacaaactctcatatttaaatttattatattttagccgtgacaaaaaagacaaaattctgacaaattttatctcttaggccttctttatttaggtttaagttttattggcttagacttttaagtcaacttattggcttatataatttataagccggtggatttaatgtcctaaatttagtggtggagtcatacatctatctcatataagtcaaaaattaaagcttctccaatatagcttttggcttaatagtgttagagtggtttatggcttcaaaaagccaaacgaaaaagctgcttgtttgtttaggcttagattttttggcttataagcctaaactaagagggccttaaaactgtcagattttcacttatttgttacggctaaaatataatgaatttgaatatgagactttgtagatagtgtaatactattaggagtacatctctaattttttctagaattttttttatgatatttgctagttgatgtgcacggagtgtgcatataaagcttgtatgcataggatatgttcctaagaaaaaaatttttatccctccacttttagagggaaaacaaaggaaagaataatccactccaattcaatgttttcaatcctttggattgtttgctacacaaccatagggaagtttcctatgttttcaatccttaggttacacatgtattcccatactattcctccattttccctatttctacgttttgaaaatcctacaaaccaaagaagtctttgcaacaggctttcacttttcctcgctcctcgagttgaattaagcttcatccaacaacatatgtactccctccgtctctaaatatttgacaccgttgacttttttaaacatgttttaccgtttattttattttaaaaaattaagtaatcattaattcttttcctatcatttgattcattgataaatatacttttatgtatacatatagttttacatatttcataaaatttttgaataagatttatggtcaaacatatgcttaaaaaataatgttgtcaaaatatttaggggagagggagtaccatgtaaagcaacgttgctctctggatggattgacggtttcgtggttgaaagatgaaagccagaagattatacaagcgcggtcttcggttagtgcagtaatgcttgtgtccttgtaagctattgtttcgttccaatgtttcagcagcgatgaaaattcgtgttcaccccaaaaatgaaatttttttattgtcctaccgaaaacctaccttgcgtaaattgacatggcaagttgtgttgtgtattgaggactatcggacgaagacaaaatgtagagcaaaggatccgctagattaggttagagaagaccaaacacaaagctgcgttgacgatgacgaccgcacgaactcgcgctataccggccggcccgcaaatgcgggagctcggcccaactactcgcgtacgtacatacgtatacggcccaactagacgcgcacgcaatcccgtcccggcccaactcgagaactgctcggctgccagcccacgtccccgcggcgcacggcgaaattgctcccctcccatgccggaatcccaaaaccctcgccaaaatcgccgcctccgcctattcgcgcggcggcggggacgcagctgcggaagtgcgggggggtcaccgcctcggccgccggcgcgacgacctccacatcctcgtccattgccatggtacggcgtcgccagctccaccttctcccccctctccttcgctgctgtttgcggttaggaacatacaaatgcggaggggccgcggcggtgtccaattttagttaggttttcgaaatttcaatccctggtaggcgcctgtttagtagcactagtcaatagttctgtagattgtgaaattttgaagggaccctgtgttccttacttagtaagggctataattgggctttcgtagaggaagaactgtgttgcagcagcttggtctcttcttttgtgctaccatagggccataggtggttgatgacagagatttcgccgaaaaaatcactgtagttaagcttggtctacctcacaaaactattggatctgccactattccagcttgtgcctttcaactgagcagtttaatgacaatgttgcattgtagtccttaacaacagagaattgtatccccatgcgtttaacatcgtggtttgtattcaacagcaaatttgttaaatggatcagtttcgcaaactatcacatccgagtatgtatgcaattcatggcacgctaatctcatctgccataccattttactgcctctgtttttggtgagctagtccatttctcttatccttttgatgccatgtactgtttaatttccctcaatccacattttttggatctgttagaaccctgccagctttatgttttgcaatttatgtgataccaaagctggctttgcatagtggaactgtcagccattttcagtcctgattttctcatgtgaaatttaattgttgttcacccatttcttcttcttgtcagtaaatgtgttgtcttgaattgggatcatttactcgctgaatcatgaatacatgcagaactatatacgttatactgtacatatattgcagatgaacagatgggcaacattgattgtcttgtaatctttaagcccatcacatgcgtctattcaggatccaccactaccttgtcgggtggagttcatttcgtagtatgtttctttctcacttgcgacttgtctgaattgaaggtaattgagggcatgtgtggtaatttgacttgtacgagataactctatactagactttctttttccttctactatcaaatggcccagttattacattgaattatcacaagttgcttttgtgcgtgcatcaatttggtctttttttgcatgcaaaccttgacctgaacttttgaccagtttgatccaaagttttctttgtaagcatgcaattttctgttcaatttaccagtattatgtgtattttccattacccaacaagcttcatagaaagtaataactaatgtacagtgatttttctgtccaggtgtttctggctgagcaatacacaccaacatcatagatattgcaggttccctccagaagcttgtttcctgagtaaatcaccaatgctgggttcaatgaatgcatctttggtatgttgtgccaacccaagcaataataggccaaggaattcagatatatcgaggcaacaaaaagatggcctgctttttgggaaaaaaaaagctttaccaagaaatatatatgactgtgagaacatttatgattttgattgttatatagtgttctccaaaggtggtccagccatctctgtcctctggggcaagcaattcacgcccgctggcaacatcaactccagggataaggtagaagattgtagagctatttgaaatgatccaggcacaactgtgagcgaggtcaacatccggagcacaaaaggcctgaacctacagaagatcagtgggagaggggcagtgttgatccaatccttaatttgctaaggaaacactcatggaactcaaaaggaagatcaacgatgggaaagaactgagttctgatgaaacgtggagaggcaatgattctgggaattaacagaactcaaggatctttggtgtgaaaaatgacatttaggaagagcgaacgtcctactgcatacaaggccaactccaaattgcaggcgaaggtctcttgttcgtggagtgaggttccagcctgttgttaccaatggcgatatgcagttgcagatgccaagtctatcacagatagcatggttgataatgacaagtctgtcgcagatagcatgattgattattgcaatggttgattgacaatggcaatgattgaaaatcacagatagcatggttgatgctgatctaaaaggtaagatatcaccaggcatgtttttccatacgaaatatgaccagaaaacatgtctttggatgactttggcattattccagatgatgattaatctgattcttcggatactaaaccttacgatggaactttctgatgttactggtagcaatgtatctcatgataagatcatggaattttcttgtgcagaagctctgatataaataagctctttcaaggttctggagctaagagaacttgcgaaatcttgaggaatcaagggctattaaaaaacgagtaaaaataaattggttgaactgttgagcaacatggtctgcttctgatccattaacgacagagtctgaccttgtatttgagccattctgctcaactatgtcctggacatgtgtgccacgtttgttttgtcaataccaatccatttagatagattaacaatgtaaattagtaagtttaacaactttacgctgttctgtgttgatcatgtgcagacctacttttttctaccaatttaagcttcttaatgaaacagctgcatttcttgtcttccctctactgtagtgctgttgacccttgattgcattgttttacttggcgaacttgtaaagctagctctattaacctgggaggtcctgcttacattgttctgatctgttggtgctctatctgtcaggtttgcgccattttctttaccaatacaaaaagatatatgaatggtatcgcctaatattctttttctataatgcaggcaaataaaggtgtatctatacagttctgttattgactgcggctgcagctttgctcgtgaagcgaagaatgaaagcggcccagtggattgcagacggcagaattcctggctgcattattgttcggcctctgtcttctcgtccagtccaagagctttgcttgtgtgttgcatcctgctgctaatcaatctctcgtgatccacgcacgcggcgtctcttggccgtggccggggccctcccctcttgatttctgggagccgtcagatctgagcgattggacggttagttcccccgtctcacgtgcctctgcccctgctgtcctcctcccctggccctctttgcctgcctgtatattgtctgttggaaccctgattaaagctgcatcccctcgttcgttttgatacgattgcagatcagtactagcaacaaatttccagtcgcgactctttcagaaaaagaaaaaggattcagtcatcaatcactagagagaagtaaaaagaaaaaataaaggtaatcctctactcctctcctctcgaacttgtgtagaactactttctttgtctggtcgcctcacttttgcagccactcgatcagcatgcatacctatataacttttatgcatagcttgctttctttcttttgctttccgtcatcactagtaattaattaaacttctagtaattcttttttttgcgcaaattcatggccttccaaaggaaggcctaattaaatagattgttaattagggctgttttggtttgatgccaaaattttccctaccaaatagttggcactttaaatagtaccttgtagatatttggtttgatgccaaaatttaccaacggtaatataattcctataaaccaactttaccaaaatattggtagtgccaaatattatccatgatttagcactactaatgatttggtagggcatcaaaccaaatgagcccttaataaacatgaatactgatcatatgcacatgccgtaggcacgagtcacacgattagaagtctagaacagaagcaagatacaaatgtaggtgcatggctgttggcatgtactccgtagggatagtagaagcgcagctggtccatgtatatgcatggagatgaagaagtgaactgttcgaactcggcttggaagttggaattaaagcacgacgaggccaggctagcaagctagcttctagctgggttactggaacccggccaatactgttcgtataggtcagtgccagtgcacgagtcagccatgctgccatggcgtcgtcgtcgcatgccaatggcttgcatgcatacagacagttcaaaactgaggatgaccagtccacatcatacagcgcccgtgcatatatatgtacgtggaccttagaccatacacatggagtttgtgaatttttggtgagcttatttcctgcttacatcacactttgcacatgtgacggagagagataacatgaaaatataagagctggctatcatgcaagagctatcttagcatgtgctcttagaaaaacaaattaaatagatatgtgagattaagacaaaatggtaaagtgtgtatacaccttgtagctccaaaaagttaagtagatatcataggtatattttaatattataaagacaaaatggtaaagtgagtggattatagctatatatgtgattacatatagctactagttgatatatcgatttactatatctatttcatattataagtcactttgattttttctaagttaaatttatttagttttgactaaatttatagaaaaatatgacaatattttcaacataaaacataacaactatcaaaatatattcatttttagatttaataaaattaatttggtgctacaaatgttgctgtatttttctataaatttggttaaatttttaagaagtttgactttagaaaagtcaaagagatttataatacagaaggtagggagtattaaacttgttccaaaatgttgtgccatgctcataatcttctcccatcctaacgagcatgctctcttcttctgttagttgctagattataattttagaatcagggcttagaactcgatcatgtagtagattgcgactcataaaataggatgcaatcataatgtttgtggaagtaagtattgatatatcataacaaacgacatgcatgttttcattccgggagcacacacacatgcacgtcctacgatatgtagtcacgtgtagtttttacatgcaatccaagctagaaagttccaaacattgtactgtgagatggtaaaactgaacaagattgacggccggtgtggatcgaacaggaaaagaagctagaagatggggagggcgtctatctgggagctgaggtcgccgtcaagattccactatcagtggatgtagaaatacacaggtacgtacgctgtacctatcgatctctttctcaagctaggacaaaagcttagctagctagctagttgcattactactggaatgcatatagatgagatgtgcaggtgcagctggctagtcccacgttgcgtgcatcgtatgcagggagcaaccagtccatgtacagggccgctccctcgttgctgaccggcggccggcatgccggattcccggccgctgccttaatcctgggccccgccggccggcgtatcgccggtggggcacccggccgcgcgcccgcgtgccttcccccacatacaccgaccgaccatcaccggtgtgtgtgcatgcatggccccggcctcggccccgatgtacatatgtaagcatatactccattctctaaatgttttacgccgttaacttttctaaacatatttgtccgtttgtcttattcaaaaacttttataaaatatgtaaaactatatatatacataaaagtatatttaaccatgaatcaaataattaataattatttaaatttttaaataagacaaacggtcaaatatgtttaaaaaagtcaatagcgtcaaatatttagggacggatggagggagtatgtgctagctagtacagtgtttgcacgcattgcatgcttagttaatgtgcatatttgatcatggtctcgaccaaaaccacggccttttgaccgccctagctatatatgagcatgtagcatataaaccatcatatcatgcccgcctgtctcgatcgatcgatcgagcgatctagtagtagtggcagtatagtatgtgtgtcgttcgatctagtgatgagatagaccgtgcaattgctgtcaagtcatgagaatcagaatctgaatcagagatggtgctgttgcatgccatgaaccaggcagcagcagctgcacatatgcagtgctgctagctaagcttagctagctgatcgctgtacgtacatgtgtccacacagtgtcaatcagctggcccttctgcctaccttatgtgtgcctgactgcctctcggtcctcgggcatgcagtaacgtagtaccagaggcgtacagctccctcgttttcgtcgttgcagcggcagcgatgaggggggcagcgtacttgcatatattcaccaatgtgcataggttctgagggtactttaccctgctcccagcccacggaacgacgattgggaagcctactttgtactagcgcactgcgccccatttccatgtagccatagagatttattgtatgtagttgatgggtgctggtcaatgtgcccagggcataaactgtagatgcacatatacaatcctccttctttccgcaccatatgcatgcatttgtgctatagctaggagtactaattaatattatcaccaattagaagcctccatctaacccatcacacacaaaatgcagccaagaaccagctagctgttactgttaatatatagacatgcagtgttgcatgcatgcaatacaatgcaaatgcagatcgatcgagaaaatgcgcatgcagtgcacaggattcgtggtgatcacaatatacaggagcagtacatgttagatcacggttcagtgtgcccaagctttacttcaggcaatgcaccagccaaaactccaaaattttgcgaatgaccattggttcgtatgcttgcagatgatgcatgatatagctagctagcaagaccacacacagcaggcaagggtaactagcaaccccctttagtctacagtcttcttctcagtctcgcactttagctgccttcctttatttggacagacattctatggctcccctaactccactgctcatttatcatcatcctctcctcgatccctctgcatgcccatgttcatcttatagctagctagcagccaccgatccatgtgtatgctcatccatctaatttctagttagttcctcatttctatgtcattttcgtatgcccaaaacatatattctaataataattttggcaaagttaacttattttgactatacagattctagaacgacacttatttgtgaacgaattgaagggagctagcagttggcatctagtttagacttaaaaaatttcccgttaaaatttttgccatagtcacatggtcgtaggagtgaaaactgatcggatattatctgatccgctctgaatttgatcggatatggtataggtttttagaaatctagtgaatatggatgcggttgcggatatgatatctctaaaatcctacggacgtggattgtccaacatttctgctagattatccgataggtcgtttcccggataattcgaaattattaacccatataaccactctatctgttgcatataacatgagatggcgcatctaatggcctaatttaccaattaacctaaatttcttagtttgaggctttcaccatctatatcacacttgtttagttgtatttttatattatgaatatcatgtattcatattgtttggtacttaagtacataattattaagatgggtcgttcattgattattgcattgttgtcccttgcattactaactcgatggtgtattttttgcatacacacataacatccgataaatttaatctgtttccaaaccgagtccacaccaactccgcaccattttggacatccgaaacaatcagctctgcatccgcatccactccaaattcgcttaaaaaatgctttaggatttggtatgaccactatccatccgaatctgttccgttttcacccgtacaaggtcgtgtactaatgtagcatgcattatgcagatttggttgtcccatgatggtgtgttacaaatagcttttattaatattaattctatagatatatgtagctgaaaactaaattttaacccaacactttcttttaagaaaaaggacaaacgaaatgtacatatatcatcacctgtactgcagtccaagctacgcgagtactctctccgtcccaaaataagttaatctagtagatagtaccataaatctaaataggagaaataagttaatctatactggatatgacacattaattttactatgaatttggataacttcaaattcatagtattaaaatgtgtcacgctcgctattagattaatttattatgaccaggggtagtattgattattctctagtagcactcaggcaaattttagtacatttatgttctgaggcaaggacgagtacaatcatgatcgaccggtgcgcgcgcctctttggccgaggcgactgtcgtgcatccatgtcgatcgttctgacatttaattgtttgcccaccggccttgatagtaatcggtcagctggttatagttgagtgttggatgttgcactggagatggagagattagcaagcagtttctgtttatgagctgacgtatgcacggagatattgatggtaggtagcactacacgaaccgtccgaatcagccatatacactgattgaatgtgtgtatgtacgtacgtagtcacgtacaagcgcttgcagcctcgcatacatcatatctactcgaggtgtctacttcatccctttggatagtgatgtaggccttgtcattgtgtcaataatttgtatatggagttatatacggctctgatcggtcgagcagtcgagctgctacgtttgacaagtcaaattatgaagaaagcaaccaaagttaatacataagtataaatttaagttttaaaatttaaattttgactgtcgataagccaataagatgaggagaacctatattcgggcttaggtttattggattaaactcgtaagcaactattttttcttatatggtttatgagctggtggcttttaagccctcaagtgtaatggcgctacttaaaaaaagatttttgtatgtggtcagaattgatcttcgcaagtggctggcggaccgcatgcacgcaaatgtctgcggaaatcagcattttcgcatgcgggaggcccaactgcttggggagattcattgttgcaggccgatgagctatgtgagctggttaagtcactgaagtgttcattcttaaatgtaaatattacatttctcagctccttagcaaattcttgatatagtgtatcaaaggtcttccactaaagagcattggtggattgtcgaatcataccatatgtcttgcggttttctcgatactatctcatcaactcatcgtcattaggatttgagaacaagcgcttcatgacatctttcactggcagataccatatcaccatggtcggaatatttttctttgtatgcaccgatgaatcaaggtcgacaacctctctattagaggacccattacctgttctgtaccgactagccccacaggttaggtaactgttcaagtctacatattccttgtagtacaatacacaatgatttacacatgtatgtatcttttggacatatgagtttcttcgcttgatacgtgttagatggcaattagttaggtttaggaagcaaaacacttaagagacccaacaaaccattgaagctactatcggatcatttgtgtctggtcttcaatctgagaagttcaagcatcgaaggcaatatcgtaaaatctttctcacatcccttggattcgtcgtaaagaagatccttcgctgactaaactaacgtctcctaattatctaatcctctcgctgaacccattagcacctttggtttagcgtgacgtggcatatcccccagaccagaaagagctttaaaatcatcaatacgagtagaactgttctcgtccatctgtaaataatcatcaatatgatgaatgaattcttcgcatctcgtacatccatgtctgatccatctgtaaataatcacgacacgaataaaattaaactataggtgttttccaccaaaacatgaaaaatacacgcatctcctcgaaaataatgcaccattacattgaactagcatgaaaactagtgcttacaatagtaattttgctcatctaaatattctattatagttaaaatttgcaaaaatagctcataagagtcgtcttctaaaactgcaaaattctccgcattgcaccgatgaaatattttttaaaaaaatggcggcaaatggaggaggtaaggaagtatataaccttgtatatcaatttaaagttcaaaacctcccccaccctatttgttgcttgttttgaagagataaacttttggttgaaatggggttagctcgggttgggatcaaatatatgggcatatcatcgcgggcaggactcttaagggcccgcttgcaataaccgcattatcgcaagcggccctttaagatgccctcatgtgataatgcacccattatcgcaggcgggtctcttaaggggggccctgtgataatgtgttaccacagacgggccttaaactaccccgataaagtgatttttacatgcggaggcagttacggcctgtctgtagcctggaaagggcattgtccgcaaaaatcaaatctatagcattgtggtggtgtcacttttccactttatacaagcgaaaaaaaagttactccaacttagttttagcttaacagtataagggtgacttgtgcctttataaaagctaaacgaaaaatttgcctatttatttaggtttggacttttttcttataagttaccttgtaatatatcgtgcctgaaaaaaaagagggcagctagggacaaagctagctagtagcaagctcgagaggtggtgaacagagaagaattcaatcccctttgtaatagtttgaatcttaatggttggagttgtatgtatactatttatgtaccaaaacgcgtgtatgggtaaggtagtaagaaatataggattgagacgaacgttgcccatgcttgctctcgatcgatcactttctctttctttctagagcagctatgtgcaagttgtagtatcacattatcttgtccatctctacccatctagcttaaatattgccactctcgaattctcatcagtagccaatagccggtcgatgggaactaatgattttcctcagcgatctgcagggctttttgactgattaggacgtgtcgtcgccgtcgttgcactgcgttatcgatcgattgatcatccgagcatctcgcgctcgcgggcccctcgtgcgggcgcaacagtgccatcgattgctccctctcatggctgcataagaattgcagtgaagtacactacccatcctaaaatataaggatttctgagttttataagtaattataaaagtagataaaattaaattaattatgcttagacggttagattaagatgagagatgattacgatcgtttgtaatgaaaaggtagatggagaagttgctatatcatggaacaaattttagacaatacaaattgctattttttaggatggagggaaaagtcatttttctgtatattattgtttggttctgcgtcttccacccatgattaatttgatcgatggcgacgctctgaaaatgacattaatatacaatcgatcagttccttaccgtaatatgctacatgctcgcttttttacttcaaaaggtgaatcatgtgtgtgcaccaggacttataggtcaaaagtagatccaacaaacaaacagttcaccaatagtattacgctccacattcatagaaactagcgatctgtattttatggatctgaggaagagaagagaaaaaaggcgaacttcgttggagggggagtatcgaaaatccgatggtccttgagggaggcagcaacatgagattgtgatatgttggcggcggcgtaccgcaagctatggcatagtaggaggcgacgaaatagaagcgggaggtatagtgaggcataaggcagagggaagtgtcggatttcggcattccttgaggtggtagcgatggggatcacggtagtagcacatcgtcccgaaatctcatagggcctgggaggtggcgtgcggcagtgacggacgtggtagtggtgggacgaacgttgtgctgtccgccagccgcactttgctaccggtcgccgctcgacactggccaccaagtcttccactcactttttggtagtagcggtgggtgtaggtggttgttaccgttgcagttgtgttgtctttcaagtactaatatcggtgacgcctatgggagtcacaccttcctataagcgttgccgcgatgcccttcccggtggacatccatgctatgcgatgaactgtcccggtggagatgatgttctagatgtctgaaatagcgatggtgatatttaagatgtcgcaaccttcttgaagtcatagcattggaggtttcttgttagtgtgatgtccttatgatggtgtccccgtcgattcgtatacgatggtaattgtggtggtaatctgggcggatgattgttaactactctttgatgttgacttcctctttggtttgacgttagtttgctgatagcgatgggagcgaaattcaatcaacaaatgatgttgtttttatggtttgataaagacatgaactaatacaagccgttggtagaaacaacggttatttatacttggacctttttagggtgctattgttgtttctaatcaagccataattgtaattcataattattcatcgtgtagactctataatagttggttgtaacttctatggagtaatgggaaaaaataatgctattataaaaaaaaaattacactccaccttcataacccgtattatggcatgatgtttcatagaagcatggcgatatatatgtgcatatagcagccgtaaaccctttttttttaccaaaaagcggtcctaaattttgacgattgatctgtgtaaaaggtttaacatgtagttaccgtggtttaaatgtatggtttacctgtccaacctattcaaaatctccattatatttcggacaaattagctactacacatgggtcttacagttggcaaccactaatgggcccgggtattataaatgcatatgtacattctttgaaagttcccctaaatgcttagcccctccagatgggacgagccatgcacatatgcatatgcatcatgcatagaagctaacctgaggttttgttcttgcttttttctacaaggttttgactctagaaactttatgctttgagacgtgaacgattatatggtctgcacactgcgaatgtggtgtttaaacttggagtgttatcgtttaaacgatgtgctcgaatgttgatgctatgctagtaccatttgtagtgaaacatatggcctcaaaggtcgatgcaagccaagacatgggtaggccatgaacgtcttgtgtcgtgtgccgcgctatagggccacgtacagtaaatggtgcccatttagcaagagtcgatactctgttaccacttgtaacacaccatgcgacaaccaaaaataatccacactgatcgtgtcaattgtggtacaccgcgcgacaataaaatccacacaatgtctaaacacccatgtggaacatctgtgtatgggtaaaatctcacctggattctacttatttagaagaaggagagagagagagagagagagagagtccatttttctactttaaacttttgagtctaaaaacccctcaaaatttgaaaccggatactattcaataacgtaaacaaagaaatccgtcactcccaaattcacctatattttgagtttttttgtgtcaattggcaatttaattatgtggctcaaaccgaaaaacaattttagttcaattgataacttacaagattttgcaagttttctcgtttgcaccacaaaaaacaatgtttcaaattaaacaaaataatctttagtggaataattgcaatccattcaacactatatataatttatctagcctgttgatactgctatatatatgtaacttttctttagcaatttcttgagtgcacttaataagttttataactcaaaagcattatttgaatttagaaaattaataaatggctttgaacaattctagaatttttttaaaggtggacgttgatgtatttataaaatttatcgatccacaaaatatttgtgtacttcctccgtttcatattataagactttctagcattgcccacattcatatatatgctaatgaatctagacatatatgtgtggctagattcattaatatctatataaatgttagcaatgctagaaagtcttaattataacctgaaatgaaggtagtattaaactatattttctgcattccgattgtaataaatttatccaaagttacaaatatgctgatagcagatatatttttataatttttgttaagacctctagctagggcgatcaagtagctattcttgcacggcatgaattaattagatgtttattatttctagtatttattttaagactgttcttgctagtaaatcgtgccgtactgcaattaatacatgcaatctgcaacactgattactgtcactgcatgtgatttactttccccgtcccataaaaaaccaatctaactagataaataccccgcacaatgttgcaggagaattgtgtgataatagaaggcacaaccacccttaacacaaacaccaagaaataattattatcatcttgtagtttgaatcatccgagttagagaatgtgagagtggaggatttaaaaaagtagtaatttaatggaaaatatatcatagttaatggtatgcatgcatgcatgacttatattattgaacataaaaaaaagtggttgtaccttatattatggaatggaggtagtatatatgagttctaaaattttcttccttatctactatacggtttttttcatgtgtttatctattttttatacttttatcaattattcaaatgttataaataattgggttgtatggtatgccttttgggggaaaagatgcaatttatacccttgatgaatcatccaaaggctaaaaacaattaaggtgatgtggctttatgagagaggagagaattagcattaactacacttactcgggatgaactttatagatctatataggatactggatgtgacacatcctagctagtactatgaatctagatatatctttattcagatttgtgttctagatttgttttatttgggacggagggagtaggcgccaaggtatcccaaaccactggggccggagttatcgcgccccggcggtaagcacggttaccgcgcggtaaccacggtaaccgtggcaaaccgtacgaaaccgtgtaaaatttatcaaaatttcaaattactttttaaatttatttgaatttaaggaggttaccgtggttttctttttaccgtacccccacagtaagcgtggtaaccgcggttaccggcggttttgtaaaccctggtaggcgccaatgccatatatgaattgtgtcgaattaattaattagcttgtgggtaagtagctgcatggagcattaagggggtgcttgaagaaaggattagggtttcgtaaattgcaatgagtgggatgccagatctatgatctatctcctcataggcttatatatatgtttgcaagtactagagcgccctgtactctgcgttgtgttgatttccgaaaagaaaaaaaaattaccatatgcaaactaactttcactacttgtcactgtcgtcctcctacctcagctccttctccatcgtcgctccaaacaactttaatttcaaactcttccttctgaaaaggcactgttcatgcatgctacaccccttcactctctctaaaaagttcgtgtgtttgtacatgggttgtgggcgcgtacattcatggccctactgtgccgaatcgaagagagacggtggccgttgtgaagcagccagcgacctgttcaattaatttccttgcctggtataaatttcttttatgttctgcaaccatgcacggctacacggagcctaatcattgataattcaaaatagtaatatctaatcgttcatttaaggacactgcggtaaagaaattttactatctataagagataaaaataattggtatcttatagtatctgagatacttgagagctatctatcaaaatttagatttcaaagagtgtgatacctctcagtattatccacttaacattgccacataaatgatcatccatgtcgcctcatcattgtcggttcagtgtgaaccgacagcgatagcgtatcattgtcgatccaccgtgatttatggtccaaactgatcacataatccagcagttatactgagtattattgtcggcttttatcacaaactgatagtgtttgtatcattgccagcttatgccatgaaccgatagagaaaactggttgaccaacatttgaccagagctaggagaggttaaaaatttcctaaggctccacggctgaaaacataagttgttggtagcctatcagtcgccacccaccccaccccaccccacgtcaacaaaatcccctcttcttctctcatagtttccctcttcttccttccctcctaatctgaccatggtgccaaccgcaccacgctagctctcttcctccctgtgtacctctcccttccctatatcgagccctctccccctcccccttctctccctttctctctcccaagtccaggttgaggtctatcttccctccctctcccatgtcgtaggcagctggtgtggtaagtgaggaggataggagacagctggcgaggtggggtctagatccagtgaccccgagctaggagtggccaaattcggcccacgggatggcagcggctcacgtggcatgatgacttgtaatctctgtgggatcctttgaaacaaaggttttattaaaggaattttgtagatatgaatcctttggaatattttcctatatatatgctcctttggataaatggaatggaccctttcaaattcctggaatatggccaagttcataaggattttggaggaaatctaacatgagctctaattaagctcttggaaaattaactttatgccatcctctctctaaattcatatattgtttttatatgaagtatccaaacaatacaattgagcaattccttgggatcacattggcatgccactccaattcctatattgttattattcctatgtttctcaattcctacgttttaaaggagccctcaggagctttgtacaagaccagctaccatatcgggggtccacacattttatgataactagtttcatgtcgtatatgtcctctaatagttctggatcaccccattagggattagcatgaagtacaaacccagtaacggttgcatatatcttatggaatcgttatatatcacttgatttcaaacggtttctgtgagaatcgttagagattagttgtcgaagattaattggctagctattttctagttgtgtacattctagcttagtattattgggcatgcatgtctgtactgtacatgctcaatcagtactgagcattcatatgcgcttgtctcctgcatgtatgtgctcaaagctaatttactattcgatcccccatttttttggccagatcgatgcacacaaatggactcgattctgccacaagatatgttcggctatatatctcttataaatcttttttagaataacaataagcagatctaacttatatatatgtttattggtcatatccagacaaaatataggagaaaacgtaatttttgatattggctaaactagctagtcataaattttgaaaaaaaaattgatcttttatggttaacatgcatccataacttaatttgatcactatatttttaatattatgtatcagtatactagctatcaaattataatattgagagattaattaaagcattttatgaagagtttactcctatcattttcatatagccaaacatactttctaggcaagttttggttagagcacattttgactgcacacatattgcaggcaatatataataaatttcccctgcatgtatctcatttttatttcaatacctaaacacgatatatttgcaaaaaaaagtcagatacgatatagtttctcaaataataaattttcccttgatatgtttctcattttttaatacttattaaacgctagtatttgcgggaaaaaataaaattcagatacgacatagtttcccgaattaagcagatatagataatctaggaaacaatttatacggtatatatgaaaaataattaagggcaggggcatatcatgcatgagagagagagagagagagagagagagagagagagagaggatgattcagcattcaggtggatgggaacatgcagccctgaccacaccagtcaatggtctacagcaaaacactacacctacaatacgtgtacatataagggatgcacatatataataagcatccaacaatatatttgtgcaccacataccatatttcatgtcgtctacagtagtaacataagtggcctgttcactctagctacatagtgtgcatatttttctatcagttgtgtgcccgtgcaacaccgatgcacccatccatcccatcatatgatcctatccggcggccacactgcaaatctgcaaaatgatagaatttaaaaacacaaaaaacaagttagggtcggtcaaaaatcgacaagaaaagcagcagcaggagagaaacaagaggccatcccctccagattatcctgcagtcatgtcatgcttctcccctccctgcaggcctcaaggcatggaaggaattgcaaagataatattattgctagtacatggatggaatatatacttgaaaatgaaatatatttatacaaacatcctaactttatattgttcaaactttggaattaagagagtgaaaggtaaatgggataaaacaaaaaagaaacatctttaactggtaggtgacatcaccaatagtgagacactttgtgacttcagcaatctcaagacatattagctgtaatttctggtaagtgtgtatggtgagtttgtatattacacctcccagaaagctagctataaatatgcacacacccaccatacacactttacagaaattatggctaacatgtctgaaattgccgaagtcacagagtatgtacagacgacgacgtgtgcatctgtattgtatttcgaatattaatttctctttaattaactttcctgtcattttctcaccccctgagtagctagcaccaagctgtctagccttcctataccctactaggctctactacacccatttctacctcacacacctagctagcaagtaggctctctcactccacacccacactactcctcccaggctgcctgcctaaaaggctagacctatccatctcttccccccactcctccagcatcgccatcatccactgttcatccactccatctctctctctctctctctctctctctctctccatcgatccctgcaggttcttgctgctgctgctgctgccttgcttgctgtcaagcatggcttgaccacctgagagcgaggagagcatagcgtagtacttggctagctgctgttcaattcctcatggatgattggaggatcgctagctaggtcgcccggatccacggacacctctcctcgtctcgtgctcgtgcatgccaagatcgatcgatcccagctgctgctgcgagtggagcagtggaggaggagatcggctgctacctgacctagatcgggaagcagattcatccggtacatgttatatatagatatagatcgttgcttaggttcttctcttcttgtttgatttcgtcggagcaagaaatgatgcttgcttcttgtgattcaggttgcattacggcggcgaggcgagggcgaggatggatcgtcaccatcaccaccaccaccaccaccaccatcacatgatgtcgggcggcgggcaagacccggcggcgggggacggcggcgccggcggcgccacgcaggacagcttcttcctcggcccggccgcggccgccatgttctccggcgccgggtcgtcgtcgtcgggcgcggggacgtcggcgggaggcggcggcggcgggccatcgccgtccagctcgtcgccgtcgctgagccggtacgagtcgcagaagcggcgggactggaacacgttcgggcagtacctgcggaaccaccggccgccgctgtccctgtcgcggtgcagcggcgcgcacgtgctggagttcctcaagtacatggaccagttcgggaagacgaaggtgcacacgccggtgtgccccttctacggccaccccaacccgccggcgccatgcccgtgcccgctccgccaagcctggggctccctcgacgcgctcatcggccgcctccgcgccgcctacgaggagaacggcggcacgccggagatgaaccccttcggcgcccgcgccgtccgcctctacctgcgcgaggtgcgcgagacgcaggccagggcgagggggatcagctacgagaagaagaagcgcaagaagccctcgtccgccggcgccggagccgggccctcgtccgaggggagcccgccgccacccggcggctcggccagcggcggcggcgacacgtcggcgtcgccgcagttcatcatcccgtgagttcttctcgatccccatcgccatctccgcatctccattgatcgatcgagcctcgcagcaagaaattccaatctccttggcagaaatgccatcttgctttgccagtacaaggcatcatatctcttctttcctcctgaattggtttcgatctctcccattttgcaaaaaaagatttctcctctttttaatttcatctctgtctcgctttctaagctaggacgaaggtcatgcatgagtgagtacttagtttaattcttgtttttttccttagctttgggacgtcaattaattggtagctgctgtcttcgatcgatctcgtcccgtttggtttaattattttgatgcaagaactggagtaaatttgatgagaatctcaagctagctagcctaattaggagttgtaatatttgttttagtctgggggatttgcaagaacaaaagtagcagaagctgtaggcatagcaagctagctagtgttagtatctgtagaatttgttcttgtaatagcttgtcgccaagctagccaagtgcagtggcgtcagcaatgcttccttctatctatcatgtactagtgatgatgtcttggtcttcctttcttggttgagcaaaagggcaaaaagggagagatcgactagctgatgagatgatgagtgatttcaattggtagcttaattaagacagaaacaacatgtgttatgtgtacttgtcctgggaacagattccatatatatgccaaatgctttaatttgggctatgatctgtgtgcaatgcaatgttcttgatatattcatgatcaagtgctccctttggtcatcatgtgtgtgctggtagctagactttatacaaaaatatgttgcttttgttctttgctttgaacaatgttttgttgtgtagtgccagtttttgaatggtttacagtactggatactaccttctttcacttttacaatatgtgcaaagtggtaacagatgaagaaacaaacaaaccaaacaaaagaagaaagaaagataggagtcttttcaaaaaaggagagaaaagaaggcagccaggcaccaaaaatatataaagggttcaattgggtgtgcactagtacgattgggtgatccctatttttgcccatgctttgatgcttctgattcctttccttgttcaagtttgaattgctggatttgacttgatttaatttgtcttcacttgtttattattcctgatgatgagtatatatagtagaactgacctgcacatatatatatgtttctgtaacaactcaaatgatcaatgatcagaggttttttcaaaaaaagagaaagaagggagaatgcatgttcaggtagctagcagacagcagtaaaactacaattctctttgtggttaaagttagtttaccacctttgttagaacctgatcagatcattctttttgcatgaaaactattcacttctaaagtcttttgtgtccctatcaatgcaacagtgccacacacatgttctttcacttcatctctgctgtccccatgtatatatatgtatactatatgatatggcattgctaccagcttagcaggagggcattcaagttcctgttttcacacagttgatgcatctatcactatcttagattttgcttgtcctttcaatgcatatatatgtgtagttgagaaaactttttctttcatatatatatggaacagacaaattaaagtcgactgttctatgtattgcttctatttaatttattcgacaactttgcgtgcaactcaatctgcttctcttttttgggggattcaaaagaatttttagcacatggccggcttcaatctttatgtgagtgatatgtctgattgatatatatgtactgactgactctctgtagccacagcttgcttgattgtggttgcataccttgcatgcatgcgtgatgagtttttctacctaattgagctagtatatatactgtatattgattaggtatcacagtatcgtcagtgttttatttgacccctaggcctcctttggaatacgacaattactaaatttccttcgttgcattgcctatatatatgtgcgctccacttagtttgatcaatacatttttatgagtgcttatattcatgaaaacaagccacaatattggctctaattttatacatttggtttctgcaaaggtgtataaaaatatgttttagcttatatatgtgtgtgataaaatttatgctcttttaatgcaatatgattgttttttgtttctttgattccaaatatataggtaataacaaatactaaacattgtgttgtctaaatgcaaatatagttatccacataatgtctattgaaaaaaataatatcaatatcaatggtaaacagttactcaccataaaacaccatattaggtgtgtgtttttcatcattgtttattttcttaagcttaattttatgttttttcattatattctattttccagcatttgcccttaaaccgctcatagatatgaaaacttgtccatgaattttttttcttacttcatttattttttttcgtgatttatcagccatatagctcaaacaatcataacccatttaactatagcaacaataaatgttaaaaaaatatgttgattacatgcacctttaattttatcccaaaactgcattatacatcacaaaaaccattcatgtaggtttcctgaaaataaaagggggcactcatgcttttatctatccatggttttcttaattttcagcagctaacaacccatagaattatgtcaaatttcttaactaaacataagcatggacacttcctcccaacatagtgtcttaaaaaatgtcaatcaacaagacatctaatacatttattataaattagaaaattatttcgttcattttttttgctacaagtcaagtaatcaactaatttaatacaacacttgatagataaaggtggtatttaaatgtaaaggctagtttaatttcacactttcgacacgcatcacactcacaacacgtatggatgtttttttaccgtcattttgggaggtattgagagatagatgtttatcatagctagcgttaatcatgacgtacacaccaggattaattatcacaaaagaactatatatatgacataaaagacatgttatccatgcatagattagcatccacaaataaatttagcagatcatggcgatggaacattttcttaattgtagtttagattgttgttgctgaaactccttggattaatgcatgggaacctgatcaacgacaagtgttttgttgtccctcaattaaattccttactatgcctccatgaacttcttgatcaattaatcatctcggtataccttgttgtaactagtatagggtttaaagcgatctttagtcctcccttggatgcatgtatgcttaattttggcctttaattcccatatcttctgttgaagtgaatattggccatggcacatctcttgtccacattattatagaaaatgaaatataagaatagatctaatacaagcatatatatccatgtgcatgaattgtacatgaaaaatgaaggtacctgaaacctctactagtcattctagttattcatatcttatattttgcggggtatatatatatatacacacacacgatcgatgctgaccaaattaacacacaccttggagcaattaacagggatttattcttacattgcatatagcgatagagctatatatgcattatactactttggcttctacttcaaataagacggacaataatcaaacgttggatacagatacacacagctgcgtttaaaatgggaggcagggagtagaagtatttaagcatggggatctgttcattgaaagaagtagatagaaactggaacgggtgggcgccaaaatttggcgaaacaaattcccccctaataaatgaaaaatccctggctcgcgttctattggttcatgttgcctgctctactgatactactttgcatgtacccatgattgacgaagagtacgtctagctagtgcagggccgaagaggctactgaaattaaggtggcccaatcgcacagaagaacaaactcgcacgtacgctgatgtgtcgtaatctgagaggagaaatgtatatctagcagcagcagcagcaactcagtttgcaggctcctttgcagcttctgatgcatgcagctgagactgataggtgagaggcatcaactagggacgagtttagtttcaaattttttcttcaaactttcaacttttccatcacatcaaaacttgtctatacacacaaatttccaacttttccgtcacatcgttccaatttcaacaaaacttttaattttgacgtgtgaacgaaacacaccctagctctgaatcgctctgatcagcaatgcgaaggaggaagaagaagaagaagaaagagagtgtagaaaaaatactactacactgctagctagctgctgctcgatcgatcgtagaaaactccatgagagtaatcgtccatggatcagaaaaatttagccgcgggatagatctgtggcgtttgtgtccaggacaaagggccactgttggcgatgtcattcaattcatttccaccgtactgtacctaccccgctctcccttcatttactccgatcctaacgtacagtatactgcagtcgtgtatgtgtactccactacgggaacacggcttaattttacccacacgcagtgtaccaaagtgcaccgtacgtatttcatcaatcttactactatattggttcagtgctttagtttagggcaatcacaattaatttttgttcttcattcgtcatcactgctttgtacgtaccaggtacgtacttctggtatctaggagtttcggtttagaaaatgtcaagatatgtactatgtttaacacatgcatggtagactatatagtacatacgtcctcgttccaaaatatagaaaaaataggatttaaatcttatgctataatacaaggatttttagcactattcacagtattacttttcccatcaatcatttaccattaaaatttctttccatcttaccccctaactaacctcccaccgctattcgttacaaatttattgagatacatcgaagcctttcttttcttaaccttaatatctactaaataatctagaaatgcttcttgggggagtatcttcacccttctcagcgtaggtgccctagcctaccaaccagaggggactctgaaggaggcccggttgaggccttggtaaggcctccaggaaggacctagtctagaatggcaccatcctcgaggtggctccggcaaaatgcgacttcacgaagcatctatgacgagaagacgggccatttagggtgcattcaatgaacccaaccatcaatgacgtatccgcggcgagagcaagcaggaatgccgaggcgcctcgatagcgtgcctcggcctcgagctgtctatcccgagattcgtcggaaccccgtgatggggggtttaatggaggcagcccctttctggtcgcctagagttttaccttcttgctctcgaggccaagcctgccagccagcctccacgtagtgggcggaggccaaagggccccttcgtaacttcccatataatctctagggatatataattgtaattcgctcctcgaaagagggcaatggagacaacgatagagaaatcgcgttgtttccttggtagactctcaatccctgttggattttattccaacaatgcttacagtttggatcggatagagcaaaacatttctgacttagttaaaatgctcatggttgaccttagaaggtcttttcggttgtgttgctgtagcttgccttctacgacaagtgccaagtagctagacacagggtagaccagaatgagacagaagacccgtgtgacagcaacaaaagaattattattgtggccctgtttttccagctaccagattattgtcatggattatttgctccgttccttccataatatatttttttagagaaaaatctttattctaatgcattacctagatatcttgttatggactattaatttcaaaatatttaatttatgtcaaaaaagtgtaactataattcactgcaataataacatggttaataattcgttttaaactactaggccttatagcgtttcaccaaatcgttttcgtttcttccaaagatctgcgtggtacaaccgtacaaagcaaccctagtagtcaatttggtcaggaggagcagcagcagcagaagctggaccagtgggctgcaccggtgacttggtgagcagtgctgctgctgattcaggccagggaacagatctgcctgcgtggggcctacatctacagtaatcatatgccattttgggccgggatcaatccgtcaggcaggccggccgttcgattggttcgtttagcgaagagttgaatccagacggcccataatctgttgcatgggcctagcaaaattgaagttagagctaagcccaggcccacagtcagatgaatagccaagcccattagtgagattccctgtgatcctgccatactgggccatacttttcggcttttcctttggcccaacttaagaggcaggcccacggtcaatcagtcactccagctggttaggtgatcttactggaaaaacgtaattaaccactgtagtaagaaaagtattcctaccagctggtcaaaaaaggtaaaaagtaggctgacatgcaagcaaagcatatgcatattgcatggagtacatgggcatgcaaggttgggcggtggtcaagccaacaaaagctggccgcttttgctaacactgacttggacccatccatatgccaggctgcttgctgcctgcctagcttcaacccttcaagcatgctgcaccacacagcagatcgatcgccgatatatgccgcattgtcgcgatggatggctaaaaaaaaagggttggaaggagagatgcccggccctccgaacattttcaaagaagaaattacgaacgggttaagaattaaacacgaaacctcaagattaaaatcatacaccccatgtccccatatcactgtattatcaagcgtaacatcgataatataacctagagctgatcaaaccggtaatacgaagtactataactacaacagtccatgaattggacaacgcttgccaccagcaagagattagaaaaaagagtccattctctcatctctatcctatttacggtatgaaaaatttagaagaaaagaaatcatatatagtgttagaaaacttgcaacgaatttttagcagcgaaagttaaggaggatgctaattaaaacctgagccctagcaaaagcaaaattactctcaaaacttatcctttagctttgtttatcttatttttctctggtatatttaacaatattttggtgcactttagatactgggttgttaaaaacaaaagaaagcaaaaatgtaacactatatttgccatgccatccccccatgcatgtatggaaaaaactctacgatcgagtgcagcgtacgtttgatcgcggctgtgtaagcttagaagcgaactaaacgttttgtttgtttttcctctgaaaatgggtaagccgaagagcagtgaagcaaactataattaacaccaaatgataacacactagatttgttgccgatcgatcgagattcgagcgtcagatcctttgcttggtttggcaaccaaaatcatatctttggcttagatttattctttctgcttctgtccaaacgcctagcaacgactacgctgcttaattaaattacgtgcagcgagacgcaacaaattgggacatgtgtcacttttatactcagtactgtaggtacacatgaacagtaccttctagttaaacaaatcttgatcccgacaggaacagtgagcaaagtactacatttatattagggtgacatgctaattaacaacagggctttgcaaggtcccaatcctcttgttctggcttagcattactgtatatattttgctattaattattattttttcgccgggctggtattaattattctctctgattttagataatatagatgataccgttgactttaaataagtttgattattggtattattcaaatacgcaaaacgtttgaccattcatctcgttaaaaagttttgtataaatatgtaaaaatataaatcgtagttaagaacctttagtgataaattaaacaagtactcacagaaaaataaatattaatcaagtaaaaagattaaaaagaagaatcctcaaatgtatatcaaaattgattgcgtcattcattaaaaaccgatagtacgtccaaactcgatctttctatcagtacaaaattttctatcagtataaattaaaatgctccaaaggatctcagcaaaagttagatagcttttgtatggccgccatctgtataggagcaatagcttaattaattaattactacctagttaaacctaccttttatatagatcatatcacgttacgtagtcagtgtgctagttcggtactactatccaattaaggcactgctcatcagtctaccacacctatggtgattcaacatataataaaactaaactagctttatcatattaaactacattgcttcataatttatatgtaaactacaactacggtatgaaggattgatggtaactaattaagccaggtagcatcgatcaagtagaaattaaaactgtcgacacagatcagaatgacgtagttacgtgtaaacagcagctatccacacaccaacttgttttccagcagctagctagctagctagaattcatcctcatcctcagcatgcatatacatacgcatgcataccggccaaattcaatctggccagaacttgattttaacggtaaatagtatagtaattaacatatataagaaagctatcccaaactagtgaagctttagcaatgggcaaaataattaagcaacaggggatgacacatgcatatggcctgatctgcatgcatgcacctactgcatgctggacattctgtcggcatttttgtattactatgctaatttaataatttatatggaactatggaagggattgaatacttaattacaaattaactcatcactgcaatatagtataagtacactatatatatccagtgtgctcagattagttgcttctaatcaaacatctcggttaattgttatattgaaaggacacttgcgctatagctaatacattcggaacagcatgtacctaggctgataaactaattaattagctagctagctaggtcatgcatgcatacacacatatatatacatggtcgatcattagagcttgcaattgtcaattaagctagaagcaagcaagttggggataaataattaatcatcaagtaaacgcggtatattagtcggtccattagctgcatgttttaattactttacaatatcgtctctgatggaattagttaggtaaatattaacaatatatgcacatgccatttgaatatatatacatgtatgcatcacgtactcgatatagctcatgtacgtattgtacgtaataacactgtgtacgcattttcaagctagatagcaaattctcttttagtttccttcgtggattaattttctcttctactttaggtcaacatatttgccacacttttggaattgatcgtcaaggacctttttatccactttggataacaggattctaatacagttcatacttatgcttttgtacttaacgtaatatttatatatatacataatttatatgctcctactttgtacattttttttatctcatggccggggacgggttttatttcttactgagattattttttttaactcaaactagctttatggttgtgtgtatcctacattcaaagatagaggatataactatatcttccttatcttaaaatggtcaaggggatcccatgttatatatctatcagttagaggccacgtaaccgaccaaactttgctgctgttaatttagtaaccggatgacgtaaccaatcgacacagccaatgatcagcaagacagcaactaatctgcaattagtattagattagctatgctctgcgtgtcttgcgtatactgtttgtgtaatatatcatttagaaatgatatgtggtcatgtccatagataatttgttctttcttaagtgcatgcgaccagatttcgatcaacagtacaggtctgcatgcatgaactcgtcacatgcacacagcaaattggttgctgcagagacgacaaattaaattgaaccgaacaaatcgatattgcaatccacccgttttgctaattaaacacacatatatattgcaatccatccgatatatccatatctcaaaaccaatcagtttacaatcatgcacagagtcaacatcaggaccagtacttctgattgtgaataaacataaagctgcacactcttcatgatgcatatatgcctcaagaagattccataaagatcagtggtctaattattccttgatgaaaaacaaatgttttttttctgatgcatacatgtatgcttgcattagtatagtgtgtggtcctacccaatctatacatgatatatatgtaagaaattaagcagcaaacgatcaatgtgtaggggaacacacatgcatgatcgttcagaaaaaaaaagttagtagtggtcctgcctgctctagatgctatgctatttattatgaccatagaaattaagctagcagaagcactgtttgacatgcaattaatcaatttgcatgtacttaattttcagtgcacaatgcacaattaggcagcatctgatggatgatgagatccctgtgcccttagcttagctaactgccaaaacaagcattcagaaagcgtggtgatggatggacgttgcgagataggggccccggcgccgatggaggacaagacatcagatcatatcacagaaattaacgagaaagagaacaaacgaacctagacgacaatggccggcttgggtcgttgtgtgtgcttcgttcagtactactgttgtgtgacatacaagaggcagcctgcacccacatgcatgcagcagcaagactgatatgattctcctgacttagcagcttgcatactgttgctccttcgatgattgttgtttattttctttatcagcttaagcttttaagttgaattagttagtgtacgtaactcaatatgttagcgagaccgaaaatctgaagttcaaatcatgtcagatgcacaattaaatcaataattgtagctcatttctatttcagtctcgtctcgaggtttgagggaacctcgcgtagaggtgagtgttggcatataagccggttgaagtaatgaataggttgtgtttgttcacatgatattgagaggagaagatttacctcatacattttcttttccgaactaataaatgatgtgttgttcttaaaaactttcaatagaaatgttgctttaaaaatcatattaatccatttttaaaattaaaataattaactatttaattaattatacgctaatatggttcatcttattttgtgtatcttctcaatcttccacttttccctcctctcaactccttcctaacagtgtttaattaccttgctggggttgtcagtcaattgtgggttagatcctatattaatggccactgcatatttacagcagtatgttgggcaaattgttgatgattctacaattacgtgtataaaactagctggctctcttatgtaggatggttaagttcctctgttaatttgtgtggatcagttagttaagtttgaaaattccacacagatacagcaatgaactaaaactagctctcttatgtactaggatatataattaactaaaaccaggtagctaatattaactacctgcagctgttaatttgtatggatcagttagtgaagtttgaagcttccacactgatacagactgaaagatacagcaaaggactagaaaaagggttccaaattaagtactccattaatatatccacccatcaacagaaactgatcattcatacattatatgtacacatgcatgacgacgtctgctactactgcaatctcaatcaaattaaaggctaagatatataatttacctccaaacaatgcaacagcgctatacgacgtaccactataccctatacacaggtgcgcatgtttgcatgcacaatcaacgaaatctgcacaagctgatcgatggaatcgatcaccacgaaacaaatcagatcaaacaatcgaggtgaaaagaggttattaataataaacgctagctagctgcgctgcagaactgcagctagctagcagctgggagtgtgtgtaagctagctaagctagcactagcagcaccgacacctatggtggatcgtcacatcggcatcaggccgttgtaattgtagtgctcctcgagccctagctccatcagaccgcactgctcgccgccgtcgaccctcgatcccgccgccgacgccgacgccgccacggcgccgccgtcgagatgctggctgaagtcgaagatgctgctgtacagcgccatgctggtggtggggatgaactcgttgagggagccgccgccgccgccggtgacgggcatgtggtggtggtggtggtgatcgggaggcggcggtgggtggctgctgtagtggtggctgctgctgcaggcggcgagcgacgccgggaatggcgggggcgagtgatggccggcggcggctgggtcgtgagacgaggaggagttggagtagcatccacccgccttgatggccgcggcgctccgtgccatggcgatcaccgcctcctgctcgttctccatgctgtacgacgactccgtctccgtctccgccttcttcttgtagaacactctgcacaacacccaatcctcctgcatacacatatgcaaaattaaacacacaaactcaagctcttgattaaccaaaagttactactatactccttcaggttataacacgttttaactctaataaagtcaaactatttcaagtttaactaattttatagataaatatagtaatatttatgatactaaattagtttatcaaatcaataattgaattaattttcttaataaatttgtcatgggttaaaaatattattattttttctacaaacttggttaaacttaaaacagtttgactaaacaggtcttaccataacccgtgctggattttatttatttgaggatgaaaggagtaaggaaattattggagaaattagttggattgtgaggactaaccttgggaggggtgtgagggttttccatgcgaaattcgtgcatgacccagttggttttgacgccgttgggggcgcggccgcggtagaagacaagggtcttgcgcatgccgacgatggaggcgcggcggtgggcggcggcgtgcagcttggggttgtggatgacgcggtccttgccggtggccttccagtagccggacttggtggcgcggttcgtgcggagccccgtcgcgtacttgcggtcgcggaagctgaagaagtaccactcgttcgtgctcagcttcgccacatctgcatgcacaccataattaatttttcacatcacaactcgattaatctagactaatctgagatcaaccgtaatatattcagtatgtggtataatactagctacttgattaattgttcgatatgattctgattaaacttgttcctgcagttttgtaaagaaataccgttaattattcagaaattttggaaagcagatcgatttgattgagggaaattaaacaaaccggttaatttaatctttttcaatattatgtatatttttattgttctcagtttttttttttttgagaataggatgggccggcgcgcggggaaattaaggagagtttatgcacacatatagtagtatgtcctgaagaaaatgttgatatggaatgaaataagttaaattttaaacatgtataaaaattgatgggaaatttgatcgtaatcgtaagagacaaagagaacaagctatagctagagcttagatagcccacttgcagtcataaagaaataaattatagatataggtatatgtatgcttgcaccagaagcaatatataacacactgttgcacatacgcgcacagagatatacgtgatggatcgacccgtgccttgttggttaattaacaagggggaagaataacgacaatcctaattggagccaataaagcgtggttgcgtgcgtaattaatcattccatggaaacggaggaaccatctacgatttaattaaccataatcatgcagaagaggggagagagagggcgcgtggctaagagcaggtacaatagcaagctataagccagctataaacatattttaaaaagataaaggaagagagagaagagcaggagactataggtatatagtcagctgtagcacggactctaagacgtaatatgtgtatgacaggtaggaccaggtattaatagtacagtaagcaactattgtatgaattgactattacattagctataaatgatttggagctagtgagagggtcgcttgtgggagaggaaaaaggagtagtaattaattaattaattttgattgagtaagtgattacctggtagctcccacggctcgtgggtgtggaggtccacctcgaccatggtgccgccgccggcggcggcggctcctccaactccggcgaagcgatgctggttcaccaccttgttatgaaggtagtggcagacaagctcctcgtcgctcgggtagaaccggaaccccggaggcagcgtcagctcgatgtccctcaaccccatgtggctatcacctgctaaatttctttgatgatctctctgtctatagcaatctagctatatctatatgtgattgatctctgtggagtattttggaagtggtagctagctatatgtacatagctaagaattaagctgcagattgatgcagagaagaagaagaggaggagagaaattgataggtaggaacttggaagtagctagcacatatatctgtataggttggcgattgtgtgagctcgggaagaaggcaggaggcaaatatatatagcttggcgagggaataattatatgcgcagctagcagctgagagagagaagtgtagggaagcaagcaacaaagcagcagcaggagcaaagggtactactatactatggctagcaatagcaatagctatagctccgatctctatctctgtgtgtagtacgtcggtatgtaagtatcatgtatatggcagtgagcaatcgatcaatcggtcgagagctctatctgcagtaatactgttgcgcctgctgcttgctagctgctgcaagcaggagatggcgctgtcacgtacgcagcgcgcgggaggaggcggaggacgcgggagaggacgcgtgcgcggacgacgtcgcattcactgacgacctctctctctctctctctggagagaagaggaggaggagggcaggtggggttggggaggaagaggaatcaaggaagaagaaggacagagagagagagagagagaggagatccagggtcgcaagaaagatcatcgccacggccggcccacttgatgatggacgatcgatatgtacatatcccccaagtgcagcgacaacggcaacatacatggcactatcaatagagacgcatttggggaaaaaacgcgagctcgatcgatctctagctgcccattatcattgtgtttgtgtgcatatcaattcaaccgcgtgcaagatcggggagccatcgtttcggttattcgtggtacaagtaaaacggcatatttgtaaatgaaaaataatttttaaataaaatttttataatattcttagcgatcaaaaatcaaaggctaaaaaataaactttgataaaaaaaacctcaaaaccagatccaaatttaagattaaaaatttaaattttgactgacaagtataagcgaaaagatgaggacatacgtatatgacacagcttagctaggcttaattattgatccgtcctacgtacagcatctcctcctcgatcccggcctctagtatgcatctctacatgtctctctgtctgtctatgctctaagcttgttaaatttgcttacaagtaagtgcatctatgtgtgtgtactgtgtttgtacagtgcaggtacatacatgggtacacagtgtactgtataggacggtgattaattatgcaaaatgcaagccaacaaaaatatcgagacggaggataaaacaaggatcagcgcccctgaatatatcaatccgcctacacttgctagcttgcgtatactgtacattcagagaagttatcgagcatgttgatcaaagaaatatcatggataacaagtctaggtattaaacctgtgtgtgcgtgtcgtcttccgtgtaattgaaaagagaaattaacggcacgattaataaggtagtctacatccacatacaacttgcgaaccgcctatgtaggtgtatggctaaataaaatggttcaaactaacataagagaccacatcagttacaacttgataattattaatttcagaattcggagttgttataatagtaaaatcgagagatcaagacgaatacaatcacatattaagtaatgaaaaccatttcgctggactaccccctcaaattatttctttctttctaaaaccccttcaaactatttcagcggagcacttagcccctcaaaaaaaatctcattcgcaccgccaaaccatcaaaaatgtttcactttacttcctaacatatttctcttttctttctccctatataagtcgtattttgtaaataaaaaaatgttaggatgatgaccgatgtattgcaacttacgtctcaatatattttttatttttatcactgttttcatagggctgaagcacctaaggctgatttaagcatcaagattctaaaaccaagcaaacaatcatgaagaaaattaaaaatacttttgaactttcatagtggtgttatctatggcactataaaattgcaacttaaaatataacttatataaaaataaaaaaaagagaaatgttattagggagtaaagtgaaccagtttagtagtttaggccaaatatgagaaaaaatattttttcagggagggattaaacgatccataaaatagttcgagcttgtaaaatagaattatttgtttgtttgttttaaattttaaagatattaaaccattaaaataggaataataaattttggactacgactacaaactaaatacaactttgtatttattaattcgaatttcaagattatttggaaaaaaagaagcaaatttaacatgtatatgcaaacaaatgtcccgtgcattctcaacttgtggagattattactagctaacagtacgtgcatcttaagcaaggtatacgtatcttagcttgattaccgataattagcagggagagaggctgtcaggaactagctgcaggtaatcaccgtacgctgcttcaccgcttgatcgatcgatcatgcattttgatgcgaatttaatcatgagagaatcggaaattatttcttctactccaagaccagaaagcgacgagagagatgattatattaaacaaacggtagaggtagtacaggcatgtcgaaagaaaaggaacgacggagataatgtcagaaataatgtctgttcagcctgcatcgatctctgtacttctctgtagtctgtacactgtactgccgattaaattgaatcagatgataatgatatcacgacggcaaaacgttctctaattgaagtagtagcagtgcataatgtacaggtgtattgttgatgatcaattcaagttcttcatcatcatcaatcgagaaatgcgaggtacaatcattgtgtacatgtataataatactttatacgtatatttgccgtgtttgtcgtgtgctctctggcgtataaaaactgacgaactcctgcagtagtactgtacgtgtgtgtgtcattagggcacatgcgtatatacgcagctagagctatatatacgttacatattaattaattatagctaagtacctattccaaaacagtgggatgcgacttatgcgacggaataaaaggaggatatgtacagtacgtgtacaagtacagtacgtgtaattttttttgagatgaaaaaaagtacagtacgggtattcgtgatcagtatatatcaaaagtacatgtaccatatgctagctgcgtcgtacatgcatatggttgttgcggcttaattatccaaaaattaattaagttattacatccctcccctgatcatcaattaataatctactcttctcattaataatctctatatagctaagtaccttgtgcagaaaaaatatccatctcgatctaggctatacacagcaagaataattaataaaagcggcatgtatgtttaattaattactatatacttgagtatgagtatgagcctatgcaaaagtatatatgttgggaattaaagtagacgatggtcggcgatagatttgatcgatgcaggactacaggtaggtaggcacaagcaaatacatgggcgatggtaaaaaaaaaagagagagagatatggatattgtttctgtgtgatatagcagtattctttgtgcgagttgcagttaactaaaatgattggcttagagataaatactccaggtcaggacaggattgatgagagcatgcatgcaatgcaatttcatggcagttggaggcaggatagataaactaacttggggagatgattgagtgacgtcatgcaattaacaccaaggaacagggcataggacggaattaaaaaagaggcgatcattggctttaaaaaacgtgggaattaatcgtggggaatttttcgcgaacgctgaataatcatggggaataattagcattaactgcttgaattgatcaccctgatgtgtatgtatgtatgtatacgtatagtactccctccgtcctaaatgtttgattccatttactttttaaacatatttgattgttcatcttatttaaaaaatttaagtaattattaattctttttcctatcatttgatttattgttaaatatatttttatgtatacatatagttttgcatattttataaaagtttttgaataaaatgaacagtcaaatatattttaaaaaattaacggtgttaaatatttagaaaatgatggagtatatattaactgaggacgagatggatgctgcgcttaagccggcgactcgatctggaaggtgtccaatcccaatcacccaatgacagcgatacctctgcagctgggacctagaacaagctaacctagccagagtatttagctgctacaagctgctcctcccgtttcatattataaatcatttaaatcttttactaatcaattttttaaaaaaattaattaaatttataaaaaatataatagcattttcaacacaaaataaatatattatcgaaatatatttaatgttaggtatagtgaaactaatttaatattttagatattgctaaattttataaacttagtcaaatttaataaaatttgactataaaaatattaaacaacttataatataaaacaaaacggagggattactaattaacgggagctaggatattacatagtagatttagctcagaaaagattagccaggagggaacaccgattcagacatctcctgcttagctgctggtactggctagctaactggactttttctattttcttcagagcctgaaatcgttggcatcttactccaaaagggcagtggaaaagagaaaagaacaagaccggtaaagtactacataaagtacttgctactacatattctgacttgttatgaatgatgcaaacaggagattaaaatcccaatttgttaagctatggctgatgatgagtcgtagcgaaatgaaagaagcaaccaaaaataatttataaataaatctcttatatctatactattcatggcttaaaaataaggctgaaaaaaagatgctactacggtgaaaaaaaatcataacataacttttaaaattaaattttgtttgtggctgataagccagcaaacagacgatgcatgagatctgtttgcagtgcagtgtgcacgacggacatatgtctgagaaaattaaaactgattagcagcagctagatattgtcgcacaagtgcagcagagtcgaaaatccagcaagaaaggtatggttcaggcagggagagaatcagagaatcgatctggtccagaaacagtctcagtgaccatgctgcatggatgtagctacatgtctgaggaacaagtcagtcatggggtgccatcgagtgcacgcggaaaagcaaacgcggcatccagtggagatggagagcattagagcactgtgcagtgcttatgtggagtgctagcttgtgtaatccaaactttccaaagtgtcaatcaggtctacagaaatgttaattatgctttgttcgttgtcaatgcacagtacattaccatcccattatcggataaaaacacacagtatattatccatttcttgatagtactaattgattgatcctgctgcagcttgctatcaaggattcagtgaaaagctcctgtccaaatgtttggtggtagagttgttcttgtacaggtaaaaggtgctggaaaaaaggaacagtcaagattgtgatttattttctcaccaacaattcatgagtttccacttaagtaggccctatatataatgccaagatatgcatatataaatgaattgtttatgctacttctggaggcatcttaaatttgtgagttgatcccctgtccttctctgaacagaaacagagaaaagacagacgacgttgtgatcgtttctgctcttaatcggaagccaatggaggagatagggatccctaattaagaatactactgccacaacacaactaaaaagcataaccacatttgcttagttattaattactactaataagcttcttaaatggaactggcccttatccctttctctagaaaagaatataacggacacaatcatcatgagctgatggcattctgtacatatttttataattattcagagatttcttttttgtccctgctggagtttttctagggttgtttataggaagagtgacggctccatactccatttcttccaccaattccttcctactaatcagactcaacactaacagtgccctttttcaaatcctaagaaagcgacagaaaccaaaagagcacccccaaaattctcgcttttaaactagttttctctcgagtagtagtatatctcaaagtctacatgaacattccattgaagcattgactcacggaattaaaacatgtaattgcaactagtattatattgtcatgagggcagggttaaggctaaagcaaagtacgtacgcatgcaaccgaagctgcatatgtaatctgccatcaatttgcacattaagaacaaaataaaaacactaccctccatatctctcaactctagctgcttggatgatgttgaatacagtatatatgtttgtacgtagggagtatatatggaagtaagtaactgtaggaacctaattaatactgtaacattatacagacagcgacagactgacagtgtcggattaatcaagttggctagctattgcagtgcagcatctaccagcctgatgcttggtttttggctgcgtactgaaaatttatgcgagatcaagagctcaatcaagctttcctccccaagaaagaaaaagcttcgcttatccttcctctgtctcttttccttgctaccattaggatccaaattacacgaaatcatcaaatgtcccatcgatggtatatgcatgatgtgcaaaacggccatgcatatattttttttttctatgtgcagtgcttgcattgggctcctctgatctccaagaggaattatgcaacacaaaaaacatatatgtactgtggtgatattgagtgggctgtgtgtctccatttcaggaatggcctgtgcactatgcatggacagcattagttatgcttaatcgttgagtcattttcaacgtcgcatatacaccctcctaagctagcccagctctctgaaggccagccaactgctgcatgaaccatgcatccactgcatgttgaggtaggttaatttcattttgttcaggaattaatgaaagcaaatatatatctgtataacaagtagtcagtctgatctttcaggaggtagtagtagtaactaaggctgtgtttagttccagcggtgaaaagttttggcgtgtcacattggatatacggacacacatttaaagtattaaatatagactaataacaaaacaaattatagattccgcctgtaaactgcgagacgaatttattaaacctaattaattcatcattagcaaaatgtttactgtagcaccacattgtcagatcataaagtaattaggcttaaaatatttgtctcgtaaattagtcgtaatctgtgcaattatttattttttaacttatatttaatacttcatgcatatattgaaacattcgatgtgacatagcgaaaatttttatcaggagatgtaaacagaccctaagttaacctgagaggtttaaacttgtgccatctgccatggatgcagaagtagcaagaggagacgaggacgcggccgggcggggagcagaggcggtggtgaaggagaggtcggaggaggcgtgcggcgaggccgtgtggcaggcagccgcaatgattgatacgactcgtcgtcagcaaatattccctcctagacagcgacctcgtactatactacactttgcagcaaggcacgcgtcctaatgttaacccgtatgcatgcatacagattagcacgcttaattagagcaaggataatgtgagctactccctccgtctaaaaaaactcaatctcaaataatgtgacccctcctaaaacaacaaatctagataaaagatagttatactaggagcggtcaaatcctctcctagattgagttttttttttggaacggagggagtataaacctactgtaagctacttcctccgtttcatattataagactttctagcattatcaacattcatatatatgttaatgaatctagacatatatgtatgtctagattcattaatatctatatgaatgtgggtaatgctagaaagtcttataacctgaaacggaggtagtagcttacgtggaggagaggtgtaaaaaaattaaggatgttagctctcatacaagagctagcttaatataagcttgaagacaaatatatcaaatgtataagtaagagatagaaagaggagaaaaaaaattatagcaaaccttatagctaatctctattatatatgttagctttaagataaactaatgaactctactattattcttgctcttaatattttctctattataaaataagtgcaccataaataagtgcatccgtatattttaaatttgaactacatttaagtcagagagagtattattactagccaattaccattgtgactacgtttaccgtggtatttattggtagcattttattatccgtatatatattattaggataaataacctttaattgttaatgtatgagttagtatatgatagaaaattaaagttacttctctatggtactgtggcagtataaatagaggagtgaatttaaactctcgacgggggcatttcctctttatttatatgtcatttaaatagttataagataatttgaaaagatgaattaatatgtgatagatcacttcacaaacatgcaagttaaaaatgtaagttgagaaaaaaaatatagctagctaacatatattcacagtcaaattcatttttttattacatgtttgtgaagtgatatattacatattaatctatctagttgatttgttttctaaataaattataagcatttagattacatgcaaataacaagagaaatattctcttgaaagtttagaatagtaaacgtatattgaattaaattaggaaagatgaattgtactacaactcatcatcgcacatgttatatacgtatacgtatatgccgagtagtggatacgaggcagagagagggtagagcgtatcgcatacacatacagagatacagggaggtggtggcatatgcatgggggtgggggggtgggtagcttgacggggtgggaaaacggttgtctgcaagtaagctccggtggatcatccgatcgttggatggcaccgcacatatggcatgcctagcttccaggcctggacactgacccctccacctgtccgcctcccattggtcgcctgcctcttccttgattcatttctcttcctattctctcatcgatcgatcgatcgatctcttcctcgtgaaaatcaaggctccttcgacatcgcctcgcgacaaacctcgcctccctatcacggccgatctatcagcacactaatccatcatgtagatttttattagtatcaattctgtttcagctaactcgtcagtctgtctgccaagccgcgcgtcgagcatgcacgcccccctgctttgcccatgatatattaatttaattaactaattaattggtattctatccgtcttgaaatataaaaatctagtattacacgagacatatcatagaaattctatcaagatttgcagaattagaatgtactccatatctcatttcttactccatattttcggataaaggtagtactatcagttaattaaaccttggatgcacgaggaataagttgatttgatcgatcttggtgaccctttttgccctgtattgaatgctaatttgctttcaagaaacccccaaaactgacgcggccgatcgatccatcgatcgatctcgccgccgaaaaggagggaaaggagaatgacaccaactgcaagagaagagattaaatgtggagaggttgacagcatctgatcccctccactaattagccagaccgcgagctgatcgatcgagcgagctcagtcacagcgatcgctccagcgacaaacgtgtgggggatttgatgcttccatctccgtcgatcgccctaaagctcaagatcgatccaaatccagctcctaattaagattaattagctatggatgttaagggagaaagagacgtccatggcgatcatccatcaccgacgcaatctcgatttcctatctatctatctaggtccagatccatctgcatgcccatgcggcactaacagtacaaaacagtatcattactgttaaactaatctttgcgataatccaaaacgaccactcttgggaaagagtcaagagctaagatagcagctagcctgcaagatcacacactggatcatgctccatccacagataccaacaaacggttcacgggtcgatccaaactgaacctgccattcgattcagagttcagaaaatggccaaaaggccttgctgtgtttctgatcacagattctaatatagatacagccaggtgcaagtgcaatgccgatggggatggaatcatcctcgccgatctgtccggcgaactgccggctcggcgttgcaaacggacatgctcgtcactgtggactgaatactgaactaatctctgaataatatgcggcggcagctgagcactcgatttcagaagggagggaaggggctgagacccaggtagatatatgcaggaaaaacggtaggtgaactaccctacaataatgccgacagcaactcgatctcgattcgattgatagatcgatcgatcacacagatggtagcacatcgatcaacagcgaatcaaggagaaaatgatgctctctctctctgtggtccagggacatctacttcagctctctattggccgataagaatcaaaaacgctatctttcagtttggtcggttcagtacctcccagtagaagcaactgctggttcagagctcgtggtgaaagtgaaatcgatgacatttggatgccagttttattttatttttttgaaagttcagtaattagcaagaaacacatatttgcatatccaattaagctacaaattcagcattgaattgctgcatctatgtcatatgtatacagagcccacaggttcagtagaaacgagttaccgatcacagaggaaaggaacaaggcaccagctgaccagcatctacacacaaatacacaatctcttccgagtgtaacagtggcgatgagtggaatgcaacaggtgtcaggcactcaggctatcagagtgcagcaagacgtaaagggtggatgcaagtggcccacttcaattttcatatatgtgctgaatgatttctaatccaaagtgttgcaggagatgtactgctagatggatactgtgaacagagaatatatttgaaagaacaggatagaccactgtttctgaaagttccttttcttcttgggaataatctgtttctgaaaattctgaaacttgctactgtatctgaggtggatgccacttaagcagccccactataattggtgtaaatgtcatgttaatgtagcagatgtatatgtatgtttgcacgaaaatgaccaagcatggacaaaagattataatatgtggaataatgtggaatgaagatatttacagttcagaggcttgccccaggatggtgtattgtcattgttggcaatgaagaagacaaatgacaaatcttctttgtttcatagatggtaatattctctcattttactgaaaattaagtttctccgtccttgatcaccaaggtgcagacaaactgaacatagaatgcaaccagatacctatctagcatcttctatatttgttttcgtcatgtctccatctacaggacccgaaatgatgaactggcatttttaaattgagaggagttacaatatggagtagtcaattagtgatcactatgatcggtatttctgaaataatacaaataagtataaaataaaactaatacacggtgcaacacaaaaagaagatactgtaaaaaagagagagaatttacaaatgcacacagaggcagcttggtagagtactagagtacactgaaatataaacttactgagggcaaatgtggggaaaggtaagcccaagaggcatgtggaccaggcgtggaaaaaaggcccatatggcccgtgatggaagcaagaagcccatatggtcggcttgcggatgaactgatcggcccgaggcccaacttgacccattataacattagtatacagtacaacgtgacaggccgtcacttgttttctcggcccaactctacattacatatacaaactctaacgccacaaaaataagtacaaaataaaggaataaatgatgtagaaaaatcagaaaagaaaagagaaaggcccatataaattcttcctagttgatggcttctcctgcaagcagcccggagtctagacgaaaacctcaaatacaaattcgaaatcctccccccatatgtttcgtgcttgccacgccaaaaaaaaaaaaaaaatcagcaacgagagagcgatcgcgcgttgcagcgtcgcctcagaagcacttgtcgccgtcgtcatcccccgccgcggccggcctcgccgccgcggaggggccgccgccgccgcctaccgacgacgacttggaccgccccgacgaggtgccccccgacgccctcgccttcctccgccgctgcttcggcgccgcccccgcggcggcttctccctcgcagttgttctcccccacctccgtcttcggcggccgccgcgacccctcgctgcctccgtcgcgccgctctttgccccgccccgcccgccgcggccgctccgcctggtccgctctgccgccgcctcctccttggttctcctccgcctcgccgccttccgtgccccccgccgttggcttgaactcgttcatctgcgaccagtgatcggagcagttagagacatgggagatggcgcgatcgggggggaggagcaaggcggcggcgatcacccagctgggcgcggtgacggaggcgttgtcccagccgatgtgcgcgacgtgcttcacgtccgtcgggttcccgatctgcatctccggctccttcacgctcggatctgcaagcaaccaaccccacaacaccagcgtgcgcgggcatgcgcgtgttcgtcagacaaggtacacaatctctcacaacgccatcccgtaatgcattttgattttcgttgtgtggatgaatgatgatgaattatcaatgtgtggcatgaacaatgttgaggtgaattggattggggaattggggaatagggattcgttagacttggaaattgatggtgttcgaggcgtaccgaaaatttgtgagatgtatcggaggcccttgagaaggcccttcatcttaaccggttccacaggcggctgcccgcccgcggtgctctgcgaggaatccaccacttatatgtttgtcctccaccccttgtcccttgatctagccttcacaagtaagcaataacattacaaatttttcgccgggccaatatcatttaaaaaacaaaagtaagaactaacaattctatgaaatgggatacaacctattgaccataagcttgattttacaaatatgaaataccaccgtgaacagagataaaaaaaacgagaaaagccatctgaatgtttcgtcaaaatacaatgttgataatgctataggtgttggggtgagatttacatctaccgaccacgtagcattgaaaacaaaacaactattgtggtctatcgtaatatgatttgctggaagatgaagattcagcaatgtatatatttgttcttttcaacattctgaagttcagtttctatttgacacacacaaatttgtggcgcctaattgaatcagactcacataccttgcaaagcagatttaagagggtgatgaagcatgatctaccgaatttcatcttctttatgacatcttcattgtgtctgcagcaattctcttcacctattgctgtttgatctatcacaatttagtggaattgcaatcccttccaaagctcaaacaggaacaagcatagattctctcttccaagttggagaaatggaagggcagaaagtttgttgcctcgatctatttatggttccctatttttggtctaggctccttttggttgaagttcattttgacatacagcagtttgtgaggccctggttttgcttaactggtctgcagcgcaaatggcggggatggacaactcagaacatgaaaaaggggtcatttagctaacaagccaatctgcctcttattttgacaatttccgatcatatcccatatcctttcgtaggtagttaacgaagcttgcattggagcttgagttcagcagcgcaaaatgatctaatacttgattcaatcagtatggagtgtccggtggaaaacaacggataaagtatcggtgcaaatgttttgatatatagtatgattatcgtaggtttcttagctttttcgatcaagactttcaagcggcctggtcatgtttcttaatgtagccaaattgttttgccacttccgtctctagtccactggaagctacaacaaagaaaatgaaaaataatcctttaaacaatatttacacacatggtcggaatccaacaagttgattttctttttcctaactcactgtattcttaagaaatagtgaacaaatttattgcagtgtcaagaacagtaggaaagaagaatcatgacgatgttattgcagcataattccaccgataccaaacatttcgtgatgtacctttacaggattggcgttcctttcttttgtagtattacaaagaaaatcaaagaattgtataatacacacacgtatcaaaaatggggaaaaattgcgatgtagctgcttctccagttcacaaaaagcccaatcgaatatcgtcacttaagatgtattaataaggatctgtaaatgctactatcatgcttttacctgcagtttaggaaagtagagagttattttagttttgactcctgactcctgagtgcgtctaaggccatataattatacaaatggattaacagaaatcttactgtggttaggtatctctcatgaatcttcagtgcccctctgcatgccttctttgcatccagacttccagtgatatcgtttaatatctgtttgcaggggacaagcacataaacaacataatcgtgtatagctttctacaatcatcatctcatgacacacacatggagagagagagagagagagagaccttcacgacatcgtctagaccttttgcatcagtcagtatctgcttgtttctagcctctatgacactagccacaatgaacacagatagaggtatctgctcttcctttttagccgcctgtaagtttttctgttcgaattttccacactgctttaaggcattttcatcttttgtgtttgcttgagatgtactgttatcactctccaacatagaaaagagacctggattgtactccatagaccacatgagctgcaacatttgtaaatcaaggaaacagccttataaaccttccacagtacaaatcaatacttgattgtaagtagaaaccacattttgattatgctttattaggataatcatgagataataattgaaaagtcaagaaaattcttatggtgcagggaactaatcaacacacctaaaaggttaaattatgcgaccttgttgggaagcttacctcccaaaggtacattgtgtctacaaaagagaactcccttcggaaaagaaccatcagcatacggaaggcaaataagtattcccctccatcaagattttctgcaaaaataatcttttgatcatggaataaatcacgctacttatagttcaataattcagaaagaaaaggcattgttcctttggccattctaatgaacaatatttggctccaaacaactctacctaaatgctcatgtagcttcggatcaacggctttcattacggatgacaatatggtcagttgagatcgaactccaatggaggttgaactactcacgaaatttcctcgctgcagagttagcatgtacaatatcaatctctcagtatctgtagaaaaattaacagagacagataacacatgcagcaaaaccactataatcaatcttaggggtttttttcccatataatgttcattagttcatatcaatatcaattattgttttgataggccatgctaagttgcaaaaatatttccagaaaacggttctgcatattacagcgaccatattgaccttttaagtttactgtaacattactgcagttgtgcacaacttttaattaacatcatatatcggaagtataaattgtacccttagcagcggcggagtcaaggcccagccagccatggcaaatgcccaggctccgcctaagatgctgcagtagattagcaattcattaatcatgcaaagttagcatattttttaattaattaccttaatgaatgctagattagttgagaaaattagcaaagcatataattaaggctcacaccatcacatgtttgcagtctatcagccccatctttttgcttatgcttatgcttattagccaaaatttgaattttcaatcttaaatttagagttgattttgaggtttttttatcaaagtttatttttcagcctttgcttttgggtcgctaagagcacgtatattaaagttgtattcataaattatttttcgtttgtaaatatgttgtttggcttattcttataataagccaaacgatggagccctataggccatcacagcttatatactgcaactcgtactgttaattttacttgtgtcaatggtaaaatggtctgtagagttgtacaagttcattttcatttgtacagtactgccagtggcttgcccggggtcaataaaatttctagatccgccactgacccttagggtaaaggatctggatatttcttagtgaataaaaggctacatgtgtaaaggtgcttaccaccctgcgcataagtcgctcaaagcaccaaaacgcatccgcttcgtgttccaagaggatcgacattggtgagcaaagatcactcattcctgcttacaaacaagaggattttatgggggggaacagcaaaatttacataacatgacatttagcaagctaacatggttaagtgttccttttccttttactatgactggatttgcaaaaggatcagttttgcttctgtaacgcaccttgacaataaccgatgtccttgtcaacccatgaataaactgcaagaatgtcccacaacctggccaagttctcttggctctcataatagactagttgacgatctgtacgattaacatcaagacctatagttgaatagtggaataatcagaccaatgaaagtataaaaaaatataacaatatgtgcccagtgaactctctcttttttttaaaaaaaaacataaaacggattgagggatgctgaaaagagaggattagtactcaccaatctggtgcagagttagcttccattgaattacttcctttggtaggggtgtgtcactagcttgttgttctgcatcaactgagttaggatcctgtataggctggccatcttctgttatgacaggcatagtaattacccttccgctaccgactgccgtgtccatttctcggcactttgttttcagtttctcatattctaacctataaaaaattagaatgagatattagaatgaatatacatgatcaaacaataaaggtgcaattaagaatgaaccttcgctgttgtcttaattggctcttttgttcagtattgcttttagggtcataacaacccagcaaaaactcccaaacttctcctttgatatttgggtgggtaccctgtttagccaaccaaaataaacaaggccttagtgtgaggtcatgattcatgaatgcaggaagaaaatgaggaattcctgatgtcccatcatgtttggatcatctgtcaaccattgtctcattgacatacggacctaggcttgtgttgttagtgagaaggaatttttgcaaatatctatatattactaaattattaaaacaaggcaaatattagcctccacatttgcacttcatcaggctacaatttaccatgttaattggagaaaaataaatagttcatagttcacattgttgattgtgtaacagatccatattagtgtagattaaaatgaagagtcaacatcaatacaatgtaggataactgaaaatctcagaataataaaaaaaactagttatttgatttctaagcatataacagtataattctactttctgaaaaagtataatttagcctggcgctgtggtgcaatcacggcgtaaattcagctagttcggagcatgcaagggattaatcgaaaagtatagctcaccccacgctgcactcttttgatcattccagctatgtctaggacaccttcttcattgtgaagcagcttccatctccttggacttagagtgaggccaggctgccaaaaggaagaggaaacagcacacaacgagtcaatgcacttcataatcaaatacatggctggcactaatctcgctagtcagaatcctcgatgcttccgctcggcaaatcgatctgagacaacaaaattctaccttcaaactaaatgccctcatcatcttgcaagatcaatcgattggccatctgagcctaattcagctcatccaggtaacagtaacagttaagataaaaaaaaaggtaacagtaacagttgataattagatactagatccaatccagcgcaagatgggcactgtcaaaatggggacgggggcataggggacgcggaattagattaaaacggagaattagaaatggatagaatgaatcaattaccctgggcttgaatcgcgtcttggcggcgtcttcgcggcactcggggcggatggggtagaccgtgtccggatcgatgagcatgtccggatcgttgtagcagcacgccatgaacatcatcctgttcatcttgaccgcccaaatcgagccgcggccaaagaggcaggagggatcgagacgagaagacgccggccgctgctggtgatcagctggaaccacacggacgggggggcagtgcgcagtgaggacgaatcaagatttgttcttcactccctcctttcctctcctttcttccttcctttcctgatttgtttgatgatgtgccttctctgtgattgagatccttggccgtagagagagagagagagaggagagagaacggaaggtggtgtaacggctaaatttggggggtcgggaggagagagacggggagacnnnnnnnnnnnnnnnnnnnnnctgcttggtttgtatcagggcttcgtcgctgagatggacggtccgagcttgagctggtcgtatatttctctttcgaaactgatgagttttcttgattgttccgttttatataagcgttctaggacttgtttgttagtagttgccgtttctgttggctgattgagggaatgaactgttgaggatacactatttaaagatttttgttagattattcaattagtaaaccgttggttcgaagagaaaatcattagttagataatctggaattcttccgttaataatcgtaaacacgagtgcacaacaacttcttggatcttgggtttcggaatatctgctatctctctcctgacttggatagacgtgcgtgcttgcttgactaccgaacaatattcggttgaagttttccacaccaatctctgaatggatcgtccaacatgcaactaaggtcaatcaagcataaagaagcaatgtactagtaactgggggtcagtacgaaattgtcaatgcaagcttcaggaccgctaatcaggcccaatgtttatagtatgtactatcatatagtgtagtatcatatgataaaacccacagaaaaatgtcgctgctaactctatcgcaattgtttacctaatgcatgtgcaagccaagttctggcttagactggagatgctaaggctccaacctcccaaaaggccaaagaaacgaactgcatttcagcgagtaccaaacaaatcatgcacgtacatgcgcaagccaagttcttgtcttaaactttcgaagctaatagctcgcatgatataatgtcgcttaacgatgtgaagcaaccagatgccgacactggcacgatgttgaaaataggaaccccatcaggtgtgcaggaaccaacaccaccttcttcaagctcggcgaatgcctcagaaaatacacgggacatcacatccgcagtcactgggtgctctactgaatagtagaatcttaacatctgcagatttcagcccagagatgatggttagagttcgggaaaaggcagatgcaaaatgattacaggacagatacgtaccgttaggttgtcccaggaaaagccattatctatcagaatcttagcaagctggaatgcacaaaatctagccaaagctttcaaatgctcctccgagtggtatagttgttcagttgtagaacagattttcaatgcaatatcatttgtgactgaaacaacagcagagcaaattttcccaccgattgtgtgcacctggcagcatgaatcatccaggtcagagtattgtgcgctccaggcactaaaagcttcgcttgatgctggcaatgaccctccagcctcctgttctctggttgggactccatcatcattagtgggactggggacatacaatattggttttatctccacgtatgctctgaaaaaatgaggaaaagtctatcttaacttaagaagagcacttgacattgtggtgcttcaagtatgagagtccagacagcactaaagcatttctctgagaaatagaatgacggatatccttacccttttggaagatctgatgcaaatacatagagaatggtgggatatgatccggtatttgagcaatccaaactggtgatgtacgaactacgaagtgtatgttcaacttgttctttttcactggacgtcaagtgtgcagaacagtacaccagaaagtgtattgccgaagaaaaaatggagcaaccaaaggcattagcaacagcttcactgtttcgtaatgcgaattctagttcagccgttgggcccccaggacagagcttcatcgtagggggatcaagccccagctgaccagccatatagagaatctctccatgaagtgttgcctaagcaaaattcaaaaaactttaacactgagaatgtacaactgaggagaaaaaagaactggtagatttggctagcaactaatctacaggaaccttgcttatgaattctatgtagaatattgtatagaagcatacaactttcaacatacccatgacatataaccacatagtgcttctcttacctggctataaggtccgatgcaactaggagcccagcatgaaatgctttgtacatgtagaactctcttgacttgctcctttgtaactagaacttccacatatgcatggcctaaaccaacctgaactagtggcaattcaactgtactacgtgaaggaacacccagagggcatttttgttcagtaataaagctcacataaacttcattggccaatccaaattccttcatgcttgaaatgaagaggtgaacatacagaacattcatccaacctaacccttcttccttgagctgattctcgattctgctcaaaactgctactagatctgtcttcaggcctatagacataaggagatattaaatggacgtttcccacaaatgaagatgcaaaagaaaggagatattcctgtcaggcgggactatggtcaatttaatgttacacagaacaataaggcacaagagcatgcaccttctgaagtaccacagggatcctgaatccaacaaccaatggagaacaactttttgccagtctttgagatgcataggtctatatttgtgcaagcatcaacagttgtaactggactcaaggtctcttgtttcttttcgacatcactgtgtgcaatagctccatctacttcatacaaataactagaattctcttgggcaatagcactatcaccaacggtgccaaaagaatttggcttgtgttcaagatgaaattttaacgggtgaagaattcctactggagcgatggaatcaggcgagtggagtataacttcaaaatcatcaagaacaattcttgcattctgcagtacaagaaactcatcagttccatcttggtaacaaaatgcttctgctgcacatagcacataatagtagtataaattatgaaatgcttcagaaatctgataagcatgctcagaatatagtcaatagccaagttacagcgtttcattgaatgtgattcatgcttaaggactggtccacatgttcagacaagtggcatcagattattcacattcagctcttatctccttaaacttacacggaatagagggcagtcaagagttagtgtttcatattcgccaccttcaccacagacattgattccataactcctagtgggatatagaaaaacaaaaggagaaattacaagctgcacagatgcaagtgactagtattgaccattagtaagaaaatcatgagaacagacataaagagagcgatatgttgtgatatgtttcttggaaaccactccctcattgatcactacgagaagctaaggcctgggtcattaacccacaagttataacaggatacaaggtcttctaatacatgaaacctccaagaggaaaatggctaaatgggatctatgtaggcagtggggaacatactcattcagttggagcagatgacacttaagttcagccagttctttccctaagtgagcagaaggtttgagccccattgcggcaacctataaagtccaaacatcagatattccatgtgataaacagttaaatacatacttgcaaggaagttaaaaaaaattatgtaccaagagaacaaatgcatgagtgtgctgtatataccttgacgattatagctactatgccccttcttatctgcaaacattaataaccaaaacagaactagtaatttgagtaaacagtttctgatatgccagacaatatgcagaagaagaaaaaatgaaattgaagttaccatttcatcaagaagcaaagtctgatcctgcttccacaaatacgccagcgataccaggcccaaccttgagcagacactctcaacacgaagcctctgataatcagacgcaatggcgcctgaagacactgcagtgatggatgggatttgccttttaacctcgctcaagagcgcaaacatatcctccacttcatcgcctgtggtaacattatatttaagaccctgctccctacaagcaagtccaatcaatgaaattgcatcaaatttcatctagataagaacagtagcagcatataacaacaataaagacaatccctgcacagatgccttgccttgaggatccacggatgcgcctccggaacagaggcaagcccatgcatttcgcataactcacgacaatctggtgcccaacctgaagcctccagccacatcaacaataggcatagcaatcagcgaatttgacagaataccagcaacgaatggccacagcccagcgctagaagcagctgctaatcagctaacgatgagtgaagagaggagtgcatacagtttgatacatgtagctgtcgagctcgtcgacggcgtcatcttcggggatgaggttggccagcgcaacaatctgcaagcattagcatgtcaatgaaaaacggatgatagaatagaactgggtgattgggttgcgctgcggttcgttgccttgccttgtggccatagtccaggcatcgcatcatggcgaagcagctgtccttgccgccgctgacgagcgccaccacctccatctccgccgccgccgcctcgcacctcctagggttggagctcgttttgttcaatttcttcttccggtcaaaacgctactggattccccccttcttcttcttctcctactggatttggggcggagcgaggtttgtgtaggcggctgcgcgcggcggagcaggacggagcagggcgcggcggacggtgcggcgagtccacggcggcggcgcggtgtgtggactgtggaggaggcgtgaagcgtgaggtggtgcgagctcgaggctaccgaggcccagagaccgagcccaatgttttggaaaattttgtggcccatcagaagatttaccggcccacgtaagtgcgttcttggagcccaggccaaaaatatttcctcattaactccggaaaaagaatgttaacacaaacagaaagatgtgtgaactacaaacttcatcataacgcttacacaagaaggaaggtgtgccaactttctttgccataaccaccgacaagccacgttgccgcaacaatgagactgggagctttgcacaggggagatcctttttatcaacttctgttgaataagcaaatccagagttgaataagaagggggggatacacgaatacttgtctctcaggaaaagttgccaagtccagggggggtaaggtaaagaaacataaatatgttgaatcttgaccacctctaaattaatcatcacaaagctaggacttggccctaacgcaacagcgaacacacacaacaaaaacaaattattgctatctatgaagcaatgatacaacagggccggagcaccatgaaattatgggatgctcctggtgaactgttgacaaataggtgataatcctgtcatttacagagtcgcaaacagcgtttcttcctttctctttccgttgtggagattcctctttctcttgccatattatttcctcttaccgccaccaagggacagcagctccaggctgcggtggagaggctcgtcgcgggaccctcttgcaacggctgctcgtgagagagaagtggcccttgtctctccaaccgatggattaaccctctgcgtgctggaaggacggcttccactgcttgagaacaacctgcttgtccggctgtattgctgctccattggttccaccgatgaacctggcctgctgcttgacgcaaccgctctccttgatgcactgcctgtacgggaggatgtacggggtctttccacggtcctttcgccggaccggtcggtgctatgcatctgagaaggtgaaccatttcatgatcgtcaaattacacgtaggagagatacacaaggggaagacattatacagcataggaactggactcctatctcaagttcatgcggggacggattcaacttacgatttcctttagtgacattgacggccgttgtgcataattgtcactctgattcaaagaaccagtaggattccttctgccagatgcttcacctgcttaaaataagatgttcttacgggctgtattgtttgtattatagttttgttaggcgtctttcatgggtggaagaacagacctggggccttttccatcttctccatagaaggtcccgcagctccactggttctttcacttggctgaatcaacaagaagaacaaagtcaaatcaagtgtatcaaacaggagagcattgtccaataattataacagcagaatgcataccctcatcagtggtttggagcctatctggggatatttcaaaatggtccagtcaaatacataatcaaattgatatcctgtatcaatgatgccattagaaatgtgcagaacttatcctcagtttaaaaaaaacactgagggaagatggaaagaagtacaatttatgatcatgaggtaaggatttatgtttaagagaacataccctcccggataaagagatcacggaatagcctctttaagtaagaataatctggcttgtcttcaaacctcaatgaacggcagtagtggaagtaagaaatgaattctgatgggtaagatttgcaaagaacctagctcaaaaaacaatataaaagtgtcagtttgatgcagtttgatctttgaaaaaaacaagagcagataccaaaagtatatatcatgaattacctccacaggagtaagcatctttttctcacttattttgtcgtacttctgcttcttagtgcctgctttcagcccctgccatggtaggctgttggaagttgaatgatagcaaatatttagcattgtttacagaaaatgatgtcaaaaacattacaagaaaaccagatgtctgcaatgctgaatatcacaaaccaacctgcctctaaggaagtacataaggacataaccaagagattctagatcatctcttctgctttgctctgtatgaacataaaacttaaattaggcaaaagctcttatcaaatgtactccatcagctagaagacacagtaaactcaccaacaccaagatgggtattgacacttgcataccgagctgttccagtgaggttcttgttctctctgcataatgaacatgacatcaacataaaaaaggtgaaaagagaagtgcattgagatatttgccaatgtccttataacattatacaattttgtgctggataacaaataaaacaacagcatatgcagtaggcataggcgtaatttaaagttgtacaccaacctgtatgggatgtgcttgtgagtctgaaggtccctatatttcttcgcaagcccataatctattatatatacctgaaacaaggtcaaaaatagtcaaaattaactggattcaagatttgctaaccaaatcttgtttctttctatcccacaagttatctacaattattattaacagaccacagttgtattttaactaaattcaccagatatcagagcattaatttagggcctgttcactttgatgccaaaaaaaccttaccaaattt

SEQ ID NO: 80150 - DNA, 1671 bp, Oryza sativa
ttggatagttcaggtggatggctgggcctgtcgcaacgtgggttagcgttggacagcggatgtttaatactgcttaattattacaactgttttcgcattaaattcctgtttataaatgccagtatttatgcaaatgaaccactctagctcttctttgttaattccctgcatcatacccccattccggtatgacttgctgagtacagtgggtagtactcagtcttgctctatttttcccaaccccagaggacgggtatgtgtcagatgaaggtttccccgaggagtaggcttcgtccgtgccgtcgaggatgcctgtggagtggtgttcccgctgcggtttagtcaaggcttaagctccagtttcttttgttttccgctgcatttttgtaagacctttataatgtttgtaagacgtggatctgtatgtcaacattgtcgtttgtgtaccccggctggtcctggacgggggttttaatacacattctgcttggaattctattcgggaatttctgggcgcgacactatctcccggccggtggcagattccggcatgaagcggcgcggcagcccagcctgcctctcgctcacgatgcgggagggcggcagcacgctaccatcgagcagagcggagccccgtgccatggcgccggaaggaagagaagattaagagcgagcacgagtggcgaaggtagggcgcaggaaagaaggagttagggcgcaagcggcgaagacaaggggaataatggcgaagggaaggaaacaaatcccttcctcagtgcctttatacccttgcccggctcctcgcttctcgcgcccactatttcgccccctcgtttctcgcgcccacgcttccactaatcccattcgcccgcttgcggcgcatgaggtggatatgcggttgtggcagtcgaggtagatcatatcgtgcgcgcgttaattacgctcgccaaccgaagcgacattaccatatctccagatgaaatgaatcgccatgtccagattcgtgtgctactcgagtaatgtggcagtcttgaagagaccgctcattattgacagccgagttactattgccgatgtgcgtgatttttgaccattgggtttctgcccaatggtggagaccggtcccacctgtcaccaggccttaggagtggcgtcacgcccgaccgcttcccttgaggagggcgatcgccctggcataacgccgggggctactgtcggtgacatgggatcgggagtatcatgactagaggcttgaggcagacacaatcgcccacgtggcctggcacccccgggggacgtcgggctcgagggtgatgtgttcgccctcctcttagtccccccgagggggtcgggctgcacccccctcggccccgagggtcgaggcgccccgacccctcgtgggttttcgctccgcgcgtatgagttaggtgagcacagtggggctcacctaaccacatttattgcggattggctgagtgtgtcacgacgcatgcaacgtagtgcattgcactcatttatccggtctgtgaccagtcacagaccggtcagatcgcgggttaggtggcgacaggcggtctgacgcacgcctcgccccatcccgtcaggacgagggcttctaggcgctcgtccccagctggagctagcgtgttacctcccagagatggcacgtta

SEQ ID NO: 80151 - DNA, 3430 bp, Oryza sativa
agggccaacgtgcagattgctaagctgacgcgtggtggacaagaatgaccgatttgtgaccagtctgacaccggtcatgtcgccagcagaccgccatgattccgcgtcgcgcctgctcccggcgaaagtggaggtagttgtgggccgtcccatcagaaggcgactcggacggcaacgatgcaaatctccgtccatttatgaaaaggtagagtaagtccccagggagagggggagaatggtgcatgtggtatccccttaagatatgaaaggaggaccttgcccactgaggagaaggagagattttcgagagctttttcttggactgaacctttccagattaggatcctagaacaaaggagaggctggctcatactttgtagctccttcacacacgaatccacctaaaacacaggagtagggtattacgcttctaagcggcccgaacctgtatacatcgccggcgtcttctgtgcttcctgtctggcgaaccttccacatacagattgggagcttagagtctcacctagggtccccggccgaaccggcaaaggggggccagcgcggtctcccggtgaggagccccacgctccgtcagggtcgatcaatagttgggccgatttggagaagcaattccacagctatttctacagtggggttcatgagatgaagttatctgacttgacggcgattaagcagcggcatgatgaacctgtgcacgagtatattcagagattcagggagatgaggaacaaatgcttcagcttgagtttaactgacgctcagttagccgatctggcctttcagggtatgattgctccgattagggagaaattctcatctgaagactttgatagcttgtcacatctgatacaaaaggtaaccttgcacgagcataggtctgcggaggctaggaaaagctctaagaaggttaatcatgtttgtccttacatgtatgggtcggatgacgatgaggatgactctgaaatagctgcagccgaatgggtgaggagtaaaaaggtcataccgtgccaatgggtaaagaattctggaaaggaagagaagtatgattttgatattactaaagctgacaagatttttgatctgctactccgagagtagcaaattcaactccctgctggtcatacaattccatcggttgaggaattaggcaaaaagagatattgcaaatggcataattctgggtcccattctactaacgattgtaaggtttttagacaacagattcaggtggccattgagggaggcaagattaagtttgatgattccaaaaagccgatgaggatcgatggtaactcatttcccgttaacatggtacacagagctgaccgaacagctgatacggggtgcatgaggggttatcaagtaagttcggctagaattataaacaaatattaaaggaaatacgacaagcaacaagaaaggcgtcatgaagaagataatggtggctttgatcctcattggggctgtgtgttcttcatgttctgttggaacgaaggtatgaggctaccatctatcgaggattgtcctggatgaagtgatgttgcagggggttcaagccgattgtacgatggaggcaatcggccaaaacaaacaagagtacctgttcatcaaagattgggcccagtaaaccaacgtggtgattcggaagacgacaaaaataggaagactcaatggtgtccttctggtatttttacgaagaatcagaaaagaagggttcaaagattgaggagtagggaacgcttccaggaggtcgagcaagaaattaatcatcggctaaagaaagaaaaaccgaggcaggagtggcgtgttaagaatcaggctcctgtagcccatgatgttgcagccgatgaggcaaagaggttggcaaaaggaaagagtgttgtgatggcaccagttaacatggtttttaccttgccatccgaattcgggatcgatcaagccgatgtcgatgaggtggaagaggaatcggcttagttggttctatcaccagaacaggcggtgttcgagaagcctgaggggacagagaatcggcttcataaaccattctgtataaatgctatgtcaatgggaatccgatatctaaaatgatggttgatggtggggccgcggtaaatttgatgccttatgctacgctcaggaagttgggtagaaatgccgaggatctcatgaagacaaatatggtgctcaaggactttggtggcaatccatcggaaaccaaaggtgttctaaatgtggagctgacagtcggcagtaagactattcctaccacattttttatcattgatgggaagggttcttacagcttgttgcttggaagggattggattcacgctaattgttgtattccttcaactatgcatcaatgcttgattcagtggcaaggcgacaatatagagatcgtaccagccgacaggtcagttaatgttgccagtgccgatttagctctttgggagatggatggccttgattgtttatctggaaaagtttggaatggagattttctaaaagtgtccgattctgatatacagccagttgaagatggagaacccaagctattattttgagggcgtcgtggagggttcaaatgtctacgctaaggatacggtagatgatctcgatgacaagcaaggtcaaggttttatgtcggccgatgatttggaagaaatagatataggttcaggcgatcggccaaggccaacatttattagtaagaatttgtctccagaatttagaaccaagctgatagagctcttaaaagagtttagagattgcttcgcttgggagtatcatgagatgcctggactcagccgatcaattgtagaacatcgactacctatcaaacacggggttaggccgcaccagcagcctccgaggagatgcaaagccgatatgctggaacctgtcaaggctgagattaagcatttatatgatgctggttttattcatccttgccgatatgctgagtgggtttctagcatagttcctgtcatcaagaagaacggcaaggtgagggtatgcattgattttagagatctgaataaagctacaccgaaagatgaatatccaatgccagtagccgatcagctagttgatgccgcgtcagggaacaaaattttgagttttatggatggaaatgcagggtataatcaaatttttatggctgaagaagatatccataagacagcttttagatgtcctggtgcaatcggcttatttgaatgagtgttatgactttcggcttgaagagtgctggagctacatatcaacgggccatgaattatatttatcatgatctaattggttggctggttgaggtttatattgatgatgtggttgttaaatttaaggaaataaaagaccacatagccgattaagaaaagttttcgagaggaccaggaaagggctgcag

SEQ ID NO: 80152 - DNA, 651 bp, Oryza sativa
catctcaatcggcttctaggaaattaagatataaggcgttgaagtacactcgattggatgatgagctttattatcggacgattgatggagtgttacttaagtgtttgagtgccgatcaggctaaagttgcaatcggcgaagttcatgaaggaatttgtggcactcaccaatcggcccataagatgaagtggttacttcggcgtgcagggtatttttggccgacaatgctggaggattgcttcagatattataaggggtgtcaagattgtcagaagtttggggcaattcaacgagcaccggcgtcggctatgaatcctattattaaaccgtggccattcagtggttggggaattgatatgatcggtatggtaaacccaccatcaagtaaagggcataagtttatattgatggcgactgattatttcaccaagtggtggaggccattcctttgaagaaagttaattctgagatgcaattcaatttgttcaagaacatataatctaccaatttggtattcctcaaactattacaactgatcaaggttcaatcttcgtatccgatgagtttgttcaatttgccgatagcgtgggtatcaaattcttgaattcttcaccatattatgcacaagctaatgggcaggccgaggcatct

SEQ ID NO: 80153 - DNA, 6525 bp, Oryza sativa
aaaattcacaaggtaaagctttcccttgagaacacacttaaagactaccgaggaatcattccttctatagacggtcacatcaacatcggtaaaaagacaattgtaacccatagaacataattgagaaacggacaaaagattgtagtttagagattttaccaagagaacgttggcaatagaaagatcattagagattgcaatcttacccaatcccataacgtttccctttccatcgtccccgaagactatgttatcttgtgaagtgccatttggatcaagagatgaaaacattgattcttctccggtcatgtgattggtgcatccactatcaatcacccaacttcttccaccagtgacatattcctacaagggatcaatttctagttttaggtacccatacttgcttgggtcctctcatgttagtaacaagtgccttaggcacccaaagaactctcttgatagaaatattcttgccccttgggcctacatacttagcaacaacacgaccactagcattcttcctaagaacataagatgcatcaaaagaacaatgtgaagcacaatcattaggaaggatacttttggccctaacaaagttgctaagaccttggggcctcttgatcatcacactcttgtccacctttccttttggtggaggaacatacccaagaccctcatggttgaagttgtccctttgatagcctaggtactcttttagggccttactacccatatggcacttaagtaggccattgtgaaggagtcccataagcttctcattttgcttttgcaaagcactcaaggaaatagagttagtagcacaagcttcaatatcaatatctttgcatcttgcacaaggttcattgcttggggcaattttggagcatgatgccttgctagggagagagacactattctttaaggtttcaaacttctcttcaagagagaggtaagctttatccaagccatccactctctcttgaagttgagcgtttgccacctcaagattagcatgagactctttggtttgcttgtaaagccgtaccaaagcctcatttttctctctccttagcaagttcgcacttgagttcatgagatcgctctttctcatgaatgagcaattcctcttgcctctcaagtgttgcatattgatcctcaattctcccaagcaactcactcaagtgtggtatggattctgtcacgcccggaaattcactagtaatttccgaacttatttgtgcataaaatcctcgtccaggaatcagccgaggtacacaaactgacaatttaatatacaaatccatcataataataacgttacacacttacaaaagaaaagaaaacagcagcggaattaacggtctagcgatggcttcagctccactcccacaggcagctcaactggggtataagccaaacgtcttctccttctggatcctttatcttcaactgaggttgattgattattgcaagaatgagcatatgacatactcaacaagccacacagcaaatatgcaagtgcacaaggataccaaaggatggcataatataggctcatttgcgaaagcagcatttagcaaagagttaagagtagtaaaacagtagagtaattaattaaaaattttaatcaacactgaacagcacacccatgctgtacaggcccaaccatcctgaacaaccatacccggctgtacagatctaactccaaaccaggagctaagcaaattattatcaggtattaacatccataattattgtgagaggtgtgagactaatcacgaaaaacattgctcaactcgcccataaccgcgggcacggctattcgaatagttttactctggccagaggtgtaccactgtacccacaagacacgattccacacatgttgccatgccccgaaataccaccacggcattgcaaagggggaaatcgtgacaatacccttcgcacaacacaactcaaaacagtgcaccgttcctggatcataatcacccccttataaacaaggcatggactccccagcgacccccatggacttctcgccacttctcagtctggcgcactataatgaatcatgctatacaaaagataaagccgttgcccatgctggcttgtggttggtacggttaatgtttcacaacagtagctcgcgaaccggtccttaattgtcaggagcacgactctcaaaaccatgtgctcacaacccaccattatgaagttttagttggcaagtaattaattaaccaatcacgattaaccatcgtgaactatcattaagccatccttaaataatagtgagtcataagttatcccaatagtgtgctaatgtttctaagcatggctaagcaatcataactaatatctagctgaaccaatatataaagcccaactagtcaagttataataacccaaggtatcaaggaataaagtaatcaatgcaaattggccataacaaaggaataagttcacaccacccggtgacattcgaaaataaatgcacagttgaaataaatagagaatttaaatataggatcaatatgctcaaaggattgtgtttaggatctgtgtgacttgccttgcaataatcggccttcaagtaatcttcttgatcacttccgacgcactcacgaaccttcgcaacgacggaaacgacaagctaacacgcaaaacgaagaaaaagactaataaaaaccaaataaacagtacatataaagtaaacaaacatgtagatcatgattttagatgaatttagcaacttgaaccactcaaaaccgagttacgatgatttagttatgaatttccgaagatttaatctattagaaaaacgggaaaaagaaaaaccgatgacgtcatgctgacgtcatcaatggcagccgactcggatggcaagctcgccggagatagagcgaccggctgcggatttggaggacatgaacacgtagaggacgacgagacgaacccaacgatactcaccctcgtgccaaacgacgaccgacgacggccggcgacgaggaggcgacggcggcggctcgggttgcacggggcggcggagctccgatgaccggcgacggaaaaggaagggtggccgagcttcccctcaccacggcgcacccaacggtggtgacggcgaccggcgacgacgatggagacggcggcgcggcggcactggagatggccggcggcggctgtttgcttggcggcggtggcgacggagctacggagcacggaagaggacgggagagggggcaaacgaaagaggaggactagggggtcctatttatagccttggattgaagagatcggactcctcccgcaagaaatcgatccgggaaatcaaaaactcggttttggagataaactcaaaaacgagttcgattcggataaaatactcaacggtttgctccgattcttgggggtaaagatagaggaggataagaggaatatttcccctcaacaaaattggagaaaaagagcaacggggaggcgagatttggaaggaagaggcggcggcactgtgcacggcacggctggctcgggctctgcctgagttggaagatgaacagtagcgcagggagggaaaatagacttttccggctaggctgagaggagaggaggcggctcaggttgggccggcggaagagagaggaaggaaaggaaggaatgggctgaaaatggcccaagctgaggaggaggattttattactttcccaattaaaataatcacttaaatgatctttaaattattaaaaatacttccaatgctcaaataatttcaagaaaaatcctgaaaatacttggacactcaaagtacttaaaaaaattacaattagaccatttaatgattaatttaatatgtgggtaattactgaaatgctctttgtatgattaaaaattaggaattgagctccgaaaaatctgagaaaattccagagagtataattaaccatgaagaatttaataaaaattaaatccatccatgctttatatttaggaaattttatttcccacatttaacttcacttgtaaattaatgaacatttaatataaattctgataataatttattaaataatttataaatcctgaaacaaaaatcagggtgtgacagattccttggttatggatttaagcaactcatcatccataacttcatcctcaacctcatcctcctcgtcactaataaaatcaacattaaatgacttgagaggagaaggtaccttaggctcctttgccatgaggcaaatgggagcatcctcatcactttagtagtcgaagagtcttggtggtgatgaaggcttgacggcgaacgtggcgactccttctccatcacttgagcttgactcggagtcggagctgaaaatcatcccaaggtgagcttggccataatgttcccgcttgctatgcttatacttctccttcttctcatccttcttcttatcttccttgatgtgggaaccatccttgaggtgagggcaatccgcaatgaagtgcccgggctctttgcacacgtagcacactcttgcggaatgtcttccacttgacttgctggagtgatgcttggaagaatttcccttgaagaagccgcttcgcctcatgaacttgccgaacttcttgacgaagagaaccatttcttcatcatcgatctcctccttgctcttgctcttgtggctctcttcttcttcttcctttgccttcaatgccaagtcttccttcttgatgcttgtcgttgagctttggttgatgtattggatgacctccttggactcttgcacaagaatgtcatgggcaagaatgcgtccgagcaaatcatgaggtgtgagagtcttatagtccggacgctcacgaatgatggtaaccaaggtagagttccttggagtgattgctcgaaccatcttcttgaccacaacctcatcggtcatgtccttggagccaagtcccttgatctcattgacgatcttgctcaaccggtcatacatgtcacttgggctctcaccatccaacatcacaaatctctcaaattgccccttgaagatctccaccttggactcacgaacactatccgtgccttcatgcaagttccgaagcgtgtcccaaatcactttggcactctcaatgccatccacacggttgaactcacttccactcaaggcactaagtattgcattggcggcttgagcgttcttgtgcttattctcgtcgtcctccttggtgggatcttcgggattctgcaaaacatagcctttttcgactattctccaaatagatgggttaatagacttcaaatgcatcttcatcttatgcttccaagcggcatagtccgtaccattgaagtacggagctttgctgctataggtactcacataagatgtggatgtagttggatagtgataaggaaacttagctcccttatcaccatctttgccttcccccatttggcccgacatgatccctccaagcggttagcctaatttggagattaggctctgataccaattgaaaaggtcaattaggcctagagggggggtgaataggctaatttaaaactttatgccgaagctaaaactgatagtctgatccacagtcagactatccgaaaatatcagatagtctgatgttggatcagactgtctgatccactaaaagaacactacaagtagatctagtgcacaaacaagagtatggcccaaacagcgactagatttatagcggcacaaaaaacaaagctaaataatggaagaagagatatcaccaacaatgaagttcaccgagttcttcccggagttcaaatccttgaggggattctactctccgttgaggagctcactaagagccgggtctttgctaacccttttctcaagaggttgcactaagcactcctccttccactaaggggtatctctttccttgtggaggcgagatccggccttcacaaacttctcccggccaaccacatgtagatcggtggctcgggagtgacacctagccgtctaggagtcctcaacctccaagagtaacaaacatcacacaactcttggtcaaccctagtgctcaagatcgagtgaaacacacactaggccctcaaaccccaaatccacaaccaccaagatccaccacacaaagaacaagaggggatttgagagagggagagagagctcaaagatccaaagcaccttagcaccaagctcaacccaaagtgaatgtgaatgaatgagttgggtaaccctagaaaagggttaggtggggggtattcatagaagcccccaaaatgtggccgttgggagagaatcttttcatcccacctcggaaagtccgaggtgacatcggatagtccgatgtttttgacccccaagcaggccagagacagagaacgaaattctagagaatttcggacaatccaatcgatcggatagtctgatgtcatatcggatattccgttatttttgaaccaagaatttcatcctctcacagagactcaagttccattgaatttcttagtctctggatcattagatactccgatcatat

SEQ ID NO: 80154 - DNA, 1161 bp, Oryza sativa
agagtaaacttgattcttgaactgatccttgatcatgaggatacactgatttagaacagaggataatgattaagaagaagtggaagaagaatatttaaatgtgaagcaaggagaaatttggactgggccaaaaggaggtcggatagtctgatttgacgtcggactatctgatgtacattggactatccggcggcatattagacaatccgacggccttttgccctagaccaacaaatctcgattcacacaaaaatatccaatggaatcaaaggatcttctaggtactagatctaggcactaaaacaagaagattcaccgaaggaaatcttgaaataatataccatgagggagatagaggaaaaacaaggaaatacctcaagaaccaccaagagaatcactggggaacaagtgatttggaaggagttgagggagggaaaccaccctaaagagaaggaatagcaatcagagactctgaaacgaagatttttggtggcctagaactagggttttgagaggagaagaggggtggagagagaaacgactgagacaaatgactgaaggggtaaaaaaaaagagttacccccggggaggttaagtccccttgcccttggccccacgtcggatagtccgatttgaaatcggactgtccgattgtggccggatagtctgacttgatgtcagacagtccgacatcctttgtggcagagacaataaaggatggctcaaggaagattttttttttcaacaacatttttataggatgaactcggctagactattacttggacaaatgcagcaaaagaaagaaaactaggcaccctcaagagagggaatgtacgaatctataggaaattgtgcaaggaccaagattcattagagaatgagatccccgtacacatagattcaagttatcctcatagattatgactagtgtttattcatgaattgaatgttcactttgtcatgatgtggcaagcaaacctattctagtaaatgaaaaacaaatgcatgcaaaagatcaagccacattccgaaatccaagatattagctcacttctcaactcacaaaacctagcttcatcaagaggcttggtgaagatatccaccaattgtttgtcgggttttacaaggtggaagtttaagttgccttctgtggaaagg

SEQ ID NO: 80155 - DNA, 18508 bp, Oryza sativa
aagagggccaaaagacttgtgatgcaaaaggcatttgatgtgaccaagggccagtaccagaagctttacaattatcaacaagaactgcttaggaccaaccgtgggagcactgtggcgatcaacagagtgataggtattgaaccacctgtgttcaaaagaatttacatttgccttgatggatgcaagaaagggtttatggctggttgcaggaaggtaataggacttgatagttgcttttccaagggatctacaaatggagagctattgtgtgctatagggagggatgccaataatcagatgtacctaatagcttgggaagtggcctataaagagaacaatgaagaatgtgaatggttttgtgacttgctgtgtagtgatctgagggttggtgatggaagtggatgggtcttcatctctgaccaatagaaggtaatgctcctgatccactgtttgcttttatgttctgtcaattctgtcattacacaatgcatacctaatgtcttgtgcatgttactatcaaatgcagggaataattaatgctgtctctaagtgggctccagaagctgaacacaggaactgtgccaggcatatctatgccaattggaagaggcacttcaatgataaagtgtttcaaaaaaaattctggaagtgtgccaaagcatcatgcagaatgcttttcaacttgccaagagcaaagctggcccaactgacccctgctagagctcaagcaatattgaacacacacccagagcattggagtagggcttggttcaggttaggatttaattgtgactctgttgataacaacatttgtgaatctttcaacaaatggattcttgaggctagattctttcctatcataacaatgcttgaaaccattagaaggaaagtaatggttaggatccatgaccaaaaaaaatgttctaatagatggagtactgtcatttgccctggtatacttaagaaacttaatgtgtacattgctgaatctgcattctgccatgctatatgcaatggggctgacagttttgaagtcaagcataatgagcataggttcatagttaacctagatatgaaggagtgctcatgcagatattggcaattgtcaggtttgccatgtcctcatgcaattgcttgcatctactatagcaccaacacactagatgggtgggttgctccatgctattaagtggaatctttcaaaaaaaacctatgcccattgcctgcagccagtagagggcatgactagttggccagatgatcctagagagcctctcaatgccccaggatacatacagatgccagggaggcctaagactgaaaggagaagggagcctaatgagccagctaaacctaccaaagcttccaaatttggcacaattatgaggtgcagatcatgcaagcaacctggtcacaatagcaagggctgtcacatgcacagtggggcaggtggtagcacatctgcagctgcaacatctgctccaggaaatacagtcactgcaaataacaacttagtgttgtcaagcacacctagcagcattgcacaaagcaggaaaaggaaggcagctgagctcagtactagcacatctgcttgccacactaggaagagaacatctcctacaaaaaaggtatgtcagccagtcctcattcaattaaacttttgaaattaacattcatttgctaacaacacttgtttcttttccttccagtcagcaaacacaaacagttcacttgtgaaggttgcagccagtgctaggctggcaactgaaagaggtggttcaaccagtgtgaaacttcaggccatagtgccacactctcaatgttcttcttctgcttcaatgaggatcacttctgagaaagcaagtgtttatgtgcaagctcaagaaccagccactaccaagcccaagaaaacacctacaggtccactgatgctgattcccccatgggaaactgacaagctgtgatgccatattgtgctaactatgcaatgttatgtgctttttgtgtattttggcagactctaagccaactatgcctactgtgaactttatgtaatttggcagactcttagccaactttgcctatctgtttagtttctgtaatttggcaaactgcttgccaactatgctgtgatatgtgcttgttctggcagactgtaagccagctaagctatgtggattgtatcatctaaattgagtgactttgctcaaatgatgtgtcatagcctaatctgatatgagatggtatttactgagctgatctgatgtgatgaattgactcttatcaatttgttatgctaaaatttatgtgcaaagttacgaatactcagccactgcaaaagatgatattcagtcacaattcaaccaaccactgcaaagtcagctcaaatatatgcaatgtcagtgtcattactgaatatcaatcacaattcagccaaccacaaatccattcacttaacttagatagtcaaagagcacagctcagtttcttggcaaaatgcagcaaaatgctttcagctaccagcattttgacacatagattaacacattgcacctcacagctgaactaaaatcatagcaaacaacacaagcatgcatcccaacgacatcagtacaagccaaactctctgtttctctagcctactgttacttgctctcatagcagccatgttagcttcattctcagctgccacaatcctcaattgtgccacttcattcattgctacccctaattctaggcactgctcttctacctttggcctcagttcttcaacacaatgttgcagctcattcttctcccttcttagcgataacacggcttcatgaagatcgttcaacagctccctcaaaaaactacttgttgcaggctcataccagtcaaaaaaatcgcagccggcgccctgaaaacattacatcccaaatcacccaaccatactgccagctcaaacaaaaaccaagcaagcaaacgaaatcttcatcactcacccgattgcggcatcggtagtaccatcgaccagggttgtccacgctcccggaaatcccccgtgccgccttcgcaccacatcggcacatcaccgccggctgataatcatagggcccaactcgcgccgggatgggagcacgactgctgggatgcgacgaccccgacgaccggtcactgcaataactcgccatcgcctagcctcacctcctcttgtcgcccccgccgccgccgccgccgcttccgccgccgccgccgacctaagctagggtttcagctcgagaagaggaaaatgtcgcggcaacgcctggaaacagcgaggacagagcctttaaccccgtctattaactccccaatggtggactaaccagtgggtcccacagcgcgacacgtcaacaaaaccgggcaaaaactgagtcaatactgccgagggaccttctacggacggatttagtaattttaggggtacacatttctggtattctagtttagggaccttaaaaaatctcggatttagtaattttaggggtacacatttctggtattctagtttagggaccttaaaaaatctcggtgtcaatttgagggacctccggtgaacttattccatgtaaaaacacgaggcctgggagatctgcttaactccagtgtaagtccagaagcttgcctttaggtgtatgagcgtgccagttgatttgatcctgcaatcaacaagaaacaaagacaaagaaaccacggttaaatccataaacgatagccgatcggctaattgccgatgaagtatcatttatcttggagccgatgtcatatgtggatcgatcggcaatcatgaataagtaagaaagaactaattaaatctactcgatcagttgtagatattaacaatatataatccttatgtcgctatatacttaaatcaagtgattgggattgatctgtcgccatgacgagacagtataaatcacatagatcgaagtatatgttaacaacgagactatatatgttcatagcatagccgatcagatagatctagcatgtataggctaatactccgataccactctatatcaagatattaaggcaagtagaatacaccaaacaaaagcctaatatacttaagggcagatttaacatgtcaattaagcatatgagaaaatggtagttaaatcaggtaagatcggctgaaactctgacgctaccctaatcggcagccaaaggcagcctagagattgagattctaatcatcactcataagattaaactcaactgatgcagctataagtatgaaaagaaggacaatatctagacaatcaagtcgttggatgtttcatagagtggtagatatcctatataatctaagtcagcatcgatatttaacctaatcggctgccttctagtaacagacgttagccgattagaggttagatagcgatattgccagagattatataagatatatgaaaactcgacgaattacataaacaagattagtgtatcataaagatggaagcactaatcccgagaacgcaagccgccataacgagttttacctctagttgaagatcgaaaccgatgcagctcaacccgaaagcaagaactcgtcaaaacaaaatgaaagtaaaaagggtggcgatgcgccgagattgtagtgaacgtgtgttagttcgattatatggggctcgggtctatttatacccaaaaattacaaaatatgtccatatcggacacgtttcttatctctaacaaactctaagataccataagtctttgcagcagacttttgcccaaacatatctctaaggaaattacataaaatatcctacttaatagatacaattgccttcttaggactctatccatgtgtggcaatcatcatgaagcacgtcattctaacccgacaacatatgccgtgtcatattgtcggattcggctcaatcggctaaccctgtccgactaacacatgccccccaagtccagaattttggataatgtttcggatttgccatacgtcgactgcgagagaatattgcacttgccgttttccgaccgttattccaacgctttaaatactaaccgttgtccccgagaaatctcacaccgtttcctccgttttcaccgccgaagcaaactccgtcctctctctccgatgatcccctcggtgcacgaagcgattcccaggcgatttcctctccggccaactttctgcccacaacgatgtagacctccgccagtccatccgccgcatcttcaaccgagtacgcagaggtaagtttccattggctagatcctctcttttcgcatcagattagttttccctttccttatcttgttttcttcttctctgttcttttggatccgtagcaactttccaatctgatcgcagttccgagtttgtcgcataaaaaccactactttcttggtccaatcggcaatcccaatcccactgagtttatcattggtgaaaccaataggatccctttcagattagctaacccgaatctaggtcactggaagaatacttttaaatcttggccagccctcgagaaaacttcacccgagaaaagctggaccacatggtacaagcgtgtatcggctagcaagcaaacacactgggatgagattggaatcggtcaagcacttgcccttaccatagcgaattcggctaaggatgaacccctaatagctgccgccacctatttctcgtccaataccatcaacgcctttttgttgaaccaagggccgatgacaccaaccctgatagatatcaccatgatcactggtctagatgtgacctcatcggctaaccctacgagtctgaacaccaagaatcaatatgacttcaagaccaagagcataggcggttggtctggttacgtggcagcatatatgggccaaggatctgttactgctcaagaacacgtggcctttttgctcatgtggctagaaaagttccttttctgtggatccagttgtggtcctacaaccaactggcaatttgtagccgaggctctagaatcaaaaagacaatttcctctaggcaaaatcatcctcggctacctataccaaatgctgaacaatgcatcgactaagatagtcgtcggctcagtagttggagcaggtggaccatggtggctgctgcagacttggctgaatctggtagtcatgaaagctgtcaatcggccatccgtgatagaagccgaattcccaagactgcagccgattgtagaagatgatggagaagaaagcactcatcgtagatgcatgtcatatggagaatatgcattcacaccagccgatgctggagcgaagttatcagccgagctgctcaaagattggttctgcagcttctatgagggttttcaaaaagatgctcgagtttggtttccttatgaagattcagtgcatcttgatctcccatcagactttagattcgaagatatcaacaatgaaaaatctcaaaaatctaaagaagtcttctcagctgcgattagcccatgcattcttcctgtcggcatacatcaagggaggaacattcaggtttcctatgaattttatcactcgatgagctctgccagaccacttgggatgggtcaactaccaatcggcttgctctttgctgataaaattcaatgccgaggagaaatctcatcaaccttgatgatggatcggctgctgaatatccaaggacctcctttgggcagcattgaaaatatagagctggcaaggttcaggagcaagaactttgacagatggtggggtgaatggaagctgtatttgttccaccaaccggcctcaatatatgtgacagatctctttcctaatgttatccctcaggtaaaccttgacttcattaatttcttttgaacaattgtcagccgattcataacttgactaatcttctcttctgttttgcagacaacagaatcttctcctccacaccaaagcaatagtggcagagatatagagtatgccccaggcctcttgccaaatggtggttgaccaacccctccagttatcagctatcatgcccccaagaccgcaagtctgcttcaagggcagatgatagagccagccgataccggcaggaagaggaaacccagggcaccaacaatcgatccattagttctggctcctaagaagaagactaagaaacaaaaacccaaggtagctgatgatctgcctgccctagatccatccattgagcaagccttggatgaactagagattgaagaggatgttgacgaagctgcagccgaggtaagtgatacagaaagaactccatcggcttcacctaaacagactcctccgactccttctactccagctcacttctctagggtaaacagctctctttaattccttcttccaattgttttattcatagttgattactcataaatcttgtcttttgcagaagaagaagttcgctgtgaagaagaaatcggcagcaacccaatccaaaccaactctgccggtaagattcttctgaaaatatttcagttccaatcatactctatgtggactaacatctattttctttagcctcctcctcctccttcacctcctgtacagcatatgtcaagtgaatgaactccatttgctgtaggaagccacaatattgaggaagcagaacaaccagccgctcctactatcccagtaagtttccttttgacacaaggatttagatcggctatatctatttggcatctaattctctttgaattatttttgcaagccttagccgatctgttctcttttgatatcaaggactacttatagaagaggacaccacaaacaaacccttagctcccttatccgatgatgtgaagaagactcttgaagatatttctcatcagctagaggcatcttctctagacaccttggtggtagattgtggatcaattacgactcggctacacgaagttcaagctctgattcctgaagaactagccgatgtcctcactccagctgcttatcttgaaaagcatcaattcaaactggagaaatgacacgcccagaaatttagcccaaatttccagactattttgtgtattaaatccctgtccaggaccagccagggtacacaaaaagacaagtaatacacagttccaaacgtaaataaaagcgtaaatacttacagaagaggcacttagtcctcacaccgaaacgaaagcagcagcagcggaaaaaggctatcctagcggggcttcagctccactccacaggcaaaactcaactgaggtctgagccttggtcttctaacttcgtcttcagctcagaagcactacacttctgaaaaagggggaataatagcaaggctgagtacaaccaccgtactcagcaagccacaccaatgatgcagacgtgcaaggggaacacaaggacggtttgtggctatttgtataaaggcggttgtaaaacattttattgagcaaaacagtaaaactgttgagtaattaaggtaatattaaatctccactgatcaacgctacaccacgttgaacaggcccaaccaacccacctgaactacagtgcattgggttgatttattaaggtggaactaatcacggtgaatctggtcgaccgcccataaccgcaggcacggctattcgaatagttttactctgactagaggtgtacaactgtacccaaaagacacagccccacgacacgtttctgtgcgctgacatgccaccacgaaataccggaaagaggccgtgacaggacccttcgcataaccccctctaaccgattgcaccacaccttagggttcgcccccgtccacagcaagcaacgggtagcccccctctcgtgccgcggtgaatccggaagccaatcaaccggaaattttcccttaaaaaccattggccgagaatattttgcaatattctttgtgccctaaaatactctctgaaatttcccgtcaattttcggagctcaagagataatttcaaagtcacaaagatcatttaatcaatttaaataaaaagaaaaacaaaataaaacctcccttcctccttgggccattttcggcccaagtccctttcccctcccgcggcccgctcaccctatctccctctctcggccagccttcccttcctctcacgggccgtcgacccgtcttcctcaagactgctttgcgtccctgtgccagcctcctccctcctcccctcactgacaggtgggacccacggccccacccgtcaggcccatccccttcctccggctccaactgtcgccatggctgcccgagccaccccactccgccgccttttctgtaccaccccgccaccgccgcgatgccaccggaggaggacacgaggccggaggtcgctcagagcggcggcgagggatggccagaggcggtaaagatggttgcggctcgggttggcagtggaggtggaattccaacgatggaatggggaaacggagtggagaacgagcttgcccgcaaggcggcgaagccggcagtggaggcggcacagcacagcggcggcgggagcggcggtggcccgtggctggaggcgacgagaggctgttgtggctcgggtgcacggtgaaaccggtgcccgggtggtttattgcagaagcggagcggtggacggggtgcggcaatgcgtggcgaggccggcggcgcaaacggcgcggcgcggggacggcggcagcggccagctggagggtcgtcggcgagcggcggcacttgggatcacgtgggaagagcgggagagagcgcggggagtgcgggaaagttggggaaaagggagaggatggccgggggagtgattttataggctcgggagggagtggctcggccgggatgggcggcaacaggcatcgaagtgggaggcgacgtggagctcgtggggaggtcaaactggtgccgtttttttgggggaaagtgggggaggagagtggaggaggtggaggggatgcggtttctcttgattcggatgcggtttctcttgatacggtgtacctcttcgattatcctttgctaactcttcctgggttgacggactattaggccatgcaattgcttttccaaatatactgcaatctgaacgtctattggaaactgcctttgatgttgccgagaatttctgccctttgatcataacaacttcacatttgtatcttcggtaaagatgatccgtcgagaagaggttctctgccatacgccctgctgattacacctttcgggacttgattcttgtatgctgctgacccatgtatggaacaatttctaccaacttccgagaaacatcatgatgatttctagaatttatattagttgccttgaactaaggaaaaccatccatgattcataatcacaccactaaggtgtaattattgcatagttaatttctcaaaactgaactgaccgactctgcattggaacagacgcagcttgacaaagatttgtaacgccccgattttctttcgggattaaaaatcatttaataatgcattcctagaaattaaataaaatttaaatcaatttaatcaagtgaaataatgggagaattaaaatttcctttaaaaatcattggccgagaatattttgtaatattctttgtgccctaaatattctctgaaattttcccgtgaattttcggagctcaagaagtaattattataatacaaagttcatttaatcaatttaaataaaaagaaaagaaaataatcttccccttcctccctttcaggctcggcccaaattccttcccccttcccctccggcccggccgcccataaccgtctttgggccgctcggcctgctcgctcccctccccctccaagtccacttcgcctccctcccagccttccctctccctccggctgacaggtgggacccatgggctccgtctgtcatctcctacgtccagccaccccacagcaacttccatggccgctgaaaccatcccactccgccgcaaaatccgccatctcccgtcccccgtgctcgcgtctaaccccacttgcttccccacgtcggcatcccactccgccgccggttgccgcctctcccaggccgccccgttgccccgagccctataaaaaccatccccgtgccatcctctctcgtttcccctcctcacccaagctcgtcgcgctttctcccgcactctccacgccgcccccatctccgcggctctccggcgagctccagccgccgccctcgccgccgccacaccgcgccgaggccacctccggcttcgccacctcacgacgcacatcggtcgtcgctcattttccctaaacaatcactgttacaccgcttcccccgcaaggtcgagccatcgccgcctgtaccacctccagcagccgctcctcgccgctttaggcaccgccgagccgtgccgccgcaaccgccagcatctcccagccgagctccaccccggcccttactctttttcccctatccgcctacgaaacgccgccgccacgctcaccacctctcttcgtcgccattgccgactccaacggcgtcgcgccgcctctccggtcgacgccgacttgcgctgccacctccttcggcttcgcagggacgagggcaagcccggccaccactcttccgaaacccgccctcttcgctctaggtgagctcctcctcatgtgatcgtcgtcagccgccgttctcggtcaccctgcaccaattctccccttcctaaccctcctaccatctctcccaggccgcgctacactgtcacgcccagaaattcactagtaatttcagaacttatttgtgcataaaatcctcgtccaggaatcagccgaggtacacaaactgacaatttaatatacagattcatcaaaaaaaactaaagcaaataatacttactgaagaggcaattagtcctcacatcgaagaaaactacagcggaaaaaaaaatctagcgaagctcaggctccactcccacaggcaactcaactggggtataagccaaacgtcttctccttctggatcatttttcttcaactgaggtttgattgataattacaaggtgagcatatgacatactctgtaagccacacatcaactatgcaagtgcacaaggataccaaagtatggcataatataggctcgtttgcaaaagcagcatttagcaaacatttaagagtagtaaaacagtagagtaattaattatcaattttaatcaacactgcatagcaccccaatgctgcacaggcccaaccatcctgtacaaccatacccggctgtacagatctaactccaaacttggagctaagcaaattattaccagttatagcacccataattattgtgagaggtgtgagactaatcacgaaaaacattgctcaactcgcccatgaccgtgggcacggctattcgaatagttttactctggccagaggtgtaccactgtacccacaagacacagctccacgacatgttaccatgcgcctcaataccaccacagtacatcggaaaggaaatgtgacagtacccctcgcacaacacaactcaccacagttcaccaatcctggatcataatcacccctaaaaaaaaccagaggcatggactccccagcgaccccatggacttctcgccgcttctcagtctggtgccccgcaatgaaccacgctatacgaaaggtaaagccgctacccacgctgggttgaggttggcacggttaatgtctcacaacagtagctcgcgaaccggtccttaattgtcatgagcacgaccttcaaaaccatgtgctcacaacccaccattgtcaagttttaattatcaattaattatcataacacgattaaccatcgtgagctaccattaaatataaccataaataataatgtagtttgattcatcccattagtgagctaatgtttctaagcatggctaagcaattatgtatatagcaattagctgaaccaatccaatatataaggtccaagctaatcaatttattacccatatgaaaataaagtcatcttcggccataattaattgagaaaggctcaccacccgatgacattcgaaaataatgcataagttgaaataaaacaatagctttaagtaggttcaacatgctcaaagggttgtttgggatctgtgtgacttgccttgcaataatcggtcttcaattaatcttcttgaacacttccgacgcactcacgaaccttcgcaatgacggaaacgataagctaacacgtaaaacgaagaaaaagactaataaaaaaacaaataaacagtgcataaaaagtagacaaacatgtagatcatgattttagatgaatttagagacttgaaccacttaattccgacttcatatgaattagttatgaattttacaagattaattccaattaaacctattaaagaaaagactattccaaattaattaaacaatttacatataatttataactgagacataagcctaaaccatcctccggaaattattggaatgaatttagtagacgacatatagtaaaaagaactaatatgccattgaaaagggataacaggatttatattgattttggacggctgagatcaactttgacctagtcgaccaaaattggatggctcggattgatctgatctaaggttttagatggctgtcacgtgggatctgagagacggcgtgacacttagatggtagggacggcagctaacaaggcgatgacatggcaaccatgcgggatcgacgccggcggctctattcggtggtgaggacggcaaacggcggcacaacggcggaaaccgagagcacggggatgaagaggaggacacgacgatccttactaacacttacgcagcgatgaacagcaaaggagatggccggcgacgagaacgggagtgacgacggggtactgatcgatgatggcggcggagtttcagcgacaggagacgacaaccgaggggtgaacgggcttctcctcggtgctgcgaatccaatggaggcggcggcgaccgaaggcgacgacgaacggtgcgagtggagatcaaaccatggcaacaacccacgggttcacggtgacggcaaccttccggcgggatttggcgcaaaagaactggcggccgtggtagagatcaaccttgcggagcagagggaagtggcggcactgatcgggaacggccggcgcgacgggaaaaggcggctggagatggcggccggagttggagagagaaggcgagcgtggggaggcggctagggttagggaaaacttcgggaaacagagggaaaccgaagaggaggccgaggggctgctatttgtaggcaaaggtggaggagatcggctcgagaacggatgaattcggtgaaggaagttaagatttatcccgagttcacccggataaaaacgactgaaattcgtgagatagataacgaattttaagggagttcttggagataagatagaggagatagagaggaatccgtttttgcaatcaattttggaagggaagcaacggatgcatcgaatttgatggaggacacggcggctctcgggaagaacacggcctctggacggctggctggagcttgaagacgcactgtagcaggagggagggcaatacagactttcagctgggcttcattttccaaggcctgattgaaggagggacaagaaatggacttcggaaaagagagggagagggctgcaggctgagaggagactgggccgagagtgagaggacttttcctaattcggcccgaaaaggaaaaggggaatttaattacttttccaattaaattaatcaccaaaatgatctttgaattgttaaaaatacttccaatgctcaaataatttcaagaaaaatcctgaaactaattggacactcaaagtacttaacaacgttataatcagaccatttaatgattaatttattatttaaataattgctgaactgctctttgtattattaaaattaagaattgagctccgaaaaatccgagaaaatttcagagagtataattaaccatggagaatttaatgaaaactaaatccagccatgctttatatttaggaaattttatttcctacatttagcttcacttgaaaattaatgaacatttaatataaattctaaaaataatttattaaataatttatgaaacctaaagcgaaaatcaggatgtgacatgcacctcggctgcttctctgccttcgccggaaaccgtcgggccgccatccgtgccgcctccccgaggagcgccgtcgctaatcctcgtcgccgactgccttcccgtcctcgcctcatcgtcccgtccgctcggtgagcatccctccctctccctctatctccactttgccggccatcgccgtcagcgaccatccggccgcgcgccgccgcctctcggccggctggcgccgctccgccgcccgtggaccccctgtggtccgggtccacggcgtctcctgggccgcggtggacttggtccaccgtgtgccaacccttgtagccactgacgtctggggcccacatgtcggcgccggcctccccttcgatgacgtgagcgactaccttttccctttgaaaaataaatagtaattgcgtcataattcgataataattctagaaatccatttaaatggctcaaaacttctaaaatttatatctaattcattcgaactccaaattgggccattcaacttgcaaaattcatctaaaattaagatctacatgtttgtttactttttatgtactgttttcttggtttttattagagtttttccttgttttgcgtgccaacgtgtagaatccgtcgttttggaagtccacggtcgcgaggaaaagagttcggaagattgttttgaagaagcaaggtaagtcacacattccccttgagcatgttgatcccaatttataaatgttttaccgtttacaaataaacatgcatgtcttgctaattacatgggatccgggtactacctatctgcttgcttgtgctatgtttacttgatatctgtcttttgtcaaccttgggtaataaatcgactagctcatgttacttatgtgacctagctagaactatatgcttagccatgcttaattaccactagctcagttgatgggataattacagtattagacctttatagtatcagaatgagctgcgtgcttgagacatctggccatgctttatggtcgtaattatccaactaaaatgcgactgaatggtgggctgcgggtgcatggttttgctagttgcacccatggaaattaaggaccagttcgcgggaaaccctggaagaatttatcatgcttaccacaagccagcgtgggcaacggctgggcttgtagtgtagctttcgtctagccaatgtacccaggcgagggtgggcgtgatggagttgggtcggccggggtgtctggctgatcggcttccggattcactaaggcacgagaggggggcttcccgttgcctgctggggacgggggcgaaccttgaggtgtggtgcgatcggttagagggggttatgcgaatggtcctgtcacggcctctttccagtatgtcgtggtggcatgtcggcgcatggaaacgtgtcatggggctgtgtcttgtgggtacagttgtacacctctggccagagtaaaactattcgaatagccgtgccggcggttgtgggcggtcgaccagatccaccgtgattagtcccaccttaataaatcgacccaatgcactgtagttcaggtgggttggttgggcctgttcaacgtggtgtagcgttgatcagtggagatttaatattaccttaattactcaacagttttactgttttgctcaataaaatgttttacaaccgcctttatgcaaatagccacaaatcgtccttgtgttccccttgaacgtctgcatcgttggtgtggcttgctgagtatggtggttgtactcagccttgctattatgccccctttttcagaagtgtagtgcttctaagctgaagacgaagttagaagaccaaggctcagacctcagttgagttttgcctgtggagtggaactgaagctccactaggatcgcctttttccgctgctgctgctttcgttttggtgtgaggactaagtgcctcttctgtaactatttacgcttttatttacgtttggaactgtatattacttttcgttttgtgtaccctggctggtcttagacagggatttaatacacaaaatagtctggaaatttgggctaaatttatgggaatgacaagaaagccatgcaaagactagccaaacgccgagaacgcaaagagaatgaatctaccatctaggccaatcggcaactcgtgcatgaagaaaagtccaagcttgatcagctatgtgaggggccaatcaagtctaatattgatcggctcgaagctcgcaagattgaactcttggcacaatttcaagaatgcaacgccaagctggatctggaacacaaaaagttagccgatctcccacaagctgtcgaagaacagaaggcaaggctgtaatcagccatcaaaaatgttgctgatatgaccaagtccctaaaaatcatctctgggaccgatgctcaagatgcccaagccatagaagaagtagaacaaattagccaaagagctatatcggctatccagcgctacttgtctcagtgacatgttgtgtaatagactctatgaatttttgtaatcggctaagaaactctggatctttgtttaactagtcttaatgtgccgattaatataactccatgtttttgctcaaaaattttacaatttttgcacatatatgccccctaattttacaatgacgaagacattgctaaaattataagttgaactaagggcgatatcataatatcggccattgtacatcggtaaaccataaccgattacaatatgaaaaacatctaagggcgatagaacaatattggccatctcaaggcaatgtgaacacatcggctatcatgcatcggcaacaccagccgatcatgcattgacccaaacacttgggtaatatttcttcaagtatttgccatttagcgatcgtccataaacttctccatcgagttcttgcaacacataagctcccttagacaaaacctgatagattttaaatggtccttcccaattcagcgaccacttgccaaatttgttatctcgagtcccaatcgacaaaatcaatttccatacaagttctccttccgaaaaagacttgggcacaactttcttgttgtaatgtcgagcaactcgttccttatcctaggtaacttttgcaagggctcttaatcttgattaaaccaagtcttccctttcatcgtccatgagattataatactcatcggctatcaaatcattttgcaactccgttcttcttgagccaattctaacttcccatggtaaaacaacctcatgtccataaacaagcttataaggagggacttggatcgatctatgaaaagccatccgataagaccataacgcttcggccaatcgagtatgccattgccgaggataatcggaaatatttcgcttaatcaatttgatcaaactcttgttagatgcctcggtttgcccattagcctatgc

SEQ ID NO: 80156 - DNA, 3634 bp, Oryza sativa
gcccagcaacggcggcataataggctagccgtgcaggcggaagcaccagtcggggggggacgaggcggccggtcggtgaagacgtagacgcccaacaacggcggcataaaggccagccgtgcaggcggaaacaccagtcggcggcgtcgaaggcaagccggtcggtgaagacgtagacgcccaacaatggcggcataaaggccagccgtgcaggcggaaacaccagtcggcagcggcgaaggcaagccagtcggtgatgttctgactgatccattcctggagcgtaagagataagcctaaagccatgaatcccttttatgcatatctggatctggatcctgcagaacaaacatataggatgagtagtatctgatataaatataatactcgagaaaaaatcaagtattttaaaatatttataaacatgtatttctcctcttgtcaattttgatttccccgagcagatgactcattacgtttaaacgctctgcccaactagtcatagccaccaagcactgggagtcggcctaagcacttcccaaacatgcatatgagtgacatgagttcgtcattaatggaacaaagtttcacggatcagaatttactactcaggtacttttgcaattattaagagcagaaaataaattatattatctctatgcttttgatttcttccgagtaatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacggaggcaggccggcggtgaagtcgtagacgcccaacagcggcggcataatagaccagccgtgtaggcggaggctccactcggcggcgacggaggcaggccggcggtgaagtcgtagacgcccaacagcggcggcataataggccagccgtgtaggcggaggcaccactcggcggcgacggaggcaggccggcggtgtagatgacgatgcccatcaacggtggtgtgaccaaccgaccgtataggcggggacaccagtcggcggcgacggaggcaggccggcggtgtagatgacgatgcccatcaacggtggtgtgaccaaccgaccgtataggcgggggcaccactcggcggcgacggaggcaggccggtggtgaagtcgtagacgcccaacagcggcggcataataggccagccgtgcaggcggaaacaccagtcggcggcggcgaaggccagccggtcggtgaagacatggacgcccatgaacggtggtgtgaccgaccaaccgtataggcgatgacaccagtcggcggcgacggaggcaggccggcggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaagcgaagtcggcgactcatgaaattgattccatcgcgctcgttgataggaaactcgacgcaacccctacctggcgcgccaactgtcgaaacatgaattcggcaataataaaagggggtagcggacgagacctaaagtggatggatgcagagacaaaggatttagacaggttcaggccctctcaatgagaggtaataccctactcctgtttggggatttgaatccgccgagtgtgtattgatctgacgatcaggttgtctcatgccccctagagggcctcctgcccaccttatataggatggggggcaggattacaagatagaaaccttaaccaatacggtatcggtttcctaaatctattttacaatattatcgaatcaggactttaggccgctccataatataaaaggaaacgtaatacccaagtcatgatcggttacatattccatagatatatgttatcccctattactagtcggataaccatgccgtgtgggtatggggtacccataatctccacactacctatctactgtatcttaactaatataaatattcgtatttttcctttcgtcacctcgtgcatgcggtgatttttcgtcccgtcagcccccccccccaaatcccagtcgaaattccgtatcacacaaatagacccacattgagcacaccttctctctaaaatctcaaaccatcccaatccaaataaaaacttttcaaaattccaatccaaatctaaatcggaatcataaaaaaaaatccaaaataagatgacgacgtcacaacgatttttcgtccataccgcgatttttcttccgtcgcgcacctcctcttcaaatcccacatcatcacaatcctacccaaaaacaaaatctcaatttcaatccaaatccaaatcgtaatcaatgagaggtctcctctcataaaaaccccaaaatcaatcacggcaacgacatcatcatcacataaaaaaaaatagaaacaacccatacacaaccaacaacaccggcagatccggccgcgaggggacggcggcgatgtcgggcagatcctctcagttagatccgtccgcgggtgccgccgacgtcgccaccgccggatccaagggagaagcttggggcggagggggagggggtaggggatcgctagatgtcacaccctgaaaattcaaaatatataaattgttgtttaattggaatttttagaaataattttaaaagtcttgaaaagaaaatctaagtttaattaataaattccaatataaaattgggccagataaaatttcattaaatactttgcttaattctataattcctagatttttctgggatttatttgagctaagaaagtatttgtaataaatggaattgcatttaagaaataatttaaattgaaaaggttttaaaaagtcttcttttggctttgggccgaaagtcggcccaaaacctctcttctctctctcctcggcccagccggcccagtcagccgcgcgcgcgcggcctcgctgtcgctgacaggtgggtcccgcctgtcggagtcgtcgtctaccttcggccgtcgccgccgaaaccctagttcgcgccgccgccgtttcctttccaaatccggccgcctctttccttctccggccgaatcaatagaggggaaatgatctccgggatctcctctacctttctcctgggaatctttggtaaatcgctttggaaag

SEQ ID NO: 80157 - DNA, 14620 bp, Oryza sativa
gggaagcccaatggcccgcggggaagaaaaaaaaaaaaggaaggaaaaattggcccaaccggcccaaaaaggaaaggggggggaaaaaaactttttttaagggtttttttttataaaacctttttaactttggttattccttttcaaatattatttgtgctctgaaaattccactaaaatttatttaagcattttaggcttttaggaaatatacaaaaatcctccaagcctcatttgacttttatctttgcccattttaattgttggaggctttcacatgaattttaattattctttgcacaatttcgaggatgaattttagagtcgatttgggacgcgacatgaatggagtataaagtatcatgagcttctttcagaattgcatcctttaaatctttgttgtcggggacacagattctctcacccaaccatacagttccgtgctcatcctccaagaaaccaatagcttttcctcttctcatattcttcttgatctcttgaatatcaggatcattaatttgggcttctctaacttgatcaattagagtgggcttcgcttctaaggctgcaactgacggagctcgtggctcctcaccgggagaccgcacaggccccccctttgccggttcggccgggggcttagggtgagatctcaagctctcgctgtatgtggaaagatcgcgtgccaggaagaaacgcgagacacggacgatgtatacaggttcgggccgctgggaagcgtaataccctactcctgtgttttggtggatttgtgtgtggaggagctacaaagtgtgagccgatctatcccttgctctaggctctaaatctggaaaaaatccatcctcctctccctatgggcaaggtcctccttttatactttaaggggataccacatgcactcttccctttccaaactggacttttttctttacataaatggacggagatttgcacggttgccctccgaacgtccttctgatgggacggcccatacctacctccacttctgccgggggcaggcgcgtcgtgggaacgtggctatgcgctgacgacatgagcagtgtcagaccggtcacaaatcggtcattcttgtccaccgcgtgtcagcttagcaacgtgcatgtttgcccttcttcacacaacatcttgcctgtaatggttaggatgaagcctggtattcatctaaccagggctaacgtgtcatctctaagaggtaacacgctagctccggctggagacgcgtgcctagaggctctcgtcttgacgggacggggcgaggcgtgcgccaggccgccagtcgccacctaaccgttgatctgaccggtctgtgactggtcacagaccggataaaagagtgcgctgcattgcgctgcatgctgcatgacacgcttgaccagatcgcaataaatgcggttaggtgagccctaccgtgttcacccaacctatgtacataatgcaaaccccacaaggggtcggggcacctcggccctcggagctggggcaggagcaacccgacccccccccctcggggaaatcaggaggagggcggacacctcaccctcgggcccgacgtccccgaaggtgccaggccacgtgggcgattccatctgcctcaagcctccgggcgcaatactcccggtcccatatcaccgacagcaacgaaacctctaccgacaattcccaaatttaatctttcaaattccttgcataattccaatggcaactgtcgtccttctgtagcattgcaatagccttttctgctaagagcgtctgctacaacattagccttccccggatgataatgaattcccatgtcataatccttaattaattccaaccatctccgttgtctcatgttcagatccggctgagtaaagatatactttaaactcttgtgatcggtgtacacttctgtacgagtaccgaaaagataatgacgccaaatcttcaatgcatgaacgactgcagctaactcaatatcatgagtagggtagttcttctcatgcggacgtaactgtcgagaggcataggcaaccaccttcccatcttgcatcagaacacaacctaacccaagtttggatgcatcacaatacacttggaaacccttctttggatcaggcaaaatcaaaataggagctgatattaagcgacttttcaattcttgaaaactctgttcacattcttccgaccacttgtacttcacatctttctgaagcagtcgtgtcatgggcttagcaatcttggaaaaattctatataaacctccgataatatcctgcaaggcctaggaaactgcgaatctctgaaactgtctttggttgcttccaattggttacggattccacgttactaggatcgacggcaactcctccggctgagatgacgtgaccaagaatttcacttcggacaaccaaaattcacacttgctaaacttagcatacagttgatgttctcgtagcttctccaatgcaaggcgaagatgttcctcatgctcttctttggttcgagagtagataagaatatcatcaataaagaccaccacgaacttgtctaagtattccataaacaccttattcatcaagttcatgaagaaagcaggggcattggtaagtccaaaagacataacagtacattcgaacaacccatacctagtggtaaaagctgtcttaggtatatcttcctctttgattctcaactgatgataccctgatcgaagatctatcttggagaaaacagtggcacctttaagctgatcaaacaaatcatcaatcctgggtagtggatacttattcttgatagtcacatcgtttagtgcacgatagtccacacacattctctgagtatgatctttcttttccacaaaaataaccggagctccccatggtgatgaactcggtctgatgtatcctttctgtagcaaatcatctacttgcctcttaacttctgccaactcattggctgccattcgataaggtctcttatggatcggagttgttccaggtaccaaatctattctgaactctatatcccttttaggcggcataccaggtaaatcatctgggaacacatcaggatactcccggactataggaatctcttccaaagttatctggttcagtcttgaccttaaagactcagatgacaatgcatgaacagttacaactcgaccatcatagctgttgagagttacttttctgttggcacagtctatcacacctttatgtctggctaaccagtccatccctaggatgacatcaaggtctttggattttaacaagataagattggccagaaatggtactccttgaatttctattctgacagaggggctacgttgcaaagagagtgcttgattatttccttggttttgctgattctgaaattgctgcatcatcatgttcataagctgtgtctgttgagcaagaacttgggccagagtgggattctctccattgttgttgttattggggttgttgggaccattcccattgctacgagtgttcaccatctggcatggacagggcacaagaagagaaaccggggaaactacttaggacagagaattactttaacttttattgatcttaactgagtttcattattacaaactaaagactctcacaccactaaactcaccaacttcctaacactcaaaagcaaacaaacacatgcaattacatcccaccactgatgtaaatcacatgcgagccacacacaagcaaacttaaagcaaaccaactaacacaacgatctaagacaacgacttaacaagtcactctagttcttccaagcatcggaggtcgattgaaggctcgtttttatcatcttgagttgctacccactcaatcttggaattgttgtgcttagattcttcttcttcatcactacttatgatgatgaccgaaggatccgcttgagctggggcaacttccttctccaccacacgaacctttggcgccaattgatagcgagggacaaatagagctctcttccttgcggtaagacgaatcctggccttctgcggcggtgcttctcccttcaatgcggctaattccttctccaaacgatccaccttgtcttctaacttgcaaatcttaccacgattccggtcttcacgatcttgagctgctaatacagtctccgcacgactttcatccatagcccacaacatctcaaccaaatgtttcgtggtaacatcattctcaattccttcagtctcaaggtaactgccacggtccttccctggggttggcgaggatggtagcgatactcaatgtcggccaactgatcactgtagcgatcacggagctctcctatggcgatccttgccacctcctgacatgcatggatgtagtttcttcctccagcttcaaacatcactgaggggacctcttcactattactgttcaaagtgactttgactcggcacttctcttcatgacgatcatgaggaatctgggcataaaaaggggcagtcccaaatccaatgacaaaggacatcgtgcgcaactcctggacaaaaccctcaacaccaaacaggtactcaggcttgtaacgcggcatctaaagacaagtgaaaggagggagttaagacctttatccaattaatagcacaagtttttggattaatttgaataaagttagaaaatcagagtaaaaaggtaagtaaataaagtaaaccaagctttgcgagataagttaaaatagttggaaacgaggtcacaaattttgtaattttgaataactggtttcaaaagaaatgaaagaaaatgataaaatcaacatgataaatttattttattgcagcaagattaaataaaacagtattataaaacttttgctggtaaaatgagccattagtacagtaatagatgtacagtactaataacactggaataaattttgaatgagaaccattaaaagagattatgaagtgcatgtgccattagtttggtttaattaaaagagaaagggaggagaacagttctacttttccaatatttttcagagggcttctatgggtaaccatttggcataacctagggtcaaagaggctctgataccaacttgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttgagaatttaacaaaacagttaagtaataattaaacaatattaatacaacgctatacaacataccctgttgtataggcccaaccattctgaacaaccaccccggctgcacagttctatctccaaaccaggaatgtaccattccaaaccaggagctaatcaaattattaccagtttaagcatcttttacaatgatgagaggtgtgagactaatcacgaaagacattgttagacccgcccataaccgcgggcacggctattcgaatagttttactctggccagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaactgaaactcgtgaaccggtccttaattgtcatgagcacgaccatcaaaaccatgtgcccacaacccaccattatcaggttttagttggcacattaattaattaactaatcacgattgaccatcgtgaactatcaataagccatcatgaaataatagtgagtcattagttatcccataaatgtactaatgtttctaagcagggctaagcaattatatctaatatctagttgaaccaatataaataaagctcaactagtcaaattaatataacccaaggtatcaaggaataaggtaatcaagtacgaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttccgcgaaaacggactctccagaaacgacggaatctaagcaaaaagaagcaaaatcaccaaaacagcacataaacaagcatgaacagtacatgtggatatttttaatgtgtaaatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaagaaggattattgcgtcagcggctagggtttcggtggaccggcgcacgggcggcggttcacgcgaacggacggccgagatctaaccgatccaagatggacggccgagattgatcgagtccacggcggttcacggcggacgaccccgatggcgtcagcgatgacgtcaccgacggcggcggcggctcggcggagcggacggctcgggcggcgcacgctcaccggcgaacggcggcgctacggcacgaacggaggacaccaacgggaagcggacgacacggcgaacacaccgacgaccaaaacgacggcggagaagcaacggacggcgacggcgacgagaaggaagcggcggctaccttcgggttgtcgacggcgacgaagctccggcgggttccaacggctgcgaaggggcggacgaggacggcggcgacttggcgatgacgacggcggtcttcccgagcggcggcgacagctggagcgacggcggagcatggctgaagcggcggcggcgacggcgaagctagggcacacggcgctaaggctcttccggcgacgagaggcgaaggcgagggctgcgacgggtagaggagacaccgggggtccttttaaaggggctcggaggcgacggcgaaggcccacggcgacggcaacggcgaaggaaaccttcggcttggagagagggaaaaccgatccgaatcgaactcgattccaaagctttccaaagcgatttaaccaaagattccaaaggagaaaaggtagaggagatcccggagatcatttcccctctattgattcggccggagaaggaaagaggcggccggatttggaaaggaaacggcggcggcgcgaactagggtttcggcggcgacggccgaaggtagacgacgactccgacaggcgggacccacctgtcagcgacagcgaggccgcgcgcgcgcggctgactgggccggctgggccgaggagagagagaagagaggttttgggccgactttcggcccaaagccaaaagaagactttttaaaaccttttcaatttaaattatttcttaaatgcaattccatttattacaaatactttcttagctcaaataaatcccagaaaaatctaggaattatagaattaagcaaagtatttaatgaaattttatctggcccaattttatattggaatttattaattaaacttagattttcttttcaagacttttaaaattatttctaaaaattccaattaaacaacaatttatatattttgaattttcagggtgtgacatctagcgatcccctaccccctccccctccgccccaagcttctcccttggatccggcggtggcgacgtcggcggcacccgcggacggatctaactgagaggatctgcccgacatcgccgccgtcccctcgcggccggatctgccggtgttgttggttgtgtatgggttgtttctatttttttttatgtgatgatgatgtcgttgccgtgattgattttggggtttttatgagaggagacctctcattgattacgatttggatttggattgaaattgagattttgtttttgggtaggattgtgatgatgtgggatttgaagaggaggtgcgcgacggaagaaaaatcgcggtatggacgaaaaatcgttgtgacgtcgtcatcttattttggatttttttttatgattccgatttagatttggattggaattttgaaaagtttttatttggattgggatggtttgagattttagagagaaggtgtgctcaatgtgggtctatttgtgtgatacggaatttcgactgggatttgggggggggggctgacgggacgaaaaatcaccgcatgcacgaggtgacgaaaggaaaaatacgaatatttatattagttaagatacagtagataggtagtgtggagattatgggtaccccatacccacacggcatggttatccgactagtaataggggataacatatatctatggaatatgtaaccgatcatgacttgggtattacgtttccttttatattatggagcggcctaaagtcctgattcgataatattgtaaaatagatttaggaaaccgataccgtattggttaaggtttctatcttgtaatcctgccccccatcctatataaggtgggcaggaggccctctagggggcatgagacaacctgatcgtcagatcaatacacactcggcggattcaaatccccaaacaggagtagggtattacctctcattgagagggcctgaacctgtctaaatcctttgtctctgcatccatccactttaggtctcgtccgctacccccttttattattgccgaattcatgtttcgacagttggcgcgccaggtaggggttgcgtcgagtttcctatcaacgagcgcgatggaatcaatttcatgagtcgccgacttcgctttcgctttgggagttttcacttcctttccgtcgaccacttcttcaagctcctcttctctgacttgatccaaatcagtcagggggaaactcaatctgatttttatcattatttatcatattgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgccggcctgcctccgtcgccgccgactggtgtcatcgcctatacggttggtcggtcacaccaccgttcatgggcgtccatgtcttcaccgaccggctggccttcgccgccgccgactggtgtttccgcctgcacggctggcctattatgccgccgctgttgggcgtctacgacttcaccaccggcctgcctccgtcgccgccgagtggtgcccccgcctatacggtcggttggtcacaccaccgttgatgggcatcgtcatctacaccgccggcctgcctccgtcgccgccgactggtgtccccgcctatacggtcggttggtcacaccaccgttgatgggcatcgtcatctacaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattacgccgccgctgttgggggtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgttgttggatgtctacatcctcaccgccggcttgcctccgtcgccgccgagtggtgcctccgcctacacggctggcctattatgccgccgctgttgggcgtctacgacttcaccgccggcctgcctccgtcgccgccgagtggagcctccgcctacacggctggtctattatgccgccgctgttgggcgtctacgacttcaccgccggcctgcctccgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattactcggaagaaatcaaaagcatagagataatataatttattttctgctcttaataattgcaaaagtacctgagtagtaaattctgatccgtgaaactttgttccattaatgacgaactcatgtcactcatatgcatgtttgggaagtgcttaggccgactcccagtgcttggtggctatgactagttgggcagagcgtttaaacgtaatgagtcatctgctcggggaaatcaaaattgacaagaggagaaatacatgtttataaatattttaaaatacttgattttttctcgagtattatatttatatcagatactactcatcctatatgtttgttctgcaggatccagatccagatatgcataaaagggattcatggctttaggcttatctcttacgctccaggaatggatcagtcagaacatcaccgactggcttgccttcgccgctgccgactggtgtttccgcctgcacggctggcctttatgccgccattgttgggcgtctacgtcttcaccgaccggcttgccttcgaccgccgccgactggtgtttccgcctgcacggctggcctttatgccgccgttgttgggcgtctacgtcttcaccaccggccgcctcgtccgtcgccgactggtgtttccgcctgcacgctggcctattatgccatcgttgatgggcgtctacgtcttcaccgaccggcttgccttcgccgccgccgactggtgtctccgtctgcacggctggcctattatgctgtcgttgttgggcgtctacgactccaccaccggcctgcctccatcgccgccgactggtgtttccgtctgcacggctggcctattatgccgccgttgttgggcgtctacgtcttcatcggccggccgcctcgtccgtcaccgactgatgtttccgcctgcacggctggcctattatgccgccgttgttgggcatctacatcttaatcgccggtcgtctcgtctgttgctgactagtgcccttacctctacgtctggtttatacagctaccactactgatggacatcatcatcttccgtcgccgactgattatgccgccgccgactggtgcttttatcttcacaactgcgcgtcttcactaccagtttgcttctgttgccgacgactcgtgttcacttcatcacggcaatgcaactttgtcatcatggtagagcgacttcatctttattatcttcggcactggcaaactctattgctgctacttcgcaagttttgctacttcaccaaccacgacgtctttgtgagcctcgacatctcggcatgcgatgccatgttattttactacaacaagaggctctccaatattcaggatttctacttggacatcttcaacacatatcttcaatcaagcaatgactacttgacgacaagaagctataattctcgactctatgttcagttgtttcccaactaaccaaagagtcgggggctacacaaatacaaggctcaaaatttgacaaattttatgtcaagctgaagaaatcaattcatcaaccaacgagtcaacttcaggagtcattatcttcatctttgattcagagcagacattctacttcaacaacttcaaatatttcggtttagacgagttgggcaacaacatcaactctcctccaattatttgtcttcacggttggcctactacgcaaccgccgatagaggatctcatcgttatcatcggctgctacatcgctattgactggatcaccgacatcgccatcttcatcaacatcttgtcaagcctcatcaacatagcctactctgctgccgttgatgggaaacttcatcatcatagtcggctatctctattgccgctaatcatcattaccgtcggatgcgtttgtcgccgccgattattttcttcatcttcatgattggtggatttcgccatcaccgttgatgcgtgtctacgtcttcatcgtcggtttgcttttgtcactaccgactgttctttcgttgttgttgggcgcctacatcttcactgctagctgacctgactgttgccgactggtttcttcgcctccatggttatgcaacttcattacatttgattggtggcatctttactaccactgacatcttccgttacttctgatgagcaatttcgtcttcatgttggtcatttcatctccatgccgactgcgtcagctattgccaatagacaattttgactatgacagaaggacaagctatatgctcaggagctcatcaactcaagcgtgaggattatatctctaatttggacttgttccggatacatgcaacatgaatttatgatcatgggtctattttctatgctcaaagactggactatttattattccccgtaagggttatcaaccgaatacttgcgccagtcgggattcaatttttatatctattttggagtatcccataagggataatcactcagatcacatggtctatatcacccgggagcatgttacatgcgtcatcctttaaagggtatcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaacttttaggagttggtacaatgcatcttaaaaggtgtcaaacagtaaagctttatatagctgccccgctgactttttaatatagtcatggtgctgtttgggtttttaagcaattgattggatacaatatcgttgctttttgccacgtaagtgtgcatttttattgaccaatattatggcttaggctgattatatattgtggtcatttttctaggcggttggtaaatcctttatgagtttatttactcggattttacaccacatatgccatatatttccaggtgtggtgaaaccatgtgtcttttagggactaaagcacgtctgttaaagcagtgtgcgcatggcgtatgcccaatactttggaaatttctttattcacaacatccaagcttctttatagctattttgctatgtgaattttcaatgatgtagccaactttaggttacactcatcatattttacaaagcagtcggtatatcacttggatcatattattcggggattcacaccgcatatgctatatattggtatcaagtcacttggttgactacgattatcaaaaccactcagttggtgcatctattagatacatctattcgatgcacctgactttatttttcagccctccacagtcttcatatttggtaaaagtactcgggagatcatggtgaggatgattgaagcactcggctttggagtaatctagttcgagaaaagattatctttccgactgtgaaggtctcaggggctactgtggagattatgggtaccccatacccacacggcatggttatccgactagtaataggggataacatatatctatggaatatgtaaccgatcatgacttgggtattacgtttccttttatattatggagcggcctaaagtcctgattcgataatattgtaaaatagatttagggaaaccgataccgtattgggttaaggtttctatcttgtaatcctgccccccatcctttataagggggccagaaggccttttagggggcatgagacaccttgatggtcagatcaatacacactc

SEQ ID NO: 80158 - DNA, 6532 bp, Oryza sativa
actttcatgtagaaagcatatttttattttgccatttaaatggtctaagtcgcgcttgaaagcaggcttggtttatgggccttcacatgttggcccacttctaaagatatttttcttttgtttatttctgttaacatctttattttaacaagtcaatccaaacttaaaaaaacctaaatatcttttaatatacggggtattacattcctcccccttcaatcgaattcgccctcgaattcgcccactgtagagcttgagaaaccgtaagatggaaaggaatacacaaaacatacatataaagtagttaggactctcaagcaatttcgaggacatctcctatattcgcaacactgcttgcgtctaggtatggtagataataattaactagcataagaaagtatggtagccaacaattcaaaagcagctaataaaccaacttggacctactagacaggaatattggcttgccaaagaagtgcaatgcacatactaaaacacccaattgggacatatacaaaaatcattggaacacatcatgaagaatcttactacaaagcaatgaaacaaattgtgaaaacaacctttacgctcaagggaatcgagaatacaacacaagcttttaatttaaaatttaaagaaataaacactcacacccatcacatcttattagtatgttgctcatcttcaacaactaaaagtctatctttgattgcaaattatttagaggtaataaacaatatctacgaagtcaatctcaaggaccataggccacacttgttccacttataatgaacattctgagtaactagaacgaaagcattatcctcaaaaactgctctgaacatcgatagatcttgaattttctaagaaactcaaacattccaaagtaaatgaattaaatccactcaataaaaaacaatttgttgggtgcatgtaattggaaagaaataatcaaatatggaaggtcaagcaacaaaacaaacacataaaaaaatgaatatttagtctcaaacacggttttcttaagaaatctgagatcaggataatgacaatctgtaataaattcaagaatcacacgtaaagacaatggaaatatttagaacatggaccgagtataaaaccactttttgaagaaaatgcgtagaaggaagcatcctcttcaacttgatttttttaaaaaaaaacaaaaaggaaatatttttttaccataaactcataaaccaaaattcaaagttttggagtttgtttgtcaactcaaatagcgaatccgaaagccattctataaaaaaattcaaataaagattaataatcaaataagtgtggacatcaatccaagaatatcaatactgcacacagttctgagccatgtaatgaaaataaatcacttggtaaagaaattcaaatttaatacaagttctccataacaagatttaaattagtattttcaaatagtattgtgcatatcaataatttataatttatcagtacaaagcaatcgcacaacacttatgtttgaacaaccaagcgaatgaaagccacaaaagtgaaactaaaataaatatttagtgttaattcctttctgaaagtaaaaaaaaatagaaatcaggagaatatttgtcaccaagtgatgaatgcagagtcaaatgttttccttttggaattatttcagaacgtgtaccacgaatgagaaagtttttttttttcattacctcaaccatagtcacataatagaactcacaaaaagaaactaataagccatatcgcctttgaatctcaagtctgaaaaatggaacatcctttttttttcttactttttttctttgcttttcgggtgaagacatcactaccttggtgcatcatgcataacatgtagacacatctcaccactgtaagaaaagaatagaatgagtagatgacatgggggccaatccatcccatacccaaactattaactcggtacagtgatagatgtatcacgacctaacactcacactcggacaacctcacttggcattgggaaaaaaaataaagaaaaagtcccctcctctaaccactttgcattgcctatacggaagaaaagttacctattcttaaaggaccattgagtcttataggatacaacattaattacttctataaaagagattaacacaagttagagccatgatcaaactagtttaactaaggtctagggaaactaaaactttatcatgtacactcacacacctcaagtataactgtaacaccccatgttgttctccctaatagctttccgaatatagttatgcgcaaacgttaatctccacactatacaccacaccaacgaatcaaaactgaataatttttttatacctcctagctttacttattatgcaatcaggtcttattcgtagaagagcatatatatatatatatatatatatatatatatatatatatatagtaacaacataactccagaaatcacaaatacaatgagatagagatcagtaatcgataaaataaatcagaagtgtgatgcaaagaatgacccaaacccatcctactgtgcaccagtgtgtcaaattttattggtttaaatttaactcaaattttacttctatttttcccatcctaaggaaaacatgatcaatattttaagttgtcatatttacttcccatggacctactgcccactcacataccaattgtaacacaccagataaccacgtaccaagagtgccacaccaaaaaccactcaaaccactaacttccaaaattattagaaattacggcagagtctcccctgtaaatacggacatccacgacagacaattataagttaaactaataacaatatcattcccacaatacgatccatccttataatccatggggaagaaaatattagaaatctaaaagattattacaagaccaaaccaggatataatttaagtgtcattttgaacctgagcctgtcgaacaaccttgtgtgatgtactctgacggctcatggtcgcacaagggggcgggcgccgcggcagtactcacttcgccaggtggcgtgccaattcgatatgccacaaggctgcagttcgacacgatcaacaacacgacagagtatgacgctgtactgatgggcctaagaaaagcgaaagcattgggggttcggcgcttgcttatccgaacagactccaaactggtggcaagccacgttgacaagtcttttgtcacgcctagaaatttagcccaaatttctagactattttgtgtattaaattcctgtccaggaccagccagggtacacaaaacgacaagtaaaatatagttccaaacataaataaaagcgtaaaatacttacagaagaagtggggtcgctgggcccacctgtcggggagggagagagggaggagaacccagggggttatttagactttgcgcgaggggaaggggaaacgggccgaggcgagagaggaagagagggggcgtgggccgtgggaggaggaagggacctggggccgaaaatggcccaaggaggaaggggaggttttatttgcttttctttttatttaattttattaaatgatctttgtgactttaaaattatttcttgagctccgaaaattcgcgggaaatttcagagagttcattagggcacagagaatattacaaaatatttccggccaaatgatttttaaggaaaatttcaaattctcccattatttcactttattaaattgctttaacttttattaaaaatctagaaaatgcattatttaatgggttttaatcccgaacgaaaatcggggcgttacatcttttgaggcaaaggaagaaggcatgaagaggtatctggaggctgttcgatctatggaaaagtgtttcgccgcataacggtcgaacacttacctagaggccagaacgaggagccagacaccctggcgaaatccgctgcttgcggaggaccacattcgccaggcatattttttgaagtcttgtacgaccaagtgtgcccacagagagcctggacatcatggcaattgaccaggcagaactgggcgaagacccagaagactggcgaacaccgttcgtgaagtacctcaagaatggttggctcctagaggatgaagtagaagcgaagcgcctacagctcagagccacaagatacaaactcagggcagttgtatcgctctggggtgctccaacgcttgcttcgctgcatatcctttgctaaaggcgaggaaatagcgaaagaaatacactaggggctgtgcagtgcgcatcaagccgcaagaacggttgcctccaaagttttttgccagagtgtatattggcccactgtgctaaaagtttgtgtgtgtcacgaccgaaaataacccaacgggtgttccttacgtgagtgcattattccttgtcccaggaggcaaggtacaccaaaagttgatacagttcagagttcaacaagcggaagcgtaaatagttaatttattacatgggcggcgaaggcccagcacacacaaagacaaacgggaaacagcagaagactagggcgacgaccacaggcgcttgacggtaggcacgagctagacaccaaagccttcatcttccagggactcctcttctgggtttgggaaaaattgagcaagactgagtacaaccaccgtactcaacaatacacacccataagtgcagaataaatgaaagggagtacaagggggttataatataaagggttagggtttgcagtaaacagcattaaaagacacttagttgctcgaagctattttgtaaacacgattctagagctatacaatattattaatcaaggccgtggacccacacgaacctgccttaacccaaggcctacgatgattcagaccgaactggcaacccgaccctgggtcccagctcgtcccaagccaacccaggccaattattccacattttagttgttaagcaggttttaagaattaaaacactaacttgggtacattgctcggcttgcccataaccgagggcgcggcaattcgaatagattgtactctgatcagaggtgtacatctttacccacaagacacatcttcctcacgtgtaaccacgtgccgcagaccaccacggtatacggacggaagacgtgacatagtttccaacccatcctagccatagacaagaataccgacccaaccccacctacggctggaacccctgggacaggtaggcaggactgagccccgagcagcaggacaccggccctgtgccatgacatctcgactaccgggccacagctcatgtagccttcatttgtcctagagatgtccatcgatccccgacttcgtccatctccatctgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcgtaaaaccattttggggattttgaatagagggggaggtgtgaatccaattccacaataatccaacaattccatagtgtccaggtgataagagtattcccaaggtctagagttgtaaaaccacctaatgttgcctaattaaccagtgaagcatctacctaaaatcatactagtggtaccatgagtagagtgtccactagttggggttttgtttaatctagggtgaacaaggtaataataacaataacaataataataaggtcataataaaggtaaataggcatggctaaataaaacagtgataacgcgggaatttaaataaagcggtaatgcaataatttaaatcaaaataattttataaactgggattcaatatgttcaaggacgatgtgacttgccttgctcgctttcccaaacgtcggcttcaacctccacgaagagcggatctttcgaagctgcagcgtctacacgaccaacagaaaagaaaaggactttactctaataaactccatataacaagcagaaacaaagcacaaaaatgggttcttgacttcttaaggaaaaattagagacttgaacggtccaattccgagttcaaatggccaagttatagtcatttgaagtttatatgctctttaaatgaatatttgcgaatttcttcatttaaattttaatttaaaaagggtttattgcgtcagccgaggggagggggcacgcggaccgggtccacgggagtggggcccacgcggctgacggccgggccccacgcggcagccactcggcgcgcccgagggcggccaagcctgtgcagccggcgggaggcggcgcgcccgcgccccgatggtcgccgccggtgaccaccggcgcggcggagcggcggccgagagaggggaagggaagggggaaaagaagcggcagtccacggctcaccctaggttgacggcgacaacgaaaaaggcggccggtgcggaggaaggcggcagcgctgctcgggtcgacggggtcgacggcgttccggcggtcggtgagcgaaacggaggggtggacgaggtcggt

SEQ ID NO: 80159 - DNA, 2404 bp, Oryza sativa
aaacattgcatggggctagcaagatcaaccaactcctattctattttgtcttagagcaggtcctccctccttcaacctctttaccggccagcttctctagatcactcttattcatctccagccgatgcaaagtgttgaatagtctttatattgattgtggaaggacaaatgacataagatataagtggaagagcccctcacctcaaggctagcttttgtgatgggaaagactatttacgatcctacgcaaagaactccacggcaataagaaagagacaatttggaaaggtagatacgatgttgtttctcgttgttcatatatagagtccagcaaatggttaaattcagctctaatgtcagcaaggataaagaagtcatcaaaagctctaatgtcagcacggataaagaagtcatcaaagttaagaggaacataatcccagttgagcacatctctacataaacaccaaacaaccagttcagcacatctctacataaacaccgaacaaaatacgccaaagggcagctaaagattatgtacatctctacagaaacaccaaacaaaatgcgccaaagggcagctaaaaattatgtacatctccacagaaacaccaaacaaaatgcgccaaaggacagctaaagaatatgtggtttgtagtttctagatggacagtggagaaaaaaattctaattttaaaatcagtaacaccaaacaaaatgcgcctaaggtcagctaaagattatgttgtttgtagtttctagatggacagtggagaaaaaaaatctaattttaaaatcagtaactagagggtgagcgtgtacggtacggtgttaacacgggccacggccggcggggagcacaaaagttacagtctctatatttattttagtgctagagaagacacatatagtaaggccctgtttagattctaacttttttacttcaaacttttaacttttttgtcacattcaactttcctacacacataaactttcaacttttccgtcacatcgttctaatttctttaaacttctaattttaacgtggaactaaatacagcctaatatatgctactccctccgtcccaaaatataaatatttttaaacttcgacacggtctttgagatactactttgacaaataatatctatgttttaactaaaaagagttgtatattatgataatttgtttaatgatcagtctagtaacatcaaattgacatgatcaatcttttttcttttgctattaatagtcaaaatttaaaaggtttgacatcacattactctaaaaatatttatattttgggagggagggagtatcaatcatttgaagagttcagtgacattgtaccctaaggacgaaacgaatactggtttgacttactcttgtttcgtcgtcacgcgccaggccgagaacgggtccaatggaggatacctcaaatacagactcagactggcagtataggaagttgtgtcgttgctcctccagctggagaagccgatcagtacacagtactagtatcacagtactgtatcagtatcaccttgcacacgatctatcgacgctggatcgccgacggcgatggccggcttttcgttgaccacttgtgctaccggcctcgtcatcttcttctccgtctgctacctgcagcccctccggctcctgtcgccgccttgtccttcaactactccaacttcagctcaaacaaccagaacatcgaaattgaaggcaaagcctccatccgcgtcgggtatattgacatcagcgcgaacgacgctcgggacattttcaccagcgcgggacgggtatcctacaagacaccggtgcagctctgggacgccgccaccggcgaggtggccagcttcaccacaaccttctccttcaacatcgtcaccccgagcgataggaacaacaggggcgacgggatggccttcttcctcggcagctacccatcgaggttgccaaagaatgcctccagtagtggactcggcctcaccaacaagtcctacaccaacgtctccaccggcgaggaccggttcgtcgccgtcgaattcgacacttatctaaaccgcgacttcgaccccaacgcaacctacgaccacatcggcatcgacgtcaactccatcgtatctgtgacgaacgagtccctaccagacttcagcctcaacgggagcatgaccgccaccgtcgactacaacagcagttcgagcatcctgtcagtaaagctgtggataaatgacacaacgaagccgccttacaacctaagcgacaaggttgatctcaagagcgccttgccagagaaggtcaccatcggcttctcggcggcaacgggcgcatcagttgagctacaccagctgacttcttggtacttcaactcgagcccgtcgttcgagcataagcatggac

SEQ ID NO: 80160 - DNA, 840 bp, Oryza sativa
agctctcctatttcatttctagcatatctttagggggagctccaccaaaatcctaatcttttattacttctaagtgtgttgtcatcaatcaccaaaaagggggagattgaaagtgcatctaggaccccacatttattttggtgttaatgacaacataattagagggtaactaatgctttttgttgagatgtatgcaaggatgaaaaaggagtggatgtcaacacaataagtattgcagcatcttttgtggtaattgtcttctaatccatgtatatcttgtgttcttgagtattaggatgccttactattaagaggaatgccacatgcatataattggtagaacactagtactcaaaatcatttatttgaagtgttcctgttttatgtctgtcggactatccgatgttgatcagactatccgaaatttcacagaactttgctcactgtcttgggtctgagtgttggctaaaatatatcggactatccgatataaggtcggactatccgatacgtcagactatctgaaatttctcagaacttcactctctgttttgaattgctttttattccttttgaaatttttggttcaaaaataacggaatatccgatatgacatcggactatccgatcgatcggattgtccgaaattctccagaatttcgttctctgtctctggcctgcttgggggtcaaaaacatcggactatccgatgtcacctcggactttccgaggtgggatgaaaagattctctcccaacggccacattttgggggcttctatgaataccccccacctaacccttttctagggttacccaactcattcattcacattcacttt

SEQ ID NO: 80161 - DNA, 2482 bp, Oryza sativa
ctttgctagctgaggacggcgatgctggtagtttctcagccatgagagaacgctgttgtgattctaacttctaatcggtcccaccgggcgtgccaaaagcgtgttgatgtaaaaacacaaggcctgggagatctgcttaactccagtgcaggtccagaagcttgcctttaggtgtatgagcgtgccagttgatttgatcctgcaatcaacaagaaacaaagataaagaaaccgcggttaaatccataaactaaatgccgatgacgtattatttatcttgaagctgatgtcatatgtggatcgatcggcaatcatgaataagtaagaaagaactaaatctactcgatcggctgtagatattaacaatatataatccttatgtcgatacatacttaaatcaagtgattgtgatagatcggtcgccatgccgagacaatataaatcacttagatcgaagtatatgttaacaatgagactatatatgttcatagcatagccgatcagatagatctagcatgtatcggtgtaacaccccagaaactacaatgacaccgggatgctactaaatagacatacatttaacaaagaggagaaatttcgactgcaactcctttaaaacataagcattgcggaagcgtcaaatataagtatagcattgcaagtagccatccacaaaaaaacaaggagaaaggaacattcagggatgaaataaactaatttcaactctcagattcatctagtgcaacttaacaagggtacagttcctttattatcaaaatcatgaacttgaaagattaaggtggcagtgtggaatgcagttgtgcttctactcctgtttcccccaagcgagcatatcactttaagcacctgaaaacactgtaggggtgtgagaataaatctcagcaagagaattgttttatcaagttatttaacctaccaaatcattaaaatatatttataagaaaacaaaggaacataacattaaatataaaggcaaacatctagtgttcataggttcaagagtaaggaggataaaccacatctgcaaagacttcaggagaaagaagccctctcatgaactcaatagagtatataacttccataccccaaaataccaaagtgcaatgcgatgcaaatgcaatgatattcctgccttcacacccaacaaggtgtgaagctgcatcgtgttacgacaatacacgatgctgtatcggtacggtcgcgaccataggttcacgacataacttcaaatgaaatgcatatgaaatgcaatgcaatacaataatagaggaaagataacacatccacaaatccttccaatgatatcacatataataattactctcactaaaagcataccacattaaccatagttagccgagcggagatagctcagagcaagatacataaaataatcatttgcacatatggaattatagtgattgtaggtattaaagtgtcaaggtggaggttggaaaaaataacatgataaaaccgtagcaaaccacagctacattcacttgcctccaatgaagggttggtatcatacacgatctgaaggaccaccacctaatcacaatcaaagcctcagcaaacactctcaaatatgaatatataacagtaaataacatgcatctacggcctcaagacctcaaaacgcaaaaacaagaaacgccgcttggactataaacaatactgttgcttcaaacctttatatctcgaaatataaaaattgtatgactgcaaataaatacattttggaaatctacagaatgagacctacaactttcgtgtagaacccatatttttattctgccatttagatggcctaaagctcaaatcaagacaagcttcagaatctgcccaagaattcagactgccacacttaaaacagccatatctggagttctactcgccaatcaaagtgtactttaccaatatggaaagctaaggaaaaactctacaacttcctagttataaactttcgcagcaaaatcattttgatcctctaattagcgaaatacagagacacaacaaagctgacagggcctagaaacactaatccaaaacacaacacctaatcccatcctctaaccttcgaataacgccgaattacaaccctaaaataacctacaacctctgcacaggagagttaagcctcacctagggtttggagaacttgagagaatatgatgggaaaaccaactcaccactcttcctgctcctctcctcttcctcgatccgtttttccaatcagattcttgattagggctatggttcttggagatccatggagtagggctaacaggggagaaaggaatatgtaagttccataggtgccgagggggaggtgtggcggcgtcggctgggaaggtgggagtcgcctctccctagggtattaggggggaggtgggctggactgctgcgacttggcccaaattgattcggcccaattccaaacatgttattttatttttaatttc

SEQ ID NO: 80162 - DNA, 3178 bp, Oryza sativa
aggtagttaaatcaagtaagatcggctgataccccgaagtaaccctaatcagcaccaaaggcaggctagagattgaaattctaatcatgactcataagatcaaactcaactgatacagctataagtatgacaagaaggacaatatctagacaatcaagccgttggatgtttcatagagtggtagatgtcctatacaatcaagtcagcgttgatatttaacctaatcggctgccttctagtaacagacgttagccgattagaggttagatagcgatattgccagagattatataagatatatgataactcgacgaattacagaaacaagattagagtatcataaagatggaatcactaatcccgagaacgcaagccgccgtaataagttttacctctagttgaagatcgaaaccgatgcagctcaacctgaaagcaagaacccgtcgaaacaaaacggaagtaaaaagggtagcaatgcgccgagattgtattgaacgagtgttagtttgattacatggggctcaggtctatttatacccaaaaattacaaaatatgtccatatcggacatgtttcttgtctctaacaaactctaagataccataagtctttgcggcagacttttgcccaaacaaatctctatggaaattacataaaatatcctacttaatagatacaattgccttcttacgactctatccatgtgtggcaatcatcatgaagcacgtcatcctaacccgacaacatatgccgtgtcatattgtcggattcgtctcaatcggctaaccctgtccgactcaaactctgccgatcttagtcgtagccgattcggactccagccgatcctcactctgtttccgggacagtctctatctcgaactccgtcttgaatcctccttcacatccgatccttggattaccaaatttggtcgttagcacatatctaccatctcttagagagtagctacttttgtctcatatgcttgattgttatgctaaatatgccctttatattaagatcttattgagttaaagtatattaggctttctgtttaatatatcttgtctgttctaatatcttaatatagagtggtatcggagtattagccgatacatgctagatctatctgatcggctatgctataaacgttcgtataatcattatctgaatgtatcttttcacttaagtgatttatactgtctcgacatactgttcaatctatcccaatcacaaaatttaaatatacattgagagaaggattaaatatgttgatatctacagccaatcgagtagatttagttttatattgctttattcttcattgctggtctaatgccaataacatcggctcaatgattgatcatatgtcatcggctcctagccgatcggctatcgtttatagatttaacctcctttttcttgtcttttcttcttgttgattgtaggatcaaatcaattggcacacctttgaacctaaaaacaagattttggacctgcacaggagttaagcagatcttccaggccagtgtgtgtttttcgcatcaacacgcttttggcacgcccggtaggaccgagttgtaacaattcttcaacatggtggatagcaagcaaacttctaaacccccgtcctctaaaccaccgccgacggcagaagtcatccctgagaacatcatcccaataacactagataagctgacgccagaacaagtggcagagtatgagcagatgattaacaatttgaagactcagtacttgcactcattcaagcagatgcattcaggcacagttatccagaggtacaaggtaaaggtggtttctgccgatgatccagaatcaagtacatccaaggatggcaaggtgataaaggtgacaaagatgatgaacctaaggatgatgaaactgggggagaagagcccttggagttcaataacttctaggaccaagtcgagtacactgttcatcaagctctaatcaaccaatcaggagtgcttgtcaatactttgaaaaatatgatcaagtttgtggttgatggcacaattgctgagcatcaggctaagggaccagtctttctgccagaaggcgtgtttccgcagtacaggaatttagtgaccggcaaccaacagcctgctaccaatgtacctccagggcagccgatggcgtcggcttcggcttctagaccaggtgtatcttcatcggcacaaaggccaccggttaatccttatttgctgaccagagaacaacctcaacacgctaggcagaacatcaatcggttgactcaggaacagattgcagcaatgttcaagccacctcaacctgttggagctcaatttatccctgaacaacaaatgcataatgtgcaacaaccgcctcagaactatcttggtggtaatttgaattttcagtatcggcctcattcacctcaggttcggtaccaactagggggatcacctcaacctcagcttctgcctcagttcaactagttcgatccaattcaacagcagatgcaaggagcgtctcaccaaaagccctgggctgacatgattgcatatgtgatgaaggagcagtttgggctaaaaccgaaggatactggaaatttgtatcggcacccctaacctgagtggtttgagagggttccattgccaaaccgatacaaagtcctagacttttcaaaattctcagggcaggacaatgtatcaacttatgagcatgtcagccgatttttggctcaatgtggtgaggcatcggctgttgatgctttatgggtcagattgtttcctttgacctagtctggatcgacatttcaatggttttcttcactgccttataattctgtttatagctgggccgatttagataaacagtttcatagttatttctatagtgggaatcatgagatgaagctttctgatttggcagcagttagacagaggcatgatgaaactatacagaattacattcagaggatcagagatatgaggaatagatgctatagtttggctttaaccgattctcagtttgccgatctcgctttccagggtttgatagctccgattaaggagaagttttcggctcaacactttgaaagcttgtctcaccttgcacagaaggtaactctacatgagcaaaggtttgaggacggtaagaagaattttaaaaaagtcaatcatgtctatcctta

SEQ ID NO: 80163 - DNA, 1897 bp, Oryza sativa
ggcagccgatgggggaaaccatcggagttcacagctaaattcggtaagatcattaacaagtaccaaagaaggcatgataagcaggaggaaaggtatcttgaagatgatggtggttttgatccacattgggattgtgtgtctttcaggttctgctggaatgaagggatgaggctgccatcaatagaagaatgccctagatgcagtgataatgcagggagctcgagccgatcctacaatagaggaaatcggctaaatcagaaaaaattgcctgttcatcagaggttgggtcctgtgcaccaagatcgttttcaggatgaggatgaaggcaggaactcacagtggtgtccttttggtttttttactaagaatcagaagtggagggtccaaaggatgaaaaacagggagcgttttaaggaggtacaacaagagatcaaccatcggttgaagaagacaaagcaagaatggcgtgttaagagtaaagttacaacagccgatgaagttgaagccaacaaggcgaagaggttgctcaaggccaaagctgttgcgtcttcatcagtaaacatggtttttatgctacctgcagaatatggagctaatcaagccgatgttgatgatgtagatgagacctctgctaagttgattttgtcatcggaacaagcaatttttgagaaactagaggggacagaaaatcggcatctcaagccattgtacattaatggatttgttaatgggaagccgatgtctaagatgacggttgatggtggggctgctgtgaatttgttgccatatactacattcaggaagctgggtaagaatgcagatgatatcatccagaccaatatggttcttaaagattttggtggcaacccttcagaaactaagggagtattgaatgtggagttgacaatcggcagcaaaactgttcctactatgttttttgtcatcgatgggaagggttcctatagcttgtcgcttggaagggattggattcatgcaattgttgtatcccttcaaccatgcaccagtgtttaattcaatggcaaggtgacaagattgagatcgtgccagccgacaggtcagtcaatgttgctggtgccgatttagctatttgggagatggatgggattgattgcctgtctggaaaagtttgggaagatgattatttaaaagtgttcaattgtgatatacagccaattgaagatggagagcccaaattattacattgagggcgccgtggagggttcaaatttctacaccaaggacacggtagatgatttcgatggcaagttaggacatggtttcatgttggctgatgatctggaagaagttgaatataggtctaggggatagaccaaggccaacatttgtcagtaagaatctatctgcagaattcagaaccaagttaatagagcttttgaaagaatatagagattgctttgcttgggagtattatgagatgccaggactgagccgatcgattgttgaacatcggcttcctattaaaccagggtataaaccacatcaacaaccgcctaggaggcgcaaagccgatatgtatgatgctatcaaggctgagatcactagattatatgatgctggttttattcggccatgccgatatgctgagtgggtttccaacatagttccagtcataaaaaaaaaggcaagcttagggtgtgcattgattttcgggatttaaataaagctacccctaaggatgaacacccgatgccgattgcggatcaatcgattgatgcagcttcaggacataagattataagttttatggatggcaacgctggttacaatcagatttttatgacagaagaggatattcataagactgctttcaggtgccctggtgcaatcggctgtatgagtgggtcgtaatgacttt

SEQ ID NO: 80164 - DNA, 1811 bp, Oryza sativa
  unsure (1)..(1811): unsure at all n locations
ggttaccagctttacaaaatggagcacagagagcactcggagatgattaagtaccaacagacaaggggtatattaagggggtgtttaggtgagagaaggactaaactttantccggacttattttttttgtgagagggaccctctcacccaaacaccctctaaacctctaaagactagacggcagcaatctaaaacagaccgaacgccaaagcattgcacggggctagcaagatcaaccaactcctattctattttgtcttagagcagctcctccctccttaaacctctttaccagcttctctagatcactcttattcatctccagccgatgcagaggactacactgcaataagaaagagacaatttggaaaggtagtattaggggtgagtaaacaagtttatccctgaacatgatgttgtttctcgttgtccatatatagagtccggcaaatggcagcaagcagggcatttttcacaactatatgtttaattcagctctaatgtcagcaaggataaagtcatcaaggttaagaggaacatgatcccagttcagcacatctctacagaaacaccaaacaaaatgcgccaaagggcagctaaagattatgtggtttgtagtttctagatggatagtggagaaaaaaaactaattttaaaatcagtaactagagggtgagcgtgcatacggtacggggtcgaccacgggccacggccggcggggagcacaacggctacagtttatacttattttagtgctagaggagacacagacagtaatacacgctacttccttcgtttcataatgtaagtcattctaatattttccatattcatattgatgctaatgaatctagatagttatatatgtctagatttattaacataaatatgaatgtggaaaatgctagaatgacctacattgtgaaacggagggagtagtatcaattatttgaagagttcagtgacattgtaccataaggacgaaacgaatactccactttagtggcatgtggtttgacttactcttgtttcgtcgtcacgcgccagcccgagaacgggtccaatggaggatacctcaaatacagactcagactggcagtataggaagttgtgtcgttgctcctccagcaggagaagccgatcagtacacagtactgatatcacagtactgtatcagtatcaccttgcacacgatcgatcgacgctggctcgccggcggcgatggccatcttttcgttgatcacttgtgctgccgacctcgtcatcttcttctccgtctgctacatgcagcctccggctcctgtcgccgccttgtccttcaactaccccaccttcgcctcctcacacaaccagtacatcgaaattgaaggcaatgcctctgtcagcgtcgggtatatcgacatcagtgcgaacagtgtgggcaacaacgtcggacgggtgttctacaaaccgccagtgcagctctgggacgccgccaccggcgaggtggccagcttcaccacgcgcttctccttcaacataatcgctccgagcgatagaagcaaaaagggcgacggtatggccttcttcctcaccagctatccatcgaggttaccagtgggccacgaaggtggcgaaaacctcggcctaacgaaccagacagtcggcaacgtctcgaccggccagaaccggttcgttgccgtcgagttcgacaccttcgtcaaccccttcgaccctaacacaaccaacgaccacatcggcatcgacgtcaactccgtcgtatctgtgacgaacgagtccctaccaaacttcaacctcatcgggaacatga

SEQ ID NO: 80165 - DNA, 7799 bp, Oryza sativa
aaacggagggagtaacagtataactgtatacgtgtgggctccttgaaaagctaatattaaggtggaaatggattagatttgcagcacacaactgacagatatatcaatcaatggtgatattctcttgaatgaaatcaatggacatttcttgaatctatctggaatcaaatttgaatatatagtatacaattcacacagttttcagtctctgcattgtccttcagtccagccacttgtttggcgtcagctttatttgtacctgttcctgtatgtggatgctttttattactcgatacaaacgcgtacaaacacttcgcatgttcccgaattcatttttttttgttgaatcgatgtaacattgacactgggtgctcaagatgtcgaagtttcgatttattccaataacaaaacctggaacaaccagatttaaacaacatgaaatatgattcattgacttcattaaaaaaaaattgatacattgaagattcatagagctggtacatggaagattcaaagctattgatcaaaatgggtcttcaaatccccaaccactcgagagcagctgcatgctggctagacttggtcataatttggggaaaaaaatctctagaattcactcctatatgatcactcagacgacaacatataaatcaaacttcattaaaaaaaacatataaatcaaactggttagaattctgagccctgcttcaaattttcgattagtcaagccttgcatggttataaacaggcatatctacatgaggtaactttatgaaggagaaaattccggataagcatggagtgaatatgctattttcaaatcaaagtggcctgaaaacatatatttgaaatcaatggttaactgatatcgtgcaatccttttgaacatttatgcacaagagtgttaatgatgctcatttagatgatttttcagaacctaaatgctttccattgttatcccaaaatccatttcaaagagggaaattaagctaatatgagatttacatagaacatctcgcaggatatggtagtagctagtatcatgttgtttcaaaatgtcacaaagatatgtacattactagtatcttatacattactagtaacaatggagagaaccatcagtttatataatcattgtgggcaattttgaaaggaggatttgatagaaatctgcatgaaaatcttccaagggaaaacttatttccattcatattagagaagaaagggggaaatggtaactagttattatgacaattaatacctggaggagtacgtataatatatctataaaaaatggagaaaaacaatgcatttcatttaccacgcattagctgcaggatatacaaatactgtacgcaatgaatgcattgcatttatactgttttgcaaatcacattgaataatactgatcaagatcaagatccagtcgtccgtggaatagctgcctgcaggcaattatcccaaaagaatagtccaaatccatatatttctccacaacagaataaaaaggtatacatatataagagataatgagatgacatcaaggacagatatttatcaacaaacataatattagcttgcaaaaagaatttaaaatcgacatatatatggctttacgaacctccctcaaacttcaacaaatgcacaaacgtttgtcctacttgatatacatatatttatcgaattatcgtgtaatttaccatgtagaagtcgaaggaccatgcataaacataaaatcaaaaacatgcgtggataatatatgtaagaaaacaataagcaaccaagccaattcggagaaaggaaaggattaattaggagaaggttggaaaataggagggaatatgcttggctccgtgcacgccatccatcataggcaacctctcgcagaagtttgttgctctagatgagtggcatacagggagccaggcacattcccaatatcatcacctttgctttagatcaattatccatgcattgatctccatcatctccttctcttgtcacctagatctctcatctttgctacacatatatctccatgcatgtcaatgccattgcttatgcatggatttgctaccacaatacatgttgcaatatgaacaatcaccatctcctgaactactactacacaatttctccatggattgttgacgaggacgacaagatctagagagagagagagatagctaggaagaactagagagagagagagaaatgatgtggtgatgtgcaaggtgaatgggagaggatactctatatataggggggtgatgatgtgtgagagaggaagaatattccgtgcacacatacaagctatgaaaagaagacaactcacaaagtaaaaaatagctccatgaaaaccgagctggctctgcagtaatttactcgtggtaaagaaaaaaaacggtgatctccaaccaattaaatcactgttctcaccactgccagcataaaacagtgttaataagcaggaacaattcttagcctgcattgattattttatcaccattttcgtacaaaaacatataatttcgactgtagccagattgctgtttttattaattgccacactactgtacattctgctcatgatgttgcactagtagctggagtacctaaaagttaacaactatttacttgctttttgatttttgcagaagtgcagagcatgaatgattactactacatgagtagtgcaattccatcttgacaagctgggccgaatgcattgctaggccaaatttctgtctcacccaactcccaaagctaggttgggctgggctaaatttaaatgaatttatgcaccctataatatatcaacaagttttctctctttcaaatctgaacctagaaaaaaataatgataaaaaaaaatctgaagctagaaagactctgagcatgctctgtgaaaccatgataatattttttttatactctccgagtgctagattgtacttgtcagcaagcccctcgaaattcctggtcgaagagggaagtcgccggcgagggcgccactgcgccgacgaaggaggagaagctagcggcgacggagtagcagtggcggcggcggcggcgggagaaagacatgaggtcgaggtcgctgcacgggtccggcgatgcatcgcgctgggacccaccgccggtgacggcctcgggaggcgccgacggctgccaccgccgtcccgccccattaattttgggcgagtttgtttgaaaactttttattgagtaaatttcactgccaatatttaactattaatgcaaatttcaatttattttgaccttacttgcaacatggctaacgctaccttcatattttcacttgcaacatgtgttcttctacttgttggttttccacgcgcatactttccccactactaaatggtatatttttttttcaaaaaattctataagaaagtgatttaaaaaattatattaatatatatttttaaaattttttaatgaatacttgattaatctgctaataaaatgacatgttttacatggttatggattagttcgcaatacacaacgtcatatatatttgagcttttgtacttgtgactgggtctatggtttgggccatcacgttagcttcggcccacgctgcgcatgcaggagacagtgggccgtgttctatcaccgtggggcattgaagtctaagcgagatggcgcgagagtggctacttgactagagtggcaaatagttaaattcaccactttttgagcgccggagtttgttcgaaaattttggttttcttgacaattgaaagatttgccatagagggtgtgttcgatatatatttgttgcggttgtacagtgcagctgctatgttttcttttgcgtgggggcattttagctgtgatgtgactgcagcaatatgaaccgaacatagccatatgcttcatccgtctcataaaaaatcaaatcatggttacaaatctggacgtatgtacttgttaggaattaaagaataaaaaattgtgggtagaaatattaaaagtagtaacatatttcattaagaataattgctaaatatacttaccgtcgatattaaaaaaaactttcacatggacactaacaaattcttcagataaaacattctgttaaaaactttatgttacaaaaagcttatatagacaaatagacaaatgtcaatctgtattttaaatatattcaaaaatcacttttgaaaaatataaaataccattaacataacattagcctgtaaaggcctcttgcaagccccactctgtcaaaaaaaacataacatgtatgcatcattcatttatttttacatgtctctatggcaagaacattctgtatatatccaagtatccaactatatttaggaggataagatttgactaatgtatgattcttcacccagtgcatataagccatatacctgaattcggctggtacaatatatatgtttgcatgtagcttactagtcggacgcccagagttttttctcctgaattcagccgggtctaagaacttaatgtgatactccctttcgtttataaatatatatcgtttaaatatgtatatatggtgtcaaacatcaaaatattaactcactaatatctgcaactgcaaagttgtgaaaatttgatatgtaataatgatattcatagagttgccataaaaaaataatttcatatagttttatttttatataattttcataaacatatagtcgtaaaagataaatgcctagatgataagttaaaaataaaggaatggacggataagtttgtgtcacgatctatatgacaataaaaaaaaatggaaggattgagtccctgctttctgggaatcatatcatatatgcccaaaaatttacgatgcacattctgtgtacaccaacaaatttcacaaaatttttagagaaaattacacacatacttctaataatttatgcaaagtatcatctttagattcattatatttttagtcgtgaaaaaaaataaaattataacagattttcttttttatggtgagaatataataaatttaaagttaatattttatagatatgtgcaatactattagaagcacatgtttttttaaaaaaaatagatggtggcatttgttaattgatgtacacagactgtgatacctttcctgttttcaaacttgtagagttacatgtgtgaattagtaaaaaaaaaataaccccttacaagccaaattccaacgaacagtgtagtacagtaaccacaaactaaataatttttgtcctttcttttctacaagattatctggaagaatatttgatttgaatgtaaagttatccttgccacgtaaccaggctcatccctttctctttcttgccatttgtttacaagtgttctctcttcttttctgcacttggctcgatcgatcatcaccaaagtttaattacccttccgacagtagtttacattccaatttgatcgaatattggtggaaaagtgcaaaggtgagtcgacgattctccacttcacatctttaaattaatttggatttcaataaatttattagaccaatactgatcgatcttataccattgcttgcttcattaattaatccttcggagtcctttgtgtcgaattttggtaagttgataccggataagcaaaagctgcattgctttcttggcatggattaattagttgagagcttgtttttacacatcaaactaatgcaaagcacagtcagctatttgattccctaaaaggtataatttgtaactataaataaagttagtatatatacacgaatcgaattgtggcttcttggaagttcatagaggtagccatgctcagataatgtgattcgaccggttaaaagcaatatatgatgtaactatatatataggtgtcctaaaatctgttctaatccatttgcttgtagttatatgtaatgaaaaacacgccctattatggaatgcaccattttttccatcaatcataatagacatccacgaaagattaatgatatatatagaatattcgatgggcagctgattacgagcgctcacccctaaaccaccatatataattatatcatatcagggtatcaacaacctcgactagctaaatgaccggccaattgtttcctcgtctaagctattgtagtcattcggttatcttaggtgggactattaacagagaacctaagataaaattttaactttatatatttatatcttatacatattacaactccaaatcctatatattaattggttttgtacatatatttgacacaaaatatataacaatagccttctcacacgaatgttaaaaattttgattggcggccctaacgtcctatatactacatctgttttttttttaatatatgacatcattgatcttttgacaaacatttcttattcaaatttcttatgtaaatataaaaaataagttatgtttaaagaatatttgacgataaatcaagtcacaaataaaatgaatgataattatataaatttttcaaagaagacaaatgatcaaacttatctgaaaaagtcaatagcatcatatattaaaaacggagggagtatcaacacacttgtttcacaaatatgctttcgactttgaatttcatttttttagaaaaaagaattaactacctttgaccgcagagagagcttggagagtatatgtattgacacattaaattcaatggacacgtgctagagctcgcatactgatcgaacacgaccacatcatatatccttgtgggcttatttaattagatatgctacatgaattaaacacgagggaaattctatatatttggatatagcaatgaattattctacatgaaaaacacgtacgtacgcgtctgtgtttgtatactaatcagctggtcggccaagcgtgtgagaccagccaaacaggctagaatgtacgtaaagtatatattgtgtcgtgtgagagtacatatgtcaatatttggatcttgagaagatcaagctagatagatatttccatggagaaataaaggagatctgcaagcagctagctgattgatttgcacttttatctgcaacctgtcactatgagctatgcgctaactttagtacaggatcccttgcattcgtataggtgccagttttgaaactggcacctattcgattgaggaaaggtgtcgcttaccagctaaaaaaatcagcacctataataagttcccaacctatacaaataagacaacctcatcttttcgcttatacttacacttattagtcaaaatttaaattttcactcttaaatttgaagttgattttgagtttttttttatcaaagtttagttttcagcatttatttttagatagttaagaacacgtatataaattttggctcagtaatccgtatttatatgcatataatgacctgctggttttctttttcttaatctactgcattgcattttcttttttaccattacttgattgagaaaataattttaaggtgatcctttcttaccaacaaataaaatacatatagagttatagatggctgattgttatgcattatattattcctaagaaaacatatatgctttgttcatttcaattgatttactaatggatcgaatgaaaagaagaccgtaaaccaaggctcacatataattgtccttccttgattcaaaatctacatgcaaataaactagttgatcaaaccaatagatacgattgtacacaaatttaaaaaatatgacattgtattaaaattgcacacaaatttttaaaattgcattacatttgaaattaatatgtacaatatagtatatgtggtcattt

SEQ ID NO: 80166 - DNA, 6944 bp, Oryza sativa
ttgtgtgctgggccgttgttgcccgtgtaataattatatttacgcttccgcttggtaaactttgaattgtatcaacttttggtgtaccttgcctcttgggacaaggaataatacacgcacgtcaggaacgcctgttgggtgatttccggtcgtgacaattcaccctggtagtactaagatgtaccaggatcttaaggaaagattttggtgggcaagtatgaagcgtgaaatcgcagaatacgtagcagtatgtgatgtttgtcagcgagtcaaggcagaacatcagaaacccgccggattgttgcaacctttgaagattcctgaatggaaatgggaagaaattggtatggattttattactggtttacccagaacgtcatcaggccatgactctatttgggtaatagttgacagacttaccaaagtggctcatttcattccggtaaagacaacttattccggaagtcgcttagcggaattgtatatggcaaggattgtgtgtttgcatggcgtccctaagaagatagtgtctgatcgaggcagtcagtttacttcaaatttttggaagaaacttcaggaagagatgggttctaagctgaactttagtactgcttatcatccgcagacagacggacaaaccgaaagggtgaatcaaattttggaagacatgttgagagcttgtgctctagatttcggtggaagttgggataagaatctaccttatgcagaattttcatacaacaacagttatcaagctagtcttcagatggctccttacgaagcactgtatggtcggaagtgccgcactccgcttttgtgggatcaaacgggagaacgtcaggttttcggaacggatatcctaagggaagcagaagaaaaggtaaagatcattcaagaaagattgcgtgtggctcagtctcgtcataagagttatgccgacaatcgccgcagagatttgagttttgaagagggagattatgtgtatcttcgtgtcacgcctttacgaggagttcatcgttttcataccaagggaaaattggcaccgcgttttgtgggaccttataagattgtcagtagaagaggagaggttgcttatcagttggagttacctcaatctttggcaggagtccataatgtgttccatgtgtcgcaattgaaaaagtgtttaagggtacctaccgaagaagctaatattgagcggatagaagtccaagaggatttgacttatgttgagaaaccaatccgtatactggaaacaaatgagagaagaaccaggaatcgagttatccgtttctgcaaagttcaatggagtaatcactcggaagaagaatcaacttgggaacgagaagatgaattgaagtcagctcatccgcacctgtttgccagttcttccgaatctcgaggacgagattctgtttaaggggggtaggtttgtcacaccctgaaaattcaaaatatataaattgttgtttaattggaatttttagaaataattttaaaagtcttgaaaagaaaatctaagtttaattaataaattccaatataaaattgggccagataaaatttcattaaatactttgcttaattctataattcctagatttttctgggatttatttgagctaagaaagtatttgtaataaatggaattgcatttaagaaataatttaaattgaaaaggttttaaaaagtcttcttttggctttgggccgaaagtcggcccaaaacctctcttctctctctcctcggcccagccggcccagtcagccgcgcgcgcgcggcctcgctgtcgctgacaggtgggtcccgcctgtcggagtcgtcgtctaccttcggccgtcgccgccgaaaccctagttcgcgccgccgccgtttcctttccaaatccggccgcctctttccttctccggccgaatcaatagaggggaaatgatctccgggatctcctctacattttctcctttggaatctttggttaaatcgctttggaaagctttggaatcgagttcgattcggatcggttttccctctctccaagccgaaggtttccttcgccgttgccgtcgccgtgggccttcgccgccgcctccgagcccctttaaaaggacccccggtgtctcctctacccgtcgcagccctcgccttcgcctctcgtcgccggaagagccttagcgccatgtgccctagcttcgccgtcgccgccgccgcttcagccatgctccgccgtcgctccagctgtcgccgccgctcgggaagaccgccgtcgtcatcgccaagtcgccgccgtcctcgtccgccccttcgcagccgttggaacccgccggagcttcgtcgccgtcgacaacccgaaggtagccgccgcttccttctcgtcgccgtcgccgtccgttgcttctccgccgtcgttttggtcgtcggtgtgttcgccgtgtcgtccgcttcccgttggtgtcctccgttcgtgccgtagcgccgccgttcgccggtgagcgtgcgccgcccgagccgtccgctccgccgagccgccgccgccgtcggtgacgtcatcgctgacgccatcggggtcgtccgccgtgaaccgccgtggactcgatcaatctcggccgtccatcttggatcggttagatctcggccgtccgttcgcgtgaaccgccgcccgtgcgccggtccaccgaaaccctagccgctgacgcaataatccttcttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatttacacattaaaaatatccacatgtactgttcatgcttgtttatgtgctgttttggtgattttgcttctttttgcttagattccgtcgtttctggagagtccgttttcgcggaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggccctttcgtacttgattaccttattccttgataccttgggttatattaatttgactagttgagctttatttatattggttcaactagatattagatataattgcttagccctgcttagaaacattagtacatttatgggataactaatgactcactattatttcatgatggcttattgatagttcacgatggtcaatcgtgattagttaattaattaatgtgccaactaaaacctgataatggtgggttgtgggcacatggttttgatggtcgtgctcatgacaattaaggaccggttcacgagtttcagttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctggccagagtaaaactattcgaatagccgtgcccgcggttatgggcgggtctaacaatgtctttcgtgattagtctcacacctctcatcattgtaaaagatgcttaaactggtaataatttgattagctcctggtttggaatgggacattcctggtttggagatagaactgtgcagccggggtggttgttcagaatggttgggcctatacaacagggtatgttgtatagcgttggattaatattgtttaattattacttaactgttttgttaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagaactttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagcctctttgaccctaggttatgccaaatggttacccatagaagccctctgaaaaatattggaaaagtagaactgttctcctccctttctcttttaattaaaccaaactaatggcacatgcacttcataatctcttttaatggttctcattcaaaatttattccagtgttattagtactgtacatctattactgtactaatggctcattttaccagcaaaagttttataatactgttttatttaatcttgctgcaataaaataaatttatcatgttgattttatcattttctttcatttcttttgaaaccagttattcaaaattacaaaatttgtgacctcgtttccaactattttaacttatctcgcaaagcttggtttactttatttacttacctttttactctgattttctaactttattcaaattaatccaaaaacttgggctattaattggataaaggtcttaactcccttctttcacttgtctttagatgccgcgttacaagcctgagtacctgtttggtgttgagggttttgtccaggagttgcgcacgatgtcctttgtcattggatttgggactgcccctttttatgcccagattcctcatgatcgtcatgaagagaagtgccgagtcaaagtcactttgaacagtaatagtgaagaggtcccctcagtgatgtttgaagctggaggaagaaactacatccatgcatgtcaggaggtggcaaggatcgccataggagagctccgtgatcgctacagtgatcagttggccgacattgagtatcgctaccatcctcgccaaccccagggaagtgaccgtggcagttaccttgagactgaaggaattgagaatgatgttaccacgaaacatttggttgagatgttgtgggctatggatgaaagtcgtgcggagactgtattagcagctcaagatcgtgaagaccggaatcgtggtaagatttgcaagttagaagacaaggtggatcgtttggagaaggaattagccgcattgaagggagaagcaccgccgcagaaggccaggattcgtcttaccgcaaggaagagagctctatttgtccctcgctatcaattggcgccaaaggttcgtgtggtggagaaggaagttgccccagctcaagcggatccttcggtcatcatcataagtagtgatgaagaagaagaatctaagcacaacaattccaagattgagtgggtagcaactcaagatgataaaaacgagccttcaatcgacctccgatgcttggaagaactagagtgacttgttaagtcgttgtcttagatcgttgtgttagttggtttgctttaagtttgcttgtgtgtggctcgcatgtgatttacatcagtggtgggatgtaattgcatgtgtttgtttgcttttgagtgttaggaagttggtgagtttagtggtgtgagagtctttagtttgtaataatgaaactcagttaagatcaataaaagttaaagtaattctctgtcctaagtagtttccccggtttctcttcttgtgccctgtccatgccagatggtgaacactcgtagcaatgggaatggtcccaacaaccccaataacaacaacaatggagagaatcccactctggcccaagttcttgctcaacagacacagcttatgaacatgatgatgcagcaatttcagaatcagcaaaaccaaggaaataatcaagcactctctttgcaacgtagcccctctgtcagaatagaaattcaaggagtaccatttctggccaatcttatcttgttaaaatccaaagaccttgatgtcatcctagggatggactggttagccagacataaaggtgtgatagactgtgccaacagaaaagtaactctcaacagctatgatggtcgagttgtaactgttcatgcattgtcatctgagtctttaaggtcaagactgaaccagataactttggaagagattcctatagtccgggagtatcctgatgtgttcccagatgatttacctggtatgccgcctaaaagggatatagagttcagaatagatttggtacctggaacaactccgatccataagagaccttatcgaatggcagccaatgagttggcagaagttaagaggcaagtagatgatttgctacagaaaggatacatcagaccgagttcatcaccatggggagctccggttatttttgtggaaaagaaagatcatactcagagaatgtgtgtggactatcgtgcactaaacgatgtgactatcaagaataagtatccactacccaggattgatgatttgtttgatcagcttaaaggtgccactgttttctccaagatagatcttcgatcagggtatcatcagttgagaatcaaagaggaagatatacctaagacagcttttaccactacgtatgggttgttcgaatgtactgttatgtcttttggacttaccaatgcccctgctttcttcatgaacctgatgaataaggtggttatggaa

SEQ ID NO: 80167 - DNA, 58158 bp, Oryza sativa
tttggtaggatttcttatatagttatcaaaatttggtagaaaactaaatgtagctacttttttggtaactttaccaaaatttggtaaggttgaaaatggcatcaaagtgaacaggcccttaaaacccaagccatatcattctactggaacatctttttggaccttcatagcaatgaagagcaccaagttacgaaaaatttaaggcgttagggcaccactgtatcaaatggaataccatgaaactattgatgtggttaaacatgcagaaacacaaaatggtaatagccaggtaggaacgcaaacctgattggctttcctaccaagccccataaggaaattatcaggcttgatatcacggtgaagaaatcccttctgatgcatgtactcaactcgattgatctggataacgaacaaatggtgttacgtcaggaatctatatagggcaagatacagataccagtttgattctacaacgattaacaaattagaatatatggattgaggaaatttgaaaataaagcatcagtgtcctcaccatctgatcagcaagcatgaggacagtctttaacgagaatttcctactgcaatagttgaataggtcctcaaggcttggcccaagaagatcgatcaccatcacattgtactctccctccacgccaaaccacttcaagtgcggaataccagctttagccaagaaaaaaggaaggtcaactcaatcataacagtcatagaaggcgataacaaagtaacatttcaacaaaacggatacgctaacaggctctaggcgcaaacttacttcctccctgcagaagcatgtacagcttcgactcataatgaagctgtgggtgcttcgtcttaacattttcctgtgagaccaaagcaaacaggtcagcaacaccaatgtctgaaaggtttcactataaccaaattcccaatagtaccaaaatagtaccaaaggaccaacattcgacacaaacattttactacactgttcattcccatcccatgatctcacggtaaataagaaattttatcaaattattcttcccccaaagaaaaagaactcttctaggtgcatcgaaaatggaggacagaatccaataccaatttgacggcgacttcctctccagtctgcacattaacagctgcaaacaaaaaagaaaacatcaacaaagtgagcatcttccatttccaaacataataataacatgttcttcagaaaagataaacatgagaaagatatagactactgaccaaggaagagctccccgaaggatccactcccgatcttctttccaagcttgaacttgcccccgactacatgatccatctccttgctgctccgatggtctcaaccaaacgaatcaactgccccccccccccctttcccctctaatcccaccccgagatccaaacccgtcgaggcgagcggcgccgcgccgaggcgaatcgaatcgggattcgggcacgagggcctctaggacgccagatccaggcaaaccaccaagaaatccggtcgaccaaactcttccctccccccacaatcgaacgaataaaaaggcaaacaaagggaaaaaaataaaaaaaacgaatatgaacaaatcaaagaagaatcggcggattaacaggaggtgtgcggatccggagaaacggatacaaaaaggggatttctcctaataaaattccctgcgccctctcggcgaattcgccgcgagaggtagagagagaggggaagcggcggaacaaaggggaggagagagagagagagagagagagagagagagggtggaggaggagaagacgaagacggagaccagcaagagaaaaagagtgaaggagaggggacgattagtaaatagacaccacccgattaaagaaactgattaactgggagcaggttgtttgtttttttttttcgtttttacaagtaattgacaggtgcggccatcttggtttgttgctcttttcttttccttcttcttttctctctttttctggcactttattgtttcttgtttgttatggtgatgggtgtagtacgcatatagtagcagcagtttgtttggtccccttttccttacaatgcctcaaaacaaaacaccaacaaattgtttagctttaaaagaaaggggagggtcaaaaatagttgcttcaaacaaggggagtatctttagttgtagacttgtagtagtggttgaacgtaccatgcttgttgtgctcttaaaacaaggaagtgatgtacacgttcggggcttttcgtggtaacaaaaactaatgcttgtgttccttctcattttgattatgatatatgggaaaaataagttcagaaacacgagttaatagcgtagcatcttgtgataattaccttcctttcaaaattatcttatgatgatttcgtgttatactaaatgatactgctttatataagtttatgacggagctaggagctaccgaggattttctatatggcctacaaaatatgttgttgtgtatatatcataatactaaggatggaattgagagtgcagtagcggtagcacaaacccgactcaaaaggataattgttctatgtttgtgacatagcaatttgtgatttgaattactatcttttgattgtagcattaaaaacattaaaagtatgggaatcttttttttacgaaacttatagagtattatacttgaactctatctattttgcacttttgataaaaggagtgcatttgtgtctctaaacaaatcaaaatcataatatcctactccttcgaatgccttgtacggtgagaattgaaactcgcgcgtgtaaatatgttatcatatgagtatttaggtggcttctaaaggtaggatagggcattcttaggataagggttgacgtgcgtatagatctcaaaatgggatacgacatgatctggttccacgtcatataatatttattctataactgttttgtttgactcgttttaattgctccgctaaacgacatcattccttttggttggttggatgttatgctcacggacattgtctttttttttccgcctatgccttcagtggttctggagtaggaccaatgtctagaaccctagcaccgagatagatggtggccatgtcataggcggatgaaaacatgtccttatagtgtcgaccttgtacatacgtaggcggataagccattttggtgacgacgatgcaatcacgagcatggtaaggactctctgtaattgatgaaactggcgatgagagtgctcatgtcaatgtatcaaggacgggatcagattttacgaatagtagagaaaaaattgtctaggggcaacaactcctaataaaatacaagaagttatggcatgattgattgtgatggaactcgccatatttgaagagtgaaactcatggcggagatgatggaccattttaatttagattactaagtgaattattgtctcggattatctacttgactatagagataaactaaatatttttttaaaaaataaatttgatagataatttaaaataggtgatctaaataaataatacagtagaagaaagttttttaaggaagcatattttccgaagcgtaaaataaataatccgatttataatatgaaatgaacatgatcaatgattgtgcacaattgtgtcttcatcttatggtatttgcaggatcattccattcctactacccaatctcaccacatcgttcaaaacaacaatatgccatcctcccatcacataataattttacagccaatctaaaaaaatataaaacctttcatttagttatgggcccggaaatctttctactatttactctgttttaaaatataattattttgagaatttaaactttgtaccaaaatatttagcatttatagaacattaaaatataagtatttcaaactaatcagaagcttgagaagagaatacaaaattcaaatttgaactaacgagacgattaaaaaatatttcttaaaacaacctaaatttttctattttaaaaggaagtagtaccacaaaggctgttcccaattcacatcgtgctgaaaaagaatcccacatcttttccacttcccataaacacaaaagttgagatagcttaggggcattttgcgtgcggataatgctaccgtccatcgagccctcgaccctgactagacaggaaaaccagccgaaatgacgtggccaataattaaagatggccaattttataaaaagcgacttgaaaaaggaaaaaaaataaaagagagagaagagggaggccaatgttgcaagtagcagagcagtgtatctttttttcccagcctttttaccggataaaacgctgtctcgtggtgggccccgctacggtaggtagaggccgacacgtcttggcccccccccccccccccctttccccccagcgactccgcacgggaataactacgcggatagcggcccatctcggccgttgatcctccgtgtccgacggctgagatagcgacaggttacggacgtggaggagcaaagctggcgcctgggtggagtacggctgatctgggccgtccatccgcctactggcctctttggaatggacggtgctgcgcgacagttgaccgctgacggacgcggcgatcgtatggcggagtacggcattttcacggttgcttcccttccatgccaaactcgttcttctcgtcgcctttttttttcttttttaccgaaacgaaacaagtcacacgccaacgattccaaacatattttcctcgtgacgctttgataaaaatatataatcagatactttgacatggagtaattaacaagcctcagttatcgatgcacaaatgaatctatccatcttctgaaaaaaaattcactaaacgtgggttacctggtccgacgaccagggaattgaagtttgaacttggaacaggtctgtgtaccacggagctcaaactccagaaatattaagtcccacgttggaattaggtaacttctgaactttatatagattcaatccttgcaaaatcccgtacggctcatgtactcgactcaagcaggcatcacgtattaatagtttcgagttaaccagcgaggggagaatgcatctatctgtacacgagcttagtacgtaagtacagggtcacagaaaattcagaaatgctggtgcatatgctggaattgtctgcacaggtttgattaccaacccagtgatgattatcactaatgagtcaatggtagacactactagacagcatggcctgagagcagttagctatacggggatcagacatgattgccaacataagcatgttgataaaagacaatgcctgcctactgactgcatagtgtccaaatgatcatctggaacacattacggattagattaacaaataagaatgtgcaaacctgagaacctggcaagtggcaagagaccgagcaatgggtcacagccagagataccgcatcctgtcatcctccacaagttgatgcttatcatgcggcttccttccaggagtgcacatgtaatgtaatgcaatactacatgcaaaggaaagcaacaattaaagcaatagctggtagccaaagttgaccagatagcaaaggagaaaaggttaccatacctgatcagctcgtacaagcctcctaagctgttttatatattcatataagcagtgaagttgctagtacttgagaagacaggtacacattactttctcgtgataaatggggccatttcttaatgtacatcaagcctttctaaagaatgacagggactgaattcatgtagtattagattatcagaaagaagtacagaaatgaacttgatgggtactcactgctcatcggcacaagggtaagttcgctttatttatatattaggtacaatgccgtagaaagggatgagaaacagaacagaaacaaattgtggaagtatgattaattagcaccagaataggtgtagaggtgggaacaatcatcaacggtagtaggccatgtggcgtgaagatcggaacggtgaagcatcaaatggagaggagcgcctgggctgggtctcaggacggggatgttctttcttagggagtttggtctcagatcgcagccatgactcgacaactgacagcaagtttttggcactctttagctcctcaacgtcagagtattttgctgattttctcaattcaccttcttggatgtatgcaatgtcagtagcccatgattccaatccatcaaatatatgagtggcatagacaatggttgcttctctctgcagtgccgaaaccttccatgttatgcaatgagaagcataacagacagaagagatagaaagaacaaaaactgtacctgttcacactcttccttaaagaagtcaaggagatccattctagtcacaacatcaagatcaacggtgatttcatcaagcaagagtacctgtattgatctcaggtgtcatagtttcatagcagtctttggcactacactaacacaaatttaaccatgagaatacctctagccaaacataaggtagtttttctatctttaaactaaaatgatgtgttgggtgaattctcagaatagtctaggcaataatgctattacccttttgggggcacaataccattatcatatcagggagcactcagcccagcaatgagccaataactatggcgtactacaaatgtatgatggagcactcaagagttattatgtctgtgagtcactcttagggtgctacatatgaaataaaagaaacaacagaaaactaggaacacggtatcaccttgtatggatgaagaagacccatgcagatttgtaccctgcggcgttgtccatctgagactttatgcatgcgccattgcagatcaatatctagtagatcaacaagcttctctcgcctaacaggatcaaccccatcaactgctcatgtttcagggtagagaaagaaaaggcatgcttacatctaccacaccagcatgaactgctaaaagcatttttactatagtaaggttgacttcattaattaagcttgactaaactgaataacaaatctaggagcagcatctatttaaacaaaaaaagaagaaagaaacatgcaagcagaaagttaactgaaagaaaggattgaaacctccagggttttcaaataattcaaggaccactgagtatgtgaggcacatcattgctttcatcccataagaacccaagaatgacaatgggatatgaggagcattattgtgcatacagtacctccaaaaatcatgtgttcagcagagaagtcgccttgcagaggaacgtcaccctgagaaagttacatgggtgttatatgcatataaattgcactgagaaaccaggcaaacgcaagaatgaattgtcaatgtgtagtctactattgtcatgccatttactgttatcaaactccacacatatgtaataaaaaaatcaattaagtaaacatgaatcttctaataattattttggacagcacataaaccatttcagagtcaaagacccctaaaatctaagaaagtaaaacagaatgaaccaaagttacaaataactattcagctaacattggtgaaaagtagggaatggcttccatgaatttcttggaaaaagcacgttagcaagaaatgcacttgtacaaacattgatcatgaagaaatataaatcaatgatgaactaatttctatttcttatagaaagtaaacagaaaggaaaacttacagctgaaccgatagcccgactccatgaaccacctaagtaggaaaggtcaccgttgcacacaagctgtgtgtcatgaaaagcagaaccattaagaacacggacaacatctcttcctccaaccatatgtttccccgcaagaatcttcaagagagtggtcttgcctgtggtttggcacaagttggtacattatataggtgtgcatgtgcatgatagattacagaagataagaacataacatgcctcaattacaggcactgtacatgattgtgcagtgattgatttaaaaaggagagaatttcttttgataaagagcacccttattcgcatttgcaagagcaatgtataggtgcctcacaactatcaatgacaacttgagtatataataaaaagtataactcgtttgaactccatttttccccctatcacctattcaccttagtatctacaagcattccattgagattgtgctttagctccaactttgctcaagcactagtgcagaacaaccttgccttgaagaaggctgaaacgtcagaatgcggaactccaaaacatcaagggtgacaccatacacaaattcatggtcattcaaattcgaaagggcacactagaaacccgtattgcaactagcaaacaaatacagtaatacacgcgaattgcttcaaaatacgaatagaggaaccatagatcaatctatatctaattctaatccaaacgacacgcggagtgaagatagcctatatattatagctaaagccaccaatccacgcgaatccatcagaagagctcgcccggagcatcgaatagtggaaatcgacgaaactacgtaggaaccacggctgatgggaggggttagggttaggcaaacaaaacctaacctgatccgttcgcgccgatgaggaggcatcgtgagccgggggcgatgcggagattgaaccgcgcgaagagcggcggctgcccgtcgtagtcgaactgcagtgcgctcacctcgatgccgctcctcctccacccttcgtcctcgccgccggccatctccgcagcctcgccgccggtgggtgatccgagcggagtttggtgggggaagtgggaactcttttcccttggctgtgtctccgccgcgtcagagcctccgtgcacttgtatcttctcattttctcacgcgactgcccaccaaacacgactactgggccttgggccgactccatccctgggccctggcccatttctcacttatgggcctgggagtaacaacgaacagctccacctaaattttcagttttgaatttacacaaactatgcacagtgtagttttttttagtgtaaactccaaatttctcatttttcgttagcacgttttttaaactgttaaatcagtggcggaccttctcttgtggcaagggatggcgccggccatacctacaaagtaggtagggtattcaagcatatgaccatctcagccttgatttcagatgctaattatatgattagttggctgtatttcatttggtacaagcttattcgtttagttaactggtggtaaagacctatagggggactgccttgtgtctgcacaaatgaatgaatagtctagctaaccacaaaatgttaatcggtaaaaatcgaatgctaaaaaatagatatgtaacttaagtgaatgtctacttataaataaacacacctaaaaaacaggaaaacactcgtagaaatgtggtttagtcataaaagttacacaacaaatttaacactcgtagaaatgtggtttagtcataaaagttacacaacaaatttaaggcttcagttgtaaaaacttcatgacaaatttaggattataatcatcgttaatggcatatattctaataagtacgaacatattatagtttgtgtataataaaatgttacatcatttttaaaataccacgcacttcgtccttgtgtgatgatccgccatagctaaattttagtgctgtatccgccactgtgttaaatgatgatgttttttataaaaagttttttttatcaaagtttattcgaaaaatcaaataaacatatttttaaagtttgtaataactaatactcaattattaatgaactaatggtttttcttgttttatatgtcattgaaaagctaaatcaagctgagattcaaacaggtctaaaatggtaatacagacatactcacatcctaatacaatgaatcgaatactgttaatagattatgtccagattcattgtactatgatgtatcacgtcgtagcacgattatgaatctaggaggggtaggactatgaatctggagtttttttttaagtacggagggagtaatatagaaatgtactagtgaccaagcaatagacagaacagcagcacagcagaagtaaacgaatcgaatcatattcatattcaccttgttggccacagacgcatgacccgcagtgtctagccacagccactcgtgtaacatggttacacttcagagtttaggtttgcagaaccagcctatagctagcaaatttacagacagaacagagccagactatagataaatgatgatacatcgttgccaccgttgaaatgccaccggcgacaaacctacgaaagatctaaccgatcttcttcaggttggaagagctcaagctctgagctcacggatgtagttagggctcattgggttgaccttcggcgagagggcggcgaggtgcacgtcgttcagtgccgaattgagcttgctctccagtgggctgaacggcatctgctccgtcgccggctgcttcttgacagcgcgcaagcaggctaggtagctgttcggctggttgttgcagcttggcagcttgcttatcggcacccctgcttccttctctctggacaccggtgcgccagaaggatcctgcaccaaatcagagatccccacatatttctccttatttgttttcactgacaagattcgatcctccaatgcaagatgtgatagtggatgaatgacattgcaaggaggaagaggtagcagagaacacttggatgaaagcatggcataggtagtagtagaggagctagatgacgtaccccgagaaggaggaaggtgaactgctgctgctgcttgctccctgcttcttcgaagtgatcctccaagagctttctcaggtcagaaagacacgagttgctcagcaatttcagaccttttatcagatggccggactcccatttgatgtagacttcaagcaggccgtcttgtccagaagcattgttctccttgttctcatcagctgcctccaaagcattgcatgatttcagctgctccgacacgggcaacttggcatcgtccacaacttggcagacgataggtgaaagctgcgaggatactggactgtcggtcactctgacgtcgcacattggaggttctatcgctccccatgctgaagggtccttgttctcatctccaaacactcgcttcgcaggctgctgcttgttctcatctccgaatgtttgcttcgcaggctcattgttctcatctccgaacgccttctttgctggtgactggaccttcttggctaattctcggtgattcccacaaagcctgaaaatgttctgaatccggttattccttgtggcagggtcttcaggctctgcaaggggctgttgcattacatagctctcttcgacaacttccttgcacacttcctcttcaacgccactgtctttatcttcttcttcatctccctcctcaaagacagtgctcaggaccaccttttctgggtacccagacagcctcacaacatcatcttcttgctccacagcgctggtgcaagagcctgcagtatttgcttggctccatatctggccctgcttgcgagtatcctccttgatcaccttcacgtcttgcgcagctggctgatctcccatatcaaaatcaatggacatatccattgacatggactgatccgccctagcggacatctctgacagacgtgccagcaatctacctccgatgatatcctgctgcacaggcttttcacgctcaacctccttcagccgctgttgcaaagcaaggagttcttgctgctgcctaagcattttctcttccatcttcatgagctcagtcctcaaactctgggtcttctccatgacctttgagttaatctcttcctcctttgcagctgctccctgaccttcaatcagcttgagcttcgccctgagctgtgcaagctcctcttcctttttccttagcacactctgggcctcattgcgctctttctcccttagcttgttctctttctggagattgtagatgaactgattcatcgcgacaattcttgaattgagcattgtagatgactcttcagagctcattttgtcccttggggttgcagcgtgggcagcacggataatgcacttcgctttagcaccatactccaatgtagaaactgtcttgtgcaattcctttgggtcaggacttgcacagagaatcatcaagatttttgatttgtcatcctcaaatgaatcctgaaaattcatggaagatcgtaggcattacgttagcagctttaattttacagtataaatttgtatcgaggaatgtgaaattttagaatcttgtacctgcaagagcattgtgagcttgctgtctcgaaatggaacatgggagtcaccattagcaatggactcaaccactcgtttcaaagccgtgttcccttggttaatctttgcagtctgttcaacagtaataataatgtaaacaaaatatgaacttctgttatcgaacacataacataatttgcaggaaaaaaagtactagtagctaatctttgcagtctgttcaacagtaatgatcatgtaaacaaactatgaacttaattatcaaacacatacaataagttgcagaaaaacaatataatagtagtacctaaagtacttaaaaacagcgtgactgtgataatatcactttatcattcaaaaaaagggagaaaaaaaacctacaatgtggtcactgctttgcagaccgttaactgttatgtttagatttttcattacacaacagtgttaattattcttctgtattaggtattcattgttgaaggggtaactttaaaaacgtcctgctgaaagtacaaaattatacaggcattagtgacatcacagacctgcattttggcttcaaatccagtttggcctgctgcttctatgttctcagaaccagccatatccacaagcatgagccttccccccaccgatggaacatccaaaattatctagagaagtaaagcgaagcttatcaatagcgagttcatttttgaaatgaagattccaggagctaacagctcaatacgagaacgcaagtgtgcaactaaccatgcagtggctccgggaactcctctcattacaaagcgtgctcttgacaatacgcctcttttccacttttgcaacttctcttgatatcttcccggcttcatttccagatatgtaggttgcattcttggctttcttccccattacttctagcctcgcctgcacataaagtaaggagtaaggactgagaaacttcaacaccatagaaaatttccaaagttacgcagttaaaactattaaaatcttctgtccatcatatgttcccgaaaatcatgttaaaacctatgataagtatgccaatccttggaacttacaagccatgagcttcctatttaagcttacagtaattatccactcaaaaaacaacctgtttcagctcacagtaagtatttcagcttccaatttcatattaccatttgtttatccctaaaatgctgcaatccgagcaccagaaaacaacttaattcagcttaaagtaattatccgctcctaaaaaaaatgtcagattcataactgacaagcaagattcactgaaaaggacagtgacagtaagaaagcagacaccacctgttaactttcaaacttcaacacacatctatcttaattaataacatttcctaagcactaggcatcatcacatatgaacccaattgcaaattgcagctgcattactaacagttaataatggcatgtggaaaattagtttcggtgtatcaccttgggggcgtttcctttagcattcgctccgctccccacgagcaaatcgtagatctcctcgttgtagatctcgagcacggcaacctgcacgaacagccccatcccgaacccggcgtcatcctcgccacggccatcgccttcacccccaccaccagagacacctccccctcctcctcctcctccttccagtatatcccggagagcgcggtacacgatcccgggctgcttggcgcagccgaacatggtgtggctcttcccggagcccgtggggccgtacaccatgacggtgcacttggcgcccacccgcaccccctcgatccgcgaccgcacgaagcggcggtagaacccctccagatcctcctcctcggagaccgagaccccgtcgagggtgaagtcgcggcacccgccggcgtcgccgcggacgcgcacggccgtgcccccgcccgcgatctccagcgccgacgcgccgcccgcccccgcggcgaggttccggatgcggccgatcacctccaccgggtgctccgtgccgcccgccgcggcgcccccgccgccgccgttcctgggcgtcatggccgggaagtggaggcggtgcttggatgcgggcgtcttgagcggggtcgtcatggccgcctgcggcgtcggcggcggccccggccggggagagggcgtcggcggcgccatctgcgagagagagagctcgctagggtttggagatgtgaactcggattcgatgcgagagaaagagagagagaattggagatcgagttgcgggtgaagagagagaggagaggagagggctgggacttgggaaggggaaggatttgaaagggaagtagccgttggagtcgtaacggtaagtgtgtttgttttgaagctggacgagagggagaccgcaccgcgccgtgtaccgcccgccgcgaaatcacgagattttcggtcgatgcaaaatgggggaaaccatgcatcaaaattgaattctgaaacaattttatatggtaacttttctttgtttccttcttaagaaaaatgctccctccatttcagattaagatgttttaactttggtcaaaattaaaatagtttgatcaactttgtagaaaaaaatagtaacaaatttattatgaaaatactatatttaattattgatttgatgaaacttatttagtattatcaacattattatatttgtctataaacttagtcaaagttgaaatgatttgactttgatcatacttaaaacgtcttataacctgaaacggtggaagtaatgtagaacgatatctcgttcggattgaatgatacctctaagatatcacctaggcacttgatttttgataggtatcagttgatacctgttcagataagatgatacttaccagatatcatacgatatttttaaggtatcatttcgttcaaacgggataacatcgtatagattttactcttttttttttgtccaacgtactatgtcggtctgatgcgaatatatagtattgtttggattctactatgcatttatgggtttagtttttttatttggtgatatcctttgtctgaacatagaatcgggtggtggtgcagcgaaactgtgcaaagataattaatttgtcttccgaaactgtgaaaaataaatcatatagtgatgttaatcaaagtgtttttttatttattactcctatctacttgtggagtagctttaaaatcatcttataaatactcgtattgggatcgagcgtcacccaagtagtactacagtaatttagccgatttttttataaattggtcatttttaaaaacttattttgaaactagtctctgcaaaaaactttaatcaaaaataggccatggactcagcgccatggacattggcgctaaactataatccgtggtgatatgaattcgctgagtcatcagatcttagcgccaaggtatttggcactgaggtccagacggtttaaataatcgcgcaagcaacatatagaaccaagaccgtgatagcgtggtggttggatgcttgggctgtcatccatagggtactaggatcgaatcctggtttccctcatgtattttacaaaataagttttgttctcttcactactcactctctttaataagttttgttctcttcactactcactctctttacaaaatgactgttccgtttgtaaatttgttttattttgaatttgatttgaaatttcagtttaagttctcatttgccatataatatagcactttaatatttttttaaattaaaaaaagtttcatattaaacatatattttgaagatagtattacaagacaaaaaaaagaaaataaataaataaagatagaaaaagaaaacgagataaaaaaaagaaaaaacatattaatactcactcttattctttacaaaatgactgttccgtttgtaaatttgttttattttgaatttgatttgaaatttcagtttaagttctcattttccatataatatagcactttaatattttttttcaaattcaaaaaaagttgcatattaaacatatattttgaagatagtattacaagaaaaaaaagaaaataaataaataaacatagaaaaagaaaacgagataaaaaaagaaaaaatatattaataaagagtgagggagagaagaaaaagggaaaactaaaaggaaaaaaaagaaaaagaaaacgagataaaaaaagaaaaaaatattaataatgagtgagggagagaagaaaaagggaaactataaggaagagtgagggagagaagaaaaagggaaaactaaaaggaaaaaaaagaaaaagaaaacgagataaaaaagaaaaaaatattaataatgagtgagggagagaagaaaaagggaaactaaaaggaaagaaaaaaaaagagagatgggagtcaaaccctgctcttcaaggatagagtagaactctactaccattatgctatcaatggggtgttactataaatgcctccgcatctatttaaatcgtctaaacctgagcgccaaataccttggcgctaagatctgatgactcagcgaattcatgtcacctcggattagagtttagcgccaacgatgttggcgctgatacgttatagcttagcgccaatgtccatggcgctgagtccgcggcctatttttgattgaagttttttgcagggactagtttcgaaataagtttttgaaaaggatcaatttgttaaaaagtatatacagtattttgtgttccattatcttcatttcacctggtacgatgtgggccccgaagtggcccatgagacggggaaatgtaacatccgtacttatgggctggcccaatacggacatattcgtatttccttttttttttcggggatattcgcttaggtcttgagccccgaacactagtcgaagttgggaagcatccaatgaggtatggaactataaaaaataaggtaaaatctaaacagagaggcctctctgtttagtctctgtttagtcttaataggagacggtatagaaagtctacgtacatagcagagaaagcctacacatctgtacgggagacaacagacaaatgcctacacatctatataaaatttctttttacccttcttataaaattttctctaaaattacttatccgatatacaatccgattacaccattgtattcattacaattaaatctttacaacaagatcttacatgattatattgcgacgaaaaaaatatttatgtttgtaaattacttttattatatatgtaagttacttttatcatatatataaattacttttagatttgactaagttacttcttatacattcataatgctctaaattgattatttgtattattgtttttagtaaattctgtaatttgtggactttaaatttaatttttcgatagaccatattttctttcctacaacgaatttacttctaatgttataacaatttacttgcattttatgctaagttacttttatgatttatgtaaattattatttctactatagagagagttagaagtacttctattacataactaaattaattctgttgcatataattacttctactacagaaacttatttctattgcatagctaagttacttctattgtatagctaagttacttctattgtataactaaatcacttctgcaatttaaatacattgcttttaaattaataaaatatttgaatatatatcaatatggatcttgtattgtcacatattttatgtagagcataatgacgcaaatagatactaaaaacaatacgtgatttaaaatatataagttattaaagagcttaaatcacatatatgacaaaagtaacttacatatataataaaagtaacttacaacatatatatatatatatatatatatatatatatatatatatatatatatatatatatatatgtatgtatattatcagaatataatcatgtaagattttgttgtaaagatttaattgcaacgaacacaacggtataatcggatcataaatcagataagtattttaagagaaacttctctaaaaagaaaaaaaaacatagatattgagtgtactggtagcttcttttggaaagaatagtgtctctctttagcactatcctgctagtactctcggtgtagttgtgtccaaaaaataaactttgttagcaagccagcggtaatgttgtgtttgtttgggactagaaacctcgttaacgcgtgatcaattaagtattagtaaaaaacttaaaaataaatcaatgtaaaatttaagcaacttttgtatgtattttaacagaaaacacaccgtttaatagtttggttaaaaatatttttttcttagagcaacttttttattttttttataaaaacataccccctccgtctcaaaatataagcatttttagctaaaaattgctatattttgggatggaggtagtacttattttgaaaaatatggaaaacaaaagaatataagttgtcccaacccctctccctcgttttccgcgcgcacgcttttaaaactgttaaacggtatattttttttgaaaaagtttctatatgaaagttgtttaaaaaattaaattaatccatttttgaaaaaaaataattaatgcttaattaatcacatgttaatggattgttatgttttccgtgaatagggtgagtagcgaacacacccttaatactgctctagggctgcacataatcgccacataagctgctattcggcgtcaaaagcgacataactttatcaatcctaattatcatcacacgataggtcactagcaaaactgacaggcatcaacctttccagacacacacagagtgacatagagatgctggcattatgctgcagtgtttaaattaagatgcttgctaaaattatcattaacttaggtcagacaactacacctcattgttatttgtttagtacagatgcatgcccatcgagctagctaaacaaaccatctgcttttggtcgctcacagttactatttgctgtcctaatcctttgctctagctaataagcagccgctgcaagaaaataattaagctgggctgcatgcatgcttatcatggagggaggagggagagatatcgctttgtgagaaggcaagatcacatgagctgagatgagaattgagaggagaagagagaagagagaagctgcagcttgcttgatcaggggaccaatcgccatggatgccattggggtccatgactccatggatgcacacacacactgtcagtctgtcaccgatcttatttatatgtgctagtggtagcctgttagctatgcatctttgctgctttgcccattctgaaatgagatctcagcaagccggccagcaacaagaatgcttctgtgcgtgaactgtaggacatctgaaactctcgatggatggattggatcaactgtcgctcgatcgacgagatttgtttctgcataggattatcctccatgaagctatcgcaggatatgatcagtgtagttagagactgtaacaacattattctgaatctttctacttgctgaatttagtagagagctgctcttcctcagcctcaagctagaagcgagttcagacttcagagcagtaaaattatactccctccgtctaaaaaaaagacaaaccctgggttttcatgtccaactttgactgtccgtcttatatgaaatttttttataattcatatttttattgttgttagatgataaaacatgataaatattttatgcgtgacttgtctttttaatttttttcatattttttttaaataagacggacggtcaaacgttggacacgaaaaccagggtttgtcttttttttttttgggacggagggagtatatctctttaattgtagaattatagcaaacagtgtactcgtacgtgatctggattggcacagtaacaacaagatttgagctagctaatggcgccatgtttcacagctgtgccctgcagccacgagagatcagggggcctacttgggctgagcagtagcgagatttgtcagagacagaagcatccgatctagtgtgaatctgcaggtacagagaacactgtgctgcccatatctctcaccaaccattagatttcctcctcctgcagccgttgcatatgcttgtgccttgccggctcagctgctctgctcatctcggtgaccaatggcgaattgtcgattaattgcctggttgatctgtatgtttgacacgaccattcagttctactatttgtcatcaagtagcagtaggctaattgcaattgcaaccaactaccgcgcaaacttgtctgcgtcaacacggcaccgaactgccaaacaacacaacaaccaatgacttttacaccgttttggtcagggcagggcagcctctcttattatgggttgattagttgcatggtctacagattaatcactgctagttactgtaaatactagtactcccttcgtttcaaaatatttgataccgatgactttttaatacgtgtttgaccattcatcttattcaaaaaatttaagtaattatttatttttttcatatcatttgatttattgttaaatatactttcatgtacacatatagttttacatatttcacaaattgttttgaataagatgaacggtcaaacatgtgctaaaaagtcaacggtgtcaaacattttgaaacggagggagtgctattgtactagcgatgatcacattagccaggttgctttatttggctgtgtcagtaataaagacaggagatataaaccgtttttatcaattattaagaggtgtttcatcagtcctaaaatgtaagaacctaacactggatgagatatttcctacccattcaaattcactgtactagaaaatgttccatccagtcctaggtttttatattttaggatggagagagtagtttgtttttttttctttttcttcttctttttctttcttcacgaggaggaggagatcgatcattagattcgatggatatatcgtagctaatgcgggtatggattattaaggatatttaaccgttacaaattcgtcctgcagctatatgccgtacgtgtgtcttggtcggccgtgtgtaaatctcacggaaaaggacgttgtcagggttgttcaacaaagctttaaagtgatgcaacgacaatgggcatagtgtcatccattgatgacattaatcttacacaagtggggtgttatgtcatggctcatggggaccttattcaagtttaaagagggaatagcaattaatggataagtgacattaatttagacaagtgaccagcattctttccctctttttagttatagccccccaatacaaaaatgcgtcccacatgtacacaatatcacagcactagctacactaactcataagttcaagtttctgattttcttttggtgccaggcaacgtgtgatatagtgacttcgttaatttcaagtctattagtctcaatcgttcgaagttgcttataagagcgcatatgcatacaattgataagggtgacgagcatatactggctccatcgtaaaatatagctatcagatgcgacatatcatgtattagttagataattcctccgttttagaatatagcaaattagaactagattaaacaccatataacacaatgtatctatgtgatgtccaatctagtttctggttactatattcctgagacggaggaagtatatttaagaaggatatagcaattgtttgcgtttgtattgcgtttagcgtagctcaactggttaggtttattgtggtggaactaacccacatgggcttaagtcataaacttgatacggatggtcgtattttactgttaattatttatttagtggtaggcgacgtaccccttgacagcgagacacccgtggtgtttcatacaagctttgaaattttggaattggttttgttgccggtggggaccggaattttagaaatttgtttgccgaaattatttgaaaatttgattgattttgaattaatttgaataaaacctgatcaaattaaaaaaaaattacaaaaaactgaaaatttcgggcaagatgtgagcttgccggggggggggggggggggtggggcgaagttaccaaaatttcagaaatttcgaaccgaaatttcaaaccctggtttcatcaattttaagatataccggcccagcctcgtggatatactcatagagacagggtatgcgtatgcgtatgcgtgtgttataagcaccaacgattgtactgtgtttctcaaaagaaaatcacacccgttacttacctaaccatttaaccaatgatgtttgcaccaagagaaaacatcatcaaccgcaacttacttagctcacaaaacaaactgtcctggcgaccatgaaatgatcacccgagcccatgacaccaccaaaccaaaccaaacccccccaagatcacccacacaaacacacagtggagggagggaaggaggcgccaatctagagcacacgcaggcaaagtctcgatacagcaggagggcgagacgcagacacagagagaggagaaaaaagaaaaatacagcgagacatcgcgcgaacaggaggaccacttcccccctccctcctctccagtctccctccgccgcgccgcgattcccctccctcccttctcccccccgcgccgtcgtcaccgccgccgcgggaggagggggcggatcccgaggccgacctcggcgagccagatctgggccacatgccgcccagctcggcctagatccgccctgacctagcgccgagcgacggggtgggggcatggaggacgcgtccaagtacgcgcacagcccggcccacctcgccgtggtgcggcgggaccacgcctcgctccgccgcctggtcgcggggctcccgcgcctcccgcgcgccggggaggtggccaccgaggaggagtccatcgccggcgaggccgtggccgacgcggtctccgccgccatcgaccgccgcgacgtgccgcggagggagaccccgctccacctcgccgtgcggctccgcgaccccgtcgccgccgacatcctcatgtccgccggcgccgactggtcgctccagaacgccgacgggtggtccgcgctccaggaggccgtctgcacgcgggaggacgccatcgccaccatcatcgcgcgccactaccagcccctcgcctgggccaagtggtgccgccgcctcccgcgcgtcctcgcctccatcaaccgcatccgagacttctacatggagatctccttccacttcgagtcctccgtcatacccttcatcggccgcatcgccccctccgacacttaccgcatttggaagcgtggagctgcgctgcgtgccgacatgacgcttgccggcttcgacggcttccgcatccagcgttcggaccagaccttcttgtttctcggggatggtgctcgtcctgaggatgctgggggcaaagagttgcacccaggttctctcatagtgctggctcataaggacaaggagatcacagatgcattggagggagcaggggtgcaaccaacggaggccgaggtcgcacatgaggtggcgttgatgtcaaagacgaacatgtatcgtcccgggatcgacgtgacgcaggcagagcttgtgcctcatttgaattggcgccggcaggagaggacggaagccgttggacattggaaagctaaggtttatgatatgttaaacgttctggtgactgtgaagtcaaggcgtgtgccgggggcgatgacagatgaggagctgtttgcgatggagggggaggagaagaatgggaggggcactgaacttgacgcggagctggatgaagtgttgacagccgaagagaggaaacagcttgattctgcgttgagaatggggaaccaggaagaagaatttgaggagaggtgcgaggaaggtgatggcggggctgatcatttggatgcaaatggcgtggcaaaagataagaagggatggtttggttggggtggcaagaaaggcaccaagaatgacgagaaaccatccaaggcgaatcaagggagtaaggatgaatcaggtgacctaggaaagggaaaggagaagaacagcagcaagaagaagaagggtgcatcatcaggggattctactaaacatgaaagtgaatacaagaaggggttaagaccagtgttgtggctgacaccagatttccctttgaagacggatgaactgatccctctgcttgatgtcttagcaaacaaagtgaaagctgtcagaaggcttagggaactcttgactactaaactgcctccaggcacatttccggtgaaggtaaccacctgccaacttgactatataatgtccacctatttcagcaattaactgaatttttgatatgccattcattttagtcaaaatttgcacgcttattcatttgcaacataaatggtgatatgattctatgtaactcaatcaacgactgtttgctgattgtatgagcaattattttgcactggtttctttgactgccagtgtttgttgtttgatccacctgctgtgtcatgcgtcgtaattcactccctagctgggacttgtgctgtctgccttgctgcttgtgcatagtactgtttgaacctggttatgacatgtgcttgaatatgaaattatgaatatgtgtttctttattgttggcgctgatgcgcggcttatggctatgcatgtggtttttttccctttagaccggacatattaatacaagatagttctgttcaagttctagaactagcacatcttatgtgtgtcctcccgggtaatcaatccctcgcactaacaaggcattatcataagatgtggtgcccgccatgtgcacaattcatatgattgatggatgttcgaataaccaaaccttttctattagttaccactactattggccacccatatggaataattagattccaataatagatattatatttgggtgtaaatgataaatgtgcagtgtacttgcaaaatatcattgactatttctaaggatttgatgcatgatggttgatgacattttttttccttgttgtattaaactttatatggacatggaacactatcgagttattgaatctagtacaaatatattgtatatttctatttgtctgtttgccatttcttttatgtggtgttaattaactttaaaagtagccagtgggtttctgctcccaccatcaatttaataatctcacagatttaagaaatgccaaaaaaatatatccattgaagctttcaaaactttcatatgtttatttcctattcatccactctatctcttcctctgtttgagtcttgattagctgggtcctactccaaaccaccataaaactgatgcccccctgtaccctactgaccttgtatccctaaatgcagttgatgatccatcgacatcttgtgaccactcttcctgtcaaatgttatttcatgtgtcatcttttctttggtgaatgctgcagtaatttttccattgcattattagactatttttaccgctttccatgttttgttgccatgctttattgtttctaaattggtacagatgtcttgtctcaatgtgcatagcaatctgaatcgtttcattttgttgtaacttttttggaatctcatcatttgttttgaatcttagttcttgttggataaggcattgtggtgccagtacaagacgtttgcactgcatcataattattatttcacatagtctcaaatttgaaatcagatctcttcttttaccaaaattaacatcactacagttacttcgaaaatgagattcacatgaattaatctatattttggaaaagatgatatctaactctctgtaacattgattttcagattgcgatacctattgttccaacaatacgagtcatcgtgacattcacaaagtttgaggaattacaacctttggatgagtttgctaccccaccctcaagcccaacgcaattccaggatgccaagggcaaagaatcagaaggatcaggctcatggtattcgtgggttagaggggggcgtggtgcacagtccagtgatagtggtgatagccgtaactggaaagatgaggttgatccattccaaataccttctgactacacctgggttgatgccaacgagaagaaacggaggatgaaggcaaagaaagccaagaacaggcggggctcaactcggaaacaatcatcgaaaagcacctcgtcggaaggaggtcacccgatgatggatggctttgaggagtaaaaaagtttcgccacatagcaggtcacctttcattcagagatgttagatgttgatgtcagctgtgctgcgcacctgacagcatagattgataatgtgctctggagaacgcgtagttgattggatctcctcgaggaagtacaggatggctatataccccgctaatctgtaattcaattctattttttgcccccttattttcttcttccagctggatgtatgtttgatgatcatgatgatacggccctgttgttgttaaagatgtgttttgtggggggctttttagctgtagcacttcccctcctgttgtacgaaaaccctcgaatctggcagtgattttctcgcaaagaggaagctcaatgcacatgcttgcttatgactgctgctgtccctcttctcttcgctttgtttccaaggaaactggacatcttatgcttgccagagacgttatcttgctttctgttggtacttaattagtacagctgctataacttgctgtagcttattgtgtttcaaagcagagtaattgtggtgctctcattgaggctaagcagatcatttacagtctgctgttgagagcgaaaccctgcgatgcagaaatgtacaaaactcatagttgatggattgaaaggatgttatatgattgtgaaagatcatgcagcttactgtcgatcagatgtcatcatttggtagcagtctctctcttcaaatgaggttattatggccacacacagtttgggattttgccggttggtaagctacgctatcagcttgagggcttgtttagagcgaatagttaaggggaaaacaaggttgaatgccagaattagaggtccaaccagctggattacgctgaaagagacgctacaatccttaccattagaccctgttttttttttcaacttcaaacttcctcattttctattagcatgtttttcaatatgttaaaatatacattcttaaacaattcctatatataaaagttattttaaaaactgaaaataactctattattcaagtttataataatctgtattaggtgcacttatattagtatattctactaggatatcctgtattatgtgcacttatattgggacgaagagaatattaataattaattaattatatgcttatgagatttactgttttgcgtgtgcttaaaattctccttcaatgggaggcaaacgaacgggcccttagaagctcatcacttgggccgagtcacgggccttagcccaacaagagaacagaactggtcggtcactgacaaagcgggccccacctaatgcggccccagcgcttttcggtgtacccatgccgcctgggcccacagccacagggcctcgcgctcgaaacatttcgaaatttgaaacgcttctcccggtcgtaaaattcccaaatcaaaccattccttccccaaaatctcgcaaaccatctccctctccctctcgtcttcccccagatccccccaaaccctaaccctaccatcgccatggcctcccgcatcaaggaccgcggcaaggccgcacccgccgccgcgggatcccgcccgctcacccccaaggccttctccgcctcgtcgtccgctcgccgcacccccgccgccgccgctgccgggaaggagaactcggcgtccaagccctccaagcccaccgccgcggtgcggtggtccacgtcgtcgatcccgagggccagcaggatcccgagctccgtggagtcctccaagctcgtctccaccctcagggcgtcctcggtgatgccggggagggcatctgtcgggaaggaaatggaggcggaggcgggcttgcggcggagcgtgagcggcgggatcagggccgctgccccggagagagcgaggaggtcggtgggtggcgttgggggtagggtcccggatgcgaggagagcaagcagcgtgcctcgtgctgatgagattggtaggaggagggatgggtttgatgctagggcgaaggcgagtgatgtgaccagtgggagaagagaaggctttgatggtaaggctaagcaaatgaatgcggttgataggaaaagagagagcttcgatgtaaaggcgaagcagatcagtgggaaaagagggagcttcgatgttaatgtgaccaagcaatgtgatgagatcaaaggggaaagagagggctttggcaccaacgcaaagaagcaatgcgatgggattgatggcgacaatgagggctttgatgtgaaggccaggctaggtgacgaaatcaataagaagaaagatggatttgatacgaaattggtgaaagagattcatcccaagaaagttatctctagtgtcactggttcggcagaagcttcttccaaacctgcaccttttcctgctactgagaaggatggtgacggaggcaacaatgctgtcatccctgtattcactgtccatgtggtggacgtggacgatgttccttgcagagccagggaagagcagaagaatactgatgagcctaagaagcaggaggaaaagagcaagctggcagacaagattagagtttttgagaaagcgtctgcaagtgggggatcagtgaaatctgtttctagtttgaacaagtacccaagcaagctgcatgagaaactagctgcattggaagggagagtccaaaagatagcgacagatatcaagaagaccaaagagatgctggatgagaataacccggatgagcctaagcagatattatctaatatccagaaggagattactgcaattgagaaggcaatttcccatgtcaaggatgataataagattcagctcggcactgcagataatagtgagtgtgagatctcttatgctaaaaaggctgcagagtgtgctgttacaaagccaagtgacccgaagcatgctgcaaaaggtatgaatactgatgaattagaggcgaggttctttccacatcataaattgttgagagactgcaaatcgtctagcgctactcaacaggaatcgtccatggctgtcaaaaaggattgtaacacagatatggaactttcttcccttgagcctcaagaagatgagaatagtatagccatggagtttctggcttccttagatggtgaagaaagcggcttcttcaagaaccgcagagcgaagaacttggaaaaaaccatcatctgtgaagcagcagatgttagcagcaagacatcgggccaaggttcctcaaataatccggtaggcccaaaccatgacaaagaaattgaattgcttgctacagagaagctagaagagtttgatgaacaggagaacaagtcctttttgattttacaggaggaaacagaggaattctctagtgatcagttattagggatagggaacaaatcctcaactggtggatggtttgtttcagagggggaagctgttcttcttgctcatggagatggtacctgttcttactatgatattgcaaaccgcgaggtacttgattcattactatgttttctttttgttcttttcataatttatgttaatacaacattttgaagttctgattgcattaaactgaaaatgacagttcaagtctgaatacaagcctccgagtgtgatctcaaataatatgtggggtgattgctggttgatccgtgccccgggtgttgacggatgctcaggaagatatgtagttgcggcatcagctggcaatgcactggaccctgggttttgcagctgggattactatagcagagaagcaaaagcatttcacattgaggagatatctcatgcttcttcagtaccatcgtccagaactgttcttgggcctcttcctaatgtaggttcatcaagatctagctctgcaatttctactgtagaaagacagcaatggtggtatagaccctgtgggcctctcctgctttctgctgctagtaagcaaaagatggtcacagcttatgacatccgagatggtgatgtagtgatgaaatgggaagtgagcaatcctgtacagggaatggaatattccagcccactacaatggcgtagcaggggcaaggttgtaattgctggtactgagtcgattgggttgtgggatgttaattcgcttaacccacaacccctgttatctgttgcttctgctggcaaaaagctttactgccttcatgtgaacaacactgatgcagagctgggcggaggagttcgtcaaaggtacgcctggaattattagcttgaatgccctttgtgtaccattggtaacactatactagatcctgtctggttgaacttggcttatgcttgcaaatgcaggattttttagttcatttaccaatagctgatttttttttgtcttgatcattgatgattctgaaacttggaaatgtaactaatctaaaggagatgtaagttctgttttgtgtgagctgacatgttttcaaagttaacttgtttatcgttctgttttgcagagttagttcctgtgaggtggagggaaatgatggtgtttttagcacacaagaaagtgttaatgtatttgactttcgtgtacctgctggcatcggtcttaaaatggcaagacatggtggtacagcaagttcaatcttctcacgtggtgactcggtattcattgggagcacagaaggtaggctgcaaataaaagggggtctgaaatcacgagttcagcaatattcactgagaaagggaaagcttgttgcaacctatgagctacctgatttcaatgcccacttccatcactcttcaataacccaagtatggggcaactccaaccttgtcttggctgcatgtggtatgggactatttgcatttgacgcctttaaggaggacggtcaacaaacttacagctttgaccgtggagccactcttggagtaagagaggctattggctttgatgatttgtactgccctacattcgattactcgtcatcaagggttcttcttgtctcaagagaccgtccagcacaatggaggtatctgtcatagctatctatttatcgtgtgcatcatgtgatcgacatgtaatatatttgtactatgtttatgctttagcttatttagtcatctgtagtgccaagcatcttgctttcactgtattagcagaaatgattgggtttcttccccttcagttaattaatatctattgcatgtttattttaccccattgtgttcttatttccttctctaacattgacatcttacttattttgtttatcggcaaattatttgaattcagtttgatgcaatggtgcatatgaattcatggaatattttttttggagggtgggcatccatctccagatacatacataacacaaccataaacaaaattaagatcttgttagcgaaatgacgcccaacaatcttcatcggaccaagaagggattattccttcttttttgacgaactgcctcgattagctgctctgatttaagcttattccatcctaatcagcaacatcatggtcttgtgcaccaatggtctctgcaaactttattaccacttatgtaccaaatctagcggcaagcagcatctccattcctggaactctgatccttactggccttgatgttggcagcatgccggcatgtcctactgcttaatcaatcagtttcaagttcacggaatggtaatgggacagtcttcactgctctgaacttgccaacgttgttcaaatgttcattctccaatctgcaatcccataaaccatttcaccatgttacaccataacattaaattaaaattgatgttccttgtaaaagtacttccaattacctatagaagttccaatggcctcgtctgattatctctagtgaagcgagcgagaaatccagtaagcgcgactcaaccttaccaatatggatcttcattacactctcagtccatgctaggcgaagtgcaagattgagcatctgtaattatttgaaggcattagtgtcctagatctggaattttctagcctagtcagaaatgaagtatattaagcatagtaccatggatacgtagtagattgatttattcttcaagatgagctcgttacgaagccatcggttctttgattttgggtttaagaagccccagtccttgacaaagtcccagtagagctggtaaattgtggcacctgaggatgaaatgatgaccatccacacccagaatggtgttggtgttgcagcatatttgaacctaacagcagctgctaccattgctgatacatattttccagcattagcaagttggttgatatcatgtccttcctccaagtaccttcttaaacacttcaaaacatgacacagctattagtttgaaactgatccaaacaaagttgttaatcgttagtatttcccatctaaagattcatacctgcaaggctctccagaagtatgggagaaaggagatcacataggccagatgcttatattgttggccactagtacaggtctcatatgggtgagttctaaagcttccagccatgaagtagcacgctgtaaattccatgtgccgtaatagtggaatctgcagatagtagcaccagttcactcataagatgctgagctccaactctcaaaagctctagtgtaaagttcagtttcttcagtattacctggctagttagttggtcagccatgaagaaatcagccatcagaacctgcatgtcaaagcagcctgcttatcagatagatgctttcaacaatttgtgataagaaaactcatgaggtctttagtctttaccttatagaatggtgaaaatatgatattgcgcatgacacgcatgaagcagtatcgcgtcgagcggtagaatatgtcaaatggacagaatagtacacctgttgacagctgaaacaacagaatccgagttgagaactgaaaatcagtacatgaaacagagctgaattaccaaattttcccaaagtttatgtttcttactagtaggagtgctccaggcaaagcattggcataggctacaccggcgttcttgaggaaaagattgatgaccagtgcagcgacaacagtgcacattatcgatgcagacatgaggaaggcgtcccggtgcgtcaaggcggtgtttgaggagaaatcgaatatgaagttgtgattgatccttgtgttcttccacatgaagaggttgcacccatacaggaagatgtggaggctgatgagagcaaacatgctgcagaagcaaggtcacatctatacattactttgaggtaaaattgcatcttttattatcatgaggtcctaagtctgaaatttgaaaaatttgcaaacattgagcccacatgctaaatctaatcaattgaactcttgtcaagaacagagcatatatagcctgaacagaagtaccaagtacaaacgcagtaataaaaaatctatttctaaatagtgctttacccctagaactgaaccgtaattctcaagaatttacctgaaaacatggtacacaatttccatgtaggctgagttcccagtggaagtaaaaataccactaacatgggctaaaatcgcgtatatgatgaacagtgaaacaaaagtgcccgtgaacaaacctgcaaattagaacatgaaaaaaaagaagaagtgaagttagatttgtgtgccaaatgcagatgacagatctgatattctgatcttgaagttgctcagctacatgcctacgaggaaggtgatcatgtgagtgtttctgggctgctgtggcttaaggtatttcatcgccaccttcctgtcattgcctgtgaaatgcttcatgaagatgcactcgacctcatctgctagctgaagtacctgttcagaatttcgcatgcttcagttcatattcgtcagagagacatgtttccatcccccaaaaaactgattgaagtgaatttgtatgtttgtgcagctttgcagtaggattgtggagcaccagatgataccttgtcggagctgctaaatggcgacctcttcaccttctctgaaaacaggtctgtagctcgctgttgctcggacacctgaaatgcaaagcagttcgtaccagtcactgtcagctcggagtagcatttttttaaaaaaatatattaaaaaattaaattattccttgcaagaaaatgtttatgctgtctcatgttattaggctgactagtgactaggattacactgtcgagaatgagatctagtacctctgctttgagggtactaaactactaatagtacacttagaactttattctcctagaagccttatatatgtagaccggttttctttaatctttatcatctattatttagactcttcattcttccatccatccatttcaaaagggcacagatgtggctaattagtatattaccttgacaaatttcttcaatattttggtgaaagcctttacattgagagagctgctcccatccatccatgcatgcaaccaaaaaagcatccaaatccgtcagaaccacaagaacaccataattgacaagtaaaagaaatataaagacagccacctaaaataaccggtgaattaatctaccttttcaaaaaccacaaaagaattagtaatttgaaaggagaaacagtcgctttcaggtgacacaggatggtgtatggatggctacgtgatttacacggatgcttccatgcaaaacggggttgaaatttgactaaactactactgtactgcatgcttgggtgcagtgcaggtgtagttgtgtgctgctcacacagtgctccatgactcatgctgcaactaatattcatagtagtaatttgttagatatacatctatgaagaaacaacttaatttttttttcctagttggtcagttaaccaaactatctatatcatttgtgtgcatgcaattagtgtgatcgatcagttgcatgctattagtgtgaggtttggccatcagaattctaaatagcttacaaatgcgtatatatatgcatcatgcatggcatagaagacaatatacatagacacaaaaggcaagtcttgttctaaaataccgtgacttcgtggttttagcttgtcagatatggcaaaaaggaaagatgaagagggaagatgtgcctgaatttcttgagcagctcgaggccgcggtagagcgccatgaaggcgtcgcggatgttcttctcggcgtgctggatcttcttccggtggacgaacgccgcggcggggtcggcgccgtccttgcggagcacgttcacgagctcctcccacaccttgagcgccgcccgcccggggctcgtcgccgggatgtcgatcctcaccgtcgctggcagctgcagcacgcctccgcctccgccgccgccgccgccccgccctttgccgctgccgtccttggtcttgccgtccttcttcccggcgagccccacgaagctgacgccgttccgctccagcgccgccatcacctcgtccgccaccgccgcgccctccgacacctgcgcctgctgcaactccaggctcccatctgcaaaacacgccatcgacgacgacgacggcgacatcgacatgacatgacattgcatgcataaagagatgtgcagctagcccaggattcatgtgtgtgggtggttggtgtcacctacctgacatggactgcggcgaggagaggccggagaggaggtagcggccgctggagccgtgcaccgacgacggcggcgaggaggacggcggcggcggcggcatagagcggcttcgggcgaggccgcgggcgcggcgggcggcggcgtggtcggcgaggatgcgcttgacgtcggcgaggatccggagctgctccagcagcgcgtcgccgcgcgccagcagctccgcctcctgccccgtgtagaacgcgttcaccttctccagctcctcgtccgccctctccatgaactccctctcctacaccatccatccatgcatctccatttttacaatcaatttaattacttagttttatttacaatcaaattaactaattaattttatacatgcttgtccgtggatcgcacgagctcccctctgtccgggcactcctcatcctcctgcgaaatgcacatacgtattaacatcagaaatgtgtattaattaattaatacacgtttattagttagtatttgattcgagacacaacgacgacgtactgaggcagaaggctgttgtccagcggagaagcgggcggcgatggcgcgaacggggtcaagaatggagaacccatagccaccggcttccttctctgcgggcggcggcgggagaaggtggtcggctgcggctgcggcgttggcggcggcgaaggagtcgtcgcggcgggtgaccttgatcctcttgatgagcttcttgagccgcttgtagtcgacgaacgcagccttccactccggtatgatgctcgcctcgtactccctcgagaacttcaccatcttcttcttcttcttcttcctcgttgcagcagcagcagcagcagctgatcgatcgatcgatcgaacaattaactgaaacgtacgtacgttcacatgtgtggaatcgagctaggagaagatcaagatggatggatggatgcaggaaagggacaggcaggcagggatgatctcgcaagcaacaaccgtcctgccttgttagcttatatagatagacagttagagagagagagagagatcaggctactagcttggtgctcttctccttcttcttcaatcctctctctctgctcacctcgagtgctcctgctatataagcttagcttagctaagcatgcagcgaaatttggcactgctggtgcacatacagggacagatagtggccttgtatgttacaatattaggtagagctagctagcttagctaaattaaagtagaaaggtgtatctgaattcagagatatatatatacacttacatagtggggatcgaccatgccattcgtagaactgtttgtgtcctgttcattcagttagtggcttagttagttgcttaattcgatcagtgggatcatatatagttatattattatatactagttatgtacacgtaattaagcctcgtcgcatgatctggttggatgctaattctgtattaagggagaaattgattaagtaattacttctaattagagtaaggcagtgtatacatatttgtagcgcagagaattaaagaggagaaggaaagaaattaaagaaagaaaggaaagaaagccggttgctttaggccgggttgttaatttgagcggcccatcttttgggcgaaaaggcaggggcaatggagtgagggaaacatgagcagctgcaggaatcaagcagagacagacccttgcttaacctactcggccactcacactcaggtgaccatgcatgcagctgctaattagctagttgcctcctctaaaaaaagacaataactaatcaagtaattggctagttgacatgcactataattttcttattagtatcactaatcagctcatgtgttaattaattatttagttaattaaagaagagggcagtgtccaggggagtaggactaattaaggtcgtaaacttttaagtatgtatgtggatttctatgtctaaagtttgatcgttcgttttgttttaaactttttgattagtatttttgttgctattagatgataaaacatgaataatattttatgcgcgacttttttttattttttttataaattcgttaaataagatgtgcggtcaaacgacaaacacggaaacccgctaatgtatttaaaataggatggatgattatataattaattaattaattaattctgattagagtgttttgtgcggtgcagcatggagtgactgtagatatgctatagctttacacatatcgtggttcgattggatcgcggaaattaatggatggatggatggatcgatcgcaagttggagacaatggagctaagcttagctagggttctgctagtacagggaccagatcagccggatgctctccatgtatgcgcaatggaggccacgccaccgccgctgctgcagcgacgccggcctgacgtggccatgacgccgactcctactcctttttcttttctttctttttagtgtttttctttttttttaaaaaaaaggtatatttctctaggcgcagtgacgaaaactgggtagggcagttagggctgttgccctaagcttaaatatctattaaaagttacatttaaaaacttcaaaacacgaaaaataaaggtaaattatgtaaattatactagttgtgctttaggcgtgagaaaattctaactacaccactgctctaaggtatctatctacaattgtagtggagtacatggtatttgtgtgtgtgtgtgtgtttttaaaaaaaaagataaatatgaactgatcggttacacagtaagcatgcatgcacatgagctgagttggtcggatagtggcgcagccgtgcaacggaaaagtgtagctaaggtcgacagtactaacaagtcgcatacctcatcctaaaagaaaaaagaaaaaatatgttcactgtatacggttggctctggtatgatcgatcgacggcgtcgacgcgaccatcattaaatgaactagccgcccaacatcgatcgcttaatgaaactgaatcgaatttgccgtgcacactttttttttcctgagcttctagataacgtgatttttataagaactttctatatttgaatttaattttttaattgctgtttcaaatatattctttaactagaaaaaatgcccatgcgattgcaatgggtgaatgatattttaatcttattattgttatatgtttagctaggatgaaattcactgtgtgcaattaggagtccgactttcatttcaagttggcatgcgagtttttttaagaaatttcttatacaactccttttgtatttccaaaagcaaataaacttaaaaaccgactcaaatacggatgacgtaccaaaataccggcaaaaatattttcaatttttataatagtagggactagttaatatttactcactccttttctgattataagtcgttttgattttttttctagtgtaaatttataggaaaaaaattagcaatatctaaaataccaaattagtttcattaaatctagcgatgaatatattttgataatatgcttattttacgttgaaaatgctataactttttttataaacttgatcaaacataaataaatttgattaggaaaaaaattaaaatgacttctaatatataaaattaaagagagaaagtaatttatttgcttctacccttaaataactatcacaaatcactagctattcagtccttcaacacaaaacaacatgtcataaatggaagaaaatattaggtcagccagtttatttctcgtattataagtgcgcgcatacgtacgtattacctggcattaattaactagttcgcttacgtacgtacataacatatctacgcgtgtgtgtacatacacatccatctcccctgcgcggatgcgggggcgcgaaaaattttgtctccacgacgtgtatttcgcgccttttttccgcaacggaaaaaaaaattgaaacggtgaggcgttattttgcctccatgtccgttacgcactgcagtgtaagtggtcgcagctgccgttgcgtcgcacgtcatggggtccaagcagaagtgcagaacagaagaaagagatcgaagaaaaaatgggtaagtacacccgcgttgcgtacacgtccatgacacctcggatatggtgcttgctgcctccctcgccacaaacaataggaaacccggccgacctcgtttggtataggtccagctaaattttgttatattcatactctaaactagctgaagtcttatatttttgaaaaaaaaatatagtagtcatagtcttgtcaaacaccatagagcttatgatgttaggtaggtttaatgtgccaatatttgtgtgtctgggtctagcgcaaacatgttcagtcaatgtcgtgtctatcatgaaatgttgtctttaaaaatttatacaaagaaactttatatttagagactattaatatagaaacatttagaaaaaaaatatatggttttgaattagaattagaatcagacatataaaatttttatggcctacaaacttaccagaaaatgaaaaaaaatatgatgctaaaaaagaaaatcatgcgtgattcgcacgatatctttttttgtaagatgttctcttcaagaaatctcgttcttgaaaaattgcattatgctgtaaattattgtttttttcctagcatttgttctagcagtttattttattaatggatcaaaagccggcttctacaccaacaagtgtgtacacagccaactagcggttcatattcatagtggtttttccagtggtcaccatatgggcagaacaaatacatcgacgttgtaaagtttcttggagcgatatgtttgtgcatgccaggatgataggaatccatatgattattcagcaacaaacaggcgtcagctcatctaaagaaaacaagtgtcagctcatgggaagcacatatatctctctttttgggggtcccttgcatgcaagggtcaaaatctggtgccgtgactaactggcccaactgtgcaatgcacacagcataattctggttctctgcaggaatcttcttgttggtttcaggaggaaaccaagtcactaagcacaaaccagaaagcctcaagagaagggtttgtagagatagcttaattaaatgttaacaaatctcaccaagggtgcaaggcactggctagcacctacttttcagggcttaatgctccttaacaagaatgcaaaacatgataataaaggcctttttttttccttcatccttccttccttcctttgctggctgttgttgccatttcatgagtgtccacttcacaacaaatgtgacctaaaaatgagagagagagataaccctttcttctttttttctcccaagccagaatggaaagatcattcgcaacactagctgcatgatttattcttctaaaccatcctcctattggctcatgcttccaaaaataagaaaaagtcagtttaattaaaagcttcatccagccatctaattggtcctttctgtttaggacatgtttaggatgctggttggctaattgacttgtttaatattcactaatctctagctatgcccatagttaacttattgcagtatgattctagttttaacccgtgcacgcatcgtttgtttgcagaatgatatagtgcgtaagttcagatagcactaagaaacctgtggctaatcgggcatctctctctcaattgcactttagtttattaattttggtatcttggataggaatagaacatacaaagttatagttaaattttgcttcgcataatgcacaactgattggactgaaatggctgcatacttctgagtaatggagctaagctaattgtgcacaatgactgtactttataagtaacagagcagaattagctaaaggaatcacaacaaaaatgtgcaaaatatgaaagatttgagggtgacaagtgtcaagtgcagcaatttgtcagtgagaaattaaaccagcgttgctttctgaattacatgatgttctagtgttctagtgtgtccggattgattttactaattaattactagttagcacgtaattaatgagtttgtaatcttcacgtatgtatatgaacttttacgtgcgcaaagatattccaccaaggaatgtgcatcttttcaggagttgatccggataaacgtgctgtgatctgggagagtcttgtacgtttctgacagatgatcagagatgtgtgacaaagatcgatcaatgctcaatgggatccacgatgcaaaccatatgatgatatcaaagccatcttttggttgattaattaagctttcatttcatcgaattaatgtttttcacgacgagcggcaaattggacactgaattgtaccactaatctgtctgaattgtactactaatctgtcatatcagtcgcttcatatatgattgtctactacaatgcaagttgtttcaagttttctttctcaagagataattagtctgagaagttatgtgggattactttgctaagtgattttacagtttgcatatctctatctacgctagctttaggaaaagctcgaagtggtagattctatatcgtgtacgaaaagaaatttcaggtggacccaattaattatgtaatcttttatacaataatactatgttttttggcacatctttttttttaataaagaaagtgcataatgtgatcttaaaatggtcactgcatttggctttaatttgatgataaaaagatgagcgtatggctggcgttttcctaatccaggctattgtgattagaagcttttttttctactttcaggtccatttatgccgacctttgttttgttcatcaaaaaattaaacatcgccctgccaatccttttccataaagtgatttatcatcgcacatatgtaggatctaagtggagagaagtgctactttataagagcagatgatgatgtataaaatgtatacatttcattatctgaaaaaaaatgtgtatatttgcaaccaaagtcctaagtgggcagtgcacaagttggtgtgctgctaggtgatccctattgttcctgcagctcatggacattgacatgggaaagaaagaattagtgggcaaaaataggtcactatcatatagatttatgaattccaaatccctaagatcctaaaatgatctgctgatttgattttaatgccagagaacagggcattgaatattaagtacttttactgcggttagaactatcactagtagcagtgatctcaactatcgattgatgaattctactaccagttgttaaggtggtagcataaaaatgtatgatccattaaatcaagagcaattttacagtacttgaggagttaccatgagatacaaaaaaatttagagtaaaatttaatacctcgtagaacctcttcataaaattgctcttaaattaaacaatgcgaatgatctctaccgtagggactgtgatgctcaattgctatgtgtttcagaaagattagttagtaggggtgtgtgtgcttaattcagtgatcaaaattagccagtgcagtgcaggtggtggaggctgacgtctcccataacgatgcgtctgtgtatgtgtgtgtctggttgtttccctctgatcctcacaatttgtctggggcaattctcctccttttggatgctctgatgatacacgaaaaagttgcagacgagagcggttttcagctgtaaagagaaacaagaaaagcagctttctcttctttatttcttttcttttatgtattttctcctcttttttttttctaatatgcgattcagactgatggtcacgatttggagttggatgtgttcgtagcagatttgttctcggccttcagactgaagccggaagaagtttttgccggaaatgcgttgtttttctgcagtttgctgaccatgagtcttgtccatggtgactgcaactgtttttggtgctttgcacggttcgtcagcagcatgaagcctcctctcactaccttttagtatcggatttcctgtttttaacaaaaatttggagataatgcactaaccggttgacttccttttgaatgatgctgcatctttcaagaatatgttccagatgagtcatgcgtcatacctggtaataatacaagtgttttttgactgaagtgatgatacaactgttagtgttctaatctgcattccaagtcagaagatgcactctgcactacagagaacgcactctcttatcccatgtctaaacccattttttgctacagttttgcctcacaataatcatccaaaaatgcacacaagttccatgcattgctagggcactactcgtctactactatagtaactctacctcctagacttcagataaggatgcatggcatccatatactatatatccatcagaatataccactttctgaattctgatacctaacattgagccattgaggccaagcaatgatcaaccatgcagtagtgcatttttactgctgctaaacttcatacatctgcatccactgcatacagtaacaaccacaacacaaaccattgccaaatactgattgcatttgcaaaaatcatccaacttgaaatcatcaggtcaatggagtcaccagggctccaagaaccgccccaccgaaggcgcgatcgccattgcgcgtgcgcacagttctcattccatggtgtccaaggggagagagccccctggggcttgatccatggtagaagctgataggattcagaaggaatctttggaagtggggagcaagctgaaatgcgatgtgctcatgtccactaccttggcattgtgatgtgttgcactcattatatacgatgtatgccacgagaagttcattgttccttttcttcagggcactgttacagtgtccctttcagagtttcaggatccatccatctctaagaagcagtgactggatggatgggttgttgagaagaaactagtgcatcactcttggccaggaatcgcaaatggaagcactagagaatggtaccttattaggagaagaacaaaaggaggtaaagtattacatgtcatctactcatgtagggtgacttggaaaaggttggctaaagaaaatttgtagagcacaattcttagtgcataggttcatgctacagtgttcctttctccatatagaaatggccagttcaacattctcatctgtcattggaactttgtcgaaatgatccatttatttgaagcaccattggtgtggtggtggagtcgtgggtgcgtgattcttaccactagggttaaaatcctggtgtccataatatggccatgtgcatcatagttgatgtagaggccacaaacaatacttccattatgtaaaaaaaaggtggagttttacagtggtctctattggtagtagaatcaatctagacagttcatgcaatactgcaaaacttgcagatttggtcgttgctgcggacaacgactctctcagagggccatcttggttctttcaactggaggtgggagagttcggggtcgtactccacccgatcagcttaccttgccctcttctcgggcaggatctcgtttcagcacctaccaatctggcgctcttttgccccacctcagtgtcacgtcgctacttcctgtggctggtcgctcactggcgctactggacgactgaccgattggagaagcgtggcctgccgcacccaacctattgtgtcttttgtgaccaactggaagaaacagttgatcacattctgattgggtgccttgagtccctatagctgtggtggactgtcctttcaagccccggcctccctcagtgctttccctctgacgctgattccttctttgagtggcactgctcctgtcggctcaaagttccgagggagcatcgtcgtgggttcaacacgattgtgactcttggcggttggtctatttggaatgaaaagggacaaccatgtgttcgacaaccattcccggccctagcctgaggttgtcgcagccatggcgtaagaggccatcctttggcgtcttgcccatcccccgttgccagcgcttcctagttagcatgtttggtcgtttggtcgttcggtcgtcacaatgtaatcgcgagaataggcttaagtccttgttttccttttcttcctcccttccccccctcctctcctctcctctctctctctctctctctctctcttctttgtttgccatttgtgtaaattttattcctcttaatacaaaagtgcgtaatccttttgcgtattcccgaaaaaaatctagaaagttcatcttttcaaatccaatttctggtagtagatctcataaatcaatggttgaggtcatttctaatgatgataatgctagtagtaaaacactactagtacagaccaccgtaaaggtacttttaaaaaaaatagagagaaaggctagtgattagtgaatatgtgtattcatcaaagttcactggattttttgggtcatgtcttcaacaaatcaaatggttgacaaagaggagaatgccctggttgttctacaggaaactttttttttttgaaaccgatgttctacaggaaacttgtgtgtcaatttcttttacatggcatagctgttactgtcatactactataaaattctgcaattggatctctcgtgtaccacttatcagcattatgagtaccactgaaaatttggtaagtgcatcctcttttttcttgggtacactggacctcaggataatatatatctaggattaagtggataccagatcaaaatatatggacctgatttgatataacgatactgttttcctattagctcagaagtttcacacgctaaagttatctgctaggatggtgcatatatacatgccctattgccgtacagaagcaaacttaggccaaacatatctattcagaggagctaaaatacaatgaacaaggtttagcagcttctgaattgcttaccagaaccggtccttgttcaccgacagatagccagacatcacctttcctgcggtgttccgcatgccgtcgatgaggtagcaccaggttgatcccagggctccaatgaagaaatctgcttcagtggccatgatgaaattgacaaggggatagtttgtgctggtctcacggcccaggctggcctcatacattgccatgctcacattgacatcttggcgcgtcacatttgtgaaatagaaattccatttgggatataattttgtttcgtcgataacttcctacatttcagcattagcagagttaaattacagaccaatgaaatgaagaaattaatttacaccatacgagggatgagaattgaggagttaaattgcctgcatttcagtagaaagccagatgttcttgagacttggaaaacgttttcgaagacgaccagccaactccatgtatttctcaaagccaactacttccatttcacaagctttatctcccatccttacatgcatactgataagaggcccgggtatatatggtttatgctccgaccacacaagtcgctcaatgtcagattctgttctgctaatgctaggctgcaattgtgaaatctttcagttacttatctaaaaaagtaaggtggttagtgctaatgttgctttatccgaatgatgcgcagacaaaactctccacggaacaaagcaacataaaaatcttcagattgctaatacaaacctttggtggatctgggacattttcaagaaccatctttgctgcctgcatgccaaatgctgaatgtctagccacattcagtaatctgcacatgtactctgactggaacctcattaggtatctcagggcctacatggaagtttcaggttgatgaagcatatttgcatccccattatgaatagcacaaaatatgctcatcattcatcttggcatgaggtacacacctgtgcaatccaccatctccgatccattttacaatgatttttaaccaatctcccatctatctctgttgtcggttgcatatatttccatggtctcccccatatcctgcataacagcaggtttcagaaaacatgtgcatgaatcggcaagagccacaagaacagagcgatgaatgagatatactccctccgtccctaaatatttgacgccgttgacttttttaaacatgatcattcgtcttattcaaaaaactttgtgaaatatgtaaaactatatgtatacataaaagtatatttaacaatgaatcaaatgataggaaaagaattaatagttacttaaattttttgaataagacgaatggttaaacatgttttaaaaaatcaacggtgtcaaatatttaggaacggagggagtaaatgtgtatagctcatcagtattgggtgcgtgtttagctttccagaaacaggaccagcgcatcgaaatggtacctaggtatatgcccagcccatatttgcttggaggtatagttttccttaacttttataattccattttccctagaatctttgctttgcatgagatctaaagcacgtttctggcagtctgcagatgtttcaggtaaaaagtagcatgaccagctagatcttgctaggcctgaaaattgaacattgacagttatctcagttatcatgtcagttaaaagttacaacttgaggtagcactacacatatcatattatcaattcataatctacaaggtaagctggattgttcctacctttacaaccattgtgatcagcacggttgtagtatcctgcaactagaatccttctctcttttatagcaatagcaagaagtcccgacattccagcgagttgcgcacctataccaaatcccggtagcctctcccagtctgcatagagaaacctcaagcttggatcactgcagtttggaggatgttgatgaatccatacatctctctgcacttgtctggtcagtggatagttttcttcatctgatcctgcaatctttaaagttttgttgtaactcaaaagttagaatactgcattcatagtagtactgacaagacaattacgagttcaggcaagtttacacacccaaggtggatatggcgccctgtcagatttagcatttgacctgaaaaacatttgcctccactcttctgaatctgaatagttctggttgaataactcaagaccaagtgaccctttccataatgtccaaggaggaaatacgccgttgtcgctataactgtcaaatttcttatttctttcccatttaagcctgcaattctccagatgaggcggccgcggcacgtctgaacttttcataacttcatcactggtcgtatccagtaaagtgctccaagcattatacaaatgcattttatcagcttcattgatgtccttgctattggtggctatttctatcttttcttgtaaaacagataagtcatctgtttctgtagctccacctgcatggaagaagctggttacacagacattgtcacagctaaaaggaaaagaaaaaatacattcagcctagatgaacatatagtactacactactactgaattttttatgcgaaatggtgttcgcaaaataccaggttcagttgatgttgaattcaacaagattgctcgccgaaccggtggatgtaccgatcggatcatcaggatttggataggtgggagagcaacaccaaacaggtacacaatgcagacaccacagaagaagcccagtgcccatgtcttgcagggagcagagctccccatctgcagagccctccgagatataaacctttcaaggctcttgctgctgttgctgtggccattactcatcatcctcaattcctgaattcctcagatacctaccagcgcaacctgacccttgcattcaaacactgcctccaatcaagaaacaccaaatgcatcatggaatggaattcatgcaagaaaagctataaagacaaaaaaattcttcccaaagagtaaagtacaaatcaaatcacagatgagctaattgcttggaagacaacatggatttgatccacagatggcttctaagcacaggaatatacagtctacatgaaagatcatcggcatgcatgcacattaaacagattaccatgcgctaaaccccatcactaatcaggaaggaccaaggtagtcgcacaacacagccacatgcagaagtcactgacaaaccagtacagaaattgaaagatggttagctgaaaaacagccgctaacaaatcgcggggcttatcactcgtttactcccctcttactcggagtctttcaagtttcaggtacaagaacaggtcaaataaacagaccgaaattcaaaacaaaccaagttctctcgagtgtcaaacaactcaccgaatcttctgcaatcagcctaatcctgcaacttatgcatgcagagtgaaattcagagctggaagtgttcttgtttttctcatctcctcctccgtcctacgccctgaaacaggagaaaagagttgacgaccagaggagcaaagatcaacaatggctcaagatgaaaagaatctgtttaagaagaagaagcaaaaaaaaagactgcacaacaaccatgttattttgttattctcttgtacttatcaaacttctcggtgagtcaataaattggccggcggcaaggaaaggatgcagagaagacaagttcagaaaagaacatttttccttgatcggtcgagattctgtgttcattgctcagatgaggctgaggcattcacctatttctaaagagaggccgtttttagcttcttctggtaggattggcgagaccgatcgaagtaaacgagcaaagtgaagtaaacaccattcatcagggaaaaaaataaaaataaaatggaagtaaactcatcagatgatgttttggcgtgcttatgatggatgcattttactgctgttcatttccctaattaggtcaaacaattatctcatatgccttctctgtgtaactcgattttttgcacacagagagagagagatggtttcatcaagagagcatagaaaggaaggtgacgtgtcccagcgatgagttggtctctgtctactctgctctgtgctagacagctagagtagctgaaaaagcagaggaggtcacggtacaaacgaacaagacctgccacgtgtgggcccgacgccgaacacatgacaagtggcacgcgcgtggcagcaactcgctccacgtgtgcacgcagcgcaagagtagcagttggggtccacatgtcattgtcatcctcgggttgcgtggaaattggaacgtctcccgcaccgaacgcgcgctaatccgaggcgtccgtttgaaatccaacgactcaaaaccaatttggttgggaaagctctttttggctgtatttttttttctaagaaaagaacggttttgctattggataattctgctagtatatagtttgaaagctttttgagacgctacgatgaagctcgatctttatagatactccctttggtttaaaaaaacccaacctaattaaaaaacaggacacaatctagtatgagaaatctagatagaggattattcaaattcattgtactagattaagtctcatcccctaacaaggttaggtttttataagaatggatggattacgtgtgtaactgtacggtaagaaagtagattggatatgatgagatttggtgcagaagaaatcaaaggcaatggatggagctagaatgcagaatgttaagtatggaggaagcaaagtggcacggccacatgatgttgatgatttcatctgctgaattgaggttagcagcaaataaccacgacggctttgtggaagaacaaaactcggcccggcccaatatatatttggcccaaatactccatattacggtacagcctccaccgtcttgaaggccccaaagccaccgccatttccttgtaccgttagcaatttagtgctatctacatcatccgttataaaatgtaaaatcatttttcacacatcctacgtataccaacataaaacgacaaatactaaaatactccaacttatcgaatcgcaatgcaattattcagcactttgcctactctcagtatatttattctctattctttataaactttgatgtaatgactgctaaaaatgaatttatttgaaaacaaccgtgagaggttaaggccctgttttctttcagcttgggattattataatacaaattattaggagtaagctgaaagaaacagacaacttattgaagtagcttattataatctggagcccagcttattataatctgataagctcatttaggtgagctttttccagattattggatgaaaaattacccaccatgccaccccactccctttttagacttacaaacccaataatctaggctctaataatctaggaaagaaacaactaaccgcttattctactacagattataacaatctaacttatagtaatctgacttaataatctagattataataatcccaagctgaaagaaacagggcctaagaatgactttattccgaggaggaggcaaattagcctatctcatgatttaccttgtttggatgggcctcaataataatggcccatccaagtggacaggccctttttgttttttgtttttttgtcggcaggcagtgccagagcccagagctgagcagagaatccccaaggatcaagaaaaacgcaggcaggcaggcagcagcctggagcactggacgtcatgggtggatgaagaagacacgtacgctcaacagatttagtggactctggctctgctgctggcttgggactctgcctgctaatctgctgtcatctggtcatctccatgcacgcgcgcactaaaccacagcaaagtcagcaggcttttatccgtaatccatgacgctgcagatgatggactcacaccagcctctgcttgacatgcttgtattgctaaactatcatactccctccgtcgctaatcacatccaactaaaatcctttatatttagatacggagagagtactttcttcatcccaaaacgttgatttgatatatcttacccaaaacattgatttgatgcatcttataacaaaaaatctggacatatctcaatcttgttttaggattgattaaggttgtgttcggcactaagagtttccaactatcctcactcatttttcgcgcacacgctttttaaacggctaaacggtgtattttctgtaaaaaattttttataggaaagttgctttaaacaccatattaacctatttttcaattttttttactaatacttaattaatcacacgctaatgaactgttccgttttttttgcgccggaggagaacgtttccaaccatgagaaacgaacaaagcctaaatctcatcctaaattacaatatttcggaacggatgtggtactattatttcgacaaaaattaactaatcataattactatatagtacaaccgataaaatcatggcatgtttgcatcgccagtttttttttcattgactgaatatcacttcatgagaatttggatacccatctgagcaggccttagatgggcctgcaacgggccgtccgcgtacacaagcacgtgacacgtctatagtagaatccgagccgagtcacgtgcagatattctctctctttactcctttgtaacaaaagctcaatcctatcattcattcagcaatggcctcagagaccggcgagcctttcctcctgaaaagcagcgagactaccccctgaactgaaatgaagcgatgcatgcctgcttacgcctttgaccactctccatctccaatctccgtgcaccatagtagcatgtctctctctgccttagctgctgctgctactgcgggagaggctccagggtacagctgaccatcaccaaaggcgccatcacgacctgcacagctccatgcgagaaaccgcttcaaaacattttcgtgacctcactcacagtcacgctcacactggagtatcaccaaagcgcttggggcactcaccgttcgttctgaaagacttccaactggacgattcatagctaaaagttactccctccgtttcgaaatgtttgacgccgttaactttgtagcatatgtttgaccgttcgtcttattcaaaaaatttaagtaattattaattcttttcatatcatttgattcattgttaaatatatttttatgtaggcatataattttacatatttcacaaaagtttttgaataagacgaacggtcaaacatgtgctaaaaagtcaacggtgtcaaacatttcgaaacagaaggagtattatattttgggatggagatagtacatactccacaatgcatgttgcttggagtaggtcccatctatctctctccgctcccttttatctctccctctcccctctcacacattccgcaccactctctctcctggacggacgaagcaaagcggcggcgacaccgagctccacgcctccacctctcctcgtcggggctgaaggcggcgacgtcgccgcccgagcgccggtggagtagcggcggcaccgagctccacgcctccatctctcctcatcggggccggaggcggcaatgcagtggcgcggtccaagcttagaccgcaccgggcagagctccccgtatggcgcaccgtccggcctccttcctcggcggcaggcatggatcggggggcggcgcggccagcgcagatccgggaggacgacggcatcgccatcggcatcggcgcttctcccctccctcccccttcttcacctcttctcttgtgggcctagaagctgcgattctaacgaagaacgagccaatacctcccctttctccacctcttctcttgtgggcccaaaagcccccgttcttgcgaggctccgagctatgcctaggtgaaggggaatgacacctaggtgcagtgtgaatggccttagcctatgttctttgctcggtgttcccaaccctctctcttgtattctgcgcgcacgcttttcaaactgctaaacggtgtgttttattctgtaaaaagtttctatacgaaagttgttttaaaaaatcatattgatcctttttttaaaaaaacataatatttaattaatcacacgctaatgtaccgctatgtttttcatgcacaagagaggggttcccaacctatatatagaaacgaacacagccttaggttgcgttcgtttggagttgttcccaactccctcgtctcattttccgtgcgcacgcttttcaaactgctaaacattgcgctttttgtgaaaagtttctatacgaaagttgcttaaaaatcatattaatctattattgaaaaaaattagctaaaacttaattaatcatgtggtaaacgctgcttcattttatgtgccgggaccctcactcccgaacacagccttaatcatgtttgcacttgtgttcaatactccctctcccgtaatattcatttttagctattgttgttttacttgaaataaatttatttttagagtaattattgtatcggagtttgtaaaaataagaaataattatgggagtagataaagcgaaaaaatagttgtattgatatttgatataaagcatgtttattctattttttattggtatgtgtataaatgaatttactttggggcggagagagtagtgttcagaaatagcatacggttaagcaaaaatttaaaggatgtgagcttttcaataacggcctaaaggctaacagcatatgctaatagtgtaattcgaggctaaggccccctttgattcaaagaaaattcataggaatttaagaggattttattgctataggaatttttcctacaaagccttgaatcaaaggaatgaaccctatggaatcctatgaaattcctatggaatgcctttttccatacaagttttggaggaattttaacaagaggtagaacctcatggaagaagaaatcctttgagtctttatctctcctcaaattcctgtgtttttcctatggtccaatcaaacggtcattactatattttttctgtgttttgcaatcctctgtttttgtcacgccccgaactagtcccgaccggaactagcccgtgatgctccaaattaacccgttaatcgataccagtcccaggaaacagtgctggtatcacaggaagacagaatatcacagcaacagaggtctctttattatagagtaggagtacagtcatgttgggctgcggacagatctcgagctcacaactgcattacaaaagggaagcggaagccaagacttggaccaaacatcacaggcgcgacttgggaactaggccgaaaccctaaaactcatcatagccggcttgctcctggaagaactcctcgtcagcgggatccgcttcatcttcttcagcaactgggggggattatttatatagagcaagggtgagtacaggagtactcagcaagccatgggaaataagtgtttaatgtaggcttcaaagaaaggctgttgtttttgcgattgattttatttaaactcttttctgaaacaactaagggagtgcttctcaaacgacacggatgagacagtgcgtctcatccggtcggagtatgtgcaatgtttcagtcttttgaattgatcaagattggcacccggccaacagctttcaaacggccacctgggcctggctgatcccatcagccgcagattttccaaacatcaaacccattccacaacagcaaatttcacaaggcagtagtcaaacaaaactacgctaagaatcacctcacatccgcccatgaccgtgggcacggctgttcgaacagttttaataacctctgcagagggggtacactttacccacacgacattactaacccggatcatccagcccgtgcagaacggccacgactagagaccttaaggctttcatgacaaggcatttcgaaagccgacacaggttcaccatatgccaacgagaggggtcccaaaccaacaccagattaggtcccagaccatactgtgccaggaagcccaggggtcctccccgacaccaccccggcgaatccacatgtctcttagcatcatggctcccccgataagctagttactcagccaggggtgtcccattccacccatgtggtcgtacttgtcttatgttcggatgaaattccaaggaaacggtccttaagtgcaagagcgggaaaccgtacacccggtacgttccccggtccgcggttttggaaattcatttagttcgcaaacaccgacccaggtgtcgggttttccaagtcttttgtaaaacccaagttttacccaagatgtttctcagattttaagtttgaaggcgaccgtcgatacccgtgcagagtacacgattaccgaggcgcaactaggtgggtacaagggaacatggtataacaattacaatggaagggtcaaatgcaacaaattaggtaggtccgccaatctgccttgcagacgggacaagcagattaagtgcgatcctatcaatgcataatatttttcaagcaacataattaagttcaaatataggctcaagatgtttaaaggtggcttgcctcgctcgagatcttgagcttgatcctcgaaatcctcgcactgcgggtcttcgggctccgaaactacacgcgaaacgggacaactcagcaaacggcgaaaataaagccctattattgacctctaagcgtgccattagatagatctcgagatttgaggaactttggaagttggacggagtcaaacggacttacggcggctagggcgggaaattagacttccctctggcggctagggcgcggcccgagagaatggggcggctcggccgagcttaatgggccggccggcccaagaaggcggcccaacgcgcgcgcgcgggcggggaggggagagagagagccggtgggccgggtccaacccgcgtggtcccgggtgggacccgcttgtcggcgactcagctcaccgtgagcgaggtgcacgcggggcgtgctagggtttggggagggaggcgcggcgcatgcgcgcggttcgcggaggacgcggtgcggcgggcctatgcgcagcctcacggctcgcggtggaccgcgcgcgcgaggggcggagggaagcggcggaccggggtctgcttgacccggtcgcggccgaggtggcgccgacgtggcgcctacgtggctaccacgcgggccggcgggaggtagacgacgacgccggccggaacggacaacggacggcggtggcgattggtggagcgaaccacggcgatacatgcgaaagcgagcacaccggggggttgcatgggacgaggggagatgagccaacggctcggatt

SEQ ID NO: 80168 - DNA, 27104 bp, Oryza sativa
ctagcagacacatgaagaaataaaattaacaaattttattatttttatttttctagttgtagatcaaatagaaacttgcatgtttgtgtacagacttatatcatcacaattgatgttactaatttttttattttttttaataactatttaagtcgcacataaatgttgggtgtcatgacacctaggtacagagaatcctaatctctttattgtacccttcctttttttgctttgaaactacactttaagactttgttcttccacggggtaatgaagattggagaagatgaccagttcgaaactgcactaaaagttccagttcacctatctttgttacgctggttgcttgacgaaacgagagcatagcagcagtgtatccaaagtattctgcaaattgagatctattgttctgaattttagtatacttatatgattattgtgatcatgttatacacatttagatcttttagactgaactaagtaactaaccattctcaggggcggatccaacgtggggactcgagtcccccctacacccacaagacccatggatacccccagagcaccttctttaatttttttcaccataaataataaactaaaggtctttagatggctaaaggttagagaaacaacgtacttgaggccccccaattttctgttgctggatccgcccctgaccattctagatctcagccagagatggggatgaattaggacaaaacaatgtttcggtagtaatctatgcagtcattggacagcattagctgaatatcatatgagatctatcaacaatgaacacatgtcttgcaagaggtctcttctgttggtgccttcgatcatttctgttttgttaatatttctgagtttcttacaactccaacatttccaggccctctataaggactaggatatcgactgaaaacaagaaaagtatgtaacaaatatcagttagagatatggactgtttgattggattgttggagaggtgtaggaaaagttttctggacaaaataaataaatgcttggaaaactgaaagcgtcatgtaaactaaacacattgctcacattgccaattaggcagctctctaaagagcaaaccaattgcctcacgagctgtacatatcccattcaagcgtcaatttgtaaatgtagaacaagtaaaatgaactaaacatgactaatactcctgtatggagcaattaacgaagatgagtccttcaaaccaacttgtgggtatggataaaaatctatatatgacaataattgtctcgctatataaatcctatgagtgagaaaacttgcaaacctagcgaggtgtgatggatgttagtgtcaaacttgaggacgacattcgtgtcgatgatgagggctgcccctccgctgaggccatcggcggtgcatatgttggcacgggcatcttagctggtaacacgggtagtggtccattggattggagaactgccatgacagctctgatagacggacgtgcacatcggtctggatgtgcacaccaaagtccaacggccatgacacactccatgctagttgtgtcgtattcattgttgagccgctcgtcggctgccttgagaacggctccttggccgtacagatcccacacccattccaccagtcggaagaggcaattgttttgggtgtcctgtaagctaattggtcttctcccgcatgccacttccaatagaacaatgccaaaactataaacatcggactcggcgcttgctttgccggtgatcacgcattcaggatcaagatagcctggcgtccctgagggatgggtcattgtttgtatcccaacagcatggtcaataagccttgcaaggccgaaatcgcctagcttcgcgttgaaggattcatccagcatgacgttgctcggcttgatgtcacggtgaactacacattgatcccactcctcatgtaggtagagtagtgcagatccgagtccatgaacaatgttgatcctgtggcaacatccaagttagcagatgaattgaatttcaaaggtgtcgattgcacataacgaaaattactaaatcaatgagttaattaataaacctcattggccatgtaaggaaggtgccattgccgtggagatggacgtcgaggctacggttggggaatagctcgtagacgaggagcagctcggtgcggccatggcaccagccaatgagctgcaccagattgcggtggcgtagccggcttattacctttatctctgacttgtactccttcctcccttgcttagaggaatttttggcgaacctctttatggcgacggcgaggccaagctctctgaggtagccccgatacactgcaccgaaaccgccttgcccaagcttctcctccggcgcaaagctcttcgtagcgtcgacgagctcgtggtacgggaaccgccttggtcccatccccatctcaatctccacgatgggctcgccgtcgtcgtcatcgtcacgccgtgccagcttccatcctctgcctccctccttttcttgctctgacgtcgtcgtacaaggacttgtaccatggtgaagaggagtatgacgaacattaccacgccaactgtggctcccgctacaactccgccacgtctggaagtcggtggtggtgacggtgacgacggcggcggtggagatgctacttctgctgccagcttctgctcgaacgacgaagtcgacttgaagtaccaagaagtcagctgatgctgctcataggctgagccaattgatgccgagaagccgatggtgacgttctccggcaaggctctcttgagatcaaccatggagctaagggtgtaaggcgtcgtcgtctcatttatccatagcttaattgacagtattctcgaattgttgttgtagtcgacggtggcggtcatgttcccgatgaggctgaagtttggtagggactcgttcgtcacagatacgacggagttgacgtcgatgccgatgtggtcgttggttgtgttggggtcgaaggggttgacgaaggtgtcgaactcgacggcaacgaaccggttctggccggtcgagacgttgccgactgtctggttcgttaggccgaggttttcgccaccttcgtggcccactggtaacctcgatggatagctggtgaggaagaaggccataccgtcgccctttttgcttctatcgctcggagcgataatgttgaaggagaagcgcgtggtgaagctggccacctcgccggtggcggcgtcccagagctgcaccggcggcgcgtacaccacccgtccggcgctgttgcccatgcccgacacactgttcgcgcttatgtcgacatacccgacgctgacagaggcttggccttgaatgtcgatgttctgattgtctgaggaggcgaaggtggggtagttgaaggacaaggcggcgacaggagccggaggctgcatgtagcagacggagaagaaggtgacgaggccggcagcgcaagtgatcaacgaaaagccggccatcgccgccggccagagccagcgtcggcgcgcaagccgcaaggtgggttgatcggctggcttgacttggagcaacgagtcgatgcacaatgcgtacactgcttgtagtgcactggcagtgaatggtgccccttctccctggaaaaaaaacccttctttttgatggagctatgtgaatgtggaactatggaagctggactacaataattgtctttgtcgagctgaaaagaacaataccccaaaaatcaacgatgctgctacaatctccatgatccatcggagagacggagaaacatgcataattgtaagtaaatcgtaatgttcagacttgagagatattcagggttgcctcatgcagtcgtttgacgcagaacaagagcccagcggtcagtcaatggcccagcttatctgaaactatattgtgccaactccactgatcgatcgatggagagtgatgcggatcgcagaaagactttaaagactcccctttggccgtggagtttagtctccgcaaatttgagctttgttgtcatctagtacaaccgatcgaagaccgaattaagtgctgagttccagcttgcagcatacacgcacacgaccgtcaccgtgttgaaaaagacagtgaactctctactgacagtatgagctttcaattacttttcgagaccttttacggcaattgcgaggtatttaaaggtatctggaggtggaacaacgtgtacccttaatcaagagaggggcaaggtacgaaacaaaattattgtaacatgatggcaatggagtaattaactagtaaaacatgggcattatacatgaattgaatacctatatccatcgatcagtatatcattgtgcagattggtatgtcgtgaggaaaaaaaagtaaatcacggatacaccgttgatttagcagcgatcaattcgatctgtaccaaaataaacagaaagatcgcatctcctttcttctctcccttcgcttcgttcttgttctagggtttgaacggttcaacggaaggagacagaggaaaaagcgtctgcatggttgagggttgaagaggagatgaggtagcccggtcgatgactaggcgcaagctagcgcatctaaaagttatcctatgcttattcacacagttgtttagttatttatgtagtttataaactccttatataaggtactggaatttctgtgggatagtaaatgagatctccgcctatggtgttcttctagtgtttgaacaggtgcactcacgaggagacacggtcgaggaagaagatctggcatggtcgagcatttgacaggaggcaagacctgattgacatgtgcaggttataagaacccaacgtaaatctagagaaaaacacgtaaaagagaacatcaaagagcggtgtaactctagataaaatgatgcaacttaagaacctgtaatgctagtgccgactaaacgacttaactcaaacacaacgtaaatcaaatctagagaaacccacataaaagagaaaatacgcaaataataacatgtaaagctggtaccggggaaattaatgttaacttcgtacgggagtacctagcgggacccgattctaattttgaagacaattctaccctttttgctctaatagtaaaattatatttttatctttagtacttaagtacctataccaatagttaaataccttttacatgatacctatgattgaggagtgttggatcttataccttttttggaatgcaaacaccgtaaaaaagcctatcagattttgttgaggaaattgcagcagtaaagccactgctgaccctatcagaaccaactcttctctttcaaattttggcttgatcactctgtgaagtagcagagatgtcaatcttggacgatatgcttgctgcatgaatctcttatgtcttaaatctggcaattggctgctgttatttttgtgtgttaacaattttgcttcgatgttctcgattccgcgttcaatcaacaccggagtactgaacataaatatccacaatttgagacgattgcataagaactgcttcagtagaaaatgattggaggctctttgtgctcttgtttacagtagctagagcctatattctatttattttattaaatttagcttattaattatatctaggttcctgttgtttatcgacgaaaagcctgtgatggtagtgttacctatcttggttcctcttgttaacgccattgtgttgcatgttgtttttcctctttcttgtgcctttacttttcggattgagctttctcattttgtcttgaaagttgaaacaatactttagactttgttcttccacggtaatgaagatttggagaaagggaccagttcgaaactgcactgaaaattccaattcacctatttctattacgctggttgcttgacgaaatgagagccaacgatagaagcaacatgaatgaaacataatgtatcaaaagtattctgcaaattgagatatattgttctgaattttagtagtgtgatacctatatgatttttgtgatcatgttatatacatttagatcttctagactgaaaccattctaggtgttagccagagaagggaatgcattaggacaaaacaaaagtttaagtgataatcaatgcggtcgttggccagcattagctgaatatcatatgagatctatcaacaatgaacaaatgtcctgcaagaggtctcttctattggtgtcttcaatcattttttttttgtttatgtttctgaatttcatgcaactccaacaattccagaccctctaaggactaggatatccacttaaaacaagaaaagtatgtagtgaataacagtcagagatatggacggtttggttggattgttggagaggaaattgaaggaaaagttttctggacaaaataactaaatggttggaaaactgaaagcatgatgtaaactgaacacaattactcatgttgccaattaggcagctctctaaagagcaaaccaattgcctcatgagctgtacatcctattcaagcggcaacttgtaaatatagaacatgtaaaatgaactaaacatggctactgtacggagcaattaacgaagatgagcccttcaaaccggctaaagtatgcgaaaggaacttgaggtgtagggatgcaagtagttcgacttgttggtatggataaaaatctaggagtaaatttcacaaaactacaggtattttgaccaaattatcacaaaactacagatttaaagagctgtatcacaaaactacacatttaacaccaaatttatcacaaaactacagattttaggttaactatcacaaaaatgcatatttaatattgaacttatcacaaaactacaacttttagagtttaaatccctagcactattgttatggtggagctataaacattattactttgtgattaaattgattctaaacctgtagttttattataatttagttactaaacgtgtagttttgtgacacttcatcttaaatgtgtagttttgtgataaatttggagctaaatgtgtagttttatgatacaactccttaaatctgtagttttgtgatagtttggtcatagtatctgtagttttgtgaaatttactcaaaatctagatatgacaaaagttgtcttgctatacttatcctatgagtgcgaaaacttgccaccctagcgaggtgtgattgatgttagtgtcaaacttgaggatgacattcctgtcgatgatgaaagttgcccctccgacgaggccataggcggtgcatatgttggcacgggcatcttggatggtaacactggtagtggtccattggattggaggaccgtcatggcagctctgatagatggacgcgcgtatcggtccggatgcacacaccagagcccaacggccatgacacactccatgctggttgcgtcatagtcattgttgagccgctcgtctgcagccttgagaacgactccctggccatataggtcccagacccattccaccagtcggaagaggctattgttctggttgtccagtaggctcattggtctcctcccacatgccacttccaataaaacaacgccaaaactatagacatcagactcagcgcttgctttacctgtgatcacacattcaggatcaagatagcctggcgtccctgaggggtgggtcattgtttgtaccccaacggcatggtcaataagccttgcaagaccgaagtcgcctagctttgcattgaaggattcatccagcatgacgttgcttggcttgatgtcacggtgcacgacacattgatcccactcctcatggaggtagagtagtgcagaaccgagtccatgaacaatgttgatcctgtggcaacatccaagctagctgatcagttgaatttcaaaggtgttgattgcacataatggaaattatgacaaattaatgagagttaattaaaaacctcattggccatgtgaggaaggtgccattgccgtggagatggacgtcgaggctacggttggggactagctcgtagacgaggagcagctcggtacggccatggcaccagccgatgagctgcacaagattgcggtgacgcaaccggcttatcaccttgatctccgacttatactccttcctcccttgcttggaggaatctttggcaaacctctttatggcaaccgcgaggccaagctctctcaggtagccacggtacacagccccgaagccgccttgtccaagtttctcctccgtcgcaaagctcttcgtagcgtcgacgagctcgtggtacgggaaccgccttggtcccatccccatctcaatctccacgatgggctcgccgtcgtcgtcatcgtcactgccgtgccagcctccatcctctgcctccctccttttcttgctctgacgtcgtcgtacaaggactgctaccatggcgaagaggagaatgacaaacattaccgcaccaactgtggctcccgctacaactccgccacgtctggaatgcgacgttatcggggtcagggaaggcggtggtggtgacggtgacgacggcggcggcggagatgctacttttgctgccagcttctgctcgaacgacgaactcgacttgaagtaccaagaagtcagctgatgctgctcataggctgagccaattgatgccgagaagccgacggtgatgttctccggcaaggctctcttgagatcaaccatggagctaagggtgtaaggcgtcgtcgagccatttatccatagcttaactgacagtattctcgaattgttgttgtagtcgacggtggcggtcatgttcccgatgaggctgaagtttggtagggactcgttcgtcacagatacgacggagttgacgtcgatgccgatgtggtcgttggttgtgttagggtcgaaggggttgacgaaggtgtcgaactcgacggcaacgaaccggttctggccggtcgagacgttgccgactgtctggttcgttaggccgaggttttcgccaccttcgtggcccactggtaacctcgatggatagctggtgaggaagaaggccataccgtcgccctttttgcttctatcgctcggagcgattatgttgaaggagaagcgcgtggtgaagctggccacctcgccggtggcggcgtcccagagctgcactggcggtttgtagaacacccgtccgacgttgttgcccacactgttcgcactgatgtcgatatacccgacgctgacagaggcattgccttcaatttcgatgtactggttgtgtgaggaggcgaaggtggggtagttgaaggacaaggcggcgacaggagccggaggctgcatgtagcagacggagaagaagatgacgaggtcggcagcacaagtgatcaacgaaaagatggccatcgccgccggcgagccagcgtcgatagatcgtgtgcaaggtgatactgatacagtactgtgatactagtactgtgtactgatcggcttctccagctggaggagcaacgacacaacttcctatactgccagtctgagtctgtatttgaggtatcctccattggacccgttctcggcctggcgcgtgacgacgaaacaagagtaagtcaaaccacatgccactaaagtggagtattcgtttcgtacttatggtacaatgtcactgaactcttcaaataattgatactagcatatattactgtctgtgtctcctctagcactaaaataaatatagactgtagccgttgtgctccccaccggccgtggcccgcggtcgaccccgtaccgtacacgctcaccctctagttactgattggactaactgtatttatggcgtcatatttttcattaaaaaatagtcgatatgtatttatattgtaagtctctaaattacatatgtaattttaatgtatttacaatttaagttctaaaattgcatatgtaagtcttaaaattacatatgtaaatcttaaaattacatattaaccatatgtaaatgatgcgtaagtggggtgtaactagtatgtaaatttgtataaatatataattacaacaataaagtcaattgactgctacaaacccatagcaactccggatcaacaaataaagtaaaaaaaatgcaaagggataaacaggtggagaaacggatgtgcatcgtgcacacgatgtccagcgcagcgcataccagccgttaaaatccgactgtactcagccacataatgtggcgtcactttttcagcaaatccgttttaaaattagttttttttctccactatccatctagaaactacaaaccacataatctttagctgccctttggcgcattttgtttggtgtttctgtagagatgtgctgaactgggatcatgttcctcttaaccttggtgacttctttatccttgctgacattagagctgaattaaacatatagctgtgaaaattgccctgcttgctgccatttgctggactctatatatggacaacgagaaacaacatcgtgttcagggataaacttgtttactcacccctaatactacctttccaaattgtctctttcttattgcagtggagtcctttgcatcggctggagatgaagagtgatctagagaagctggtaaagaggtttaaggagagaggagctgctctaagacaaaacagaatacgagttgattgatcttgctagccccatgcaatgttttggcgtttggtttgttttagattgctgccgctttttttttaacgagacggtgcgaagttctattgatagagcaggaaaaaattacaagattacaaccttggaaggtcgtaaccaggaaaaaggaaaaaaaatatactaccacccacacaccgacagcgccaacacacagatccgggagaaggctagcaccggaccggccaccgctaagcgtgaccgaccaccgctaggccaacaacgggacatagacgagatcgcccaaaaacgcccttacaaccaacacaaagcccgactctattcacgtcttccggatttaaggagagggggtgagagaaaagaaggaacacctctccccctagggcctccgacgtgaccaacttgtaggaactaggatgctgccgcaagaggatgagaatctagagcgtgcttgcaccaattgctcgagtgatttcggcaaggggatacctaaacgacgtctccaaggagagaagcgatggaaaaccaacgccaccatccgtcaaggtctcaaaagagccaatactgggcttttgcccggcaaccacccttgaggggtgagacggcacgacaacgccctcaggagggagaatgacactcgagcactgatgctgggttttcacccaccgctcaccacctgcgagtccacggctgacgcaccgatgctccaccgaccgcccaacctctccgacatgtgggaccactgcatcagcgccccctgcacagaaaaatcgattttcgtgtgcaggcctcttaactggaacgcatgcgaaaatttcaattttcgtgtgcggctctttaagaggaccgtacggaaaaatcgattttcgcatgcggtccacaaatcgattttcgcgtgcggtcatattaagtgaaccgcacgcgaaaatacctctccctcgcactcacttcaaatttttcacacctcctctcccttcctttactttttattttcactcctctctctctgtctctcactttccttctctatctctttctccatctctttctcttctccactccactcctctccgtggctggcgacgaggcgcgtcgaccgggtgggcgcgccggcgagcggcgaggggcgacggcaaccggctcctaccaggatccggccgcggcggccgtcccccgcccggatccggtagcggtggcagtcggcgcgacggtggcggcggcaggcgagctcgacggtgacgacggtttcgacggtggcaggctcgatagcgatgacggttgcggcagcggcggctgggtgcggcggcggcgcgacgacagcgacaacgccgggagtggcggcgggtgattccagggttagggttaggattttttatttttttattttttttttgtgcgtgcgggcggtataatttgaccgcacgggataatcgattatcccgtgcggtccacttaacccgaccgcacgggaaaatgattatcccgtgcggttgggccgcccgcacgtgaaaatattgattttccaagacccctgagtgcagatgggcaaaacctctgtacggaaaaaacccatttttaccgcacggaaaaatgcttttcatagtagtggctccgcgtgaccgcaaggacggcggcagcggggcttcgcgcaccacgcgcttgtggcggccgggggagcctccggaggtggcggcggcggtagctttcccatccagatccgggccggcactggccagatctagcggggcgccgggagctagcggttggcggtgggggaggggttggcgccggggctagtgacggcgcggagactggcggcaggcacgggtggcgtcgtggtgggtgggcagaggccactcgcgccgaagttgcagcgtcggcgtcggcgttcgtctgcgcgggtccacagaggtggcgctgcgcaggcaggggctacggcggcgtggtggttgcggcgacgatggacggctgtggcgcgcggacgtcgaagccggcttgctccaccctggatggatctgagcgttcgtggccgaatccgtcgcctccgcgcttgatctggccagggcagccagccagcggggcggttgcgtgtggtggcgttgcatggctcgggtgagctccgatgagctcgatggctgcactgcgtcgcctaggcaggttccagtggggttgctcgctggcgacgagcctcttgctcgcgatgtgcggatgtggagttggcgggacgttggcttgcgttggcatgaagcaggaatggggcttgacatccacggcggtgtcttcctcgttgccggccgagtgttctccctccttttggtttccaccttctttggccagaccctgttctggttgtggggaatgctagggggagggcggaggctccaacttgctgtaggaatttgcagcggattgatggcgtttcgagggtggccaagggcacatccttgccgttggttacggtcaaagtatgacttcttgtgagacgccatggacttttctgtggccgtcgatgtgggggtgcttgtgtgggtgatatgaagacactagtgaaagccttgtcgtgcctttggccagttcgacgatgacgacgcccgtgggtgccgtttcccttcttggaggcgtcgtcatggcgttctttcatatccctcacaaatcttcaggtgaaaaaattgttccggatttcggacgagcggcggcggaattacgcgtcgtgtcctccttggaggcatcgtttcggagaagttcctatgcatcgacgattgttgatggcctttttcggttcaaaagctttgatactttaatgttcggcgaggccttcgccttcttaggtccgcttcgttcttgtggtgggtgacactctcttcggttgtttctactgatgaagtcggagctgctcgctgatgaggtgcggtgacgcttggcaacggtgacatgttacagtctcttccaaggagttggtgctagtcgtgtgaaggaagtggctctttgatggcttggctgatgtccattgttggataacggagctgcttttcgatcgctttggcgactttcgtggtttcagtgtcgctgcggttgtgaagtcggcgctgctgggtcgcttgggcggctagctcggcaacgataacacctcttctgcaatgtcggagctgtggtatcgcttttgtgtttagcttggcagcgatgtcctgtgtttgggctctgccgtcattgttagttgtgtagctaggtctcttgcttttttctctacggtgggtttcagccgatttcccataattaaccatgtagttgtatggtttttgggcccggtttcccttataaattaggtcaattctcttcttctaaatatacaagctgggacaaagttccacctcagttttgaaaaaaaaaacaatgccgcgagctgatcgcgaccgtaatttgtccatgcatttgtaatgctcggactcgaactcgagagatattagggtgttaaactaatgaatgtccatttttcttcagggatgtaaaatggatatttctcttaaattaatgatgtctatgtagagagcagaccaagaaaacatagggttttgattacgccacaagtgaaaattaaactgattactgtatcaccaagacacgtactcgtaagaattagccatacaaacaacaatagtactagttgtatgcttgcaactccctacagttccacgaagataccacaaatcaagaataaaggggttctttggatgccactctgtttattctatcagcaaatttgacaatgccacacttgtggaaaattttgactaaaaaatgatcaatttaggtgtgggtgtcgatggattatatctaatacaagaggtatacctgatccgtaatattgacagtcctgattgtcaaaaaaatatatgacatattattaatgtagtagaaccaacaaacgctaggttaagttagttaaatgtgtataccacaagtgtaacaaattaaagttttgcactcaatcaaacaacgcctaaggacactattggatcaagagtgatgtgggaatgcgcccccctgggtgtgaagaaaatagtcttccgctaatttgcgcgttgtttgcaatctggaaactgaagaccgggagtgggtccagcttaagtcaagggtatttagataaatactcaagattttgtatttaaaaataataggtagatagatatactatgtgatgcatgtgtaccaaaacaaaggttgtattcaatccaagaggttatattaaactcataatacgtatgtgatatatatatatatatatatatataggacactcatatggggctccatggtgcccaggcaccatggtatgaaatacacaaattcgcccaaatttttcaaaattttcaaattgtgagtatatatctagttataagtattcgattcatacctatacctagcaataaaacaactcaaatttatctttatttcataatccaatattacatacctaactaattatatgtttggatgttatatacctagaatcaaaatctaacatattacatgtttaaattcagttcaaacttgtttgaactagttagtaaagtagttaatgttaatacctaaacatttaaaaaaaattcatgctcatttgaattgagtatatactcaatttgaatcatggagcccgggcaccatggagcaccaaacaaatttaatatatatatatatatatatatatatgtatatgtatacatgttatattttttttgcagggatatatacatgttatattaggcttctgcctacaagtttattttaattaccccctcatattttgaataaacaattaaccttagaatcctaacccggtcctgctaaagaccgaaacgcttagatctatactatagctttggagacttggacagcgttcgtttgggtgagtttgagggagaaaacgtatcgttttccgcacgatggtacgtttttttaaaaaaaaatctataggaatgttgctttaaaaaatcatattaatctatttttaaaatttaaaattgttaatactcaattaatcatgagctaatagcttacctcgttttgcgtatcttcccaatctcctcgatttccttctcctcgaacacacctttggaagagatgagtcaaaatacatgtatacagtaagtccgtccgtacgtgttgaaaaacaagaaatggcctgttgggccatatgcctgaacgaaatactccaaacgtggcctgttccgctttttgcgcctgtcactgcgggcgaaatgcaaatatgtaccttcaaactgctggccacttgaattttactttccagttttatcactgctggccatagctgcatgttgctatagtggaggagtataatatcgttcacttgttgtggcgattggatcagcaaatcaaggagtaccaaccatccaaattaatcacgcgctcactcggggtcgtagctgttgctgtttcgtgttgagcaagagaatatccagactttaatattctcttgtttgtgaattgtgatatcacctgccagctgggtcttgtcaggtcttgagcaagctcggcatcatgaaacgccttgttgtttaaatgatcgatcgaacactgtctttgctaatgtacaattgtgtgtataggaaactcggcgagttcacatgcgagtgccaggatcactgcatcgctataactgaacacctgaaaatgcatagatccattgcatccgttgcctctactctactgagcggatgaaagttaaattggcgcacgtaaaaaaaaaagctattagcacataattaattaaattttaattattacaaacttgataaatgtatttatttgatattttaaagcaactttttatatagaaagttttcgcacaaaacgtaccgtttagcagtttgaaaaacgtgctaacgaaaatcgaggtaaaatctgtatgtgtgaaaaatgctagtggttgattggttagaattaatggtactgcttttgtttgcatatttttttcttgtctaatgatgaaatcgtttgctttgttcgtgagagaatttatatgtgctacatacccaatttggtgccgaatgctcattaacttgcctctacggctctacctgtgatgttccggtggccaaattatattttttaacgaatcgatatttagatggtgccaatttcatttaatagagtagaaaaaatatataagaaaaggaaaagaaagcccgaaaccaggtagcaatgctgcgaggtgttttgctaccccggacccaagtcttagcgaaccatattttgtcgcgtttgaacttaattacgtgtacacaatcttccacggcatttctctcaactttttcaccaggccgaccaaaagttgacagccagcgttttgcgccgatcatcgtatgagatctatcaacgcgatgaatatgtagtcctgcgagaggcttcttctcttgataccttcaatcatttttgttcttttgtttttgagtttcagttattgcaacttaaacaataaatgagttaacccacaaaattgctaatttgccatgtagatctctgcctgagggcgaggaagagaagaatatattcttaccttatcattgactctagacaaacgatgaaggactctaggtacaatatatgcaatgaattttttttaagcgaacgattgcaggagctctgctggaatttttagtaagtgagaaagttcaggttaaaaaaaggttacagggatccggagtaaaaaacaccccttttagaacaactggagaataccgcaaggtaagctaagaaaaactatcgacgaactaggcggttcaaaaatgaaatgttgctctgccacgatgaaggactctagatacaatatacgatgaaaaaatatatatgatgaaaagatggtacaccgaagtaaatttggaaatgatggctatatttgtggaatggttccttgtgtaatgtggatgacttaggaatcgagtcaagctcaatatagttgaacatgccctaaggaataggacatccactaaaaacaaaaaaagtatgttgagaatgacagcatccactgaaagaatgaataaagcgtagagagaaaatgacaggaaactaaatggttggaaaattgaaaagcatgacgtaaatgcatgtacgtacattactcacgtcagcactaggcagctctaaagaacagattaacggggtcacgtgctgtacataccattcaacgatcaactctaaaataagagcaaatcaaatgaactaaaaaaacatttagcaccatcttttcacttatgattatgtatgtaaaccaaaatttaaattttaaaacttagtttttttaaaaaacaagtgtgttttggttttatttgtgatggaaaattggtgagaaaattggaaaccatgtaatggtttttggttgaaaatttggtttggaatattggcgattatcggcgtgagtgctgcaatttaaatctctaagggtttgtttagattggtggattatcacgggatttttggaggaatactattcataggattgtttttcccttttaataccattcggatcacaaaaaccaatcataagaaggtcgcaggaaaaatttcctttacttttgcttccatgggagaaacatttgaaaatatccatccactctaatctcttttttcattttcttcgtgttggaacgaggcaatcaagcattaacaaatgcaaagaacagagaaagaagaatcagcgaagaacagagaaagaaaaggcagatctcacatgattggaaacatatcctatgcacacaagcttccgtatacactccatgcacaccaactagcagatgtcacagaaaattttagaaaaaattggacacatactcataatagtattacacatatctgcaaagtctcatattcaaattcattatattttagtcgtaacaataaagtgaaaaatctgacagtttttagggtaaaaatctgtcagaattttgtttttttgttacggctaaaatataataaatttgaagataagatttcacacgttggtgtaatactattggaagtatgcgtccaattttatctagaattttatgtgacatttgctagttggtttgcacggagtgtgcacggaaagcttttgtgcataggatatgtttcccatatgatttctttaaataagttccgtacaggaagcaaagcccatacgacaaagaatcccaagagcaaacaagagcaaagaggtcacgcgcagaggtcaccggcaacggtatcgaggtcagcttccagtgtggagctaatgcggcgcgtggcgtgcggaggtccccggtgacggattgaggttggcttcggtcatggataccgcgcgtgaaagttgccggcgacggatcgaggctggcttctggtgtgtagtggatgccgtgcgcggaggttgacagcgacagatcgaggccggcttctagcatggagactggagtggatgccacgtgcggaggtcgatgatgacggggatcgagagcagcaggccaacatccagcgtggagcagcaggctagcatgaggtaccggtatctcgaggtactttttgttggactggagcaaaatctttttctcctatcttacgtttttcctatgctataatccgaacaagccctaaactagatttcaccacgatagcaagatctcaggccctcctgagaaaggatccctgcccatagctaggtatccacaattttctatctaatctgaaataagaacacgaagtagaaaaaaagtgcacttataattaaatgatgtggatcaatgtgtaccatgagtgggcaagcgtacatccctaacgaggtgtgattgatgtttgtgtcaaacttgaggatgatattcctgtcgacgacgagtgctggccctctgatgaggccaccggcggcccatatgttggcacgggcatcttggttggtagcatcggtagtggtccattggattggagaactgccatggcaactctaatagatggacgagcgcatcggtctgggtgagcacaccagagcccaacaaccaagacacactccatgtctgtcgcgtcgtagtcaccgttgaggcgctcgtcggccgctttgagaacggctccctggccgtaaaggtcccatacccattcgactagtcggaagaggccattattctggtcatccagtaggttcattggtctccttccacatgccacttccagaagaacaatgccaaaactgtacacatcagattcagcacttgctttgcctgtgatcacacattcagggtcgacatagcccggtgtacctgaggggtgggtcatcgtttgtgctccaatagcatggtcaatgagccttgcgaggccaaagtcacctagctttgtattgaaggattcatccaacatgacgttgcttggcttgatgtcacggtgcacaacgcattgctcccactcctcatggaggtagagcagtgcattcccaagcccaagaacaatgttgatcctatgacaatatccaaggtagttgatcagttgaatttcaattgacatttgttgattgcacattgcaagaaataaaaaaaataaaatctgaaatattaatgagagttaattaattacctcattggccatgtgaggaaggtaccattgccatggagatggacatcaaggctgcggttgggaacgagctcgtacacgaggaggagctcattgcgaccgtggcaccaaccgatgagctgcacgagattgcggtggcgcagccgacttatcaccttgatctccgacttgtactccttcctcccttgcttggaggagtctttggcgaacctttttatggcaacgtctatgccgagctctctcagattgccacggtacaccgcgccaaaaccgccttgcccaagcttctcctccgccgcaaagctctttgtcgcgttgacaagtatgtggtatgggaaccgcctcggccccgtccccatctcgatctccacgatgggatcgccttccgagtcgtcctcctcttcctccctcatcttctttctctgacgtcgtcgtacgaggattgctaccatggtgaagaggagcacgatgaacagaattgcaccgacggtggctcccgctacaactccgccacgcgaatgttgtcctgtcggctgcttctgctccaacgtcaagttgaagtaccaagaacgcagctgatgctgctcaaaggatgaacccgtcgccgccgagaagccaacggcgaccttctccggcaaggcgctcttgagatcaatcttggagctgaggttgtaaggcgtcgttgagccatttgcccatagcttcaccgacatgatgctcgaattgctgttgtagtcgacgatggcggtcatgttgccgatgaggatgaagctaggcagggattcggtcttcactgaccggagggcgttgacgtcgatgccgatgtggtcgtaggtggcgtcggggtctaggaaggagttgttgtaggtgtcgaactcgacggcgacgaaccggtcgccggcggtggcgttgtcgaaggtctggctagtgaggccgagggcgccgccgtagcccatgtacggcatcctcgacgggtagctgacgaggaagaaggtctgttgcagttattcctggtgtggcccgagctgatccggacgacgcgggaatgcaacggtgtgtaacggtgtggcgagatgcccgggcaaaggagatcggtggcgactagttcgtgcagcgcaggaagcgcgatgaagcagagtgcatgacggggagtaacctcgtcgtttccacatttgtaggatcaaagttgttagcctataaatagttggtggtaacagaatttgtacgcgcgcattcagttttcatttcagttcgaaataaacaccgaaagttgcccaaatactctcccaagttattttgttcttgttctctgcattctctgaattctctgtctccctgaaagtttcttcagtctgctgtgccggatagctacaggacgcccacaaggtgttcgattggtgttcttcgccaacaagtggtatcagagcactcaggttgagggctgatctgacaccatggcgttggttccggcgggagccgcagcggatccggcgagggggagctcagggagtgcgttctcctacccacaactcacggcgacgaattacaccagctggtgcattcgcgttcaggcaatgatggaggaccagggcgtgtgggacgccatcgagccggcggccggggtggccgtcgacccaagaagggacaagaagtcgaagtcccatctgctgcagtccctcccggaggacttgctgatgcaggtggcaaagaagagatcggcaaaggaagtgtgggattgcttgaagacaaggttcgtgggcgcggaccgcgttcgcgaagcgcgcctgcagacgttgaagggtgaatttggtgccatggtgatggagccgggggaaactctggatcagtacgcgggccgcatcaccgcgatgagcgtgcgtcactcggtgttgggctcgacactgagtgattccgcgatagtgaagaagctgttcgacacggtgccagagaaattcatcagcctcgtcgcaggtattgagcagttttatgagattgataatatgccatttgaggaggcggtgggtcgtctcaaggcctacgaagaacgagttcgcaagaagaaggcggccgctggtggtgtcaccgccgacggtcaagtacttctcactcaggcggagtgggaggcgcgtttcaggaaggacggcagcgagtcgtcttcgccgcagaaaaacaaacctcccagcgacaggggaaaccgtgcccagggcggacgcggtcgcggcagagggcacggtggaggtggtggacgcggcagcgcgccgcggaacagtggcgctggtggctctggcggcggtggccgtgacaagagccacatcaagtgctacaactgcgaagaattcggccactactccacccagtgccctcatcccaagaagaagaaggtggaggcccatctcgcgcaaaccgacgacgcaaaccctgcattgttactggcggtgaccgaagacgagccggcgagcgggctggtcgtacacgaggagcgtgtgtggccgcagctgctgttggctgacagcggagcagccaccggggacatctggttcctggacaatggggcaagcaaccacatgacgggtgatcgtgctaagttcagagatctagacgtatcaatcaccgggagcgtcaagttcggggacgcctcaactgtgaaaattcaggggaaagggtctatcctgttctcctgcaagaatggggatcaatggctgctgcaggatgttttttatatccctagtctgtgttgcaacatggtgagcttgggccagctcacagaaacggggcacagagtggtgatggatgaagatgtgctcgaggtgttcgacaaaagtcccctgcggctggttatgcgggtgaggcgcacccctaatcggctgtaccggatcgagctgaagctagccactccggtgtgcctgctgacaaggatggatgagccagcatggctctggcatgcacggcttgggcatgtcaatttccaggcgatgaagctgttggctgacaagggcatggctggtggcatcccggcgatcacacatccaaaccagctctgtcaggcatgtctggttgcaaagcagataaggcagccgtttcccgcaacggcgaacttcagggcggaggagccgctcgagttgctccacattgatttatgtggaccgatcaccccgacaactatggccggtaatcgttactttatgctaattgttgatgatttctcacggtggatgtggatgttcgtgatcaaaacgaaggaccaggcactagaggctttcaccaagttcaagccgctggccgagaacacggccgggcggcgcatcaagacgctgagatcggatcgcggtggcgaattcctgtcgggcgaattcgcgcagttgtgcgagcaggcgggcatccagcggcatctgacggcgccatactcaccccagcaaaacggggtggtggaacgccgaaatcgttcggtaatggcgatggcacgatctctgatgaaagggatgtcagtgccgggcaggttttggggggaggcggtgcgccatgcggtgtatctcctcaaccggctaccgacgaaggcgatgggcgatcggaccccgttcgaggcatggacggggcgcaagccgcagctgggacacctgcgggtgtttgggtgcatagcacacgccaagatcacgacgcccaaccagaagaaacttgatgaccggagcgcgccgtatgtgtatctcggcgtggaagaaggcagcaaggcgcaccgcctgttcgacccgcgttgtgggcgtatccatgtaagtcgtgatgtcatttttgaagaaaatgtaccttggcaatggagtgtagtcgcaggggagcaaaactctaccgagttcacggtggaggaggatggagttgatgcaccgccggcaggagcgccggcctacccagtaccgcggtaccgggcgccatccccggcagtcccgcaatcgcctccggcaagcccggtaggggcgtcatcgtcattgccgacttcgccccagtcatcaccgagctctacaccgccttcaacacctgctaccggctctgccgggccggtggcgtcaccaggttccggcggcgaccttagaagcgatgagggtcccgtccggttcaggagtcttgaagatatcatgcgggaggcaccccgcgtggacctggtggaggatgaacacgatggggacgcgctgcttgcagagatggaggagccatcgagctaccgcgaggcagctggccagccggcatgggagaacgccatggcacaggagctgcaggcgattgagaagaattcaacatgggctctcactgcattgccggcaggacacaaacccattggcctcaagtgggtgtacaagctgaaaaagaacactgccggcgaagtaatcaagcacaaggctcgtttggttgcaaagggctatgttcagcgtcaaggggtggattttgaagaggtgttcgcgccagtggcgcggcttgacacagttcgtgtcatcctggctatcgcagctgatcggcggtgggaagtgcaccacctcgacgtcaaatcggcgttcttgaatggcgatcttgaagaagaagtgtacgtagcccagccagagggttttgtgaaacgaggagaagaacacttggtgctcaggctgagcaaggcgctctatggattgcgccaggccccgcgggcgtggaacacgcgtctcgacaagtgcttgaaagaactcggttttgcacggtgcacgcaggagcaggccgtgtatactagaggaaaggggcaagctggtgtaatcgttggtgtgtatgttgatgacttgattgtcacaggagaaaatccacatgagatagccatgttcaagcagcagatgatgggggaatttgagatgagtgatctcggtcttctctcttactatctggggatagaagtaattcagggggagaatgggattgctatcaagcaagctgcgtatgcgaagaagattctgtctcagtttggtatgcagggatgtaatcccacctcaatccccatggagccacggtcgctgctgcacaaggatgctgatggaaatccaattgatgcgaccgagtaccggcgtgtcatcgggtgcctgcgatacttgttacacaccaggccggatctgtcctacgccgttggcgtggcgagcaggttcatggagcggccgacaacgatgcatctcaaggcggtcaagatgatactcagatatctaaaggggacgctggactctggtctggtgtttgcaagcggcagtggctcgttggacatcacgggtttcactgacagtgacttggcaggtgacatggatgaccgtcggagcaccggcggcatggcgttctatgtgaacagcagcttggtgtcttggtgttctcaaaagcagaagacagtggcgctctcgtcttgcgaggcagagttcatggcggccactgcagcagcatgtcacgcgctctggcttagggcgttgctgagcgagatgatgggtactgaagcaaagcgggtgaaactttttgttgacaacaagtcggcgatcgccttgatgaagaatcctgtgttccacgggaggagcaagcatattgatacccgctaccatttcattcgtgaatgtgttgagagtgggcagattctgattgagttcgttcgttctgaggagcagcgagcagatgcaatgacaaagggactgccggcggcgaagctggcgactgcacggcacctgttgggtgtgcgtgatctcaggccacgccaagactaagggggagtatgttgcagttattcctggtgtggcccgagctgatccggacgacgcgggaatgcaacggtgtgtaacggtgtggcgagatgcccgggcaaaggagatcggtggcgactagttcttgcagcgcaggaagcgcgatgaagcagagtgcatgacggggagtaacctcgtcgtttccacatttgtaggatcaaagttgttagcctataaatagttggtggtaacagaatttgtacgcgcgcattcagttttcatttcagttcgaaataaacaccgaaagttgcccaaatactctcccaagttattttgttcttgttctctgcattctctgaattctctgtctccctgaaagtttcttcagtctgctgtgccggatagctacaggacgcccacaaggtgttcgattggtgttcttcgccaacaaggtcatcccgtcgcccttgttgctcttgtttttcggggtgatgttgaaggagaagcgcgtggtgaagctggcaacctcgccggtggcggcgtcccagagctgcaccggcggcgtgtacaccatccggcccatggtgccgccgctcgacaggttgttccctttgcctttggtgagctcgatccattcggcggcggcgccggcgagcgccgcgctgccctggagggtgatgttcttgctcgcgttgctgaagctggagtagttgaaagatacagtagtggtagcgacgacgctaggcatgacgagcaagcaggctagagcagccatgaacggttttgtcatgaggacgccggcggccatggccggtctttgagcggaatcagcggccggacaatactgccaatgccaaaaacggaaaactactagtagtactcaaatcagcaggtggccagtcgccagtcgccactcagagagaccagtcgagatcttaaggactctgctaatttaacaagttggtggttggcaaatcaacactaggctccatgagaccatgaccctgacagctctggctcctcggaaggtgctgaaatgtatcatattttgtctattttgctaatagatgacgaagttaagcgtaagttccgtttcttgttggtatcttccctttttcttcaaatacattttcaagaatgataaaatcctttttatatatatacatcaagctggtttatatatatatatatatataaaaggtg

SEQ ID NO: 80169 - DNA, 21450 bp, Oryza sativa
catatcatgatagtatgaagtaacagttctggtatcttgttttaaacattgcagtttgttgaacaaaatgtcagcataatacatgggaacataaacatctctgaaatatcgtttcaggtctttccaagattgtggtattttgttatgcctacaaagatgtttccaatcattagaagcatgtttaattaaaacactagaggcacacataaccttttgtttctccgacaagacatgcttttgaaattcactatcaaccgctagctcccaattaatgtaagcacgaggatcatagtctccctcgaaataaggcagtgcagatttgatcttacctagaacatcatcacttacctcataatggtcatgttgatccctcctcatgtctcgacgaagatgtcgatgttgagcgcagctatccccaattatcttgcgtatccctgccattgttagtagaaaacaagaaacatacacaaaaatatgcacgttcctattaactactaggtagtggcagctcaaaaatcgcacacactcaagcttttaaccaagctcttacaagatcttaccaatgcaagtggaatggtgacatacaccgactcaaccaagcaccccaatgaaggttggatgtatcgatgccttggcaaacacttgcggtacagctgtaatcaaatatgtggagctcgggtaggcttaaatatgtagcaaaggaatagcaaatgctcaaatcagataatgcaaagttgaataattgttcaaagtcaagtaccgtgctggtcctaggctagaacgtactagagacgcgagcctagacacaaacgataccacaagatagcactaggaacaactcatgcacaactctgatatatgaagttcagctcaaacataacagtattttctcttttctttctttcttctttcttcttttctttttttttctttccttttcttttctgttttttttttgtgcggctttttttttcttttttttttgcacctttcttcctttttttttcacttttttcttgatttttttaacaaaaactgactcaaggaccttaatgtaagattacagggactcaaacttaaatataaaatttacagggactcaaatgtaaaagtctaaaccccaaatttaaattatccaaaaaaatggaatgctgaatttatgccggttccgtttttccaaacagatctcgaaaccgacaccaaacaaaaattcgccaaggtgtttgacacaactcggaaccgtggaagagagggagggagtcggactcggccaaaggggcgagtgggactcggccaggaggtggagtggatggcagccgaatttggtgtatgggataaaaaggaaactgatttttaaccaatccaatctactatatctttccaaaacaatcttgactacttccaaaatcagatatggtaattcaccttcctcctctcgtgcacgacacaggcacggccaaaacaaacacacacaaggatcggcaaactctagatgcaactcaagaactccaaaactaaccgacagaaacttctgaaaactacaaaaatagaaccgtggcagcgagccgattccgttttcgtaggtcccgacaacaacagagacacggtggcagcaacgactgtggtacaaaacgtgaccagaacttgaaactctaaacgaactagacgctaagaccagcaacacgacgtgacgatgcaacacaaaattcaacaaagcaaaaactgaaaagaacaatgcaatggcacaatatggctaggtaaatgatacgaatttttttgtatggctattttctggttataggaagataaaaactcaccgagcaacgaaagctctgataccacctgatgaaccctgagttcctctcgacactcaaggttgttgttggcccgatctttcggtgagttgatgaaaactacgatttggaagaaacgttgacgacccgactacaaccgtacaagacgttgcgttgcgccttagcgatcgatacacctctccgtgggttgttgatcttgccggtgcaaatcaaccttattcctgcaagcaaatcgaagaaacaagcaagaacaagataaaagcaatctgaattgcaaataggagttaaatacgaatgataagttggggttccgaagaacaagcagacggacggtctagccgacacgcgcgctgcaagcaagtagcaatggctaaactttaatctaacaaaacccgagaaaccctgaaggggtaactagctatatataggggtgggaggacgacctaggggtgcctagggtcgtgctccaccagcttagggcgcaccccacatgggccccacctgggccggggtcccaaatgaagttacaagcccataggcccattataggtgatgcaacaccttgttcctgtgattctggccacacgagatagaattcagagaagaggctggatccgttagaaagagggctccgagagctttccatcaagtactcacgggccgaaaacggaggtcgtatgcagatttggtggccgtttgaagtcagcagtgtagtaggtggccgaatcggattccagcacttggagtacttgatctcgatatcttcttgttcatccatgatgtgagcaatggttgcatccgtggtagccatggtcacatcagactaggtaagccgatgcagccgattccgacagtataatttggtgtatgacatcgggttgaattgaggtgcttcaagatgattgccgcaaatggatagagtcctgagaaggcaattgtatctattaattaggatgttttatgtaacttccttagagatatgtttaggcaaaagtctgccgcaaagacttattgtatcttagagtttgttagagatagtggtcgtgtccggtatggacatatcttgtaattctcgggtataaatagaccccgagccctatgtaatttttaacacacacattcaatacaatttcggcacattgccacctttttgctttagttttgtttcgacgagttcttgctttcgggttgagctgcatcggtttcgatcttcaacaagaggtaaaacttgttatgacgacttgtgttctcgagattagtgtttccatctttatgacactcttatcttgtctatataattcgtcgagttatcatatatcttacataatctttggcaatatcatcatctaacctacaatcggctaacatctgttaatagaaggcagccgattaggttaaatagcgacgttgtcctagattatataagatatctaccactttatgaaacatccagcggcttgattgtctagatattgttcttcttttcatacttaatgctgcatcagttgagtttgatctattaagtcgtgcttagaatatcaatctctagcctgtcctctagttgccgattagggtagtatcggagtttcagccgatcttatttgatttaaccatattcgatctatatgcttcaatgacatgttaaatccgccctttatgtcaagatctcattgcatttaagtatattaagcttttgtttgctatattatacttgttttaatatctttatatagagtagtatcggagtattaaccgatacatgctagatctatctgattggctatgctataaacatatataatgttgttattaatatatatttcgatctaagtgatttatactgtctcggcatggtgaccgatctatcccaatcacttgatttaagtatatattaatataagaactatatatcgttaatatctacagccgatcgaatagatttagttccttactatctatttataaccgtcaatcgattcataaatgacatcggctcaaagataaatgatatgtcatcggcacctagctgatcggctatcatttatagatttaaccacgaattctttgtctttatttcttgttgattacacgatcaaatcaactggcacgcttatatatttcttcgaaggcgagctttggacctacactggagttaagcagatctcccaggcctcgtgttttctgtcaacacgcttttggtacgcccggtgggacagattagaagtcagcaagcaattcttcctcatggccgagaagccaccgctgtcgccatcctcgactagcccaagcactgttaaagaaaagatccagaagttggggttgactgacgtcaatgaaggaaacgtcgtgcccatcgatccagagaaattcacacctgagcagaagaaagattttgaagcaatgttgcagcaagcccgggatcagttcttgaactcattcatgcagacccacaagggaacattggtttagaagtataaagtaaaggtagttgccgatgatcctgggaccagttcttccaaaggtgaagacgggaaacaagctccagatggctctgctcaactgagtgacaaaggtgctaccgacagttctctaggaagtcaaggtgacaactctcaaggggtcgatggagttcaaggcgatggagtgcatggagttcaaggtgatggtgctcaggggttgcaagggggaaatcttaatcagaatagtgatgcggcacaagattttttctataatttccaagaccgggtcgactacgctgtgcaccatgctttgatcaatcagtctggggtgttagtcaattccttattaaacttgatgaagtcaatagccgatggattagtagttgagcatcaggctgcaggcccagtttatttgcaaggaggtgtctttccaaattatcgtcatttgatcactgatgcccagccatctattcaggcagttccccccatcgcaccatcagctcagccgacggcgccggcatcgactcccttacctgctccgtcagcattggcaccaggccagctggtgaaccctcagttgttaatgagagagcagccacagcatagtgggcaggttgcgaatcggctaacgcaagatcaggttgctgccatgtttctgccgtctccacctgctgttgatccaatacagcagcagccgattcaacagacactcccgattcagcaggttgtacaaccaatccagcaacaagttgtgcaaccagttcagcaaatgccaccaaggcaacagcctccgtggccgattcagcaaacgccgttaagacagcaaatctttcagccgattcagcaccaaggctcaatgagcgcatcggccgggtttgtgacgcctggtggacagcctgttcaacaatttttaaatcaagtcgtcccagaacacttggtacagccggatgggacagtaatgcctcaagttgttcccgagcatttggcacgtaatattcagtcgaaccttcataattaccagggggcaacttgaattatcaatatcagcctccttccccacaagcccaatatcagccagggggactggctcaacctcagtttgcgtctcagtacggtcagttcgagcctatgcaacaacagtcacagggagcagctcagcaacgaccatgggccgatgtgattgctgatgtaatgagggaacagtttgggcttaaaccaaaagagactgggagcttgtatcggcagccttaccctgagtggtttgagagagttcctccccccaatcggttcaaagttccggacttctccaaattttcgggacaagatggtgtgtcaacttatgagcacattagccgatttttagctcagtgtggtgaagcatcggctgtggatgctttgagggttaggttgttccggttatctttgtctggatcggcttttacttggttttcttctctgccgtatgggtctgtcggtgacatgggatcgggagtatcatgactagaggcttgaggcagacacaatcgcccacgtggcctggcacccccgggggacgtcgggcccgagggtgatgtgttcgccctcctcttagtccccccgagggggtcgggctgcacccccctcggccccgagggtcgaggcgccccgacccctcgtgggttttcgctccgcgcgtatgagttaggtgagcacagtggggctcacctaaccacatttattgcggattggctgagtgtgtcacgacgcatgcaacgcagtgcattgcactcatttatccggtctgtgaccagtcacagaccggtcagatcgcgggttaggtggcgacaggcggtctgacgcacgcctcgccccatcccgtcaggacgagggcttctaggcgctcgtccccagctggagctagcgtgttacctcccagagatggcacgttagtcctggtcagatatatgccaggcttcatcctaaccattacaggcaaaatgttgtgtgaagaagggccaacgtgcagattgctaagctgacgcgtggtggacaagaatgaccgatttgtgaccagtctaacaccggtcatgtcgccagcagaccgccatgattccgcgtcgcgcctgctcccggcgaaagtggaggtagttgtgggccgtcccatcagaaggcgactcggacggcaacgatgcaaatctccgtccatttatgaaaaggtagagtaagtccccagggagagggagagaatggtgcatgtggtatccccttaagatatgaaaggaggaccttgcccactgaggagaaggagagagattttcgagagctttttcttggactgaacctttccagattaggatcctagaacaaaggagaggctggctcatactttgtagctccttcacacacgaatccacctaaaacacaggagtagggtatgacgcttctaagcgtcccgaacctgtatacatcgccggcgtcttctgtgcttcctgtctggcgaaccttccacatacagattgggagcttagagtctcacctagggtccccggccgaaccggcaaaggggggccagcgcggtctcccggtgaggagccccacgctccatcatctggcgcgccaggtaggggactctgtgagtgatcttctgagctctcgcactccttcgggtgcgccaagcttttcctgttcggcctaatggccgagccagcaaaggcgcacgacctctccccgagtatgagcggtgacgacggggagccaaacccacgccgtcgagctcgtactccaccgccccctccacgccaaagtcctaggcgagaaaaggcgatcgagagggctgaaggatccgcgacttcgacatccacaggaggtggaaaggggcggcgagatggggagcgtcgcctcctcgtctatggtgacggcagcacgccccagggcgcgctccaagctgcgggcgcgctcctacgtcacccgcccgtcgcccatgacccggagtctccagcccaacgctggctggacgatgtggccaaattggtcatgactgcacggcagcgcctggatgctggtgggcggtcctccgccaccaaggcctctggtgctgctaccactggctccgcgtcatcaagacgaagggcgcggcgagcggcagctgccgttcgctattcggccgccactccttcgtcgactccttcgacccgggaagatctgcgtggggggccggacgcccgcaccagcatcgagcgccggcgtaatgaccgacgtgctgcccacgcaacggagggcgcttcctcgtccagagtgtcacctcaacacggacgcgggaatcagccctccgtgcccccggttggtggtgtcggctgtagagcctttgtggcgagtctttggaatgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaaaggacaggcgcggggctggctaatgaacttgccacccgcatctgtccattcttgggaggatttgtgccaacagttcaccatgaacttccaaggcacatatccgcgcccaggtgaggaagcggacttgcaagcagtacaacgaagggatgatgagtcacttcgctcgtacattcagcggttctgtcaagtccgcaacaccataccatgcatccctgcacacgcggtgatttacgcgttcagggggggtgtgcggcacaaccgcatgctcgaaaagatcgcctccaaggagccccagactaccgcggagctttttcagctcgcggaccgagtggctcgcaaggaggaggcctggacttggaacccctccggttccggtgtggcagcttcggccgcccccggatccaccgctcagacagggcggcgtgacaggaggaggaagaagaggtcagtccattccgacgacgagggtcatgtcctcgccgtcgagggcgcttcgcgggccacccaaaaggggaggcctgcgagcgacagaaagaaaaaggccggcgctcccagcagggagcgcccagccggcaagtggtgcaccgtccacaacacttcccttcacgacctcgcggactgccgtgcagtcaaaagtttggctgagcggacgaggaagtgggaggaggagaggaggcaggagcgccgagagggcaagtccccggcggttccttccggcaatcggcgaagtgaggccaagcagaaggcccccgccgaggacatcgatgacggcgatgatgacctaggtttccaagagcccggggccaccattgccactgtcgatgggggagcgtgtgctcacgtttctcgccggagcatcaaggccatgaagcgagagcttctggccgcggcccctactcatgaggcgacgcgccgggcgcggtggtcggaggttgccctcaccttcgaccagaccgaccacccaccgtgcgttgcccggggagggcagattgcgatggtggtttctcccaccgtttgcaacgtgaagttggggcgtgtcctcattgatggaggagcagccctcaacatcctttcccccgcagccgttgatgccatcaaggccccggggatgatgctccggccgtcccagccaatcatcggtgtgacgccggggcacacttggccgctaggtcatatcgacctcccggtcacattcggtggacccgccaacttccgcacggagcgggtgaactttgatgtggcggacctcagtctgccctacagcgcggtcttggggaggcccgcgttggtaaagttcatggcggcggtccactacgcctacctccagatgaagatgccgggccccgatggccccatctctgtccatggcgacctcaaagtcgcgctcgcttgtatggagcagcgcgcggaccgcctcgccgtcgtgtccaagcccgagggtggcgacgagaggcttggcacatccgcccccgccgccccgaggcagcggatagtcacgtgcgatgaagtcccggtcaagcaggttgccctgggcgacggcccgtccaagaccacacggattggtggtcttctggacggcaaataggaagacgcgctcgtctctttcctgcgggcaaacgctgacgtcttcgcatggagaccggcggatatgcccggggtccccagggaggtgattgagcaccgtctcgccgtacggccgggcgcaaggccggtccggcagaaagtgcggcgccaggccccggaacgtcaagccttcatccgcgaggaggtggcgcgacttctggaggccggattcatccgcgagttcatccatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccacagcggggtgcgaccttttgtgttttctagatgcatactctggttaccatcagattcgcatggctagggaggatgaggaaaaaactgcgttcattacccccataggaacttattgttatacgacaatgcccttcgggttaaagaatgcaggtcctacttttcaacgtactactcgaatttctttgggtagccaattaggacgtaatgttgaggcttatgtcgatgacttagttgtaaagacgcgcaaccaggaaacgttactttcagatctagcggaaacttttgagagtctccgctccgcccgcataaaactgaaccccgataagtgtgtgtttggtgtacctgcgggcaagcttctcgggttcttggtctctgcccgaggcatcgaggccaaccccgagaagatacgagctatagagcggatgcgcccccccagcaagcttagggatgtgcaatgcgtcaccggttgcatggccgccctaagtcggttcatatcgaggctgggggagaaggcgctacccctatttaagctcctcaaacgctccgggccgtttacttggacggaggaagctgaacgtgccctcactcagttgaaggcgtatcttagctctcccccagttctggtcgctccggagccaaatgaacccttgctactctacttagcggcgaccccgcaagtggttagtgcggcgttggtcgtggagcgcgatgaggacaatcctcattccgcgcacccccaccttgtgcagacttggcccgggagagagcagggaggagaggcccccgagccgaacggcggcccaaggcccccgacgaccggagttggccctctacccgcttgtcaaacggtgctaggagcccccgacccccaggaaggccccgaggccactgcgggaaggccgcacctatcgccctctgaccccgaggctaaccctgtgccgattcgacccgggagagagcagggagaagaggcccccgagccgaacggtggcctaaggcccctgacgactggagttggccctttgcccgcttgtccgacgacgccaggagcccccgacccccaggacggccccgaggccactgtgggaaggccgcccctgtcgtcctccgaccgcgaggtcgtcggcacaggagacgagtgcgccccgcgaggccgctcgggtgaagagcgccccagggatgcggcccctagcgaagaggatcggccccaccgaaaggtgcagcggcccgtctactttgttagtgaggccctccgggatgccaagacccgataccctcaggcccagaaaatgctttacgctgttctgatggcctcgaggaaactgcgccattatttccaggcgcatcgggtcactgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaatgcccgaggccagcacgaacccctcacagctgcctcacgccgcccactgggtgatgcaattcgacggttctctgtctcttcagggcgccggtgcaggggtcacgttgacctctccgaacggagacgtcctcagatatttggtccgtctcgactttcgagcgactaacaatatggcagagtacgagggactccttgccggactcagagtggcggctggactggggatccgccgcctcttggtattaggcgactcccagctagtcgttaaccaggtctgtaaggagtaccggtgctctgacccacagatggacgcctacgtacgccaagtacggcgtatggagcgccattttgacgggatagagcttcggcatgtgcccagacgggataatatgattgccgatgaactctcaaggctcgcgtcctcgcgagcccagaccccaccgggcgcctttgaagaaaggcttacccagccgtcggcgcgacccgaccccttaggggagacggatgcgcctgaccggcccccgaggcccgtcggagtccaggcctcgggacccgaagagagtgttccaagctcccttagattgattgcttggatctctgagatccaaacatacctcacagataagactctacctgaggaccgcgaagggagtgaacgcgtacaacgcatttccaaacgctatgtgctggtagaagggaccctctatcggcgcgcggctaacggaatcctcctgaagtgcattcctcaggaacaaggcgttgagcttcttgctgacatccatgagggcgagtgcggagcccattccgcctcgcgcaccctggttggcaaggcctttcgtcaaggattttattggccgacagctctcaatgacgcagtcgatctggtccggcgatgcagagcgtgtcagttccacgccaagcaaattcatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctcttaaatttattaagggcatcacggcccgttttggagtgcctaaccgtattattacggataatggcacccaattcactagtgagctcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcgaaccgaaccacaccaagccgagcgaccggggaaacgcctttcttcctcgtctacggcgcagaagcggttctcccatctgagctcaccctgaggtctcctcgggccaccatgtactgcgaggctgatcaagatcagcttcgtagagatgacctcgactacttggaagagcgaaggcggcgcgcggccctccgagctgcgcgctaccagcagagcctgcggcgctaccatcagcgccacgtccgggcccgatcactctgcgtcgacgacctcgtcctacgccgcgtccaaacgcgtgctggattgagcaaactctcaccaatgtgggagggtccgtatcgagtgatcggtgtcccccggccgggctcggtacggctggccacgggcgacggcacggagctgccaaacccgtggaacattgaacaccttcgtcgcttctacccctgaagggggggggtcgggtgtcaggttttggctcgggctaaccccgcaccccccctcgggtgtgcagggttagccgggggctaccacacatgcatatatattcctttcagcatttcaatagaagcagtttcaatttcctaaaggttgtgtctgtgccgttttttccttttgaagaatcttgacttgaaataatgtcactcgtgctcaaccttgccctcgggggctcggttcggtcagctaaaatcgccaaacggggcccagaaccgagccgtgccccggggcgtggtgaactccgggggggaatcggcaaaaacccacaatcgggtcacccatacccctcggtcaccacgttcccggcctggccagtctcgacatgcggatctccccaggcactagccccgacccgagccattcgaggaccgggacttgggcgcgagcccttatttcaagctaaggcgcaaaaggaccatggcacagatcatcctcaactcatatatatagcaaaataaaactaacacaaaaatttttcatcatttctcattgcagattaagttagattgtacaaaaaagaggcatgaaggccttagaagaaagaacaagaaaaaagataagagtggcgggggcctgggggctcattcatatgcgcccgggtcgccggcctcgtcgccaccgccgtcctcgctgctggcgtcgccctcctcgtcggagctgggggcgaacgcgagccgaggggccgagccctcgaagctgttgacgatgtggtcggcagcgtccccgacccgcgcgcgcgcgtcgtcctcggtcccgggagggaactcctccagcgccatccagggggagaagttgggatcccgggcctggtaactcgccagcacgagttcaaccgccccccgggcgaggtccctcgaggatgccttgatggtcttctcaagctcctcggggagtcgctcgagaacccaagccatcctgttgaggtgcggagcgaggccttccagattggtggggggcaccgacgtctggcctccccagaggcccgcttgccgaccggcgcgcttcatgcgggagaccgcatcccagagcatgtcgggcccgatctcgcccgccaagcgaagggcctcggcctccccggtggaggagtccagcgcgcgctgcatgtcagcgacggtgtgttcggcagccgcgaggcgagcggctaagtcgctttcgcccgcggccgccccgctgataggcgccctcgcgtctagctccttctcccgcgcctcgaggccagcagcccgctgctccagcgcggctctctcggcgcggacgctttcaaggttgcggcgcgcctgctcctcctgcgccgcctcgcggagggagaggctgtccgccagccgttgcgtcgtggcctcggcctcctcgagagcccgctcccgctcggcgagtgcatcctcgcgaaggcggagcgcggactcctcctcggcgcaggcggcctcgtgcgccgccagcgtcgcctcccggagagcagtggcggcctcgcggtccatcaagctcctctccacggcgccggcatgttcttccagcgccatggcacgggcctcgagggcctcctcgcgccgccgggacgccgcttcggcttccgttgcccgccgctctcgggcagcggcggagtcgagaaccccttgggcggcgtcgagcttgctcttcagctccgcctcccagcttgcgtgctgaagacggagggtgtcttgcgcctcgaccatcgcggtggtggcgacgagggcggcctctcgctcctcctccacctcccgggcgatctccgccagcgccgccttgcgggcttcgagctccgagatgtggcggcggtgggccttacggcccacctccaccatggcgtccaccgagcgccgcccctcctcgacacgcgcccatgcggcctcgagctccgctcgttccgcttgcaaggcctccacctgggcgctaaatccatctagcaccgcggtgtttgcggcggccaaggcctgcataatgggctcggcgctcactggggcgacgagagaagaggagaaaagccgccttggagaaaaggcgacgcggcttggccccccggaggatgcgctgggctcggggatgtcccccgggcccgtttggtcctgggcgtcgcccggtgaggtaggcccaggcgatgcgcccgcggcctcgtcgcgagccgcctcggaggatgtcgcctgagggccgcccgagggagtgggcccgagtgacgcgccagcagcagctgccgcctcagcctggcgagcccgggcggcctcctcctgggcagcttcttcggcttggcgagcccgggcggcctcctcccgagcagcctcctccgcttggcgaacccgggcggcctcccgggcggcctcttcagcttcccgaaggcgggctgcggcttcacgccggtcagactcccgcctccgctcctctgcggccgctggatcttcggcctcggactggccggacttggggcggcgggaggaatgcgacgggacatcgctgaagcagaagaaaaaaccaaaagacgaacaaaatgggtaagaaaaaacttctctttgggagaaaggtggtcgcaatgagaatgagacgaacctgcgagggggtcggttgaatgaccaccttggaggggaaattaggtttccccgggctggttccgtctcccccatcttgcggagccgcttcttcttgcgctccccctcgggctgtgacgtcggcgcagccccctccgggcgccgaccgctggtacgcactgccccgccccctcggggaggagatgggggaggtgttcctcccagcttcctcttccccggggcgtcggcagggcggctgctccccgagcccccgacgcggggcccagaagcacgaccccctcctggggcagattttttccccgggcgactctcgcccgcgccgtcgtggcccttaggggctctctcctctgaggccccgacccccagcataatggttagaatggagacgcggtcgggatcgatgcagagggggaggatctcctgaggaaggcgagacgcctccgcggagctaagattcagcaccctttggactacgatcttgaagtcctcaggagcccaatcccatctggctccctggtgggtccgcatgtagtcttcaggcccagtgtactcccaggcgctccgggcgcgccgttggagcggcgcaatccgccgacggaggtaatcgccgtacaccatggccccggtgagcccctgggatcgcaggcccgccaggcggtcgaggacggcgtcgtactcctcccccagatctaccggcgcccgccagctggagacctgcgccgggggctggctcggaagtcggaggcgcgcttcgtcggcgaggggggtgtagaaccagtcgctcttccagtcgtcccacttcttgcggaggacgcaggggatgtagcggttcaacaccggcccccgcggctggaagtagcagccgccaaccaccgatggcggtgacaccgactgcacggtgaagaaccaccggaacagctgaagagaggggcgcaccccaatgaacatctcgcacaggtgtgcgaagatggccaatgtcatcaccgcattgggggtgaggtgcgccatctggagatcgtagaactccaggacatccatgaagaaatgagaaaatggcgggaccagcccagccattgcgaaggggaggaagaagatggaccgccccgggtagtctggtgccgggcgcccctcgcccagcatcacaatctcccgaccggtggcggactccggcatgaagcggcgcggcagtccggcgtgcctctcattcacgatgcgggaaggcggcagtacactgccgtcgagcagagcagagccccgtgccatggcggtggaggaagagatgattgggaacgagcgcgtgtggcgaaagtagggcgtggtagagaaagagttagagctcaggcagcgaaggcaagaggaacaatggcgaaaggaagggagcaaatccttttctcgatgcttttatacccttgccatcgctgggcctggctcctcgtttctcgcgcccactacctcgctccctcgtatctcgctatcttgctccctcgtttcccgtgcccacgcttccactaatcccattcgcccgcttacggcgcttgaagtggatatgcggttgtggcaatcgaaacggattgtatcgtgcgcgcgttaattacgctcgccaaccgaagcggcgttaccgtatctccgggcgagacaaatctgctcacccagattcgcgcgctgctcaagtgatgtggcagtcttgaatagaccgcccattatggacaaccaaagttaccaataccaatgtgcatggactgggaccgttggggattttgcccaactatgcagaccggtcccacctgtcaccaggctttaggagtggcgtcacacctgaccgcttcccttgggaagggaaattgctctggcataacgccgggggctactgtcggtgatatgggaccgggagtatcatgactagaggcttgaggcagacacaatcgcccacgtggcctggcaccttcggggacgtcgggcccgagggtgaggtgtccgccctcctcctgatttcccccgagggggggtcgggttgcgcttgccctggccccgagggccggggcaccccgaccccctttaggaagtctgcgccacgtatatgggataagtgagcacagctgtgctcacctaacagcatttattgcagtctggtcaagcgtgtcacgctgcacgcagtgcagcacggcgcgtccctttatccggtctgtgaccagtcacagaccggtcagatcacgggttaggtggcgactggcggtctgacgcacgccatgccccatcccgtcaagacgaaagcctctaggcactcgtctcaagccggcgttaagcgtgttatctcttagagatgacacgttagccccgatcgatatatgccaggcttcatcctaaccattacaagcaaaatgttgtgtgaagaagggcaaacatgcacgttgccaagattacacgcggtggacaagaatgaccgatttgcgaccggtctgacactgaccatatcgtcagcgcacagccatgctcccacgacgcgctcacccccggcggaagtggaggtaggtgtgggctgtcccatcggagcgtcattcggacagcaaccgtgctgatctccgcccattcaagagaaaaagaacagtccagtttggaaagagaagggtgcatgtggtatccccttgaagtataaaaggaggaccttgcccatagagagggggttggttgattctttcccagattatgagcttagaacgggggagaagtcagctgacacttgtagctcattcatacacagatccaccaaaacacaggagtagggtattacgcttctcagcggcccgaacctgtatagatcgtcggtgtctcgtgttttctggctggcagacgatatttccacatacagagagagcgagagcttgagatttcaccctaagcccccggccgaactggcaaaggggggcctgcgcggtctcccggtgaggagccacgagctccgtcagcccccaagtaaacttttgatcagctttcaatcttaacaatggcataaaaggctctaatgttccagacaaattagaaataaatcttctagcgaaatttatcttgccgatcatctcctgtaactccgtcttgttctctggaggctgaattttcttgattgcaataacactcctttgagttatgtcaattcccctctcatgaacaagaaatcccaaaaactggccagccgatacaccgaaagcacactttgttgggttcatcttttggccatatttcctagttctctcgaaaaacttcctcaaattggctatgtggtcctctatctctttagacttaacaaccacatcgtcaatgtagacctcaaccaaccagccgatcaaatcatggtatatataattcatagcccgttgatatgtagctccagcacttttcaagccaaaagtcattacaacccactcaaacaagccgattgcaccatgacacctaaaagctgtctgatggatatcttcttcggccatgaagatctgattgtatcctgcatttccatccatgaaactcaatattttgtgccctgaagcagcgtcaaccaactgatcggctactggcattggatactcatcctttggggtagctttgtttaaatctctgaaatcaatgcacaccctaaccttgccatttttcttgataacaggaactatactagaaacccactcggcatatcggcaaggatgaataaaaccagcatcatataaacgtttaatctcagccttgacaggttcgagcatatcggctttgcatcttctcggaggttgctggtgtggtctaacccctggtttgataggtagccgatgttcaacaatcgatcggctgagtcctggcatcttataatactcccaagcaaagcaatctttgaattcctttaagagctctgtcaacttggttctaaattctggagataagttcttactgataaatgtcggccttggtcgatcacctggacctatgtcaatttcttccaaatcatcggccaacaagaaaccctgttcttacttgtcatcgagatgatctactgtatccttgttatagacgtttgaaccctccacgatgccctcaaaataataacttgggctctccatcttcaattggctgtatatcacaatcggatacttttagaaattctccatcccaaacttttccagataagcaatcgaaaccatccatctcccaaagagctaaatcggcactggcaacgttgactgacctgtcggctggcacgatttcaatcttgtcgccttgccattgaatcaagcattgatgcatggttgaaggaatacaacaattggcatcaatccaatcccttccaagcaacaagctgtaggaacccttcccatcgataacaaaaaatgttgtagggatagtcttgctgctgaccgttagctctacattcaaaactcctttggtttctgatggattgccaccatagtctttgagcaccatgtttgtcttgatgagatcctcagcattcctgcctagcttcctaaatgtagcataaggcatcaaattcactgcagccccaccatcgaccatcattttagacataggcttcccattgacatagccgtttacatacaatggcttaagatgccgattctctgtcccttccagtttctcaaagactgcttgttctggtgataaaatcaatctagccgattcttcctcaatttcatcaacatcggcttgcttgatcccaaattccgcaggtagtataaaatccatgttaaccgaggcagtcacaacactttttcctctagccaatctctttacttcatcggctgtaggaacttgtttcttaatgcgccattcctgcttcgaattcgttttcttcagccgatggttgatctcttgctcaacctcctaaaaacgttccctattcctcaacctttgaacccttctcttctgattatttgtaaaaataccagaaggacaccattgggtcttcctgtcttcactgtcctcttggtcacagtcttggttcactggactcaatctttgatgaacaggaactcttgtttgccttagccgattgcctctattatacgattggcttgaactttctgcaacattgctacacccaggacagtcttcaatagatggcagcctcataccttcattccagcaaaatctaaagaactcacaaccccaatgaggaccaaaaccgccatcatcttcttcataacgcctctcctgctgtcgcgtcccaaaacgactctaaaatacatcctcaaaactatgcatagaataagtaaaatccatgtgaaagcctccaacaattaaaatgtgcaaagttaaaagtcaaataaggcttggaggatttttgtatatttcctaaaagcctaaaatgcgtaaataaattttagtggaattttcagagcacaaataataattaagaagaaataaacaaagttaaaaaggttttataaaaaagaaaaaccctaaaaagtttcttttccctccccctctccctcttgggccggcgcggcccacctccctccctctctctcctctcccccgcggcccatccggccccctccccgcgcgcgcgtgccgctgacgggcggcccgcacgccaccctcgctgacgggtggggcccacccgtcatccccttcctcccgccgctcccgccgcctcgcccgtgccctagcgccgccgccgccgcgaatcccgccgcctcccgccgtccccgggcgcaataaagagggggaaatcactccccatgattccct

SEQ ID NO: 80170 - DNA, 2414 bp, Oryza sativa
agtgcctgtggtcgtcgccctagtcttccgttgtttctcgtttgtctttgtgtgtgctgggcccttcgctgcccatgtaataaatttaactatttacgcttccgcttgttaaactctgaattgtatcaacttttggtgtaccttgcctcctgggacaaggattaatgcacgcacgtaaggaacgcccgttgggttatttccggtcgtgacacctgctgcttgtcatatttcttctaatacttatcgataatgttagtcgaattcacttgaaaacatctagctcttcatgcatgggcagttagtccagcaatgtgtaccatattgatgggaaaaggattgcaatcgatcttcatcggcctcttggagtcatcaaacttgattttgcctcatataatagctgcttggatatgctatataaagacattacaatcattggtagaatgagacccagaagtatgccactagcaatacctcgtcttgcctaagtcctcagcagatgggattgtgtgcccagcaggaagttgaatctgtttctccagaagtagaaaatcaaagatcttatcagcctttgtgatatcaaagtcatatctttcttcttttccagaactcttcacccattggcatggtataaccttcttgcttctaacccattcggctgctgctatctcagaatcatcatcatcatcatcatcatcagatccatacatatagggacatacatgattgaccttcttaaagcttttcctggcttctgcaaacatctgctcatgcaaggttaccttctgtacaagatgtgacaaactatcaaagtccttggatgagaactttttcctgattggagctgccctgaaaagccaaatcggctaactgagcatcagttaagctcaagctgtagcacttattcctcatctttatgaacgtctgaatgtagtcctgcacaggctcatcatgcctttgccgaatcgctgttaaatcagacaatttcatctcatgaaccccactataaaaatagctatgaaaatgcttctccaaatcggcccaactgttgattgatccacatggcaaagaagaacaccaagtaaaagccgatccagacaaagacaatggaaacaacctaaccctcagagcatccacagccgatgcttcaccacactgagctaagaatcggctaacgtgctcataggttgaaacgctgtcctgtcctgagaattttgaaaaatatgaaaccttgaatcggttaggcaatggaaccctctcaaaccactcagcgtacggatgccgatacaggtttccagcatccttcggcttgagcccaaactgctctctcatcacatctgcaatcatatcggcccatggtctttgctgaggcactccctgcgcttgttgtggcattggctcgaattgattgtattgaggagcgaactggggctgagtcgaccccccttactgatattgaacttgtggtgatggaggctgatactgataattcaaattgcccccttgataattctgaaagtttagttgtatattacgcaccaaatgttcgggaataacttgaggtaccaccattttatctggttgcacattatgaaccaaatgctctgggacaacttgattcgcagcgtgctgtcttagctaattgtcaggtgttccgaacccagccgatgcattcaccaaaccttgatgctgaatcggctgaacaacctgttgcctcggtcttgtctgctgaatcggctacacaacctgctgtcttggtggcatctgctgaatcggttgttgctagattgtgtcaacagtaggctgagctggtaagaacatagcagcaacttggtcttgagttagccgattcacattttgtccattatgctatggctgttctctcaccaacaaccaaggattaattagttgacctggtgccgatgatggtgcagccggtgcaggagccgagactggtgctgtcggttgagccgatggtgcactgtgaggaattggctgaacagctggctgattattagtgaccaagggccgatagtttgggaaaacacctcctggcaaataaaccggtcctgtagcctgatactcagctatcgagcaatcaaccatcgacttcaccatgtttgacaaagtattgactaacacccaagattgattaattaaagcatgttgcacggcatagtcaatcctatcctggaagttgttaaattgtagctgtgccgtgttgccatcttgattatgattctctgaaagtgcatctaggacccctcatttattttggtgttaatgacaacacaattagagggtaactaatgctttttgttgagacgtatgcaaggataaaaagtagtggatgtccccacaataagtattgcggcatcttttgtggtaaatgttttttaatccaagcaaatcttgtg

SEQ ID NO: 80171 - DNA, 7083 bp, Oryza sativa
tttgtgggtgtgtcttgttgagtacggtggttgtactcagtcttgctcaattttccccaagcccagatgaggagttccttgaagatgaaggctttggtgtctagctcgtgcctgccgtcaagcgcctgtggtcgtcgccctagtcttccgctgtttttcgttgtctttgtgtgctgggccgttgttgcccgtgtaataattatatttacgcttccgcttgttaaactctgaattgtatcaacttttggtgtaccttgcctcctgggacaaggaataatacacgcacgtcaggaacgcctgttgggtgatttccggtcgtgacaattcaccctggtagtactaagatgtaccaggatcttaaggaaagattttggtgggcaagtatgaagcgtgaaatcgcagaatacgtagcagtatgtgatgtttgtcagcgagtcaaggcagaacatcagaaacccgccggattgttgcaacctttgaagattcctgaatggaaatgggaagaaattggtatggattttattactggtttacccagaacgtcatcaggccatgactctatttgggtaatagttgacagacttaccaaagtggctcatttcattccggtaaagacaacttattccggaagtcgcttagcggaattgtatatggcaaggattgtgtgtttgcatggcgtccctaagaagatagtgtctgatcgaggcagtcagtttacttcaaatttttggaagaaacttcaggaagagatgggttctaagctgaactttagtactgcttatcatccgcagacagacggacaaaccgaaagggtgaatcaaattttggaagacatgttgagagcttgtgctctagatttcggtggaagttgggataagaatctaccttatgcagaattttcatacaacaacagttatcaagctagtcttcagatggctccttacgaagcactgtatggtcggaagtgccgcactccgcttttgtgggatcaaacgggagaacgtcaggttttcggaacggatatcctaagggaagcagaagaaaaggtaaagatcattcaagaaagattgcgtgtggctcagtctcgtcataagagttatgccgacaatcgccgcagagatttgagttttgaagagggagattatgtgtatcttcgtgtcacgcctttacgaggagttcatcgttttcataccaagggaaaattggcaccgcgttttgtgggaccttataagattgtcagtagaagaggagaggttgcttatcagttggagttacctcaatctttggcaggagtccataatgtgttccatgtgtcgcaattgaaaaagtgtttaagggtacctaccgaagaagctaatattgagcggatagaagtccaagaggatttgacttatgttgagaaaccaatccgtatactggaaacaaatgagagaagaaccaggaatcgagttatccgtttctgcaaagttcaatggagtaatcactcggaagaagaatcaacttgggaacgagaagatgaattgaagtcagctcatccgcacctgtttgccagttcttccgaatctcgaggacgagattctgtttaaggggggtaggtttgtcacaccctgaaaattcaaaatatataaattgttgtttaattggaatttttagaaataattttaaaagtcttgaaaagaaaatctaagtttaattaataaattccaatataaaattgggccagataaaatttcattaaatactttgcttaattctataattcctagatttttctgggatttatttgagctaagaaagtatttgtaataaatggaattgcatttaagaaataatttaaattgaaaaggttttaaaaagtcttcttttggctttgggccgaaagtcggcccaaaacctctcttctctctctcctcggcccagccggcccagtcagccgcgcgcgcgcggcctcgctgtcgctgacaggtgggtcccgcctgtcggagtcgtcgtctaccttcggccgtcgccgccgaaaccctagttcgcgccgccgccgtttcctttccaaatccggccgcctctttccttctccggccgaatcaatagaggggaaatgatctccgggatctcctctacattttctcctttggaatctttggttaaatcgctttggaaagctttggaatcgagttcgattcggatcggttttccctctctccaagccgaaggtttccttcgccgttgccgtcgccgtgggccttcgccgtcgcctccgagcccctttaaaaggacccccggtgtctcctctacccgtcgcagccctcgccttcgcctctcgtcgccggaagagccttagcgccgtgtgccctagcttcgccgtcgccgccgccgcttcagccatgctccgccgtcgctccagctgtcgccgccgctcgggaagaccgccgtcgtcatcgccaagtcgccgccgtcctcgtccgccccttcgcagccgttggaacccgccggagcttcgtcgccgtcgacaacccgaaggtagccgccgcttccttctcgtcgccgtcgccgtccgttgcttctccgccgtcgttttggtcgtcggtgtgttcgccgtgtcgtccgcttcccgtcggtgtcctccgttcgtgccgtagcgccgccgttcgccggtgagcgtgcgccgcccgagccgtccgctccgccgagccgccgccgccgtcggtgacgtcatcgctgacgccatcggggtcgtccgccgtgaaccgccgtggactcgatcaatctcggccgtccatcttggatcggttagatctcggccgtccgttcgcgtgaaccgccgcccgtgcgccggtccaccgaaaccctagccgctgacgcaataatccttcttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatttacacattaaaaatatccacatgtactgttcatgcttgtttatgtgctgttttggtgattttgcttctttttgcttagattccgtcgtttctggagagtccgttttcgcggaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggccctttcgtacttgattaccttattccttgataccttgggttatattaatttgactagttgagctttatttatattggttcaactagatattagatataattgcttagccctgcttagaaacattagtacatttatgggataactaatgactcactattatttcatgatggcttattgatagttcacgatggtcaatcgtgattagttaattaattaatgtgccaactaaaacctgataatggtgggttgtgggcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctggccagagtaaaactattcgaatagccgtgcccgcggttatgggcgggtctaacaatgtctttcgtgattagtctcacacctctcatcattgtaaaagatgcttaaactggtaataatttgattagctcctggtttggaatgggacattcctggtttggagatagaactgtgcagccggggtggttgttcagaatggttgggcctatacaacagggtatgttgtatagcgttgtattaatattgtttaattattacttaactgttttgttaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagaactttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattgcgtgacactagatccgcccaccaaaaagaacgccgccgccacttctgctggatctgcccacgggagcaccgatgtcaccgccgctgccgcaggacaagcttgggcgtggagggtgaggaggaggtggtagagaatcgcccgccggatccgcctgccggaaacaccgccaccgccaccgtcaccggatccgccaatagtagccgccgactccaccgccactcccggatccggcccgcgggagcagctgaagccatcgctgccacctcctctgctaccggcaagggagagacgagagggagagagagggaccggtgggagaagagacgggggcggcggcgcggcgctctctctaactctcggctgttggcaaaggaggagagacggggattcgggagacggagaaagcgaccagagagaactgagaagcggaggtggaggatttcagagaaggagataaggttcgataggtgggcgggtccataccaattttttttctttaccgcgctccaacatgtatagggtgcaggggcggacacactaacgttacccatatttttaaaatgtagctacacaatgtagcacaatgtcgatgattctcaattggttagactgaaacatttgaccaatagttcatgagttcgattccatcgatctcttcgttttttccattttatccaattcctttcctaacctgatattttgctggttatcctctactgttcttttcccttttctctctaattttatccttttcctttaaaataaaaatgattattgcaagaacatacatgttatcctctactgttcttttcccttttctctccaattttatccttctcctttcctaacctgatattttgctggttatcctctactgttcttttcacttttctctccaattatatccttttcctttaaaataaaaatgattattgcaagaacatacatgtagaatagaatacgaggttaactaaaattcagaaaaaataaaataagctccaaaaaatagaaaaataaaaataagagttcacgtagaaataaaattttcaaataaaaaaggaatgaaaaaatacaaaattgtaaaacaatagtccattaaaaaaatacaataatagcaaatgataataaagagaagaggaacaacagacctataaagcaatagtgtggtgacggttaatgggacatctgatgaaaactattaacaaaaccgaaaagatgattaggttcgatttttagaatcccaacgatgattaagaagaggaactacgggcaagtcgttaagcaacactgtaatggcggttagtgggctagaaagtaaaaaataactaaaattcgaaattaaaatatgtaatattgaaagaaaagtccatgtaagaacatttttttcttttttcattgtcttttgctgtttgcatattggcctttttttcattgttattcacaggttgaatgaacgtcacaaattcacagatcgaatgaacatactcaaattcacatattgaacatcacatatcaaatggacaccgcaaattcacaaatacatctaaaaaatgttcatctaactatttttctattttcggaatttattttatttgttattcaaaattttaattgatctcgtcatgtgttttaaatggtctcttcttttaatagatttaattttttattatgaatttttaatttgtattcctaactaaactcttatttttctttttaaaatttcatattttattttatttttatttagaattttaattaatctcgttttgtgttctatatggattattcttttcatattccttatttatttttttcaattttagttgtttcaaaattatatcctacttgaactctcttttttatttttctaatttcagattttattttatttttagtacaaattttaattaatcacaatgtgtttttatatggacttttctttcaatattacttattttaaattcaaatttcagttatttttacattctagcccactaactgccattaccgtgttgcttaacgacttgcccgttgttcctccccttaatcgtcgttgggattctaaaaattgaacctaatcatcttttcggttttgttaatagttttcaccagatgtcccgttaaccgtcaccaccctattgctttataggtctgttgttcctcttctctttattgtcatttgctattattgtattttttaatggactgttcttttaaaattttgtatttttttcattccttttttttgttatttgaaaattttatttctatctgaactcttatttttatttttttattctttggaacttattttattttttctgaattttagttaattaacctcatattctattctacatctactgttctctcaataatcatttttattttaaatttctgttatttctaaattgtattcttactctaactctcatttctatttatctactttcagaatttattttaatttttattccaaatttcaattaatctcat

SEQ ID NO: 80172 - DNA, 129700 bp, Oryza sativa
caatcaattgaatcttagttgatgaagaaagatgtgtatgacatacttcaacacaacatgatcttaatcgcgaagattattaaatatgctagcttcaattaatccagcccacaatttttagcgagctaaacctcaattaattaaggccccatcaggaacaggaaatttataggatcactgtatgaatagccaggaagattccacatgagattctcaccaaaatctttgtcgaattccttaagtacgttgcaaaatggggcttagtggaactgcttatcaaacagaaacaagggttggtgtttgtatggaatcagatttgtctgcatcgttcaataaattccggtgactatgcgcaagtgaattgccacagaacagcaagctgacgtcttcgtagtatatttatttggaatcgcagatgttaactatctttctaaaactttgttaaagttagagaagtttgacctacgacaaaactaaaaccaccttacattctggaacttgtaaaccaccttacatactagaacttctgaaacagagggactgagggagtagctgacacaagaatgggcaaaccaacccctggtctgtaccaagctttccatgcaggaaatgggtaggtttgtgtttgctgccgctttgccatcagtctcaaagttgaagtaggtatgacatgcccccggaccggcaattcaaagcacctgttcatctaaccatatgatgtttcagtaccacagttcatagggtagttaaagtgacctttctcctgatatgacagacactaatagtagtaagcctcttcaggatacttaggccattcacaatacgcctccgtggcgttcagcctcagcttgagaaacagcatattctataccacgtcgatcgcgttcggagccttattaggaacgcgtagcaaattttggtcacccgttcttcccactaaaagcctgaaaatgctggcgcagtgacagggaagaggggggagagtgtgaaaactgcccgctccgctggcgccgtcgccatcctcctcgccgcaccgccgagcttgtcgccgtcctctccgcaccgccgagctcgtcgctgtctgcgccgccgagctcatcgtcctcctctccaccgtcgctcttcctcgtcctcggagagaggagcgccggagaggggagaggagcgtcggacaccaccgctctgccgccgctccggtcgccgcctcgctttgttcggccggtggagaagggatagagcagagagagagaggagagaaaaagtgagggtaggtatatgcactgtggaacatgtagctaacaatgttcctaggtgttcttgagctgagttgtatatttgcaatgcattgctaatgcccttacgatgcagtcaccaaagaaagaattaatgtatataataatatagtaacctcaatttgcagagttgaagtgtcctttacaaggtaggagtagcatcattatacaggccagatagcttcaaaagaatcaatctttctgacagatttttcatgttaactatgtgggtcataatgtacatggatcaggcctctccttgtctgtggctggacactgcaaataaccatgcttggtgtccatgggggagaggttatccttcctatctactattgactgactacaacctgatacaagttgggtacaaaatgaatcgacgactaacctcgtgatagggacagagaaaaaatgggttatgaatctttacttgaaaactattgtggtggcgatgcttctgaattctgatcgctggtggttacattgaaaaaaatcaacaaggttagctgctgcctgtcaagaggaccactgatcggggacggtgaggaagtactttgacatggctttcctgaacctcttcttgtactgcatcggagatatgacggtcggggactcgttcttggggcctcccaggatgcctgaagctttcacccaggtctcgagctgcttgtcccaggtgtactggcgcaagtagtcaataatgccaatgacaagctctttcttctcctcgtcgattccaacaagtagtgagtaatccatgacatccgctgtctgcaaagtatttcaaatgattaacagtcattttcagtaatataaaatgcaccaattcatgaagttgtgcagttttacaagaaataagtattttgtgcaatcccttgtctgaaataagaatatatatatgagatgaattatcaagattaatttccataacaacataccgcaagaaaagaagtgtcattccaaacggctctttccaatcttcgttttgccttgctccctaaaaatattggctttgtatgcaatgcctctaggaggtttgaatccaagaggactttactctcactggatgtatagcgtgagcgcaatgaaccctttagatcatagactctagatatcttcctttcaaagaaaagattctccatcaccatgaggtccatctttacttccctaccaccttttaagcccttgatattaacctgaactcaagaaaaggcagcagaagttagaaccaggggaatactctatacacttcattcatcatcagataaatcatgcaacaagaagaaaacaaacctgatatactcctacgattttggccaggcaagttggactacctgaagtcagggattccatcaaatatctgaagtactgaggagcaaactctacaaacgattcaagctctgtcctggtgacttgtttgattatgaatctctcatcaagagtctttgcaaagtaaacattgctttttccaccttgcgcattccatctcttgcagcggctaagtgaacggatgaaatcaatatcctttgggcagcatttcttcctaagtgcggcaaaatgctttgcgaaataacaagtaatggaaaactttgctttatcttcagaaagtggcgattcatcatcaaaagaaaacttaaagtgagttcccttagaatccaaatggtcttcttgtgagagcaaggtcccgtcaagtccatggctgctgtcaatggcatttggtaggtgtaagaaactcaaacttgaattcagtttgcgtgtgacttgctgcacatattcttgtgaagtcattgcataggacacgatactggtaggctcatcatcatagactgcaatgacagcatcatcttcatacccaatctgaggcaacagcagccgtgccccatcatcgatcatatgtgaagcagatgagatatatgtaagtgtacgggtaagaacaacatttaatttctctactgcaccaggagacctttgagaacaagccctccgtatgtttggcattggatctttcaggatactagtaaaatccccaaagtattcagcagatctgaatgacgacagatgcaatgaagtaggagccaatccattgcgttctcgctggtgtatagcaaatttagaatcaaatgaatgaattctgacaggggttacagaattcccatagcttggattgtctgggaaattaaacgatccatactcatcaattttggtaaaaccttgtagaaggtcatcttgtatctcactagatccagtccatgccaaatcaatcttatctgaaaaaatagatgcaagtgagggtaacctttcaacaggttccttacccattgtagctgtagtaactggctgctctgtctctccattgaatctgcggaaaaccttgtccagatcttctgcatcatccacaggatgagttacaagatcaatctgtgaatttgtctcacccatcctgtattccgtatcattcaagcagccttctctagatagcaaggattttcttggacttcctgaagattgcgacaaatttgtggattttcctatttttgtatcccccacaagcaggtcagctttccactctttcagtctgacatctaagaaaatatcaggatttgaaacatgactgtcttttttaaggagtgaatctatgtaacaaagccttcgatcccaaatgtaagcatcaaggagaagaccgcgtctcaagcggttgagctcaagaacatcaatagagacctgcacagaatgattgctatctgtaataactggcaacagcaggatctgcaaaacaaacaaagaaagagacagggggtcaatattaagataacataaccttttgtttaacctgaacgcatacaaccaggaaaatctcgttgcactacctcatatccatttctttccattttaagcaaatctttcatctctatgatctgcctttgaacacctgctttcaccggctcatcctctgatgtaacactattttcattatgatgaagaaaatcatatacctctgaatgtaaggtctccattttgctatatatctgcaaaagccaaaagtcaagtatatgagtatcatattattagtaagttcacagcaaaactatatgatgcagtctatgaacatggtcatcataacttagaaaaattgcatacctcaactgccatccttctcatccaatcttgtcgactgcggcaattgaaatccagtactgaggggggtaggttaactgagagaatatcaacaggagaatatctgaagaaagcaaccatgtttccgtacctggatatttagcagataaattgaaatcacattgaaggattgagcaatgttaattggtgaaggatacagcagatacatacccatagaaacgaaggcagtctctctggagagaatgtccacaacttgcaactcggttagcagtagtatggtttgaaaagcttagctccaagaacttcccaaacgacagaccccaagctgcatctgacataattaccctccgtgtggcaggtggtacaccatccttaggttcgcacttgaggcatctatgccacatccatatcctaccatcacgttcacctggtaacttttgagacagaagccgccgaacactaattgttaaactcccatgctgatgagtatagcacctgacatgtgattctgatgactctttgcatgacgggcagcaatatgcctttgcatgaaaaaaaacatttccaaaaattatgataatgataagaaggccatatgatagtgcacatacggattgtacaggaaatacctgatcaaataagtcttccctgaggtacctcccaagtggcttatcaaagctaccataaaacttgatgcggaagagctgagaacgctcgcatagcatgcttttggggatacaagtgcttgaaagggaaactaagatgctctgatggttgtcagtagcaggaaaatattcaccagaaagctcattcgggccatctgcatctcccatcaaataatcatcatgtggtttgggaccatagtggtctacctcttgaaatttctttcctgaaaccatgccttgacggtcatcatttatgggaagttgtgtcgagtcattcaaatactgatattgcatcaccatatctgaagttctaatgtcatgatccaatgaacatggaaatattttatgacctttgcatgattcagttgcatggaatgaatcatgatcatgacaattcatatgttcaacaggaattttagattccctatgctcagagatgaccccctctccttcctcattcaacgataatgagccaggtgatatagaattttccttaaacataccattgactctagtagcttctgaatgtttgccttgtacaggtttaagtccatgaggaataccaacaccagcagatccagcaaaatagttacttgggtcacttcgaatatcatttaccactaccattggccttgaaggaaccttgggaagagtcgcaccttcatcagcaaagaatgatgtttcaagagagaggtgataagctgcaaacacagcaagttgcacaacacgcttaattttctttagttcctctcgacatgatcctctcagtagaacctgcagaagttgaggtacattgattagaaatatatagtcctttgaaaagaatgcaatggtgatggtgaatctgacaccctccccctacaatgtgtacaagctgattttacaattgattcttagttcccgttgtaacagaattgtgattatgtttcagtgtattcaatggaaaaatcatttcttttgaacaggaatgattcatttttattcgtggcaaaaaacgggcatttaactagtgtaaaaggtaaaatgagatattcaattgaaaactaattacagaaccagtgctactactgcgtatgattgaatatacaagcaaggagttatcaatttatgttagtgaaatgaatctaaatggaatatttagggaacagaaatagattattaccgtgcaacctaaacgcctcggacagccttcaaagaacatcagggtcttcattgacctcctgtttgtctgttttcctgatgagaattctgaaactttatgcaccttgaacaattcacattgacctagtcttgctgaagcaatattgtcaattgacgaggcaatttgtgctcctgagcatcttgatatcctatccaaaagcggtctcttaacattcagaactaaagaaatatcttttgccaagagttcctgggcataagatgagacacttttctcaactagcagcacatttggtcgccgagactcaatctttgcaacaattgccctcaggtgctccttttcctgcatcaatggtatttcattcagcaaaacaagaaacaacaaatatatgcaacacaaccatgaagaaaacacaaacctgttcaagtatagtatcaatggatgctagtttgttcgtgaccttctgatactcaagtgctccccctaaaatgagcaattttgcattcacatgctcagaggccatgcgtttgtgttttacattcttagagcaaaccactcctctaacaagattgctgcataaaaggaacacccatcagtttcatatgatggaaagtacaaacatgtaaaaaccagtcaaacaacaaagctaagaacatacctatcacttggatcccctgatgctaaacatttaactttcacataatcagtaggatccatgctgccacctttcttggtatctggtctcacatagccagcagctagccaagctagggaggatactatttcaagccagcttttggatccattgtcattttccagatcaatacattctcccttaagcaattgagccacaagagcccggaaatgcccaagtacagcattcctcagaccctctttgtgagctatgtctgtgattgtgtcaacaccaactattttgttagtattaaagttaccaagagcaagaagcttgcccgagtccccagcctcatcatcctcgtagtcgaatccaaataatctcgcttcaacatcgtcaccctcatcttccggtgatggcgggagccagacattggcatcgaaatcagcaggataacgggtcatgtcacctccactcctgtctgcgatgccaccgttcagcctggtatcgcaaccaagagaatccaggctgaggcgctcgttcctcttggacgttggcgaggcgtcgttgtgccccaccatccaagtcgggctctccagagggcttggtgtcaaggacctggcgaccccgttaggagtactgacgctaagagagtctgtatctgaaaagtcatgtaagtagtcattccctggggtgaaaaactgtaccccgggctcatcgtcgtcctctccatcgcctcgcctgcatccacgaaaacaagtaccacaacaaattcagcacaatagtatttgcgaatcgattacaaagcagcgccggattaacaccaacaagcatacatgaacatccatgagtgctacctgcatatgttgcataatccactacacctaaattagtcaataataggtggtatcaccattcaccaacaccatcgaaaaggttagatgccatgtaagtgattacttaataataataataataataataataataataataataataataataataataataataataataataataataataataataataataataataataataataataataataataatatcgtaataccaagcaatctctacctcgcttttccccttttcctccatagcaagccaaggaagaagaagaagaaaaaaaaggaagtcgtggtagcgtaaggagggcatgagaaggcgatggaaatggagggagtacctgacagcgtggcagcggagcagctgcggcgaggagatctggcggcgcagggcgatggcgcgcctgccgcccccgggcctcgcggggagcggcggcgtcgtgtccgcggcgccgctgcgcgatctcgtcggggtcgcgggcgacggcgggccgctcgtctgccgggccacctcctcgccttcggcggcggcggcggggggcgtggggccggcgatgagggatctgaacttctgcaccgcccccagcaccgagaactccaccactcccatcaccaccaccaaaatatatataaaaaaaaactctagaagaaccacgccttggctcgcgtccgccgaggctaaaatccctcaccggcgacgacgacgaaggcggcggcgggtatatgtacagggttcggtttggttagtcagtggcgaggcattagggggtcagccaatgccggactggtcggggggcataggtcaggttgcccgtcgctgcggtggtgccgggttacgcgcgcgcggaggcggacgagaaggcggcggcgatggtgcggcggggggtgccgtcggagagcatcgccggagagagagagggaggtgggggtgcaaacgcaaagcgatggcggaaggaaatgaggggaaagggagggagggaagggggggtggttttaattgcggggatgaaggacggcaattcttaaggcctcttgcgtcacaccgaaacacacaaaatgaggcggtatttattgctcatacatactctctctgtccgaaaaaaaaaggcaaaccttatgttttttatccaactttgactgtccgtcttatataaattttttttataattcgtattttattgttgttagatgataaaagctcgtacatgtacagtgatacccgcgaatactttgtttaacccattcactcttagttttttactaaatgacgccgttcattttaactatttattttactaaaaagtttatatatttattatttattttaatgtggtttaatttgttatgagatgttctttcagcataatttaattttttacataagaatttttaataagataaattgtcaaatattcgttgaaaagtcaacgatgttatctactgaaaagggaggtagtaattgcatatccacaaatatgttctcaaacacacgctctagaatctggtgaacattaaaagcaccccctccctcctttccccttatttcgttccgccattaagaattttctactgttcatatcatcgccttaacaccgtcatatgaatagtcgtagaaaatcatgcatcaatgactactcatatgatcggtgttttctcatgcgatcctttaattaatagtaattttttaaggcatgcacatacacacacttaattcaaaatatattgtcattacatgtttttaatatgatcttataatttttcaatggaatatcttgatatacttttcaaaagtaaatgtgaaggtcaaaaggtaaagtcaacaataacgtatcatgagcattgagttgtctatgttttagtgtgtattcaaccggagtgagggagtttacttgatcaaatacgaacctaatggtacaacggataggttgtcagattaaatagaaaattacgaccctaactgatcgaacagtcggaaaaaaaatattagtacgaatggtctgaggtggtgttcttttttaacgaagataaaaaattaaattaaggcacacataaaaaacaaagaaaaaccattaatacgtgattaattgagttttaattatttcacacttaaaatataaatttatttaatatttaaaatcaacatgtatatagaaagttttcgtatgaaacgtaccgtttaatagtttaaaaatcgtgctaacgagaatcaagataaaaaaaatatgtatcttaatcagaaaaaaaaacaccaccatcaaagtgtttatttgtatcatgagggtagcatgagggtgtttatttgtatcgagatataaattggtgctgtacaaataattacataaatatttatcaatctccttataattgcactctttttcttatatacaaatttttaacaacagaggccaccatgttgttttcggttaaagaaacatggtgacaattgacaaacatctacttccatacccatcttttttcaaataaattaaatgtataaatacttcaaaagtattttatattaacgaagcatgttgtatcctaaacattgtcatatgatatgtctaatcatttaaaattaggtgatggcaaaagttaaaagtataatggtcaaccgtgacagttattacttaaggccggaggaagtataaagctaaattcacttaacgggaaaagaaatgtctagatatgaattctgcattacaagtcacaataatactaatactaatatttatggttggaataatttattttctcgttccaattcgtattgcatgatcaaacgtttgttttcgaaaatgtgtacaatactaatgtttttaatcttcttaactagtactatttacaatgcaaatgcagtgccctcttgattatatccgaaataacttaaccaatggatcaaccaggatttattatttatcaatgaaaattgcatattctgatacatatggctgctaattttatttttgggtggtgttttcaagtcgtgttgcgctgccctcaaaagacatacgtatatacgcacatttaaaaggggcagtgtatacgtgttaggaatcaggagcaaaattaataaatacgactagtcgtcgcaaagtaatactcctaccgtgacagttgagagaacccaattatatgatgaaatatgggcaccataatttctatggcccacatgtcagccttaggttgagttaatttcccagctttcccaactcacctcttacttttccgcgcaaacgtttttaaaactactaaacggattattgtttatataaaagttactttaaaaatcatatcatttatttttaaaaaataattaatacttaattaattatgtgttaatgagtcattctgttccacttacgcgagggattagtcccatccccaggtactgaacacagccggaggattttataacatcaaagtatatttatcagttaagccgaaagtggatgtggtgtgtgtcatgcatggtcggatagtcggaggaccatgtcaatcttgtgtggctaactcatggattgtcggctaactgttgtgtggtgtgaagcgagcgattttattggggtttaataaatactcctgtcttttcttaaattgttagggtgtgtgcgtatcacaatctcacatcattaacatattatatggagtaattaagttttgttattataggttagaaatataatattcccttcatccttgtttgataatcacttaagaaaaagcgcagagattagggacaataaaattttcatcactctgtagttaattcttatcaattaacatgctacatcgctttttatcccgtgaattgtatagaattttaaatatttacaccaatataaattaatcttaggtagctgcatgtagcacatttaatgatgttcatttactctttatttactctttgtccaaataaataaagagatacttgatagagaataatcatttggggaatacctcaaaaatcttaggtgataatcaaaatggaatagagggagtacttgttaatttgtgttattcttaatttttttttataaaaatatgattatgaaagatacttataatcatgtgtgcgttaaaggatatcttatacgcaagttataccataatttaattgaaatttggtacaaaattaattcaaatcgaaaggcataaataggtttaatttttattgaaatattactattgattaatttgttaagatcggcactacatatttaataaactctgaagttaatcttgcagtaccatgtaaaaaaaactatctccatcttctagtaacaatgaagcactcaaaccgattatctactttttttttccaaaaaagaaagttaatttacctaggtatatacaggatgtagaaaaatatggtctgttataaagatcagtatccagtcagtaaaaaatgaaaaaaaaattaattagccaggataattatttcaaatgtgtgtggcagcccttgcataactttactctagagtcaagtcatggtactactaatttatctttagttcccacaagtcatggtagcgttgcataacgtaagtaaatcttgcttctttcgattttgaatgtaagttgttttagcacctctttggaaaattagaattttcatggtatttaaactaattcatgtgaaattcctccaaaatttctcaggttcaaacgcgcacttgtgattttcattttttttttcaaaatatgagttgttttgaaacacctaggcacattttccaacttttacttttgagtttgctcttgtcgagttatcaccacttttacaaataaataattaatccatcttttctaatgtagtatgaatggaagacatcaaattaatttgagcttttttaattgattctggtacataattaaatactgagcataaaatggatcattcatgttttctaatctagtaagagcatccctagcagatgctccatccaatcctccatctgagaaatagcgtatgggagtgaaaaatcggcctccagcaaatactccatcggctatgccaaaagtagtggatcgccaaaacaggagagaggaatgccaattttggcgttcctctctccccacgccaaatcgcaaccgccgctctcccgccaacatccagagttcacagcggcggcagacaaagcgggcagaggaggaagaagggaggtagagaggtggcaccagccagatctgggccgggaaggttatcggagaagaagcgccgccacagctcctccgcccggcgactgcccgcgccgttccgcgccgacgaccctgccgcccgtgtcgcggctcctccgctcggtgaccgcctgtgcaactccccggccgcgaccccgccgcccgtgccgcggctcttcttccgcccggcgaccgcccacgccgctccccgcccgggaccccaccgcccgtgccgttgctcctccgcccagtgactgtcgcgccgctcctctgcccatgacccaccgcctgcgccgccggtcctccacccacaagctaccgccgtcgcccctccgctcgtgagccggcgccgagatgctgccccttgcgcccctcgtgagctgctgcttggctggaggcagaaaggaagaggaagatgaaaagaaggatgagaggaggtagagagaggaggcagtgaggaggaaaggaagaggaagagggaaaatgtggaaaagaatgagaaaaaaatagaaatatttattttgttataatttttgttcaagttgtatactttacttattttgctatgattacaaatatattcatttcaaacatatatttagtcattcaaaataaaatccttgtaaaagaaattacacaaatgtatggttagttagataatactccctctatctacttttgatagtcatatttcatcttgacacatagatcaaggataagtaattctacttatcatccatttaaaaatgctactccctccatctacttttgataatcatatttcatcttagcacacagaccaaggataagtgatactacttatcatccatttaaatatgctactagtcattcctcgtaaacaagcgattcattaatatttatatttctcgatgctcatgtagccaatcttgtgtggaagaatggagagtcacgcattaaatccaataaagccattaatatgataagttgttggattgaaatatgcctatcaaaaataaaattttcagatttggaaatatgactatcaaaagtagatggagagagtactagtcattcctcgtaaacaagcgattcattaatatttatatttctcgatgctcatgtagccaatcttgtgtggaagaatggagagtcacgcattaaatccaataaagccattaatatgataagttgttggattgaaatatgcctatcaaaaaataaaattttcagatttggaaatatgactatcaaaagtagatggagagagtactagtcattcctcgtaaacaagtgattcattaatatttacatttctcgatgcccatgtagccaatcttgtgtggaagaatggagagtcacgcattaaatccgaaaaagtcattaagatgataggttgttggattgaaatatgcctattaaaaataaatttttcagatttagaaatatgactatcaaaagtagatggagggagtatctcagatttaatgtgtgactctccattcttccacacaagattggttacatgggcatcaagaaatgtaaatattaatgaatcgcttgtttacgaggaataactagtactcccttcattccaaattgatctacatatttcataggtacaccaaaaccatgaaaagctaataactctctcatactatatttactctagcaataaacttgatgcatgcaccatttctactatttcctagccaatagcaaatcaacatattgcatgtgggttataaatatttgtttgcatggatgcatgcattaatatccatttactccatgcatagataacgaatagacttaatgaatgaatacaaatatgtatgttatttaggaataacctcaaaaacactatatgtagatcaatttggaatggagggagtagtatgtttaaatggatgataagcagaattacttatccttggtttgtgtgcgaagataaaatatactccctccattccataatagtataatgtacaaccactttgtttagatgtttcataatataagacatgtatacatgtagacaattaactatggcccctttttcattaaattattacttttttaaatcatccactctcatgttctctaattctattggatgcatgtattgtatttattaggatgatccaaactacaagatgataataattatttcttagtctttaggttaggggtagttatgccttatattttagaatgaaagaactatcaaaagtagatgcaagggagtacaatggttgggttatccacccgagctaggcagctactactactattcatctctcagtcaccttgaagctttcgctgaccgttgatcactttatctcccttttcactgtgcatgcactgcacggcacaagaggagcagaggactatcagagattcagtgagaaatttattgcatgtcttgagcgagcgacttaattggatcatcatgctgcccacattactacgccactgtactactaaaattcgtcctaaaataatttttactttttttcatctcatatatattaataaaaaataagactaaaatattttttctttttttaatcctaatataattgtcccctacattatctagctggtcatatatttttatcaactctaatataatgcttgttcatgaataaatttgttttaacataaataagaggagacaaagacgaagggagtgcgatttaggtctaatttagtgctctaactcttaaggctgtgtttagttccacaccaaaattggaagtttgaagaaattggaacgatgtgacggaaaagttgaaagtttatctgtgtagaaaagttcgatatgacagaaaagttaaaattttgaagaaaaaagttggaatctaaacatgtcctaaatttaactttagaagttgggtatagaatatagttgtgaagcagttaaacccagttttatttctctaattcatttgtaagagtgctctagccagatccgctctagtcagagctgaaactatttagttgcgctcaagctctaaaagagatagagttagagagccctgtaccaaacaaactcttatcacagcttagtactccagtacagtagtaccaagttgactctgcatatttgtccgacttacgccgtgtttagttccaaaataatttttcaaacttctaattttttcatcacatcgaaactttcctacacacacaaactttcaacttttttatcacatcattctaatttcaaccaaacttttaattttggtgtcaactaaacacagccttaattaaccagcaagcgagcagttctttgtctcgtcaaagatatcacgaactgaaggactgtacactagaaatctttccctaggggtactggaaattaagcgaatatgatcgacctacccacatgtagtacagtcgtgcgtgtgttcattacgcatgccatgagaaaaaaattatcgtatcggatcatcgaaattaataaactgaacacggaaaacccttagacttataatatgatgtgctatctaggttcacaaacccttaaaatatagtttcgaatctcaaatttgttttggatgtcatgtcacgatgatgtctatgtgttgtgagactatgattttaaggacctatataccagtcacatagaaaaacaattaaaaataaagaggggagagaggacataaggatgtttttaattttgaaaaataaaattagaaaaagatagagaggagaaaaatatgttttttatttttttatatgtgtgtcagggttatagataccacatacctaatagtagttgactaaatcccggcaggacccaccacataccatgtcttgtatggaaataaccttcgaatataggaggagttccacataaggaaggatgaatagagttctacatggaaacgacaaggactactcagattatatccatattggtttccctagttctacttggacaatgggacacttatgggtataaatacaaggccccctaggaggagaggggacacgaaacaatagatcaagacacaagatcaacatacaagccaacatacgccaagacaagacgctggatatcgacttcagagataagcatggctagtcccctacggtgtctatggatactgataggagagacatagcgctatctttgatcttgccggatgcagattcgaggaggaaggctaccctgttgtcgactacgagtcagcacttcagaccgccaagtcgacaacagttagataggctaccccaaatattgtactggtgtaattatagtgaataagagcaacgaccggcttcggccaacaggagtagagttattacctgacaattcaggggcccaaacctatataaaaatcatcatccccatctcttttattacaatctcgcatatatcctaataccaacgatccccatactatgtaaataccggaatcgcgacatcaaacgtcgacagtgtgattgacacatgggtcctactaactttttatatgtaattttctatggctaattggtcacagccaatcaaagcgtaactatgcccattctttgtaccgggcgtgtttgtctctaaatatatactccatctttttccctacaatgttaagttaatatatagtatttgattagaagatcaatatatcattgttttatctataattcactcaagttcatgctacaatgttaaaaggctctacaatgtgaaattgtcgaagtcatatatatgggggcaaaccatccatcccctacccacctatctctcgtcgccgctaatgtcgatatcctctattgccattgtattataccaacactcttaatccaaaaacaatcattttcaccattcattccaaaatttcaatgctttgaaggttgtgatgtctcacagcttatgtgtttagagttagggtccatacaatactgcagaggatctgaatttaagccaaacatgtatagtgattgagttaagtagttcctcgtagaaagtgaagctgtctagttctatttcataatgttacttttgtgcagaaaatggggaaaactcgagaccattgttccaatacagatactccataactttaggaatgaacatatcaattttgatattgtgttttgctaacggaattctattttaaaaaaatatgaaaattaaactcgaagcatgaagacacacagtgagtcttagtaccgcactgctgtacaaaaataatactgtaggaagtttctgaaaaagggaccgagttctctaaaattgaatcattatatttaacattccaatttaattgtggtagccttcgtagatatttgaattttcacaattaaaattgagaaaataaaataaaaactgccgtgcaagatctccacttttcgaagttcgattcagagttttgttttttttttaaaaaaaaaacaagctgtaaaaatgttctaccaaaaagtccttcaccattgcagtttgtttgctccagtttaatttatatacacaattttttttatctagaacagttttaataggagttgactgctgatttctgaatatacaaaacccgttcggtgatctggaggaaatacaccaggaagcttctttgtttttgaccataaaacaaactacacattattcatattatttttgcaaaaaaggggtcagggccttttcaaattgtcctctgcgagttcttcgagccacctggtcgatacagcgcatgcagcacccatttccgtgagacgtttcgttcgcatttagatcacatattaaatcaaattatatttgttaacaattttatgaaattaaattaaattaaattgtacttgcgcagttctattgtcgaagtcaaattttagttctcgaacgatgcagcgtgccttgcatggaaaattctccaattttttatccggtggacagctaatatggatcattcaactttggattttgtcctcattacaagaacattatgaatattctgaccggagaatatatcttgaccaaattctcttgtcactaatcggataaggggaatgatcgcgcttgtgcaagccatgtcatcactagcaattaattaattgtgcaattattaattaattactaattgttttaaaagttcatgatagaaacgagccttgctattggtcagttggtcaagtcatcctcactgtgcaggaattgcactcaaatgctcaatgcaactaatcaattcaaaatttaggtgatgatttaattaggtacccaagagcaaacgccaaggccgagaataattagcatgtgaaatcgcaggctttttgcatgctttcgctgcatgattaattttgtttgttgaagagcaaagatcccatttaaaattgaaattaaaatatataaacacgggaatcagcggccaagagcaataaggacattagcaggttgtgcttagagaatgtgagcatgtgttaggagggaaagtgttttatgtgagttgaattaaaaattaaccctgggaaccacttttgattcgatgcacgagtaccattttcccttttgaaaaatgtgcaaatataaatacagttaaaccactctttcgaagcactactgacttgtatagttaaaccactcattctcacattgaaataattattacccctttcgttttaaaatatatgatagtgttaactatatatcctttctctttaaccactaattacttttaaacggttagactatgatgaacaaaattattatgcatgtatttaaaattcagtacactcgataatataatagcttttaaattacttataataatattactgtaaataaaaggagagatcacgagttttgagaatgaatagttccactatcaataatttaaaaatggaggaaattttggaccatatgacttgaaaaggaaaatgggttcaaaaagattatttagtggggctcgtatatatattgctccttataaacaacgaaaaattagaggtaatcgagtttagccaatcatcatgcatatctccacccaatatgaataattcaaatacaacactcggctaattgtacatatattattatgaagacctatggatttagacaaatcatatcgattccaccactccaaacatttcatcggttttctttcgaactacccctctagcattacacctagtatatagtactatagtggagcgacttgtaataaaaaaaagttgactcataataagtggctggctggggtttatttgactccgaaaaggagaaatggatggccactaaaatgtatggaaaaaattggaaatggcaaggtccttgtggccgagctgcacagtacatccaacctatcctgtttaaaatggtcaaaaacccatgctgcacgttataaactattttaaacttttaaaatatattaatatggttttttaaaataattttcatatatatatttttttaaaaaaacacatcgtttaaagaagagtgcacgcggaaaacgaaacataactttccggcaatctccagctgccgaacgcagcatgcaggaatcagcaacaggaaaaaggcagagaagatcggtgggcggcggcgcaagcggccaagatttggctgcatcaaaactcaaaagctgatgcctttccaccggccttggctagcagctcatgacgacatgtgtaaggactacgggccggtttggtttgagtcctaaattggccttatcaatatttgataattttaacaatgtttaatgtctatttggtttgaagcaaaattttagcatgcctaagaaaataggctatttcaatagttaacttaggctattttggcttcaatccaaacacaactttaccttgccaaaattagccatgcctaaacttgctaaaatttggcatcgacaaaaattggtaaggccaatttaggtcacaaaccaaaccagccctacatgtggattaatctgtaaatccacttaaaagttaaacaagtggataatttgtttggatttgtggattgatccacttgcagccttagacctctgtatgaccagtgacgtgaagttgagcgttaaagaatcaccaacagtcatcgtatattgtttccaaaactgattttgaagattttaactgaaaaatcggatccagcagatcccctcacacgttttggagttctcttccctgtatttctcgctctgtcgatttgagggagagcgatcgcttcctctgactcccaatcacttacgcgctggaagaaccacatgatctatttgcgtgcatgtaggaaaacagagaattttattgttagtttaacataagggttcacttttatttttttttgataaaatttaggctctctcttgaagagattagttatttttattttctattttcagtttaaaacaattttttttgtggaagatcatacgtaatctctaggtgatgctctaattcggtgatgccagtggagatcatcgtaaaagaggtttagtgagataattgtgctaaatctgaacttaatctctctactccctctaaatattagggggaatctatatattcgtcaatcatgtagttgattttttcccttatctatcaatctttttttctattctcctgtctcaaaatatagcaaaacctattagtagattagactaatactacgaatatagatcgaatcgagtaatatataaattagaacttagcaacttacatgtcaatccttaattttattgaggtgaaacaatgacagctatatggtactccttccgtcccataatataaggaattttaatattttgtttgtactgtttaaccacttgttttatttaaataacttgtgcaaatataaaaaaacaaaaagttatgcttaaaatactttggataataaagtaagtaaaaacataaataataaatctaatttttttaaataagacgaatggtcaaatagtgcaaacaaaatatcaaaatcccttatattaggggacggagggagtaacaaacttgttggtgtggcaaatttcaaaaatcaaatattggtgattgataaaccaataagcaaatgattgatatattttgaattgtacaagtttagtctattgtcgtgcaagtgtagtcatccaaagagttgaagaaaaatcaagtgagattaacgaatactctctgtacgagggaaaaaactaattttgtagctatggatttgtataaaatttaattctttttgatacggtggagtaccaaaaccgatgtaatatactactgcctttgtcctaaaatataggaatttttgaggtgggcacagatattaagaaagttggtagaaatagttgaagaaatattgtgattggttaaaaagagaaaataagtgagataattaaatgtagaatgactgtgattggttaagaggaggtagttgaaaaaataacgttattttgagataagttaccgtgttagaaatagttacaatttttacacagaggaagtagtaagaaaatctacatagccggagtatcttatagtatcaatcaaccttttcctagaacttttgcaaacatttcccttctcctagattagatgttcatgttctctgagaatcccaaggacaatggcagacatgccgtgacctagtcagaccccaagctttacagctcgatctcctccactaaagtgtctcctggcgagcatgaatgcatatgatcttttttcacagtaccgctactccctcgttccaaaataagtgtaattttaatattgtttatgttcaacgtttgaccgttcgtcttatttaaaaaaataattataattagtatttttattgttattagatgataatatatgaatagtactttatgtgtgactaatattttaaatttttttttataaaattttcaaataagacgggcggtcaaaacactggacacggatatctgtggctgcacttattttgaaacagaggtagtacctgccatcaatctcctctcatatcactcaattaatcatacatatcactcaattaatcatgcatgatgcatcaagtgcacactctgacagtccacactgcacaagtgcacggtgcacacacaccagacaccaggcagctggtacaataatcacctctcactcacagagctcacactgtcagaattaatgggaaaaaaaatccagatccttcaggtgggccccacaaagcctcctagtcagatatcagtatatatcacagatcagtaattcagcatcacccccataaaaagcctctttccatgagagggacacatattatgttgatgcagcttgggttaattaattagttacaatttccttccttatctgctctacttgactaatacatgacttagttactatttttactatcagtagtgatcaccataaaactcgtcattatcactatgtgttactccctccgtttcacaatgtaagtcattctagcatttctcacattcatattaatattaatgaatctaaatagatatatatgtctatctagattcatatatatatctagattcattaacatcaatataaatgtgggaaatactagaatgacttacattgtgaaacggaggaagtaccatttatactatcaatagaaaccattgcaaaactcgtcgttatcgctgtatgttaccatttctactatgagtaggaccaatcataaaattctttgttatcgttatctgttaccatttatataagagcaagtttaatagtatagctctaaatcatctataactaatttaatagctcattaatacaatagtcatatgtaaatatatacttcaccattaatatatagccccacctctcatacacataatgctttagaggtggggccagcatgctgcagttggctacaaatctataactcgctttccttttctatcttctcttatcacctctacatgtgcttatagcttacttgtagtcactattttactgtacgctcgctttgcactatgcactcttgtcaccacacagtacataccttggctggatagatgcacactgtccatccaagttgccattgcatcatgtttcatgagctgcaggaaaccaaatggagccaggcactgaaactcattgagcctatttatgggatgatgcttaagttcaatcaactgtgtgattggaattgtttctggggagatgaatttccatggccagtggtgctggagcatgggtggtgatgagctgttgatattaacctgtgccctaggtgtagggtttcttggtggatcatttgaatcaaaattgatcaggttgcctgagttgtcaggatcatctaggggccatatctttacttcttgttggagtcacctcaaacccaaattgtggatgtcatggtgatcatcagctggggatttattataatattccacattatagggctcaaatgatgttcatggattagacatggataactctttggtttgtcattttcgttgaattcaggatatgatcaatttgttgtggaaattaattctttttgccaacctttgtgtggtgcagtgtcagcctaaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatcccatttcatgcaaataatcattttttattcagtcttacccctattaaatgtgcatgacacaccagtgaaacccccattgtgactggcctaattgtcaagaaatgattttgcatgcgactgccggcattggaatccggaatttgtttgatccgaggacaaatatgcagcatgctgacaagttgaataattatgcaccattacttcaaattgggaataacatgtaaatccctattttaattccatgtttgtggtaataatgccgggattgaattggcctgtgtgtgagggcagcaaaagtctggatttgatcttcaaccaatacagcaagttgatgcatgcacaaccttttcaatctcaggttagcaagtggtttaattaagagcattttatcttggtacagctcatttttcacagtacaagatgacattaaattgcaatttgcaagtgctaactaaaaagttgtgcacacagttaagattcagggtaagagaaatttaagcatttgacctgcaggataaaatagccaggttggaagacttataatttccctttgcagctttgataacattattaattacaagcaaaagtgaaaatgtgagtagctgcaaattaatccccagggaataactatatatactttgagaaatgggaaaattaaatgaaaactaaatgtgcttcttgcatcctaattttgcaggtggaacgtatttcttgggtccaatcaaatcagcagataagcatgcaaaatacgcacaaaacatcagatgacatttttttagaagatcaaaagaagttaggtacacattatgtcactgagaaaacaatgttatcttagcagctctgatacatgtttgaacaagaaagaaaatgacaaggcaatgaggtgttcaagaaaggaggagcaacagtgaaggtagccattcagagattctatggccaaaatctaagcagacaacaacagtacatcaccacaactgctagctatatctttttatggaacaataatatcacattaaactatgatgtacagtcatctcaacagagataaattatcctccagaagcaatatggatcagcagtgccctggtctcacctttttcttatgaaaagaaaattagttcctagtcacatcacacaattcacagagtcacacaccagaaataggccgagtttagttccaaactttttcttcaaactttcaacttttccatcacatcaaaactttcctacacacacaaacttccaacttttccatcacatcgttccaatttcaaccaaacttccaattttagcgtgaactaaacacaccgatagtccattttaggttatatgtaatgttcatgattacttgatcatcaaacactactatgcacatcttattgtacaactgaaaaagagatctacaaatgtacaggtgtagaactttctgcttcccttgtggcataaaacagaaggactgaactactgaagcaatgaaaacttgaaaagtaacctttggaaagaaaatgttggcatggcagacagaaatggttgcccatcactttacatccattgtcaatgtgggttgtcattactgtttttgtcaccaagaaaaaatgggaaaggaagttttgtttttcgatgcgataaatcgctatcaggagaaacttagcaggacacttagaagcctacaagtcatcagaaatgatggaagcaaggaatcttctgattgtgtgatgacaacatgtgctcctgaaagatcacacaagaaggttagatggtgggaggagctgtatctgccaatgtttggtcccaattattcctggaaaagtggtgtaagagacaacaaaaggatgaagcaaaaagaggaagaagatgctgtgacattgcatccttgattaattagctttttggaaattatggtttgatcatgggcagagttaactttgctttggctgtgttaatctgatgtgtagcaagaatgttcagcttccttagtagccaagatacttgtgattcagtaaagtggactggcttttttttctgtaaggttacttgggatcttggcaagaactttcttgtgagctgctctgttgcttgagagtagctctgttgttgcatgtgcttgttgagattattcggtggttggttaataccaagtacacaaatggattatataattaattcttgctattgtaaaagtagttcttgcagaagtttgagcaagatgaattgagaaactaatttggacaaaaaagcaaataaatgtgtccacttggattgaagtttggttggcttatcagtactgtataagggttagctacatgggccttaagtgtcaacgtaggacaaataggcccatagtgggtggatttgtaagccgagtttagcaaggaataagttcactttaggtccctcatcttgacgatgagtttgaattacgtccttgaaattacaataccacatatatcacgtccctcaccttttaaaaccagtaaaaatgtaattccaagatagtatcgtaagctgttttggctaatgtggcgctaacatgacaccagaagcaaaaacaactaatataaaacctcatggaccccacatgtaagtgaaacaatattggaaccggtgaattttatgttgtttgtccatcagaagagcccatatgcacagtatgttctcgatctattgatccaccaaaacaagcagattatccaggctgttatgtcaccaagattagctttgcagtacaaaggagtaggtggccaatttggccaggttatcaagcaacaagaatacatgaaaaattaggtccaaatatcacattggaatgacagaattgcagtagattttgagctacattttattcaccaatagaccaatctaaaactgggaagaggggcggccgccgcggaggaggagggagcaccgacgtcgcgtgttggggatgctcatcgcggaggaggagggagctgccaccgcccgctgtcggttgcgcagcctagagacctagacagagatgggaaagagaggggagagggggagatagagaggaggaagatgatgttgtttcactaacatgtgggggcccacaagttcttttagtatttgtttttgcttcttgcgctaagttaacgtcaggtcaatcaaaacagcttacatacttctaccggttttgaaagatgaaggatgtgttttaattggtattgtgaatttgtgattcaaggatgaaatttaaactcgcggcaagatgagggacctaaagtaaaacttattccatttacaaatcattaggcccccatgagcacattgatctcccacaattgaatttgaccaacggttttgctatttcacttccgccagatttttgggttcgtaacttttgaaagattaacaagcaatccatttgatcaattctgaacgtgttatgacatctctatctcattcctacgattccctcccagtgtctaggtcctcacatccaggcccacctccagatcgcaaatctagaggtcctggtcttcgtccatcatttgatcgaatttactgttcaaatttgaaatgctcaaaaatcatttaaaatttgtctcagaatcttctttcatctcacactgaaacctcaaaatttttgtagctttcaaccaaatttgaacatgaaccttgtttgccacatcatcgtcgaactattgatatcccaggtggctaccttcccaggcaaagcactacctattgcagaccagtgtatcggatggtggatgggacatgaagcccatgacagaaaagagcccatcactcatcgacctgaccagcagcccacccaaccggcaacggtccattttaatttgtccagaccatttccgcgaacatttgtgtttctgaattatttttcatcagattttttttaagaaataagtacaaacgtagccattcacaacacgggtggcgcacactcacccctatgaatacacacaccctatatgagtacttttgaaaaactgaaccgatatattttaaaattaatgcagttatcatggacgtctcattatcgatgagtacatcacttatcactgaaagacccgatttagaaagtacaaatgttaaagtggtatattcggtcagtgcgaatttgtgtgaccattttcacaaatattcatgccatgtcttttatgctcccatttttgctagggattttctttcttttcgagatgttacatcatatctcccctcgtctttcttttcttcctcaacaatgagccatgtctttgttgcctctttcacatttttaatgtggttgacaaagaggtgtgagcacccaaccacatgtttctcaccaccaaaatgatgtggctcagtcgtcgtcactgtcaccggcaatgaaaaaactcaaccgctgaaggaaagattatctgatgaggacacaactagctcgaatataaccataactaccttatgtattaatcaacagaaggtgcatatgttctacattagatttacatgttatatatttgaaaaaacgttgctacacaatgagtttcatgtgtttttatttgcaaagatacttgcttgggagaaggaaaaaagaccgagcgtaacgaattcatagatgataaagaagttgattggggaccatatcaagaccctctccaagtccacttccatctcatcacgtcacttttggtccatagaagacaagagataaagttctacacgttttggattcggattcgagcctcctgacagcatcaacttcaaacggacctagccgctgatctagaaggaatttcggggcccatgagtacttgttggaaagcttatggagtctactttcagatggttttggtcccacgtcaaaattcctaccgagctgctgggaatctgcaaaacaagccacgtatctcatccagtccgaatctgactcgggttttgggccttgtaattttgtcgtgggcttagcccaagggggtgtgcgccctagggcaaccctaggacgtccctaatcatattaattcagtagccgtcatcgtttagagttgggttttgcttagattattctgtcaagaacagtttcgccgctagatcggtttgtggaaccccaaattcgagtgcttaatcattcatatgcaatttggttgcaatctatcttgttcttgcttgtgtttttcgattcacatgcagggattagccttctcggcgaggtcaaccaggtttcggcacggttgataaccagaggagacgtggtgctgcgattgcgaggctcagtagcgtgttcgttcagaagtcggatcgagttatgtcaccactccgtccaaatcgactgtttatcaatacctatcggaaaatcgggacctacctccctcgtcactatccctacggtttttcattaagaagaagaagaagtctcaactaaaatgagggatgaggcaacatcgaggaagaggatgcccctaggttcctccttcgttgtagacatcgagattgtgtgctgctgagggcaaccaaatctatgatggttcattaatattgttagttaataagtgtggcttatgtagaatttgttaacttaaaattgttgtaattctgacatatttagatgaacactcatattattagtgtagaaataactataatgactgattagtatgtacatgtacaaatatgctgatgatataattatgaccgaccacatatgcacactggtttgcgctttgcagtggtggagaaaggaggggcaaccaagggttcaagacgttcagcctccctgaatttctcataatttgcagcttgaatgaagttttataagatcaatatcactggtctccttcaacaattctttttttaaggcataatttgctacatgacacttaaattttatgttatttgctggtagtcataaaaatgtgtcacggctaaaagacactctaaaaactagtaatttgctggatgacactttcagtttaattgaaaagataaattcttcaaaaagacaagaatgcccctagggtcaaaagcttttgagctgaaactagagtgaagatggaatataatgtatgctaatgatgtacttagggtgatggcaaatttagagttacataatttctaaattttactttaacgtcatatttgagcatgtggtcttagagcattctcgtctttattaagaatttatcaatctaattgaaccgaaaatatcctcttgtaaataccaattttttaggatgtcttttagccgtgacatgtttgttcgatgtttattagcaaattgcataaaatttagatgtcctatagcaaaatttgccttttttttaaaaaaaaagttttctggctctgctgctaccagcttgtctatactgtgtgctatgtgctttattattagctagtacacttcagaattgaccagactactacagtatctctttctttacaatttactagtaggtaggtaaccaatataggagaaaagcacaatcctttaaaaaagtataaacaatcatgcagaaatctcgttagctaccaacaaattaaccagtactaataatcaatctcactaaccaaccgtttcttggtccccatgctcatggcaacatcaccccaactgtgcctgtgtaccatgcaaatcatatttagtatgacgtttaccaaaccttctagtccaattaaggcacaaataatataatcaagatgttaattaagatccaactgcaaactgcatttcgtcatcaaacacgtagtagtccgtgagagaagcaaaagctgaacttctcgacgaagttgacgtggcatttatgcgaggaaattaaagtcaatattgatcattggatactcacacgtgctatagatgcagagcaatgattagtatgacgctagctaatcatcgtatatttgaacatggcactaatctcgactaatttgtcaatcagtttcttattaccatcccaaatccaattctcaaagagcgagggtctcgaataagaaagaaacatgaaaaccgagttatgaatttgccccctgtttcaattgaaaataagagggaaactcgcatttctttttttttttctagtacaatgcgcgaacatttacttatgtgaatacactagtacaccttagccctacgagcacatccgactggtccagtatatcttgaaattaatcgtaaatatgagcactcgtgtcactcactttgtgctttgtttgcattttgaaactgaacaggtaccttgattgattttaacctcataaacttgcttgaattagatattaaacgatcaaggaatgtgctctcatttgttagttacgatctaaacaattatgaaccattttgaaaaaaaatagataacacaaattattgtgcaagctttctttgaagataataaggcatactttgttaataattaaaattaaacctgacctctccatctatcaggaatgcagaaaaaaagggaagaataggtgcaaaaacctaggatagggatcacaatatcatgccaaacgccaaacactcgaagattccaacgattgaatctgtagcataagtatatatgatgcgtactgtagaacaatgcctttaagaagaaaataatttttgtccactggtatcattcaaaacaacccaaatatcaatcggtgctagattttcatccatgtaaaagttagagaccacattcagcaacgaaacaccaaacatttatcaggcattgtcaaactaaatcagggttttcatgctagagttgagtgccaacattatacaaccgtccatgataggagtttgtgccctcggcaaaagggccaccatctatcagagaagaaaccacacacacaataaatcgtgacctcgaattgtcgactaatctctccgatcacaacgaaagaaaccacccgcatagtccctctcgcattattatgtactccataagatatcccttcacaagtacgcatgttatttttatttcttcacgtgtagattaaatctaactatatatgtctgtgtaaaggggcagacaacgagagagtacatgctctctagtctctagggattaaaatagttaatacatgtccctctgttcatgtcatatttttttcatgcccacattcaaaccttgacagcatagcaacccccacctccaacaacacatccacttctctccctgtaagagccatgcttcctattggaggcttgaatattgtaaaatcaaataaatttgcacgccttttcattcgagtcacgaggagctggatgagaagaagctctcatgcataggtggatctaggggtggtcccggaaccattcaaataaaatcctagcataatgtataatatacatatgtaagaaaaacttttgaaacaaagctcttttattaatatattatatgatgcacatttaatcaatttatttttctaactttgttatatttaggatatttaaaaaatatatatatgttagaccacctatataaagatcctagatatgccactgctctcatgttcggttctatagtaaggatgaaaaaaaagaagagaaaccatcgactataaccccaaaattaaaaaccacattatttcttaacacacatataggagaaataaagggaaaagcctatcgaggcaatcatatttgtttgatattttgtaattatcattttttatgtgagttatgttatcagtaaaagtattttaagcacgatttatatctcatgtatttgcatacagtttttaagtaagacgaatagtcaaacatatgtctaaaagtcaacagcgtcatctattcaaaaatagaggagtatgtaggtcgaaattcggcctttgtatccacgagtagatatacacatgtaatttgtttggttgatatgttatccaagcagtcctcggcacatccactgagattaaatagcgatcatccatgctttccaaagttgaaaaaaatcccttatctttatccacggtcaaagtccatatgaatgcaacaagatgcgcactaagaaaaaaaggataacatcagtagcaaaaagaaagaaagggagatccacactaaccggacaataatatgtacaccgagcagtccatgatcacactcacacacacacacacacaccccacaacacctttagcatctgttccttttctgttttttttttcttcttttcctacacaccaaaagtcaatcaccaactaattctaagccgtttctgacgacaagaaatatcagataaatattcagattaggctactacagctgcagatgacaagacttcgtcaggctgggagagacaggaagccattcatatcttcacatcgcagcttctcgtgtcagtgctcattgctcccaattaacctgcaaacgcgatagtaatcgatccatctcattatctcctccctgaaaacattaattctctaaaattcgcctccatccatctgcactactgtttcatggtgatttgcatgcaataatgccgatcatcaaatgttcagaagtcgatgatctcgtcaggtacgtcagtcataaacctcgccttcttctgccaaggaatcaacacacaagagaaaccaagttcagaacgaaaacatacatttcagaaagattaattcaaagcgcatgaatttaaacattccacagcatctgcttctcctcctaggtgtgttttgatttggtgtcaattagctagaggggattaattcggattgctttcgttcggacaaggacgaatggcttttgtgtggtgtgtgcgctgcttttgcagcctgtgcttgaatcagaagctatccatggatttggatccctttctgaccggccatgattgtgtccgtcaggacagaggacgactaactgcaccgtttgatcgattcgacggcctaaccgacactccaatgccggccataagctggtttcatcgagaggaactgttgaccagttcagataaagttcagatacgtttacatttcttatgtgtgtatagaacaaaaaaagttcagacttcaatttttcccaaaagaacacaggacaggggagcttgtgattttttttcaactactcgtgagaatatagaaaatttgagttttctactttctatgttctgattcatttctagtttttataactatgaactattgaaatcttgtttagaagttagactactttaggaagctgaagattctgaaagaagccgcaagtgtctaaggccctgtttaggggagcttgtcccagctgcagcttttcccaaaagctgcttctgttagaagctgcctcaaacagtccacagctttacagattctgaaaaatgaactaagaagccaaaagctggagaagctgggtttcagagttttttcagattgtcagaagctggctaccaaacagccgcttctcagaatctaaagctcccccaaacaggccctaaacctcttctaacaacgccatagtatttaagcatagattctaaagtagttgcagatagacaaccctgatgttttagaagtacattggagtgtaatctaacttaggtttagttccatcaacttcataaacacgagaggtccaagacctgtccctctaaattaatcactgttctaatgtattcgttaatgatactgtacacaattgacattggagaatggagaatgcattgacagcttccacgtagcagccagctactagctgtacctagtactacatgaagtccactcttgcaattaaaactctctctagaaaaaaaaccaacatgtcatgatcgatcgattcgcgtaaacaacgtggttaatcagtttcagtctaattaaccaagtgccagaatctaagcacgtgtgattagttgtattagtagtactagtactcaattacattagacttacttgctcatcatttgacctcaaattactcttcctagcaactcctctacatgcgaaatttacctatttaaagcaagcactcttctaagttgaccattgccatattgacctttctttagtaggaactcaaccacttgatcaatggaatatataaagttataaacatctcaatgaaccattaactatgttttatcatcttttatatattttttcctgatcagtttaaacttttgcatgaattggttaatacgtgaagcacctaacaacctcatatgcaacaaggtagcacagacactactctgcacactagggctgtgttcggatgcctgagttcccaactctaacagtgcgcacgaaaaacggagcgatccattagcacgtgattaattaagtattagctaatttatttttcaaaaatggatcaatatgtttttttaggcaacttacgtatagaaactttttataaaaaacaatccgtttaacagtttgaaaagcgtgcacgcgaaaaacaagaggagagtattgggaacttggagttccgaacacagcctatgtcactagcaagaaattataagaggacattccactgtaatactaatactttttattagatcatcataaaaatattcataatactcccccatttcagattataagtcattttgactttggtcaaagctaaactactttaaatttaactaagtttgtagataaatatagtaatattacaacaccaaatcagtttcattaagtcgataattaaatatattttcataatgttactatttttttctataattttgattaaatttgaagtagtttagctttcaacagagtcaaaacgacttataatatgaaacggagggagtaatgattaggtgggtttcaaagcccgcttacatccctaaaaaaagatttactaactactgcactgatctctgaacatcaacggccaatatcatgataatgacttgacttactccctcttaactttgggagttggagatcatgatcaatatatgtatgacccctccaattattttcaaaggcctcatttaagtgccacaccaaacttgttcacacaatatatgcttctaactaactaaaccaattaagcccttgcacatggtcctccattgacacatatgcatgtccccttcatccatatcacatgcatggacacatcaacccaactattctaggtcaccatggatatctcttttaattttccctttgtttcaaaactgttcatgagaccatgtttcaaacacagggtgaaggagaggagtaggcaactagaaagaaaagcaagttcattcacttgttgcatgcacagctctgcaccacctaaaccatgtgaaggagtagtgaaattctgacacgaagtggatttggattaggggaagtcaacgaatcatggacaactcattgctaattgttggaaagttgaagtgatggattgagattgtttttttttatttttaataatgggatagtgatttgcacttccgatccatggagtatacatgatcgaatagaaaaaaaaaaattctgaatcattggtctacgagtatatttacggtggtgactactggtagtattaataatagcaccggtattaccactaataggaacaattatatcactagagaacaccgtaaaaattgtcaagacgcgagacatgacttaaagtaatcgtcatcctcttaacaacaagctattagtgttttctaaacagattgcagttctgatagatcctgttatctgctatcatagtcctttttagtaccactgagctgaaaaaaaatattttcaatctaaaagttggtatagtcaggtttaaaaatttcaagctgaaagtgctcggtggttaatctactaatgaacacttcaattacttcaacttctgacctgaaattttgattctttaattgttcttttgccgctgaactcatacatttcgaagaggtttcagagagtatgaaacatggcattgtcgaagatttttgaaaatttccgccatttttgtggtttgaattcgaagcagaggaaacagagcaaagggttagaaaacagagagagtatgttatatgctgttccttacctgcttcttgtcggcgaccttcttcttgtccgacgagacgagcgccgccggcagcggcagcggcagcggcagcggcggcgggcggcggaggacgggggtggccggcgcggagctgtggtccctgtcgacgcagagctgcatgatcttctcggcggcctcggcggcgtcgcggctctccttcacaagccgcgccacctccgccttgggcagccgcatccgcagccgcacggcgccgccctcgccggcctccaccgacgacaccggcgacgccgccacgtccgacgccgaccgccgcgacagcatcatgctctccaacctctccccggcgccgccgacatggacaagcgcgcccgaccacgtccgccgcggcgcgcgggcgaggcgagggagctcgacgaggaagtagagcttgccgggcttgagcggcgcgtcggcgtcgagcggccgcgcgcgcatcccgaggcgcctgacctcctccgactccaggacctggtagcccgggtggtcgcgcagcgccgccgccgccgacgccggcggcctgtacttgtacgtcgtcccgtccaccgtcatcaccctcgccgtccgccgcctcccgccggcgatcgcgttgcccatcgatcgatcaaaagcttagctgcctcactcagctggctgctgctgcttcgccgacgagctcgaattcgagtagttgacgtgagctcgcgaggcaagaggaagaggagagaagagcatataaagggaggcacacgcatgtgatgtggcaaagtcaaatctcacgtctaattgttaaattattcccaattttcaaattactcgtcgctaattttatgctaagttaaaacagttgtttttaaaacgttaataatttaaaattttgtgtggtttaataatatttgaatattatatatttattacgagagcgtgaatctaaaaagattaaccttataatgttgttggcttcatccatcatgattcaaatactgatacacacgaataaaatttagtaagatgtcgttggtttatgtcaggaggcgtgggtatagaagtgtgtgagtatgttgttgcatgtgtaatggtaaaaagatagttaaactatatgatttattttagagttagatggacatatgtacggatttctgattaggaaaatcttaaaacgctgagtaatttaaaactgagggactgtactagtttaattagttacaggtgattagaagcataatcttttcgatacctgcattattcaagggtccaggcgtcgacgtgtcgtggtagctagagatgcatgttctttaattagtacatcgttgtatgggcgtggcaaaataattgcattttggatttacttggacactaataatgatgtacatatctaactattatctctatcctaaaatgtttgacgccgttgacttttttaaaaatatttgaccgttagtcttattcaaaaaatttaagtaattgttaattctttttctatcatttgatttattgttaaatataattttatgtatatatatagttttacacatatcacaaaagtttttgaataaaacgaacagtcaaacatgtttaaaaaagtcaacgatgtcaaacatttaggaaatgagggagtatattactaatatgttgtactagtatatagtgtgcagtactgtactatagtacatacgacgagcaagagggccatgtgagctgtttgtatatgatcgatgttctaggtacggtttaattctatcatctataacaatgccatgcccttaattaaatgtggttgatcatccatgcgtagactagctaacaaaaacagtgattaattgcgcatctaaatgtttaatttgttggttgttagctactctctttaatgtatgacgtttattgtctcttgtacatacatttaacatttaaaaaaagttaaagtaaagatcacaaagcgcaccatgctttgaccacatctatctcaaagttcatatgctcacctgttgtaattgttttgctttgacgaagatagctgaattaatagcgcagaagtgtcgagaatgacatcaatatgcaagttttgcgagaacttgggttatactccctccgtccaaaaaaaagtcaacctctaaagtttgaattttatcccataaaaaaccaacttctaccatccagctaccaaccctcggcacataaaacgagaagttttatttcttaaatacccttcacctatctatcaccattactattttttttaataatgaggactatttttggcatttttactccccactaagtttaaattgggatgctaggattggtcttttttttttaacgaagggagtacttatagcatgatgaactaagtgttaactgagtgaacggatttctaacataaattggtacttgcatagtagagtaattgtattgttgttcatatatattacttcctccgttttatattataagactttttagcattgcccacattcatatatatgttaatgaatctagacatatatgtgtgcctagattcattaacatctatataaatgtggacaatgttataacctgaaacaaagaaattgtttccgtgggattagccaacaaaaagggagaataatagaaaacgtacggaatatgggttctatgatacaatatgccccaagaagtgtggttttatgataaaaactgctaaacctatggttaaatttgagatagatgtgcccaaaaactctcggtgttttacgatatttactgctaatataaatatatagaaaattacaaatcttgtctaaaatacctttggtactccctccgttttaggttataagacgttttaactttagtcaaaattaaactgttttaagttagactaagtttatagaaaaaagtagtaatattttcaaccaagaaaaatttattatgaaaatatattcaattattaatttgatgacactaatttagtattataaatattataatatttatctataaacttagtcaaagttaaaatagtttgactttaaccaaagtcaaaacgttttataatctgaaacggaggaagtaataaatatcacaacaaattaaatacataataattacgcaattttcttaaccatgtgaatgcaaccagatatataaaaattttagtaacatcatacattaaaaactaaaacccagagagagtactagtactacatccttctagacggggcaacgggcaagctacaagtgagaaggggcgtgcgtagacggcaacggaacagagatagaactgcgagtgcgtgtcgttgttaatttttggcggtgtccggtgagaacagggaaaaataaaagtgtggctagctctccatttccgttaaatatctctttcattagtcctaaattcttggcttggttcaagaaaaatgttgagaattagctttggctgtagtacatacgatcgagctgagttaccctcggtgtcaggttacctcatggccggccatccagcgtggattctggagatcttttgagaagaattctgtgaaatgtcagtcgatttcaatttcatgtcggttatgagagaaccttctgtgtcgatcgatatgattccaagcgttttaccgcgggatatatgtgatcgataaatgctgatctctgtcaggtaaattccatacgtgaagaggacaagaggcagctagttagtgtagccttttcttcagcatgtccaaattaaactaatcgtcgtctctttgtcagcacgtacagtacagtatagtaaagtttgtgctttagctaactagctgatgactagtccgtacaaatggcaattaatattatttttgcaagctagtcccctttcatctaaaaaaatcaaattctagttataaatctaaacaactatatttagattcgtagatagaagttaaatttattttgagatggaggtgtactagccagtaattgtgtaatggtagtgctaattacagtgtgtaagtagaattaatgaaccgatcgagtagtcgtgtgatgtatatatactccctccttccaaaataaacttaagttcatgataggatgtgactttatgtttagattcgtttatgttgggacgaacgatcaacggtagtacagatagtactgtcctaatgtccatgctcagttgctcacaattcattcacacctgcgctgcgatggttagtacctttaacttgtagcgtaggacgtaggtgcatacgtaaggctgacgtgtgggtgacagaagttggtcatgggggtgagcgagtgatctatcgatctgtcgacgaacgacgacattaaatattttgtctcgatgtccaccatggtcgatggagacgactatcatatatactacagtgatcatatataggccatgccatgtcgttctctggtgatagatgcacgaggcaaaactaaagacgaagaagaagaaacagcagcagcagcagctaattaaagaagaagactacatgctgacgctgcaggcagatatgccgcgagtcacgggaagaagacgataaaaggggaagacagtaggaaggcctcccgggtttgtcgtacgtctcatttctgacccattactgatatggagtatatacgtatacgtttgtgttctaaaatataccactctaaacatgcgtttggttgaagaaatgatatgaatagggttgagtcgaactcaattttaaaggtgtttggtttgagaatgaatgggataggaatagcatgatcctctagaggaatactcctcttagatctgggtccaagccactcgagaaaatctggcgaacgagctcgacctaccggggttgagcgcacggcgtgagccgtaccgttcttccaccgctcaagctcccacgccgtccatccgcatcgcgccgcgccgctccttgctcgctggccgttgcccatctggtcatgatccagctcctccgctggcagatcttctcctccactccacctgttggattccgtcactactttgtttttgttcggcagctggttgtcatcaacttcctctccgtctctagtcgattgctggcgtgggcttccgctacaatccagtcgccatatatcgagctcctccagcagttgcttgtctcctccacccgttccttcacccgccagattacatcgctccgcccattagctggttgctgtatgtcgggctctaccacactgtcggaactggatatggacttagctgcaaacattacccatcttctaccaaacaaaatgattggatcattccatcctataaacaaaacaggaatcttggttcttaaaccaaacacacattaaggtcccctttggtttggagagtaaaaatatgaatttcagaagattttcatcctataggaaaaattcctatgaatacttttgaatcaaaggattgaatcatatccaatcctttaaaatcccaatgaaatggacaatcctatagagattttgaagaaaacttagcaagagctcaaagctcttggaaaatttcctttgagtctatctctctcatccaattcctgtgttttttctatggtctaatcaaatgttcattcctgtgtttttcctatgttctacaatcctctattttaaattttcattcatgttagaatcatgtattttttctattcctatctattttcattcctacgatttaaaggggctctaagattggaggaacgtttctatttagattttagattaatatattttgggatggagatactaactagtatcaatgctagattaaattaactaggagtgagatgaataataattgaatactacttctatgatcgattgatatggatgtgtggtttagctagggaggcgagagcgaggtacggtgaggccacgtatgcatgtaatgggatcgaccgatagaatctgtcagatcaggttatgttcgagcctgtttagatcccatgtcacgttttttcatcttatcacatcgaatatttggacacatgtataaaatattaaatataaataaaactaattatacagattatgtgtaaattacgagacgaatcttttaagactaattgctctatgatttaacaatatgtagtaaacatttgctaatgatgtattaattaggcttaataaattcgtctcgcagtttacatgcggagtctgtaatttgttttattattaaaccacgtttaatattttaaatgtgtgtccgtatatccgatgtatcgacacggcaaaactttttacactcgatctaaagacagccttagtctttgccttctgtcggctgcctgagcccctgacagtaggttcattatcttatatactactaattaacactccctcatcttaattatatggatcacagtacgtgtttgcacagcacacggcgacacacaccacgagctagcgtacgtgcagctacgcaatcggttacagcagcggaggacggcgggttggcctggctctggcttggcttggttgcatttgcatatacgatcgacgacgcacagttgggcgtggggacgaagaggaggccacagcgaccgaccgaccggacaaatctctgcagctgatgatccccattatcaatctgatgtaatgtaccgaacacaggttaccaaccaggaacatgcattgagctaggtaattaccccgatggcaaactgttgaaatcaaaacatgaaggatggcccttcttttacatgcatggttaataagtattttggtgggactagaatgtctatactacttttaaatattattccctccgtttttaagtatatgattttttaagatacgtttgatcatttgtcttatttaaaaaatttatgtgactatcatttattttattgagacttgatttatcatcaaatgttctttaaacctgacttaaatattttatatttgcataaaaactttaaatagaatgaatggtcaaatattttgttgaaaagttaatagcgtcgtatattaaaaaggtggtagtatatagtagtgatggtggtggtcgaatgtcacttgggttcatgatgttaatcttcattgtatgaatcaaatacacatgggtaatttatattcaattgtttctcactacgagtgactgtgtagctcaacacacatgtacaaaattgtaacaaaccctgttgcatatggatatgatgtttcactatatgtatcgcaggggtatttagctagtttcaaaagaaaccgtatttgaaagaaaggatatggtacaccatttgggaggccaactggatcccctcaagccacaatctcaaagtcaatacttacaccgccagaaggtaaatttctcttatcaaacttaggtaaatgatttgaataatctagtagtttgggatgaatacctggtctaaagtttattttcggcagttaatcgaattttagagataccactggtagaattccaacaccagtttgttcactgttagatatgcataggaaatgctacttaatggagaaggcaacgctgatatttctggtgttcgggatagactctagaagatgaatctgcctgaaaaaaagttaaaatctttggttgaagagctttacatggcatggtgtctcctgctccaggagtactagcagggaataaacacatcaataatcagggaggttgtcttgtgtgccaaactgatggtggagattgtggataccccatacctacacgacatgtatatccgactgggtatggggtgccatgtatagatagaatatctttaaagggactcgggttaaattccaaacttgtatgtcaaggaaatacccgggatcctagttggttacgattgtattttgtatgtaactacctattccattagagatatggactgtacttaggaggggtccgggtgcctcttggggcacgattttgctcctagatcatacgatcaataatacactcggcggatcaatccccggacaggagtagggtattacttcttgttaagaaggcctgaacctgtataaaattccttgtctctcaacccatccacttttccagcttgatagccacccccttttagtattgccgaaatcttgtttcgacagttggcgcgccaggtaggggtagcgtcaagtttttcgccgactagtgcgatgggtttcgtctctggcatcgacgactttgtcttccctctcgggcaggcgttccggttcggcagcctcgacttcatcaccaacgacttcggcaagatttctctcctcgactcggattcgaaccagtcgggaagaggccaggtttccgccccgttcggtatcccgaactcggccgagacctactccaggatcatctcaaccgagcttgcttcaaaccactcagacgagatccaatctactccaacacgacctgatcaagacgatggagcttatccctcaatcctgatgaaactccccgatgacttggctgccgtcttcaccacaagggcgtcctctccccgtaggcctacgcgggatctggcctcgaccccgatccagtctggctcccgggaagttggcgtcatactccagcctctcggcacggtttcgacggaacaataggacggctacctcagctcccccggcgtcgactctcgaccaacggagatcgtagagtacgacgacttcggctaccgctatgactaccgcaaccttgacgacttcaacgaaggctacaaagataactacacgcccctctacttcggcattttcatggccgacaacgagacggaagagcagcgtcaagcctgagaagcagaagaacagcgcgtacgacaagaagccgaacgttgccgactggaggaggaacgccaagcacaagagcgagagcgactgcagcgtgagcaacaggagcgcgaacgggctgcaaaggaggctgagtaccggcgacaacgcgccttggaggccgggcgacgagcacgagagctcatcgggcaacaagacgtcgaggggacgacggtttttcgcacccccccagcagaacacggttgcagcgatcacccttctcgacaccctcctcaaggaagacacacttaattaggccaatcacgtcgtcaacatcttgaactagactaagaccatgatcaccgcttcggtcccggtcaactccgcaagcatccgtacgccgactggcagccgagttccgcctcttcgatctcaagactatcaccaaccaagcctcagcgtcgtcagtgcaggatccagccgcaggagcagggatcacggcgaatgatctgtccactcgcctcctgaccggcacagggagcgtcgggctgaacatccccgctccccacgtcgcatgcatcccatcaatcttcgcgaaactatcaaccagcgccgtgcggcaagaggctacatcccccaccattcaccagattgttacgacgacgacttggatggagatcaatgctgttcagcccgatacgccccaatatcttcggtggtcagagacagttatcaagtttgaccgctcggatcatcccgaccgagtggtccacccggggcggtaccccctggtactagacccagtggttcgcaatgtcaagcttcgaagatccctcatcgacggtggcagcgcactcaatatcctttttgccaagactctggacgacatgcagatccctcgcgcagaattaaagccgagtaatgcgctctttcatggagtcatccccaggctatcttctactccactcggccaaatcactctgccggttactttcggcactcgggagaactttcgcacagaaaatatttgcttcgaagtcgctgatttcgagatagcgtaccatgctatactcggacgcccggcgttagccaagttcatggctgtcccacactatacctacatgatgatgaagatgccaggtccccgaggagtcatatccctgtggagcgacatcaagcaagccgtcacatgcgacaaggaaagctgcgagatggcccagacccgcgagatcacgcttgcccgagaagaaatccgactggctgcgtccacagcaaccgaaggagaagtgcctgcaaccaagatgccaaagagcggagaaggcgatgccaagaccaagaaaattcctctagatccctctgaccttactaagactgctgtaataggcgctgagttagattgtaaataggaaagcacgctcatcacatttcttcaaaataataaagatatctttgcgtggaaaccatctgatatgcctgatattcctagagaggtgattgagcactctttgcatgttaaggaagatgctaaacctatcaagcaatgactccgccgtttcgcacatgataggaaggatgcgattaaggaggaattgaccaagctgttagcagcaggcttcatcaaggaagtcctacatcccgactggctggccaacccagtcctggttcggaagaagacggggcaatggtgtatgtgtgttgattgcaccgacctcaacaaatcttgtcccaaggatcccttcgggttacctcgcattgaccaggtagttgactcaacggccggctgcgagttactcagttttttggattgctactcaggatatcattagatccgactaaaggagtccgactgcttgaagacttcgttcatcacacccttcggggcctactgctacatcaccatgccttttggattaaagaatgcaggagcaacttatcaacacatgatccagagatgcttttcaactcatattggtcacaacgttgaagcttatgttaatgatgtagtcgtcaagaccaagcagaaggataatttgattacggatctagaagagacctttgcgagcatccgcgccttcaggatgaaattaaaccctgaaaagtgcatcttcggagtaccgtcatgaaagttgcttggctttatggtatcccatagaggcatacaagccaacccggagaaaatcaatgccatcctcaacatgaaactgccgagctcccaggaagatgttcaaaagttaactggctgcatggcggcgctcagccggttcgtctcatgactcggcgagcgggggatgcccttcttcaagctgctaaagaaaaccgacaatttccagtggggacccaaagcacaaaaagcctttgaagacttcaagaaacttctcactactctaccggtcttagcttcgccacatccgcaagagccgctgttgttatacgtgtcggcaacttcccaggttgtaagcacggtcctggttgttgagcgtgaggaagaaggccatgttcaaaaagtccaacgaccaatatatttcgtcagcgaggttttggccgactccaagacaagatatcctcaggttcaaaagttgttatatggtgttttgattaccatctggaaattatctcactattttcaaggtcactcggtcacggttgtcacatcgtttccacttggggatatacttcataaccgcgaagtaaatgggcggatcgcaaagtgggccttagagttgatgtctttggatctatctttcaagccgcgaacttcgatcaagtcccaagctttagcagacttcgtcgccaagtggaccgagtgccaggaagacacgtctgcagagaagatggagtattggactatgcattttgacgggtcaaagaggctttcgggcaccggagcaggagtagtcctaatttccccgactggagaaaggttgagttacgtattgtggatacatttttctgcgtcccataacgtggcggaatatgaggcgctcctccacggattaaggctggcgatatctttgggaattcggcgtctgatagttcgcggagattctcagttggttgttaatcaggtcatgaaagagtggtcctgccttgatgataatatgattgcttatcggcaggaggtacgcaagctagaagataagttcgatggcctcgagctaacccatgttcttcgacataacaatgaggcagctgacagactagccaatttcggttcaaaacgagaagcaactccttccgatgtgtttgttgaacacctttatgaaccaaccgtaccaaggaaagaaacagccgagactacggacactcaagtagtagccatgattgaagctgactagagatagcccctcatcaaatttttgaccaagcaagaactccctcaagataaagacgaagccgagcggatttctaagcgcaacagactttatgtcatacatgagaccgatctgtacaagaaaagtccgtaaggaattctgcaacgctgtgtgtctttggaagaaggacggcaattgctaagagatatacactcgggcatctatgacaatcacgctgccgcacgaaccattgttggcaaggcctaccggcagggtttttttctggcctaccgctgtatctgatgctgacaaaatcgtgcgaacatgtgaggattgtcagttttttgaccgacagactcatttaccagctcaggagttgcaaaccatcccattatcctggccgttcgcggtttgggggctcgacatggttggcccgttcaaaaaggctatcggtggttacactcatctctttgtagctgttgacaaattctccaagtggatcgaagccaaacccgtcatcacaatcacaacagacaaggctggagattttttcatcaacattgtgcattggtttggggtacctaatcggatcatcactgacaacggcactcaattcactggcggagtatttaaacatttctgtgaagactttggcatcaaaatttattatgcctccatagtgcatcctatgagcaatggacaagtcgaacgcaccaacggtatggtacttcaaggaataaaagcacgagttttcgaccgactgcatccctgtgctggcaaatgggtagaacagctgccgtctgtactttggtccttgcgtactacacccagtcgggctacgggccagtcaccgttctttctaatctatggtgcggaagcaatgttgccaagtgaggtagaatttgaatctttgcgatttcgtaacttcagcgaggagcgctatggagaagaccgagtggatgatctcaaccgactggaggaagcccgtgaagcagccttaatccattcggctcgatatttacaagggatgcgacgttatcacaaccgcaatgttcgatcacgagctttcttagtcggagacctggttttgagaaaaattcaaaccacacgagatcggcacaagttatctcccttatgggaaggaccgttcataatttccgaagttactcggccaggttcttaccgactcaagcgtgaagacggtactagtgttgacaactcttggaatattgagcatcttcgtcgtttttatgcttaggcattacttttgtactttcctctttgactgctaacatcaagctactccttgagttatcagtcgggggctactataataataatggagtgtgatttttatcaattcaatttgcttacttgatttatcattgctttgttcgattttttggcttagtcaatgagtactgaaagtttttaagaacttttgcgggttttaggctcaataaggtttgacagaaacttttaagaaatccggggctgagtttaaatcatcaagcacaacataaattcatcagtattgtacaaattgtgcctccatcatcatcagaatacaaaatcaatcagattcagttttttcatcatcagagttatcagacccagtcggcttaagatcgttgtcatggaacctctcaactacatcagcggctatcttgtcagcagctttttgcacatcactgatgagatcaagggcggcttcctcacttgtcccatctgcaaagccatcaacagcatcaatatcaatcttcgggtaccaggacttggtcatcgccaatgccagactcacccctatatttccagcttctttgatgttcttaaaataggtatctagagtagatctcagtttgtcgaagatttcgacagcatcaattgaactcggaccattgttattgaaaaacatggcttggaccgagtggcgtagtggcgttggcgacttcgtctctggctccttcaagctttttgattttgctgaccaagacattgaattgagcctgagatttgactttacgatctgcacaaatggttcacattaacgataaagcatgaagacaagaatgctttcgaggtttcagcaacaagtaccttcgacgtcttttagagccgagtctctctgtttggtcagttcactcttgtctgtttccagggccttgattcacttttctagttcggatatcttggcagcttgcactgtatcgttgcccactggtcaatcacatgtgaaaagcggctcagacaagtcagacaagaataaaagttacctttggacgaaccgctccgctcaatgttggaatcttgaagctcggcgattcggtctctaagatcatgttcagtttttctagcaagctccttggcttcacgaagttggtctctggttgcttccagggttccaaggtgggggaccaatctctcgagagttgcggtcttcgccttatttctaagatggattctctgcattgcaatttcatctttattcagtaaagttgccgacagggtgattgaagctatgggtaaagagacatacatttacaagacgagtggcttgactgagtgtctttttcagcagacatacttcctcgtcttccttctgtttatttattacaattccctgcggttgcatttcatcatcccaccacttaactaagatgggtgggcaagaatcttcagctaaccgtatccggaggacctcttcttcatcgccgaccattgggccttacatatttatgaacgatgataaagcaatcgaagaaagtttgtcggatcaaaatggatttggatcttctgtttacctgttatgacttctggtcggggacgagcaggcccttgcaccctaacaggtgagcctaacctcgggtcggcgctggtatcttttcggagagggctgcttgtttgagcctctacttccgggatgtcttcattttgttctatacccgactggtttccagtcgggggctcctgatcagcacctatctcagcttcggccgactggtttccagtcggaggctcgttgctggattgtacattgtcggttgctggttgattattactcgggcgatcttcggcagttggcccggtttcagttgtaggaccagtctccgtgctggtcgtttcagagttctttctagaaggatcgatgtcatatggcttcctgcaaatttgagatatgctatcaacactacttcaatggtgaatgaccagcgatacgagggaaattgctaaatgactcatacctggatgacttcctgatttttggtatgggacgactggatgttttcttctttggattagcttgccttggttgtttctcagtcgcccctttgttgcctaccttttccacatcgtcgccctcatcgtcacttgaaaccaacttcctcttacgagagtctgactggttaattgacttcgaggtgttgggttgaacgtcggactggattttcggccctccactagcctggccagtctgccgacggggtgagcggcgttgagcgatcggaggatccgacttcatcaaggcgaattcctgtgcatgacattccaagttttcaattaaacttgtagaagacaaaaagatgtttttcagagaggccgagatgtttgatacgtaccggaggaggagggttgaaggcattgtatggcacgactggcaacaagtgcgaatagccgaccacgataacattcgagaagattttgtacattctctcctgcatgattttgaactcaagagattctgggtcctctcggttggggtcttgcttgccgtcaaactcgaaggctgtgcgggatctctctttgatttgctccccttgcagaccctgttctttaagcttcagcatgcggtccaacagggcaagtgcttgggcggcctcttctcctatgggaagtgagttccaggtatctcggtatactggaggaagacaggagtacccgggaaatgctggctcggggttttgcacaaagaaccaatttgcatgccaacccttgttcgaggtcttgaagggcatggagaagtatttttggctcaaggttacccttagttgaaaaccggctcccccaacaacgcacagtttgctcttgttcggctggggcttgaggaagaagatgcggcggaatagggcaaaatgcggtctaacacccaaaaaagcctcgcaagcatggatgaaattggcaatatggagtacggaattggggtttagatgatgcaaactaatcccatagaaatccaaaatcccttggaagaatcttgaggttggaagagaaaacccaccgtagaagaaatgggagaacaccacgacctcgtgtgtatcgggggtcggaaatgtttcaccgcacgccagacgccacccgatgatctccttcgccggaagaacactgtgcaccaccatttccttcaagttttcctctgtcacatcggaaggcgcccactgactctcgaagctttctctctcctccgccatggatgcgaattggatgatgcgatttggtttgagaaatggccgggaatggaagggagacagatgcggtggttgcgcagaagatttttgtggagctctagcgaatggattggagggaatttgtgaaccctagctttgccggtgtggtttcgcactgtagcagtgagtggggaaagtggcgagagtttcggcggggaagacgaaacgacgccttgccttcggcgtttatttcgctaggatatcgaaagtgctaatgggcctgggcctaaacagtatttcagcccaattttattatcagcgtggctagttgtgatccttagggacttaggcatttgtttttgctttggcaacacttgctcacgacagtatagcccaatgctgattaaaatcctttttgacgcagttagataattttttggaattactacaatgcacataaaaaggtgcccaacagaaaagtgttatactaattttgtaggccttcttaggctacaaagctgttcgggttttgttgagatgactggttttgaatagtcattctctcagcatgttatatgcttattttaatcatgacgtgagtcatagcttaggctatttagactcatcgtttgtcatgctttataccacatttgatggatctttttgagagtttttactcggatttttatcatatgtgttgatttatagacctttagagtgttttctcactcgggcctctttatatctccttttttgtgtattaaagctaaagcagtcggctggatgttttactaaacgtcgcatatgcttagctatatgatacattgggagactaggttgtaaaaccactcggatggagcccttcacagtctttgattttggtactagggagaccaagacaaaagaagttggagcactcggattattgcttgaattacgagagaagactatcttcgtcgactgtaaaggtctcaggggctactgtggagattgtggataccccatacctacatggcatgtatatccgactgggtatggggtgccatgtatagatagaatatctttaaagggactcgggttaaattccaaacttgtatgtcaaggaaatacccgggatcctagtctgttacgattgtattttatctgtaactacctattccattagggatatggactgtactttgtaatacgaaccccttcccctatataaggaggggttcgggtgcctcttggggcatgattttgctcccagatcatacgatcaataatacactcggcggatcaatccctggacaggagtagggtattacttcttgttaagaaagcctaaacctgtataaaattccttgtctctcaacccatccacttttctagtttgatagccacctccttttagtattgccgaaatcttgtttcgacaccgattgcgaggatatttaacatattcttttcacttgtgacagggctagaaaggtttcgacgaagatgggtatttggaatagaattgagaatatattgaatatggatcgatctggctacgtggtactaccagaaataattatgaggggaggcagttaccacgacttaatgatttgggcttaatttgttaaaattgttttcacatggggtggtatacttggtgagaaaggacacggatggttaatggtgaaagggtccaaaccactgtctgtcctaactctaaagtataattgcaagtaaacacatccaaaatgcaaaaccatgagaaggatggcacaaacccccaagggtttctcaagattaatgttggatgtttcatttgacattgattcaggaatcaggaggaactggggcaattgttcaagacgcaccaggaggtttcatagcaagcgtgtgtatgtataatatttgtatgtatatttgtatacaattaatattcttcgggaaggaccttttctagctaagcaactgaggtgtcatgttgattgtaggatttctatccctgtatggagcaagaaaacggatgcgcaagtttattattagggatgcaagcggaacgggcaagcggacatttttgtcccgcttatcccacttcgtttattttttcttttaaattttgtactaccatgcgaaaaatacacttgcaagtgggtttttacgtgggtagcggaattacccatccctatttattatccaaacttactgcttgtaggtagtggagacgatgcaagatggaggattctcgactacaaaattggctgcaatttttcacgaatgtggtatgttgagatttggtttagagaatatctatatagagcactgtaataagaggcaaactgcacgtaaatccgcctgtgtatctacaatgtagatacggtgctcaaggatcggaaccacgtgtgtgtgtgtatacgatgatgtgtttagcgtcggcgacttccttctcgactccgctcggttgggccagacgttggatcacccggcccatgggccattagccccgtccatttctgggcttcaccgagaaggcgccgtgtggcccatctcttctccacggcccatctcctctacgggtaggaataagttcatctgaggccccttaactcgtcaacgaattcgattttcgtcgctcaaccagaaaaccagacataacaggtccctcaactatcaaaaccggtgcagattagatccctcggcagttctgagggtgttgttgactgatgtggcgcctacgtggctaatttgactcggtctttatttgacgtggcattgacatggcgcttacgtggcaattcgatccggaaaaataataaaacccatgggacccgcatatcaatctcacacagtaaataattaaaaaaaggtaggacccacgtgggccccacttatcagtccaactcacccctcctcttcttcctcctctcttcccatctcccctcttcatctctcttgcgctgggggatgggcagttgggcaccagatgcggccgacgacgacgacggcggcggaaatggagaagagcggccgccggccatctctcttgcgcgcgctcaccggtagaccagggaaaccaccctcaaaaccgctgcgcgacgccgccctttcccgccaccaacccctcgcctccggaggacggaaacctcgcccgcgcacatccccagatccatggccgtctgcccgccgtgcgctacccagttctcccgcgcccgctgtcagaccacctgcgccgccatctgccgagtccgcgggtgaacggcgacagcaacagcatcaagcccgccctcgccgaccacaccgcgcagttgctcgacctagatctgctccccggcgcccatgcacggaagcccccgggtgcctacagtgaggcggcggcggccaaggcctacccgtcctgcgacgccatcccctgcgaccagttcgaggtggccttccaggccgtggagctctggatcgccgaccacgccgtcctgctcgtcaagaactcatcacacgcacatatgcactataatcaaacctactggctataagtagtgatatgcatacaggatccattttgaggcaaccatagttgagagagctacattggtaaatttatgacagaaaccgtagcaagaaactattcgattcaggacaaaaaaagaacaagccaatccagggttcgtgctcgccgacggcatccaggacgacgccgggaacgtgacgcggttcgtgatgctggcgcgggagcccatcatcccgcgaacggaccggctcttccgaagagaggggagatggggggagaggaggaagaagaggaagaggaagagaaagaagaggggtgagggtgacatgtggggcccacgtggccccaccattttttattaatttgtatgtgaaactgacctgtgggtcccacgggttttattatttttccagataggattactatgtaagcgccacgtcaatgccacgtcagatgaagaccgagtcaaattaaccacgtaggcgtcacgtcagccaaaaccaccctcaaaaccgccgagggacctaatctgcaccagttttaatagttgagggacctgttgtatctggtttttgggttgaaggacgaaaatcggattcgttgataagttaagggaccttaaatgtacttattccgtacgggtacggtgctgctgcttgcaacccgtgcggtgggctactctccaaggtgggccgcggtgattgagaaacatttttttttcttttcttttggagcacttggtaaattggcaagtgatctatatataccaaatgaaaaaaaaaaatgcaagcattccggtaagaaatttcgtccgccgtcacctaaatttttttcatccaccactctcgcgtcatgcgctcgtcatcccaagtccgggtcgaatcgaatctgatcgagatttacgtgcatgggattaaatttaaaccagttcgtattacaccaggagaatttacatatacgacaaacaaaaattggttacaaaattttctcaagttacaacccaaatataagaattaacggtagacgaagaaaataaaacccaaatcaagcaaaaatccagccactggaatcacggtttcaccggttctaatcttgggctgcacataacatgactcatcgcatacgctcccaataggcttcgcgctgtcatcggaccttgctggagacacgagcggcatgagtttgccgccaccaccacctcccaatgctagatccagtgaggagggtacgtgcggagtggccgccgggagtagctcaattgagttgtcgctgccgccagccaccgcatcacaagaccagatccggtgaggaaggggcgtggagtggccgttgggggtagcttagttgagttgtcgccgctgccggccaccacatcccaagaccagatccggtgaggaggaggcgtggagtggccactggcggtcgctcggtcaagctgtgcgccaccactagtggcgggatccaacgagcctgaagccggatatagcgaggagccgaggagcagggcagcgacgacgtcccgacgaggaggaaagaggtcgacaatgggggggagggagagtgctagagctggggagggagaccgatacatgcaagcatgccacatccacacattaagcatataaagctcaatatgcaagcatatactctcaccatctttgaatatttgacgccgttgacttttttaaacatgtttgaccgttcgtcttatttaaaaaatttaagtaattattaattcttttcctataatttgattcattattacatatcattttatgtatatatatagttttacatattttacaaaaaattttgaactgtcaaacatgtacaaaaatttcaacggcgtcaaacatttagggaaggagggagtagtaattatatctataatttatttcattctaaaactaaacatacccatactaaatcatcattctcaaatcatttttataatatttcaatccaaatcatctcaccatttttctaatatgtaatataattaccacatcaaattaagcgcggacatcatctagtatatattaaattcccagtacatgcgttgtgcaaaagcgtagtgagtgcctagtatagtagtacacatatgtggccacacttgtcttttccaaaactaaaggcccaaatacgtcagtacatacgtacgtcagactacacagtgatcgatcactgagatgtacactagctacatactagtatatactatactactactagtactatagtataggagtcacgcacatgcaggcaacgtcggaggcgcaacacccggccgcccggttggccggccgccgccgccgagattgctttctaattctaccaaatgcagccgatggagcgagagacgaagctagcagagagcagataaacatccaacgatcgatcgatcagctatttagtcgtcctagctagccttggatcatgacgatgcatgagcatgacgacacaccactagaggcgcacgagctcgcgagaccattcgatcctagctcactactggagaaactatcttttccggtcagccaaaaaccacaatagtcccggttgcaataaaaatcaggactaaagatggtttttaatcccggtttataagcaaaacgggactatatgaactttagtcccggttattaccaccaaccgttcacacgctgtcaagggctgtcagggctctcgggatctttagtcccggttagtaactccaactgggactaaagttcggatatttaatcccggtttatattatcaaccgggactaaagatcccggtgatctttagacccggtgagtaataccaaccgggactaaagtcaggtaccgggactaaagatcaaaacgcactatataatctctagtacttttcctcttctccaatccacacacaaactcctccctcttctcccctctaatccttatctctttccttgctcttaccttatctctttccttgtctttccttccttctcaggaggagtgagcgcaggaggctggaccggctgggtggtggcctgcgcggcggcgtggcggtggccagagaggaggggaggtggcagcggttgcaccggccgtgggcacgagaggacggcgggccggtggatgggagggcggcggcggcggccagcggccgacagtgcccactcgtggatttttgtcctttcttttttttcttttaagaatttgtgattcgattgagataaagaatttgtaattcgttgtatggattgagatatataatttctttttttttgagaatctgtgatctgagatgtataatatgtgatatatttgatttgtgatatttgggatgttactttgatttggggtttgatttggggatatgcatcccacttgattttggggaaaatagttagggagtaagtagtaagtatcaacagaaacaatgaaaaaaaaataaaaaggaaactaaccgggactgtcgacagtcccctctttagagataacgatctgccggattcgaaggcccggttgaaaaaccgggactacaaagggttacgaaccgggagtaaaaatgatctctccaccagtggcttaattaagtttaatttttgtttttaaatttaacttgccacacgcacgctggctcgctccattgctgaatgtccgtgttttgctatggataaaagaaaatgtattaatgtgttcttcattctttttactgtagggaatattcatcttaatctaattttttacatggctatccatttagatttgatcccttttaatattaataagttcaagggggtaacttgtaaaatttacaatggaactagtgaagtggcagattcactaccaccatcactattttcttttataggagcatagatattaattcctgaagtttacataataaaatcgttcaccattgctgtagttttctcaaatacgtacccaaagtgtagtaaaatgtaaaatgatagtttacaataattggttgtagttttttaatataatcatttactattaattgttgcaattttgtgaaacacccagttaaagttgtagtgaagttacagattgtaacaaatggttgcagttttctcataaaaccatttgttgttgttgtaattttgtgaaaagtacctaattaaaattgtagcatatcgatagtattgaatacatggttacagttttgtggaatacacagttaattaaagttgtcacaaaatgattggtttgaataaacggttgaagtttgggggaatctacttttttacaaaaattaagataactattcacatttttctaattttatgtgaagctattttttttaagatcggatttgatatatcactgttcgcttttgattccaatgatatatatagtatacaataggttctataataaaagtcaagttgtataactcttagctagcttgtattagaagatcatatacttgttgtgttgaaccaaatccgtattctcgaaaacagaaagccggaagaacagcaatcgctctaataagttaatttttgaaagaagttaaaattagcttccctaaatataattatattttgcatacagctatatcaattaacctataataatttggatatacgatgatttggactatactttttaaggtaacgtggtgtcctttttcaagctatatatatagtgctcgatcgtgtacttctagtttgatgataattaattatataacctgggtatagaatcatactggtcgtacgtaagtaccacatacgtacgtacgtctatgctagttgaattctatccggcagggcagaggatcatatcatatcgctgactcaatggagtcttgcttggctgccactatagtgtgtgtgtgcgcacatgccgtgcgctcgatattgcactttactgtaccacatgcatgctagcctatcagagagagattaaataaagatgctggggtacatttgcgattgagccaagcccacgtgacgtgagctagctagctaagtaggggtggcaacgggacaaggcggggccaggttgaacatgaacgcccctgccgccccgtgcccagccttgcattgctaaccgggtggaaagcctcacccgtcatcgtccccgcaggggacctcgtgggtgagtgaggccccacaattccgtatagagtcaatacacatcctctaatcaatgcaataaaatgcataacaatattctcaaaccaatacaaacaacaccataaatcaacaaacacatagagtcaactcgttagatctgaactctgaagctgcccgagaacaacctcgtggctccagcgatgaatcgtgttgtggtacaccggtgagatgaccgatggccatgagagacaaggcagagaggcgaggcaacgatcatcggcggtgagaggcgaggcaacaaccatcggtgatgagagacgaggcggcttggtgacgcggcgacaaccgacgagatgataaggtggcacagcgaagacagacggcgatgggagaacaaggaggctcagcgacgatcgccactcggcactgtggcgagaggcgcagcaatgaacagcgctgtggcgagaggaggcgatgagcggcgttgttgcgagaggcacgcgcagtggtgagaggcgccacggcgtggaggtgagggtcacgcggtgagcgacgtgtcgagcggcgactgtgcgttgagtgggagttggggaattatggttttagtttaggggctgtctatataggaatcgaatgatttctgaagctccaatcatgcagattttatctaccataggatgcacatccagcaactcagaaaaagtgatacaaatagatattacacttaaaaacagatatattatttgattatttgaacgccatttttttaaagcccaaatccagatccagatccataaaagcccaaatccatatccagatccataaaagcccattagtaaaaagaaggcccaaaatacaaaatttgaatcaaacacaaataaacaaagcccatgattttttcgcccatgcgaattatttgaaggcccaagtccatatccagatccataaaagcccattagtaaaaagcaggcccaagatacaaaattagaagcaaaacataaggaaataaagcccaaatcataatccaacagcctatccaaaaaagtagtagggaccaaacttggaagccaagtagatgaaaaacatgtcacgtgaatcaaccatgtatgggaccacacttttcaatcccctacttttcaacagcactactagttcacaaacagatctagcacgaatcaaacatggagctaggagaagagaaagaagagagaaaaagaggatccaaatcgcagatggaaggagagagtacaatgtcagaatcaaagagtagttctagaggaaagaagaaatcaaagacaacttttgaacagaaagttgagatccatacaaaggaaacacagaatctggagaacacaaagaaaaaacaagaggaaggcaaaatcaagagaaacaagaaggctccagttcaaggttagttcaaggttccaattcttatcccctatatacaattcctgaaaaagatcaaagagagagtttaggtcaaatatacaattcaaaagaatacatgaaattgctgaatatgtcaaatgaaacaaggttaacaatccactttgctggataaatacaacaactcagaactgaaaatttcatatgtttgctctgtagatctgaactatgtaatgttaaaagtaaaactacactgcattcagtactacaaaactgcattctggatgattgtattactgtgtactattgatgaataccaaactaactttataaaaaaaacatgacagattgattagtcttccaaccttactgaatttcactctgaagatatcacagttatacagttatacagaaatataacaactaggccatatagcatatcctgaattgtcatacattcaattttatcagcataatcaccatattaaactaatgacaaattcaaatctcaatgtcaaccacttgtctcatccaactcaatattacataaaagttcaatatctcatacagcacaaacaaaagagccaattcatatgaactcacaaatttcttaacatgttacagtaaaaaagtaataaaattacatacaagaatcacagtaattctagtattaactcattgtaaaaagattagttcagtaaacaaaatagtttagctcacacaatcatgcacaaattcaggaacacattcaagatatgttttaaactcaagactatctcagttcaatgtttctctcatcatcagacaacaaaatgaagatttcagataatagatcattgttgatttgttcaatgtctcaaaatagaatataatgaaactagttacagtgaacttgtattacaaatatatagagtgaacactacaatttcaattgaaaatacatgtaactacaaagaaactatgtaaaattcatatgaaatcatgatctaatgcagtttaatctcaatttcaagatgatttcagatttttcgagcaaaaaacagggtatcaaatacttcaaaagtagtacatatgtaaaaaccaaaacaaatcatatctaattgaaatagaaagaaatagaaaagaaaaagtgccatcagatagtttgttccataagtaaattttaactggaattacagtagcattacactctaattgaaatacttatttactgtaatactacttatggaacatactcatacaggtttgaaaaacatttaaagactatcttgaatatttctttacaggtgtcatacaaaaggacaaagaatgcaaaagttctaaggaaatagaaggaaaaaatataggtaaacaagagttacagtaaattttaactggaattatagtagcattacactgtaattgaaatacatacttagtgtaatattaaaattattttgaaagaattatacaaactaattcatttgttcacttcactgtctataatcaagtatcaaattgattgtagttggatttttaagtagttacagtttctgtttactggaattatagtataatttctctgtaatacaaatatatgttcactgtaaatggacttatgaaaaagattgggaaatacactctatgtttcagaacttgctggtttagaaattcaaaagttctttgcaatattaatttattctttctatgcaggtggcatacaaaaggagaaacaaagcaagagttctatggaaatagaagaaaaagaatcaggtgaacaagataatttcaaattttattcacaaataagaagattaaaatgagtctgaaattttttaaaaaaatgccatcagatataaaaaagcacttcaaagctctgacagaaatggatacagagattataagtcaatcaaatctgacagaaattaacacagctatgttgagctcaggtaagaaacaaaaaattatgtagttcaatgtattttttaaaaaatgacaaacatctagatgatctgaactatatactttcaagtgggtactttttaaaatctaaaaacattaaaactagttacagagaagaagtaataaaaatacatgtaacaataactgaaaatacagtatctatcttgacttccttcataatgatttttattttgcaggtatcacaattgaattgtcagaaggagaaagaagtattcagtcaaaacaaattcagaatatgaaacaaagtattttgacagagtataaaacaacttttgtaaactcaggtaagatcttacacaggtattcttattctgtttcagaacaattctttcattacagttaatttgtataaaaattacataaaaaactgtaattccaatactaaaaatttcaaactggaatacaaatttactctaatttttaatgttgaatcaatcaatctattgcaggcataataggtaatgaggtaggaagaagcaatgctctggatgaaccaaacacaggtaacaattcaaaatggaattgaacaaatgcataattcctttagtaaaaaaacacaaaatgcaaaaattacagtcaatttgaaacagaataagaataattttaaacttcaacttgattgttatacagtttgactggaacctatatataatttgatcacaattactttaattgcaaatataacagatcatattggattaggagcagaagatgcaacagtagaaaagcaaagtatggataattcagcaagtatgacagaagcatttgttgattacagcaacaaatattcatatgatgaattatctcttttcggatcaatgaattcagtaagttcatattacaaagtttttgctattaaaggaaaaatttgaaggtggtagtcaaaatactatatgaaaatttatttgcaggttgcaaatatgtcatacacaagcttaatggaacaaatcatatcatcacagcctacgatttctgatatgcaggtaagaaaaacaatatttgaatattatatataatttagttgtaatatttatgtttttattggaatttacaggaacaaaattcagcacactctatttttgttgcgagtccaagtgcatttcaggtatgaaatattaattatttaattgaatctaataattcaaattcaaaagcaaataagtattgatataaaaattttgttttgcagaattcaatgatattaacaacaaatcgtactgatgctaatattgaagaatggaataatgatgcggcaaatgaggcatgttgtcttggatgtattacttcttgttgtagtattaaaaattatgataattttagtaaattttaactttgtaatgtaattcaaattccaggaagatgagagtaatgaagaggatgcaatggataattggaatcttgatatattcaatttgttagatggtgaaaaggtaatttttgttgtttgtacctttttctctagataacaatgattgatgattgaagtttcatagtctgcaaaaaaaagagtacaaacattaatatttcttaaaaaattaaattgaataattcagattagcaatgaataggctagaaaattaatttcagaaactaatggaactgcttttttttttgcaggaaccaagttcaatggataatcatcgatgtacttcagttcaaggaacaagagatgatgacaataatccaaatgataactctgaaacaaatcaacaagagctgatagaagaagacataaatattttcgtagagaatgaacaggaagaagctacaaagggcaataatgcagcaattgatagcagatatataccaagagttggaacacaatttaagaatattacagaagcacatgaattctttaacttctatgctctgttggctggattttctattgtcagggctcacaactaccacacaacaagcaagaaaaggaatggagaagtgactagagtaacgttcagatgtaatagacaaggcaaaccaacttctcaatccaaatcagtaagcgcagaggaaacagtggtttcggaaagaaatacaaatgaaaatgatgcaacagattgcaagtgtgctctggttatttcagagaggaatgagatttggaatatttcaagggtgcaattagaccacaatcatcaactaagtccaagagatgaagtgagatttctcaaatcacacaaacacatgactacagaagaaaaaatgctcataaggaccttgaaggaatgtaatataccaacaaggcacatgattgtgattttatctgttctaagaggaggattgacttctttgccttatacgaagaaagatataagcaatgtgagaaccacaattaacaaggagacaagcagcaatgatataatgaaaactttagaatttttcagaaggaaaaaagaaaaagatccacatttcttttatgagtttgatttggatgagagcaagaaagtgaaaaatctgttttggacagatgggagatcgagggagtggtatgagaaatatggtgatgttgtgagttttgacacaacatatttcaccaacaaatacaacctcccgtttgctccctttgttggaatttatggacatggaaacacaattgtttttggttgtgcatttttgcatgatgagacttcagaaacatttaaatggctgttcagaacttttttgaaagctatgtcacaaaaagaaccaaaaacaatcattactgatcaggatggagcaatgagatcagcaattgctcaagtatttcaaaatgcaaagcacagaaattgcttctttcatattgtaaagaaagctttcaatctatctggaaatttgctcaaagcaaaagaagggttgtatgatgagtatgaagacattataaataactcagttacagaagaagaatttgagtatttatggcaagaaatgattgacagctttgaagttcagcatatcaattttctaaagcacatgtggtcaattagaaaaagatttattccagtgtatttcaagggtgatttctgtccatttataaaaagcacagctctcagtgaagggactaactcaaggtttaagaataatgttggtccacagtacagcattacaaacttcatgatagagtatgaaagagtaatggatacaattcaaaacttggaacagtttgatgatcacatttcaaggacaaagaaaccaagcaaactttggtcccattactacattgagtaccaagcaatgagaatgtacaatcgcaaaatcttcatcaagtttcaagttgagttgaaaagaacaactagatttcaaataaatgaagtagagaagttcaaaacttatgaagtttttttggcattgaatcaaaatattcaagtaatcagaagaaggaagtaccttgttattgtggacttggaaaaggaggatttcaactgcatttgctcaaagtttgagaaagatggacttctatgctgccatgtattgaaagtaatgctccacctcaatgcaatgaagataccagaaaaatatattattgaaagatggacaaaaaaagagtacaaaggtcttgagggaaaaggcaatggaaatatacctttagcacagagctcaatcctgagattcaacattttgtcaaggaaaagtgcagaaatagcatcaaatggatcgaaaagctatgaaactttccagtttgtagtggaagagatggacaaaattgctaaacaattggaattattgtgttcaaataaagatgctgagcaggagatcaatgattcagatccaaatgcagaagacaatttgaactcacatgaaaaaggcaatcaacaatctgaggaaaatatagatgaaatattgttggatctagatattgcaaaatccaaaggcaggccaactcaaagatacaagacaatcagggaagaaatacagcaaaaagaactatatcattgcagtcattgtcagaggacagatcacacatttccaacgtgccctctgaaacacgttgagtttgacttgccaaggaagaagagaagaaaggttaaaaatacaagagaacaggtaacaaaaattacaaatccatatgaattgaatttttttaaaaaagtaataaagaaagatattatttgttgcaggatggtgtagagcagaaaaagaaagatgtttcaaacaaaagaaaagatttgcaacaagatatatcacaggagaagcataattctggggctgaattagaaggcaaaaagaagagaaattcatcttcatcaaaaaggggtggcacaaaagaatagaaatggaaatgactgaaaatagagagaggtttacttgaatacaatggaaatagacatattccataagtttctgtaatattctagaacatgtactctggtttgtacttaaatgtttgtttcttatatcaactacattttatgaactactttgcattttatctaccacatgagtttatgtacagttgtagccctgcaaaagttgccaactgtcatatttgaacaaacaaaatttattccagaatcaatttccctacaaataaaaagagatataaaaatataaggactaaataaaaaacaaaattgtgaaaaaaataatgattctaaaaaaaatttacctgagcaaagtcaatcactagtttctttgttcctgtaccgagaacagaattgtctggatagaagaaaagacggttgacatattgaatcctaatgttttgaatgtctttttgagagaaatggtttgtcagctgaactcttggaccccatagttccatgtattttagagtaaaaactccgcaatcaaaactaggaaaaagaaaaaggacataagtaaccacagttacttatcataaaaaataaaacaaacaaaaaaaaattaaaaaaagctaatgcagttatggtcatactatttactctgtaaatttactaatgaaatctattgcaattctagtccatgttgtactaagaaacaggctcttatcccatctagtaattctgaatgaaacaattgacaaataggaactaaattttttgaatgataatcataacaaacaaactaaaattgtgcattaacagcaaaacaaacaggttatgcaacaattagaaaaacagaatagtcaagaatttctgaatgaccaacagaacatacaagattcctgtcaacaagagaacaattgggcatctgtacaactctaaccaacaaaaacaaacaaataaaaaatattattggactaaaagttacagtaaagaaaaacaacttacagattattttggcgaggtactggtggatatacaattttgaaagcatcaaaattgatttgatattcttccatgatggaattccaagcaagtgcaaaattggatgtctacaaaacataaaaagaaaactctgtaattataaattccaaatcacaaattgaacagtaatacatatatttaaaaatttgaaaataaactgaccaatctattcttaacttcatcttgatattcagaaccttcttcatgtaatgagtcaagaaagacaaacatttcatctttcagatgaacaatgaaaacaaaccagtggcgcttgtagagaattggaaagaagagctgaaacaattaaataaaacaaattataaatgtaaaaggaaatatgaaattaaatatgacaagtaatttacaaattcacaaaccatttggattttgaggggtgagataaatgaaacaaatatcggcagaacacagagacaacaaaattagaaacttcatgtccaaaattaaatgatcctccaaaagaactgaatttgcagtgaacaccatcaatttcaactgcatgtcgtctacattcagaatacaaataaattcaaattacaaatcatacattgaaaatgaagattattagaaaaaaaagtacaaaatagtacttactcttgatatctgcttgttgatagagtgcagacagcattataaatttgtctttcatattgtgagactgtgaagtttgatctttgaggagtataaggatctgtgcaatactttgcgggattgattacccttctaagatcgtgatgaattggttttgttccagaagtacttggattgaaattcttcatgttgcataacaaaactctttctggactagcaaaggttttgaagttttgtttctgagaatccaacataattctattcattttattgtacatcatgttggttttgtttccaatatcagcacatttcttagagaatttcttttcaccaataaaaacaacatcaggtgaatcctgaaatttaacaaataaattaaatagtacagttagaaacatattaaaaaaagaagatcaaaataactagaaataaaaaataataattattagcttataaccagaacagaaaaatgataaataaaagtaaggtatagggcatggaatatttgaaatatcaatatgaaataacagttaagcaaataaactagtgatgttcaacagcaaacttacaaacttgagattataaattgaataaaaagaaatgaataagcagtgagaagaaaaaccttttggaataaaaaaagaaagaatgtatgttattactagaactgaaatacattgtaacctacaagaattacagcaaaactatggagaacaataatgcaaaaatggaattagaaaaatttttaaacaccatttaatttcaaaaagggaacatcaatgaaaataaactatgagattattcatacctttatgatgtgacaacctttttcattttctttgttttcattgagagaagcattaggagaagttgaattttcaagtgtcaccatgtacatcttatcctaaaattttaaaatttaacaaatgaaagtttagtttgtatatacagaagaaataaagaaagaaattaatgtcagaattaccggactgtctgaacagattattaggctttcaacagcagcagcaaaagtttgagacaactttcttggagtgatctgcaagatttgtataaatcaatataatgttctaaaaaagtattccttatgaaatttgaagttacttcacaagtaccttatttcttaaaacatgatttggggagtatgaatcaggaataacttgatatgaatctgcaagatgagcagttgtaatttcttttttgaaatcatcattttcatgatggaggtcatcatcagaaccccagattttaaaagacggttgatcatgaaaaacttgattgtttcgagctacagcaataacataagaattagaaacaaaaaatatggcaacaaaaagtaagaggaccatagtacagtgcactaaaatcacatgacaaaagaaatgaaatattacaataactcaatttttttgatgctagaacaattaaagatatacaagtaaaaacaaatgagattccattaaaaaaaatttaccagtcaaggcagaatttttctctgtttcatctggtggattaataggaacatgaccttcaatgttaaataggcacaaacatcaataattcatatttaattttttaaaaaacagattaacaaatttagaaaaaaaaataacctgttttgttcaactttgtcattatttcatcaatgttgatatgtttaatctgcacagataaaaaatgacagttaaaaactatcaacaattacagttctatatattcagattataatgattgaaataaaaatgaaagaaaaacctcttctgaagaattcaaaatggtagacttattcacaggattaaattcttcatttggaattggcaacttatcatcatctagtactgttttactgtttccctacaaaaaaaaataaaaggacaaaaaaatgcttaatgattcacatgactattagaataaaaaaaattgaaatgagaacagaaaacaatgtacctttggagatgaggtgaaattgttatttttttgcacagcttgattaacatcatcattattttcttcaactggttcatgatctggttcaattccttaatttaaaatttataaaaaaaatcaagacatatgaatggaaaaaaattaaaaataaaataaacaacaaaattcgtaaattaaaagtaataacctgaattttcatgtgtagtaggttgagtaggataattggaactgcaatcagctaacaacaacagaacatctataagaagtttcttagccttgtcttcaaagatttcatcttcttttccaaaatgattacagagcaaatgacaaattttgtcttgaacatcacttggcaacagatcaccaacagaacttttgagcatatcagcaaatgaagatgagctattattcacctaaaaaattaaaacagaattttcaattccaatctaagaaaatttattagaacttgaaaagataaaaaatttgaaaaaaaaactaaacatttaccatttggtaacaagttgaagcaatatcattgactggtctttttccatacactccttcagatattttatcaaatttggaatagtccttaatcatagatcttttccaaactttaattcttggtgtatcaagtaatactttttgtgaaccaaagttgagaaaatccaggtaattaacctatgaaacattgaatatagaaattaaatgaatagtcatttagtacaaaatataaattagcataaatggagggaaaaaaatttaccgctaaatggaataaacaaccaccaaaagttttcgatttctcaatcttgctaatgtgttccatcaaccagtcaaaacctaacttgcaccagtccaaactttcaattaagtccatgtcttcaaaggcacttaggtattttgtacctggaatcaaagaagagtttggacaaaggaagcaattcaaggaaacaatcataaagcagatgagaatttgatcatcaggaaattcttcatttttaattaacttttctccaatgaacttgacagaaggaatagaagttttcccaaaaatctgaagaatcttttgtttgccagaatcaaattttgaatggattgtactaccaccaacagggaggcctagcacaacatggacagattgcttgttcaatggaataagtttttggcccaaaactatatcagaacagttcacatctacttgttttgcaatccagagagcaaaagaattgggaacaaaacacttgtcaaatagcagcatgctttgaaaacaagaattttcaatgactgttttgtgatgtggacttaaagaatcaagaacttttgagaaatatttgactgagaatctagagaatgcatcagacttcaaatcagtgtcaacatttttgtcctgacaaaaagaaaataaaacaatttaatcaataaataaaaaccaaacatagatataaaagggcattgcaaaaaactaaccttaaaattttgatcacctatgttgtgatgaatattaagcttttttttcaaactgttgataatttgatccctttgtatgatatcacgtagaacctgatttatcattacatcattgtccaattcaatagattcagaccatttcatctaaaaaaaattcaaaattaaaaacaagaatgatggaaaaatataaaatgaaaaataacaaacaaaataattaccttaatgttatcatcttcacttcttttagacttactgagtttccttttcaaagttttcagaagttcatttgtagaaatttcatttacatgtggttgtgaaacatccatatcctaaaaaaacatattaaacaattaaaacattgcaaatgtgctatgaaacatggctacaacagagctacaactgcatactaatgaaaaaaataatgaaagaataatggatactattctgaccttggaacaacatgacaattcaagaacaaataaaacaagaaaatattggtcctactattacattggctaccaagcaatgagaatgtataattgcaaactcttcatgaatttacaaatggaaatgaaaagaacaactatattacaaatcaatgaaattgaaatgtaaaataaacttacatgactggctgagttatcatcagaatcacaattgtaatcatcatctttagcaggcaaagactcagaattaatatcatcagattcacttatgggctggctacaattatccaattttgaacgcttttggtgaaccatctattaaaaatagcaataaaaaatcaataaagtttggcagactataaattataaaataagtgaaggtatgcattaaaaaaaagatatatataattcctcagaaattgaccactttattcaggaaaaaaatgaacattacttaaacatggcaaacgaacaaaattaactcccagtacaatatatacgttggttagtactttcaacttgtaagtcaaatgttatagtatatctccatgtcctcacaaatatatgcaaagaggtccacactatgataaaaagtcaaacaatctcacaaacttaagccctgtacacctgattcacactagggaacatgaccattccacagttggtctatgcagaggcacgcaatccaatgaatccagtctactacaaacattagcagtagaaccgacacaaatggcgtctaaatccctaaaggggaagaaatgttagacctaagtacataaacacgagtccaataacaaaaatggggtttgcactagagtgtaatccagtctactacaaacattatgaacagctacaaaaagacatccaaatcccacaaggctaacaaatttgcatagatcataaagttctcaataaactagcgtaacaaaatcaattaacctgcctgcctgccctaacttaacataaattaaattaaggggctgtctatataggaatcgaatgatctatataagttaaaacctatattgatctacacttcagatcaatatctcaggcttcatatttctagcttacatttgagtacacacaaagaactagaaaacaaaatacaacgtggatatagtacttatgtagcaatagtaatacaacacacaactaaatcacacacatcatcatgatgcaaagtttctgaatctgtacaacagttcttttgatgacccatctaataattaaaacaaagggagagagacaaaaaaaaagcacaaggagttattataaggatgcacatattagaagcaatggaaaaaatgaaatgagaaatagaacattgcatagcacacagggaaaatagaaacataatcaatacataaatcacagcaataattcactatcagatctacagctaacaataattcatcagctagcaagctaaacaaatagttgaagactacaaataaagtacaaatagtcagagatacaaaataatgcaacacaaacttctataaatccaaacatgagcaaacttcttcacaaacatcattcaaaacaaatcacacgcatctactaaaatagcaactcgcagattcaacaaatcacaacctaacatccggagaacaagggagcaactatagaatcaactcaaattcccatgggaaaaactagatctaactttacacatcacagatcacatagcacaattcgtaaatcacatatcacatatcacagatcacacatcacacatcacataaacgaaactttctagaacatcgcatagcacaaatttatgaacaaatatatcacagaaacctaaaaaaaatcacaaaagcaaaatcgaacacgaatcatggggattcaatgaaacaaacaccgaaacaaaaggtgctcagatctacgaaaactagaatgactagtactacagaatcaacgaaacacaacatgtagcatgctaaataggagatggaaatgaacaaaaaagaaaaaaaaaacaaaaaggaaagccactggaataatcttgcgcaatcgacggcgcgacacctccgcaacagcagcagacgccgagtcgactcgccgaagagcagcctcgtcgcctcgctaaatcgccaccgcgtcgccggagacgatgagaacgagacgacgaaatcgtcaacctctccttctataactctctctctctctccatcggcaaaagcacaactagcggagcaaaacaacaacgaatcgagcagcaagctaacaaatgaagctagagaagaatcaaaacatactcaccggagaaaaagaggagaaggagctcgaggacaagatggagaagcccacaccgcaaactccagtggaatcaccgccgcgacgtagcctgcatgaatccacaccgcggcgtagcttacgccgcgtcgtcgcttcccggagtcgccgacgaaatctccgccgaaatcgccggacgagacgacgaggaaaaaggcaaaaagcaaaatgaatctctcactctctctctctagtctgattcagacaatctctctctccggtgcggatttcaaaatttgaatagtgtatgtgggtcccaccattaacactctctcacaaaaaaatctctctctgtcggcaacacaaagtgggtcccacaaaaatgtaaaaaaaaaaagaagcccatttagcccacgtatggaagcccgaacttacaataatcaaaagcccacatacaaaagaaaacaaaagtttagatagcacgaatctcaaacaaaatccaagggaccaaaaaacgaatgatacagcccaacaaaaacatgcgacagccatatagcctttccgtttagtttatatatgggctatttaattgggccaagtaagcctacattgttgaaatgggctacttttacaaggaaattcacattgcagggtcccgccagatcacccatggccaggttggttacaacccgttccttccccggaaaattgccacccctactagctatagctagcgatctgctggctgccgtcactacaacgtttgttccctgtgctctaatatatagctattagttacatttttacggtctcttcgattaatctcttaagaaaatgggtgtgatattatgtctttttttctaagaactttattatgtcccttcaaaccctctctcggagactaatcgaacacggctttaaagagactgtaaagtcactccttaatttaagagaagacagccgtgtttatctagtgaaggagctataaactttgcctttcttaagaaaatgactagtcaagaactctattaattatactacatttcagtggccggtcattctgatccaaatgtgtcgtggtcgttaattaattaccactcaaaatcactgtccatagttcggcaggcgactcctaccagataagaataaatacattaaattgccactgtatacgtagtgctgatctatcagttaggaatatttgtacaatcatataggaagccacatggaactcaagtatgtccagctagccactcttaattaggtggattagtacatatatattagctttcctcctcaaaaataaaatgtggataattgtcagctacaattttccttttcattccactttcggaagttaagggaaagaaactgatagtgaaatattaatatataatatgcttgtaagaatacttgccaattgagattcggaaagtaacttttgcgtgtttttgaaaaggaggacaaagggaaccattttgactcgatggttgcatataaattaacaaccaaaactaacaaacggataataataatccataatcgattcctctttcaaggccatcgtgttcctcttacagttggttacataatccatgctttgcccttgatcatatagttaaattgctccgatcatttaatctatggctgataagcctagcaacaatgaactaagcaagcaaaattaatttttgggtaagacatttaaatatatgttttaaagtactttaaaagtctatactagaaaaaaaaaactactaaaaatcaatattattttacgagaacccctataaattgcaggcgggccataagtgtcctttcatgcaaaaatcacttccacaagaggtgattcaggggtcacatgtgacaatttatttttgcatgcgtccccttaagaggtccacctacgagaataggtgcattatcacaggcggaccttttgaggggccgcatgtgaaaatacatttttgcacgtggccaacgtgtgacccacgcaacccactcctcctttgccttttcctcggtgcgcatacttcctttttatcttctccttctcctcctctccacctcttccctttccatcccatcactcatctcccactccctctccccttctcttctccatcaccggtctcacgagcaggtggcgtggagacggtggccacaggggcgggcgggcgctggcgtgcggatccactgctcccaacctaaggaacagtgacggcaggagcgagcggccacagcgaccggctggtagatccgccgtgcacagatcgaggcgccacccccatcctcgggagcgagcggccacgacagctggcgggcggatccgttgcccttgtccatcggagcaacgccggtgggcggatccgccactcccgccctcaggagctacggtggaagcaaacggtcacggtgaccagcaggagaattcgccgcccccgccatcaggagcgactgcggtgcagggatatgctgcccttgtcctcgggagcagcgggctcaggcagtgggacgggagcaggggcgacgatgatggcagtgatggaggctgcgatgatgacaatgacggtaacagctgcacgatgacgatggcagtgatggctgctccaacaacactggtggtggtggctgctccgacgacgacggcagcagtgactagtgtcgacgggagatacccgtagaccggatatagagggtattggggtacgctggtacgaggatctatgtaatacgacatcaagcaaataaaagacaaggattatactggttcaggccccttgataggtaatagccctaatccagttgatatgggattatatggtggaaaccacaaattacaaaggaaatagcagaactcgatgataccgacgagactgtagtcgagttggttcgactagatcatccggcgacttggctcctgtaggctccgactttgtaggctgtggtggttgtgttggcgatgagattcgatgccttaggtcctcccggggggtcccttttataccgcgggtcagttgatctccaagtagaacttggagatatcagaccccacatgatacagtaaagacccagttcagtccgagtaggactccttccgtccgtggattccgtttttgttacacgatgaatttccttaatgcgtacaggaaacatccgtgtacgcacaggtataccgtatcgatatacaacatacatcgaagggtagagggtataccttatccataaccctgacaactagagtttcggtagaatcggggacgctagggttttaggcgactttgttttttgggattttttttaccgaaactattttcacggacgatcagcataggtgacagtgtacgtcaatccctttttcacatgcggttgcgctacccgcatgaaaaaatgttagatttccgcagatacctggatataggcgagccgcttggtcatatacaaaaatcagttttggccatatggaaaaatgatttttgtacttaaaaaaatctcaaaataaactactttctaaatcaagttttagaatttaaattttggtcacgcgcgcagttgataagacaacaagtatacaatgagacgcttaaactagatatctggcgaagaccgaccgttaaaccaggaaagctagagcaatacatgaagtggtttaatccgagtaaaagaccggagatgcatatatgaacccacaaactcaacgattcaaccatttgtccgagtttaacaactgccgctaatttatatggtccaattacctcaaaacttgatgtaagcaaaagagacctaacaggatatgtacatatgcaaattaggtcaggtttgtttggtttgtgaactgtgccaagtgaaattttggcaacattttgctacacttggcgtttaactgttcgctagaggccaaaagtaggattaagtcgcattagttctccttatctatttataaagtagaatttcaccaaattaattatgctgggagctagaaaacgattttggcacatccatatcttggtaaatccaaaactttggctttggctcacacataggacgtatcctagctcctaacctagtccaatataattaattcacttggcatgcagtttactcaaatctagtaaaaaaaatatagcggccgttacccaatgtttcttctccacaatcatttcctaggggcaattgatcaataaagtaggtgcaagcaatccaagcatgcagccagtggaagttagaatcgatcgacaagagaaaaatcactcagagaaaaggatggttgaattgatcaggatgtatcaggccgcgtgagtgtaatgccaatatggcattgcaatctgtatattatattcatgtttactaataattaatggaaaaattaagtcctctgtgagctagagaattttctttagttttgctaactaataggctaattcatattaaaattaatgagtaaagacggataattcactgaatacaacatcacacaatgtcatgccaagcttgtttgtaccatacaagagccaattgccttattgcgagacgagatttaagagcctattaattaatggtgcattcttttcagcgtatgtttcacctaagctctacaggcgcatgaaaaaaatcattaacacgtaattaattaaatattaagtactataaatctaaaaagtagattttttatcaggaaatgtgctaactgaaaacgaagttgccctttataactcaccctaaatcataacctccttgtctcatatacttcccatgcgtattagatttccaagattctcgagcggtcttcaaaactaataaaattaacggacggcacaaataaaaaaaaaagttaaaatggaaaaatatactaccatgtcttacatgggcatgtaaggttccaaacgtcatcaatcaagtaagtaatgaacacctataaaaaagatatgctcccttcattctaaaatacaatcacttctaacatttagaacttattctacaaaataaacactgttaccactattcaaagtacttacttatctcatcaattatttcttatttaaattttttcctgttttaccctaacccttctcacttctaagcagactcaaccattcaccatttatgaagggacgctaaaaattttctttctcaaccttagttaagcaacctatagttcttacatattgacgtgcaattcttttacgcattcggaaataaaaaagttaagcaacctatagctagctatacttacgttttaaaatggactgtggtatacgtccatatgcatgcattatttcatgcaggttttgcacgtatatgtgcacgtatatctgctccagtcttttgtgcaatatgtgcgctggacaacattatattacaaccgaaattcagtggtcggagacagctttgggatggatgtacttgcgtatgctttccactactcatgcatgtccatctgcaaaagatttgtcggagccagctaagaagaaaatattctcacactgttgccggattgcaattggctagctagctacctatatatccgcatatgcctgcacatggattatattcagctagtttcttgtcgattgagaggtagatgcaaattacaaaatatactattataaactcaccaagcgatcgatatttatacgaggagctttgatgtagtgatgtaattatgtatagctgtaaattttatccaccagcaggattcaatttatgttttttttttaattatatggaagacgcacaggtgtacatatttatacacaagtgaatataccctataagaatatactttcaaagaaacagaagccaatggtaaatctatggccttactaaatttttattgatggcacctgagtgtgcataatgtttgtgggcattagaatttgaaatctacacccatgatgtgcgtgtgcacacatatgttaacattagaaattctgggactcgtatactattttagttgaaatctatgtatatgttaaatatgtgtagaagatatacgtatataggagtaattggtaagataactttttaccgttcctaagtaatacctataggtacaaatatttagtgtaaaatttggtaaattctatgtacctaattaattaggtattccttgtactattttttacctaaaatttagtgctcatgtttatgatataaaaacataattataagtaataaatttaaaatacaaatggaatagtatatttcataaaaaaatcatcataaagtaattggtgttcaaagttttattctaatcaaacaaaatatatcttatttttaattggagtaagtatgtatttatgtgataaaaagcataatcataagtaaactttttttcaatattaattaattataccaatctatctatctattatatactaaaagtccattaaacttcctacaaacgctctcgtactgccacatggtactcctagaaacgctcttaaaccgctatgtggcattctaatggattaagaaaatctagccctcgatttttatttaaattggcaggcccattatttcaaaccattagattggattggattagattgaatttagtgccttcttgtcctctctctctcatgtacgtacgtgtccctccccacacacgtatgtacgtaccgtcgtaccctcaccaatttttctttccgtttaccccctttatttttctcacttgagataccttataatatgtgtatattaccttcattttttatgctgttgatttttgcgtatatatttgattttaaagattaaacaaaaatatgtcattataatttattttattgtgattttacattaatgacttatgttggttatgttttagtgcaaaatacattacaactgatgacgttgacatgaaataaataattccataacaaatttttaaaaatatttcacatcagatttatagtttcaaatattgcttaacaaatataaatcgctaattggaatctacatgcaaattaacaatgtatttagtcgtgtgttttttcaagtatatatggtataaattttaactcgggtgagattaagattcacaaatagttttggaattttcctttcttccttgcactcctaccaacgcttctaggctgccacatgtcctactaataaattagaaaaaaatcatacaaatcttaagaaaaaaggaaatcatatatctatatattttcatttaaatcggtggacccattatttttaaccgttagatcaaacttaaaaaagaaccaatactttccacctccacctccctctctgtacatcacagattggatcaaacaataaaaaaaacatatgtaccatgtctcctcaggtacttatatacgtactctccatccattgcatgcgtacaattatatattctactgccataatttttaagcaatatatccgtttttttaatttattggaactattattaaatttattaatgaaccaagaatatgggatatatattgctcatattatcatatataacatttggacatactacctccgttttttaatatatggcactgttaactttttgataaatgtttgaccattcgtcttattcaaaaaattttataaatatataaaaaaattgaagctattcttaaataaattttgacgataaattaagtcataaaaaataaatgataattacataatatttctaataagataaattatcaaacgtataaaaaaacaacagcatgatatattaaaaaaaggaaggagtagaaccctatgctttgcatgccaactaaatatcaatggaacattgtaagaaattggaaataaatttatcattgtaaacatttacatgtataaattagatagatggtgtggaaggaaataaaaattataaattcaatgacagaaaattattgctacacacacaattcaaataccacaagttggtgaccatctataggactcagccaagcacaacaaaaacttgtagaaatggacgccgcgtgccgccgacttgcccaacagcagcaggtagttgccgaggtgtcataggtttgctaatgaagattgaagataataacatcattgctgtccagggagcattgagatgtaaagctcttggagcatggcttagaatcgtgattatcaaagaaaatcttaaaaattgaactcatttaaaccgattgtcctatactttctactttataaccattagattagattgatctaaacaaataaataggatcataagtgatcaagtccgacctctgctcctcctttacaaaccgactctgaatattgttcgatatggctactagcaaaagggtctattgatgtgctggttggtgggaaatgctaagctggactttggtcccatgagaatagtccagcaatggaaagatgttttttctgtgtatgtgctttgcctaaaaaaatataaatatgctttttgtcgactcgcccggggaaatatagatgactcgccctgggagaacgggagataccatgctggcgcactgtcgtcgccacgaggagaggtgagaccaagctgtggggcacgcgccttgacgtggtctgcctaagggcacacgacaccagcatggtgtcaccgacctgccaagcgtccactcactgtttaacctgtcatatctctctatacacgaataatcgtctcactctaattaaaaataaatagattgctatgtctaatacattagatgaaacacctcaaaatttattactgtcctaaaatacgtaaagacatctacagtatagaagaaaaagttttactaagtttgaaaactaaaaaaagatatactaaatattttttaaaaaataaacacatggtagaaaatagataggaatcaacttctttattgtaatatactacctccgtcccaaaatataacaacttttagctatgaatctggacacacagttgtccagattcataactaaaaatacttgtattttaggatggatggagtaatattttttagtttaaaattttatacgatgtaagggtaattagcataaaatcgtagccaatgcccaaacaaatacatattaaaaaaggaatcaaagaatgtttagaaaaaaaatattacctgcaaataaaccatcgtaataaaaatacaagcaatattaaataaggtgtccgtgtatatgcgcgggctacttttctagttttacataaaaggtgtgttcgatagtgtaggtttggagctagtaagtacttaaaaaacgattttttgtgtttgaggacccatatagattgtagccggaccgtaattaatcgcgtctacaaaaatcgaccttcatttttttatacgggtgtcccaaccgcatagaaaattaggtttcgttcgtatggaaaaatgttattcgtgagtagttggagttaataacgtgcgtcactgtaaatggggtcaatctacgataatatttgtgcgtgcatcttctctatgatcgatgataatctgaaaattgttttgtgcatgtaccgtcatcaccgaagctaatactgtgtgctactaattctcttagcttagctagggatgctgcactatcgtgcatgcaagcacacgtcgtttcatggatgcttgctgcaggcctggattaggagaaacaggatagattagtggtttgattattccgaaagctgtcaatctgcaggtgattgatcgattgaaacacggggcactgctgtctgtatgtaggctatagcttaattaagatcgagtacgtacgtagctcattaactccacgttatttcagcttattcatcataaaaaatatttacaccacatttataaaatatgttcttaaaagctttctttcgattacattactcaaattgattattttatactatttgttatatttattccttaatatatttaatttatcattataaccacgggtagataatccgctcaactatataagcctattgctgctagttattactccctccatcttatcacaaaataaaattacttctttatttactctcttatttcaactacttataacaatctctcatttaatcacaaccattttctatttagttttgaataattttacccatcgggagataccacattttctgatataaaatttgttaactctgagtactagataaattgaggaactaaaatttttatacctctgaatactttttacggatcataaaatttatctttagttttatttctctttaatcttcataaaaattctaatccttacatacattttaagacggaaaaattactactgctaggtagtggaagcctacaagtaggggtgaaaacgatacggaaacggacgaaaaccatctttatcattttcattttcatatcttttttgaatcggaatcggaaacctcggatacgaaaacggaatcgaatattatcgaaaccgaaaatggagcgaaaacgaaccagcgcgaatatagtaacgaaaatttatcggaataaaaaaaagcactcaaactgatatatccaattgaataaattatctatatttaagagagtaatttgttgataaatcccaatgcaggaaaaaaatattcttatgtaattttagatttgcataataaatatttttttaaacaataatagccaaacaccatgatattcactattcagtgcttaaaaaaagaattcagggtatttctatcacaaaatttctggtaattctgagaaaatttccggaaagtttccgaccgattccgagttccgacggaaactacccttatcatttccgattccgtttccgagaaaatatttccgaattcatttccgtttccgaaaaaatccgaaaaaaatccgaccgacagattccattttcgaaaatagatccggaatccggaaagttttcgtaccgttttcaccactacctacaaggcaagggaggagactggtctagcaggttgggcttgagcctagacctacctccaaaatcttgtttaaattgtgttgaattatcacgaaaattttgtaaaaaaaccatcactccattagttaattagccctaccgtagccttattatttaaaaatttctggctcggtcaccgccggaagatgatgcatgcgtaacactgtattagcaatatatgggtggtggggtcaggtgcctcgctatcaatcggtaattcgttatccagtggccgcccactcgtgcactccaaaagcaagctatccggtagcttagcaaaagctatatatatatatatatatatatatatatatatatatatatatatatatatatatatgcgctgcacgagtatgagatcagcctgtccggacaaatgctgaaaagattaaggtactgttcactttgataccatttttaaccttatcaaattttgataaagttatcaaaaaaaaaagtggctatatttagtttgctactaaatttttgtaactatataaaaaatcctgctaaaattttaacaagttaccaaaattttgacaaatttactaaaattttgacaataccaaaatttaataaggttttttttggcatcaaagtgaacatgccttaaaggagcttaggcggagctatagttagcggcgctaacatgtttttttaattatcacatactccgtactcttctcgaagctactaattaggctaaactagcgggaggctggacccaggttttctttctttttttttttgtcccggctgtaaaattggagctttttttttattaaactcaaaacacgacagaaagaaattgtagacggcagaaaaaaatgagtacaaatcgttcatctcggatacaacactactacatggaacgctactacaaaacagcacgtaaaaactggtcttatagatgttggtttgtttgaaacgcacctataaagttttttttccaattttttcaatgtaaaattaagagtcggtatctataaccactcattgataccagtttataacaaaaatcgataccaatagtccattaatgtcatatgtcgtcgtttgatgtcacgattaaggtatttggatagtatggggatcgttggtactatgatatatgcaagtttgaggtaaaagagaagagaacggggatttttatataggttcgggccctgaattgtcaggtaataatcatactcctgttagccgaagccggtcattgctcttattcaccataatcacaccaatacaatatttggggtagcctatctaactattgtcgacttagcggactgaagtatcatcacgtagtcaacaacagggtagtcttcctcctcgaatttgtgcccggcgagatcagagacagcgctagatccctacagccggcctctataggtaccggatagggccagtccaggcatatctctgatgtcgatatccggcggcgtgtcttggcgtatattggcttgtatgttgatcttgtatcttgatctattgttccgtgccccctctcctcctagggggccttgtattctaattgtaaaccggcacatatgagctcataattgttttacagttaagaatagtcacatatgtaatgcccatatgtgctggctcatgataaaaaatggtacatatgatattatccttatgggtaccgatttattaacaactggcacttgtgatgttcatatataggtaccgatttattataagaatcaacatatatgatgtcaggttatggataccccatacctaatagaagttgactaaatctcagtaggacccaccacataccatgtcttatacggaaacaaccttcggatataggagaagttccgcataaggaaggatgaatagagttctacatggaaacgacaaagactattcggattgtatccatattgatttccctagttctatttggacaaggggacactgatgacataactcatatatgtgtgtgtgtttttatctaacttatttatataaagtcgaatgaagatacaatttatataaaatttttagagctcgacgagatcaacaaactttgtagttgatgacttttcgatttaaggctgtttggatgtccgaaaatgtgttacaagctctcatatatatttgcataagtgaatatttaaaatttaatgatatcggatggaaacaaaacctatatgaaagttgtagatctagatgtgatctacatttctgtagttgataaacttttcatttgagctcatcaatagtattaaatatggattataagtttggatgacattagtctcaaaagaatagcatttgttttcaagataactgtagttgtaggtaagatggtaaggagactttgtgtaaagagagaggttttgagttcgaatcttgcttgacctatgtcaatcaatatgggtctaaaaaatcatgttccttgtcaaaagggaagtgtgggtataggtgcttaataaaaaataccaaatattttttcggttttttcagcacctgcaaaaaaaaaagtgtgctggttctaaattagaacaaaacctatagtaccacataggtgtcggttcttgaaccgacaccaatgacttgtgttatgggtatcaataataggtgcgggtacctataagttcttaagaaccggcacctataactttttttatagtgaaaattaggagatactaagaaaaatataattgaagtatgaatgtatcgattatctttgaaaaggttggagccataccattatcaaacttgcagcgcaatctatgtactatttttttcgattacatgaaagattcacgtacatactatctatcacacacacattcgtaagtgtgcccccataacacaagctcaaaaagacggggattatagttacatccttggttttactaaattcctattgaaaacacactcacgcatgtgtagtatttgtagtcaccaaaattttaatcctaataagtagattcatacacccatgactttaccccacacaactaatactatcgcaaaaaggcaactattcaccatgtgcgtgtgtgtatatgcgcgcgcgcgcgcgcacacacacacacacacacacatatatatatatatatatatatatatatatatatatatatatatatatatatatatatatatattctcccaaaacaatagaacgaattataataaatatttcgctaaacatatcggtcctttatgtcgatattaaaagtcattctattgtaataatttgatagtcccatgttacatttgtccaagactatcatatcagtcttgggcagaatggagacaacttagttttgttattaaattttataacatgactatgtaactttagaatttcatattttgcatgattgcaaacataagaatcctagcatgcaatctgattaattatagcctagaagtctagaaaaaagttgctagattacctattcttgaaccacttgtcatttctatatccttccaggcaaaagaactttttcctttgctagtatcatgcctccttctttacatttgtgcctctattttttctgcacctttttgctaactaccttttggaattcgaagtacatgatgcaatattttcatgagacaaaagacgacaagataaccagcttagctagctatctatctctcaatctaaacaaagattcactttaatctttgcaacgcagaacacgccttatttccccccccccccccccacatccaaattaatgattgcaattgaagatccatgcgacttaatctaagagaaaaacagaaattaaggtatactcaattgtaaactgattcaaaggaaattcccaaaaattatattgcctagtacgcattatcatggaaagcatatatatgaatgttaggtactaactagaattgcagagaaacgaaaatgaacttccaggcttaattaagtgatcaacttaggctccatttggcacttagcggattgcgaagttgctatgatcttggtacaattagacattgtattgtttaggtatcaatttctctttaatttaaattacaaacaacactattatggcattcgaaaaatatgaaaaaattatgatgtacacaaacactgttggataaattatttcatctaaagataatttgattcatacggtagactaataagggtgtgttcgctattttcagttcccaactagaatagtaaacacggaaaacggagcggtccattagcgcgtgattaattaagtattagctatttttttaaaaaaaggattaatttgatttttttaaaagcaactttcatatataaactttttgcaaaaaacgcaccgtttagcagtttgaaaagcgtgcgcacgaaaaacgagggagaggggttaggaaagagggtgccaaacacaccctaatgatgtatatttgcatatgcttttagagtattgtattttaaaaataagtatagcacaaagcaacacagcaacaacaaattaagcattatatgaacccacccagtgaatcttctaatagtgaatggcagtgctctcgtttcttcccttagaaaaaaaacccaccaaaataaatatttacgcttataactcatgtgctcccttcgtaaaaaaaaatcaaattctaactatatactctttatgtactcgtaaagaaaatcgtttagtaaaatgtttaagtcaaatcttgaaaatataaattataaataattctgtttaaaaatgtaaaaattatatgaataaatttgccttagaaaaatactttcataaaagtatacatatcacttttcaataaatatttttatagaaacaagtcaaagttatattttagagactgtatcgctatctaaaacgactttctttacgagtacggataaagcatttggaaacatactgtgtacaaatatatagctataagtttttttttcggacaaaaggtgtagaagagtcctcgcttgcctgtcgaaaaccgtggtcgagacatgccctattgccgaatccgttgatggattgaacatgccacaccctcataggcacatgacaaacagtgggcttctttctttcttctcaccaaaaacagaggcttcattccgatcgatcgccaggccaaaaggtgtggtcacaacatgagtcagtaccaagtgacaaattgcaacgacctatcctaacaccctatttagatggcactaaaacttttaagtccatgtcacatcgaatgtttgaacactaattataaatattaaacgtagactattaataaaactcatccataatcttggactaattcgcgagacgaatctattgagcctaattaatctatgattagcctatgttatgctacagtaaatattctctaattatagattaattaggcttaaaaattttgtctcgcaaattagctttcatttatgtaattagttttgtaagtagtctatatttaaaattagtgtctaaatatagaaactaaagttaagtctctggatccaaataccacctaagctttaatttgttctactactaatattctactagtgcccatcactcagtcccctctgccatagctagctttatgatgcatatgcacactcgattattttaacaagaagaaacaaagctttggtcgttgatgtaaaaataaaaaaagaagtgcattattttatcacatagagattatgatattctataggttaatcatgaaaatactaaacaatttagtgtgttcatagctttaagagaccattggcatatagttggaaatagtactatggcatatagttggaaatagtactaattaaaaggagcacatagaagggtgaatcagatcaaagttgtaacaaaaccgcggctgcatcaggcaacgatcaaaaacacctacctggaggccttgggagcacatagaaattaatggttggttttgcccaaaaacaaggcacaccgttatgctgattaattatgcccactattaattaggcactaactgagagcaatgctcgttcgctatcagaccataggaatggaaattatgtttgttatttagcgttctgatgattatgtgctgtgagctcatagataagagtaaataatgtaaatcaaatatatggctatgtcatgcaatattggatttcttgcaaaatgttttcaaattttctggtatgttcctacatggtttaaattcaatgtcttgcattagaggctatgtataaaaaatatggttcatacatggttatccatggagctaaatgatctctaaacttctgcatatccctgtaaaacacaaatatacaatattccgtttatattcgtataataaccaattggaccaccctggttccgttgttttcattgataaacaataaggtaatatggtcatctgtacttgatatgatttttttagtgagctaagatcagatcccagcaggtgcatggcagcaaacagacaaagagcactagagggctttttaaaacaatgagttaggtttcgggtgcggtttttcttttatagtgattgctagtagtacttatatttgtaggtcatatagggttttaagccgctaataacggtgttggatgtagaggtaaaatgccatattggaagaaaagaagcagccatagaggtctatactaaatatgctattatgtgcggcattatcggactgctagtatagtatatcacaccagaagaattaaaatatgtgcaagatgggagtcgtgtatgatttcaagccactaacaatggtgttatctatgacagcaacaatcaagtgccatattggaagtaaagaaagagccacaaaggtctaaaatatatatatttattgtgggaaaagtctatacgtactaactttttcttactaaatttttactaacactgacatgtcatgctatgagtctatctagattttttataactttcatctgcttaaattaaacggttgagatgattgttagtacaaatttagtaagaaaaaattagtacgtgtagcagtgctctttattgtgcgtgttactattagtcagttgtatcttggttgactatgggtcctttatcttaatcctagatagttaaatccgcttttattcaatagaaataacaggagaaacaatcaagatcatgaaccatctactcgtaaaaaggaactcattgagatggttacatgcatactccctcaacttctttttaaaagtgtcaaaggggttcaaagaatcggtggtaaccggttagtgagtttgtatcaggattaaaatttatgtttttgcatgtatttgttattatagcctcatttattgttgataccaataattttaattagattattattttcaaaaaactttatctagtaaattccgataatcattttgacccaaaagacatatttttatggatactaatttgaaaccttggtttcccaaaagactttaacctaagaatgaaagagtgaaaacatatagtttcctatatagcattcggggatagttctgttcacccatttcggaaggaggccggaattttattttattccattttctaaaatataaataggactcgagccaagtggttggatacatctcgaataaatttcattatcgaaaaaacaaatactccaatatcctccgtttccatgctcaacattttacatatatgtccatttgaggacactaagattatttactcgttacaaaaacattaattgccgataaaatttacgtactcttccaaagcattgggtaacccgaattaatagaactacaaaattttctctcaactcaaaaaaatgaaaaaaaaagtttccaaaattgtagtccaagaagaacacgccatgcccgcctatgggcgcggcggcggcagcggcaggaggcggacgggcacgccgtggcgtggccggagcgtgagcacgttcaccggcgcgtgccggtactcgtcggagatggcgaagcggaagctggagaggagcatggcgagcgcgaccttggcctccaccatggcgtacgcctgcccgacgcagttgcgcggcccggcggcgaacggcaggaacgcccccgccggcggccgcggccgtcccggcgcgaacctgtccggcctgaactcgtgcgcgtcgcggccccacgcgccctcgtcgtggtggatggcgagcaccgggatccacaccgacgcgccactcggcacccggagcgcgcccccgccgagctcgatgtcctcgaacgccatccgcggcagcagcgtcgccggcgggtacagccgcagcgtctcgttgatcaccatctggagcacggcgagcttcgggaggctgtccggcgacggcgcgccgccgccgcagacggcggcgacctcggcgcgcgccttgtcctgccacgccgggtgcgtggcgagcagcatgatggcccaggtgaggagcagcgccgacgtctcgtggccggcgaagaagaaggtcttgcactcgtcgatcatcatctgggcgtcgtacccgacctcgccgccgccattgccgccggcctccttcttctccatctcggccagcagcatgccgaggaggccacggccgcacggcgacgccgacggcgtccggccctcgtcggcgatctcccggctccggtcgatggactccttgagcagccgctccagctcgccgttcagccgctttatctctctcctgtacttgctcggaaaatacctggagaaaaaaaaaaccatggtattagaactattaaccacgtaaataaaataaaaatgtataccgtagtaaattatttttcacatttctctcgtgaaatacgtcgtcgatcgttgtgcaaaagtttactcctatatatacggacattcaattaaaaaatatatatgtatatgtgcaaagcgtccgcttttaaatagagctggtgacaaaaaagtgtaaccgtcagctctgcttaacgacgaacattctaagaattaaaaaaatattgggttgctactgctccggttttttttttttacttgttggtaaggatatgggttcagtctttttatcattattttataaaattattaaatatatttaatatgaaagttttttatatcaaatttcactgtttttccatgtactcgtgtttttaagatgctgaggctttttgtccagtgcctcctagcttttgctcgtgaatgggaggagcatttcgtcgaatggttgcggtgcagcctccactccaaggaggagcagaggagagcatcaatggcggtgactcactggctgccggggacccagaggtagcggctggagcgggcggtgaggcgctggagctcctcgatgaggaggaagatcctcttgccggtctcgtagctcgtgtcgaactcggtgcgcgcgatcacgtcgccggcgagcctcgccatgtgcgcgccgatctccacctcgttcccggacctcgccaccgcatccctcagcgcccgcaccgtctgcctcgtgcactccaccatgtgccccaccctcccctgtgccaagaaacggcggtggggttagctctgctctgccgccgccgccggcaatggcaccgccgtggcgagacggtgcgttaccttgagccggtcggccatgaacgccggcgcgacgacgtggcgctggtgcgaccaggtggcgccgttggccatgaggaggccacggccgatgaagtgcttggcgccctgccgctgcagccacgacttgccggtgacgtgcgcgtgccgcgacgacaggagctcccgcaccatgccggcctccgtcacgcacacccgcggctcgctcccgtaccagtacacgaaccgcctccctgcaagcgcgcacccatgtcgccggtgtcagtgtcgatccgatcgtcgatcgccggcggcgaaccgcggacgaacactcaccgtacgtgttggaccagaggacgtagtgggggaggaggcgggcgacgatgtcgtggctgagggaggccatgtcggcggcggtggactcggcgacgagcgccgacacgtcgcggaggttgccgacgagcggccgcggcggcgggccgcgcacgccctggctcgccaggacccgccggatcctcgccggcgtgaggtagtagcatgagacggtgacccagacggccttggccaccagcagcagcgccagcgagaccggcaatgcgatggcgacgaggacggcggcggccattgccatcgacctcggacgaacaggaggaggacagagtagaggagaggtgttcttggccttgttccttgcttgcagctgcaatggcggcttgtgtgcactaggcactgccatacatgtgtgtatatatatagggcttgggagtctttgacattgcccagtgaccatgcaactaacacaatggcgcctaccttgttcagccttttcttatttagctttttcttccttcccctggcataagccggtctggctaattgcgtcgtatcactataactcttttcttttaatatattgacgtgcaattcttttgcgtgttcggaaaaaaccttatccagacttttttttaaaaaaaatttctagtattatttttttactttgattggttgtttggttgtgttggcggcaatgccagagccaaaaaaaaaagtttagaggctagctaaatcaaactacgtttgtacttcctccattcagtaataaattcatttttagctcatcctatttacccaaaataagttcacttttagaataatcgtcacatcggagtttgtaaaagcaagaataattatatttaaagtagataaagtgagaaataattgtattgcgatgtgataaagcagagatattctaatctttttttgtttttatatatcagtatgagatggatgaaaaataaacttattttgagacaaatatagtatttgctaaagaaatatatttttaatccttgcaaaagtattaagattctattgagtgatcgatgacgagcctgggcagctgcctagggtcgccgggcaatgactccgccactagttggcgggctagatagtattgaaacttgtctctattgtctattggcaatactgttatcaaacgtaattgaggagcaagaaattaaactcaaaacctatttctgtatcagcgtacatgctctaattaacaattttcggagtatatgccagtgctctctctctctctctctctctctctaccctcgttgtggttatctctacaaaatgtgaggataaacaaggctggagaaaggtgtttgacttgattttgacctaaaggtgaggccatgttggtgaaaacaagattagtttttggggtgttagtgggggagagagagtgaatgatgtggctttggcataaagttgcaaaaccggtacggttgagaattgagataattaactgcaatagttaagtacaattgtgtggcaatcagtatttccactaagtgaaaaggaggtagcatatcttcatacctgacgagattgtttaaggcaaaggtattttagttgggcttatggtttcattgcatttgcaaagtaaggataggcagagagtaagtggagatcatagctcttggatgcaagagaaggtcagaaatattgccatgaagtagcagcggagccagctcccaggcttgtcgggcaatcttctaggcttcgccgttgatatctccactgctaaatgtcattgacgtccttaaaagatggtaagatggttgatcgtcataaaacactattagttggcttggtactatatacccaaccggaccactttgatctagttgtttttctaaaaaaaaaaagaaaaagggaagtattgtgcaaaaatatgatatacgaattctgtgcctggccctactttcgattggaactgtaagctattttgaattttagtgtttaggctttaagaataatattaggtagattttgtaattgccttcttagaaatcataaaagaatatattcgtgcaacggcaatgatgaagagaatcctaaaattaaattcaaaaaattaaaatcagcttcgaattaaatccgaaactcacccaagcatggtctaaatcttaaggtctttttaagggaatagtgggaccaagatggtccaactatttattacattacattatacataaaaatgaattgtgaggttatatgttcaatcctggaaacatgtaaagattattctcagtgtatgtgctagtcaatcccataaagaaaaccttctttctaagtgtctttattctattctcttcactttcagtctttcacaactgatggttaccagaaccagagcctctgctgaggaacattactgcaaggagcatgttatttcacaaggtacttgtctccacttactgcaacttgcagaaaagatgtattggctcattccttcagaagatagatagtctgaatagcatgcatcacagtgctccatataggtcaaaggctaaaagtgtttgtttagtttgctgaatggcatgttgcaaacttgcaatgcacctgaaactaactgtatatggttcggatttcaaggtccattggaccatgaacacatctttggtttcagctggacttaaatcttaagctaaacagatgaatttgcatcctcatttagtcatcattctcatttctgtggaatgttcagtgaaccttgtcacctcccattggcattcagtgcctcgttttgcaggcttactaatttcttgtggtttcttgagtttgttcgtctcgtagacaggaaattcaggataccatagtttatacttccatgatgagaacatttataacatgtcaggcgtctcagggctcctttcgaaccaaaaaaaatatgggttaattagattaggtccagttggtgatgacgatgacatcgttgggaggctatggcgaagatattggatggtatgtgtgttgagagtttgtgtaacatcctgaaaattcaagacaaaaatcacaaaaatttcgaactttttaaaacttttgcatcatgctggttgttatgattgctattgcttgccaaaccgtaaatgatcaccaagaaagtaaagaaaagaactacatttaagcaatagatatgatttacgggaatatatttaatcctacaaataattatgcacaagatattaaaatcaaataaaagaaaagttattattaacctattttatcaaatattaaaatatttgaataatgtaggtgggtgccataatatgtgtacacatgaaatgatgatcattcaaataaactgagctctctatatatataatagaattatgggagtatttaattcgatatgtagatcgattttgcaccaagttcctaattgcattcagggattgaaatttgatatattaaacccctccatataaaataaactaacatatagataaattgagctaatgtgctattgtgttaataacggtctcattagaaaattatagaatctttaataaaccttaaatattggacaatattaaattttgggcaaattcacatttgaacacttaatacggtcacctaaatgcttgggagtaaatacaaatttaatttgcaacttttctcaatttataaatctaccaaaaccctaaaagaagaaaaataggaaaactttgaaaaatatataataataataagaattaaccctgattaaaaattcaaataaattatataaataaaatatgagtaatattaatctagaataaatccattggttggaatgacacaaatattgggtaacttcatttatacaaaatctaggatttatagaatcaaatttacacaaaaaataggctaaaatagggattaaataggaaaagacactattcatcggccaccaggtgttcgacgtggtcccctaacccagcccctcctctttccccctctctctgtcgcctgccaccgcgccgacgtcgccatcgccgtccctgccccgcgctgccgtcgacgtcactgcctcgcgccgcgcgccgccgctgccacgccgccccgcgcccgcgccccacgccgcgccgcctgcccgtcgcgtcgccgctgccgcgccgcgcgccatcgccgtcactgcctcgcgccgcgcgccaccgctgtcacgctgtcctgcgcccgcgcgtcgcgtccgtcgtgtcgccgtcgtcttgagccccgcgccgccttgtcaccatcgccgcgcgccgagccccgtgccgcgccgcgccgtcccgtcgacactccgccgtcgtcgtcgcgtcgcccgtcgccctcaccgcgcgccgagccccgcgccgccccgagccccgcgccgccgtcgcgtcaccccctcccttctcttccctcttccccttattccctctctcccctataagagccaccgttctcccctctcctcactccatcttcctcctcctctccctcttccccctctccacgcgccgccgcgtcgccgccttcgagccgccgcgccgccgccctcgttctatcgtgccgccgcattcgtgaccgccgcgccgccgcctcagtgtgccgcgccgtgcgccgtcgtcgccgccgccgtcgtcgccaccgccgccgtcggtgagccgctgccccccccccccccttgtttgtcgccgtgccgccgggtagagagggagccaagaaagagagaggaagggagaagccgagggagagaaagaagagggaaggaggagagaaaccggaaagaagagagagagaaaggaaaagaaaagagagagggagaaaggagaagaaaagaaaagagagagaaaggaaaagaaaagaaaagagagagagagaaaggagaggagagattagagtgggccccacgtgtttagtgaatagtaatccccttcttaatctttattagttgagtctattacatgtgggtccgggtggttaaaaatctaattatagaagttttatggtctcgagtttatgacatgtgggccccacttgtcattagctcttcctatttccctttagaaaataattcggtaggaaaaaggaataaacccggggtcctacttgtcaatggatatgtcttggattaaaaataaatcgtttatgaacagtagcttttcgcaatttctcggattaattcaaatttgaatctttacactagcataacttattcattttaactcggatttgagtgaaacttgaacctaaattcatctaaattcataagctttccaatgatatataattcactattcaataaaatatatttataattataaattaattaatatcaaatgattagataatagttaacctaaatagtgtgccaataaataaaaaaatggatattgtatagtagcataattatctttaatatgtcttgtcactgtagcaaccaaataaattagttataatcaatccttcaaattaatgggtgtaaaggaaaatattagtgccatttactagcctatgtccaaatataactaattccatgacttataaattatttacataaagtttagcctcatattttgtaactaaaatataaacacacatagatgagtctttaacttgtttaggagagtaatcacagagctagttgtatttggaccacttaaaaaaattagttgatacaatgtcatgtgaagtagaatatatatatatatatatatatatatatatatatatatatatatatatatagtcggttgatatccattagttaaccaaatagagccatcttaaaatcaacatgtattgtatagcttacagtaaaaagaaactactcaaatatatgatccaataataagatattgttgcttacacatacactatacatcccattatagttgcatatatgaaattaagagggagtgtatgacaaacatgtatattagataaatactagttataaatcttgacctcatataattataattatagttcaactgtaaattaggattattcattataaaattatgtgatgggataatctgtaaccataatatgattaacctaaacaattctaacatacaaagcaagggtaattgttaacctttataatttattttgacaagtaaaatatgtacataattaaaataaagcctccatcaataaaataataatacaaatgattcacagtaattatttgaccgatccaaatccatctggcaacaaaatctctagtgtataaccgttctatttagatagatgcatgaatagccatttgctagactaaaccacatagtagccagatacgtatctcattcatactacattggctagctcctaaatagaccaccatgataacagaaagattaagaaactttagcccttagcatgttggaacccattagcaagcgcgaataatatgagcaaccttaggttcaacctcaacaaatatattttgtttgtgtatatttgattgttgcttgaatattggtttttctcgcgtattatagactttgtgtattggttagtcgtgaggcaatatcagcaacttccaggaggtgaaggttgatcaagaattatatcaagaataaggactatcctgagcaaggcaagtcatcactattccttgaacatgttgatcccaattgcgaaattgttttgtttacaaataaaattgcatgcaatgatgaacatcccacttgtgattatgccatgccttgattattgtttacccttaaatctttgtaaccatgtttacgtatgagtccctagtcaactatgacaattgcttagaaatgctattctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaacaactgttttcgactggggcggacggaggatttgggtggtatctggaaaaggctagtaccgtccccggtcaattaaggaccgagccatgaagttaagcatgaaacgacccccgtacaaccgcacttctcgtatgggtatagacctagcggattagatagccgagcggaggcagtatccctgcatagatggttcacccctgagtgaggcaggtgcgctacggtgggacagccgttgaggtagggccgagaggcgtgccctacatcggtgtcgccattggtaggactgccatgagtgtgtgagagagagaacttaacttgaaccataatttaatatgtgtgtgagacttctctttcccgggagcgccaaaactcctctcactgctagaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattcttaacttgtgggggatgggatattgcatgatgaattttatgctgatggagccacttcccgagaggagggaaggtggacatcctcagaaaaccatgacgattcaatggcgggaagctatccttggaatcacaatggatggtagacagaaccgtcgttgtttaaagtgaacactggtactaaaatttgattagtctatgctaggttttaggcttgtgaaaagaattgtaaaattagctttatgcaaaagaatctgaagccattccttgaaataccctctatcatacgcattgttgttgtggtggcttgctgagtacggttggtactcacccttgctattcatatatcttttaggagagtgttgaagagaagcccttgtcggtacgcttgcgtatccaacaagatgatcggagtgcggtcttgttctaggtctcgttccccggtcgactgcctgtggcatgttaaccgggcccttatattattttgtcttccgctgttgttctctgatagttgttggcctacctggccctaatgtaagtatttaacttttttagcctgaattcattcgtgatatgttgtgattcaactatgtatgtgtgtaccaactactgatctagagattggtacggataaacacagatgatttccgatttccaaaatcgggggtccacagtttgttagccttgcaaggaaacgaaacaaaggtagtcccaagttttggagccacactgttttctgtttggaagatcgtttgtatcatgcgcttcgtgctcttcgtttcctttgcattcatccggtgctcccatcatgctatgagattctcagaaaggttttgaacagatgagaatttacgcgtttgtgaactcgccccgttccttcacactccctccgtcctgaaatataaaagattttggttagataggatatatctcattcaatcagaatcccttatattttggaggagaaattgacaccattagccacaaaactattgcaactttgataaccaataatttttaatgattagattatagtaaataaatgtttagtgcttatgtatagtatgtatacacagataatatgacacttatttttaagtatttagatttttttaaaaaaaatacaatggttaagagtttaaatataaataatgcttggtgacaaattataaagaaacggagggagtaattagcaatctttactgttcttgatatattcaattgagatgccaaggaaaattgttgttatactatcttaatatattctacccctgttcgggaaaaatggtggcaatacaaattcaattgagcacacatcgcgtgacctcaaataaaaccttcaattgagcgcacacgtggactccgagtagcgtttgcaagttgggagaagaaactataatgttcatcaacatttatatgcgttttcatcagcgagaaattttgactgaactttttaaaaaacaaaataagcaagggcactagtttcacggaaacaagtatttgccagccagctgccagcttgagaaggtaaacaaacagagctggctctcatatattccagagacatggatgatcatatgcaatctaactggtacaccaaatggatttgagaatctcttatctgggcacagatagatctgattcgtgcaatccatttagacctcactgacatcttttcaatgacaactagctaatgcaataatgacagtttagacggcccatgagaggaggggcttaacgtctccagcaattttttcatggacatgcttgccgtgccaaaaagcaatacacagatttgcgacaaagttcaggagattctcaccttggtctgcttcaacaaccaacatggcatgtcgatgcgtttcggaaaagctttgtctgaggttttctgaaacagaaaaaggggaattgcaaggcatgtcccacaaatttttgaggcgcaagtcactttattcccatcactagagatttgacagcccaatgttaagactactattacactagaaaaaatatatacgcatacacagaaacctgatagtctataatgctatctcagtgagttcttatatggtatccacggtgcaatctatcttcttttgctaaagttttatatgacaaaagtaacgaaattcaatgtgaaaataaacaggctaaaattcaaggtgaaaacagaagacatagagggtgcgcgtactaccttgatcgccagtcgccagctctctggctcattcaggacagcagcttggagcatctcctcatttgctctttacaggcttactctggttcaactttatccctgcactccaggtaacggctgcaagaatccttgcagggcacaatgagctccgctatctgtttccgcaaacccaaagagaatgcaagaattcattttcagcttgctgtaattcaagttcacgagtttgccatcatggagtactcagatactgatcaggtctagcaatgcaattcctgttgtgttttgcttcagttcaagtgaaaccttcgtctgaggctctgagcacacctgcaatatgaatgaacttagacttgagacaaataatggcaattggcaaaagcaaacaaagtaatttcctgttcagttgtctaagatctgacagttattcttttttatttcaagtctattctgtactaccacctaaaactgtgaattgaaatatatttatggtacattccttgtaagccactagaattttgctcaatgccttatttgccaatttagctcaggtcatatcagtggcaaataagatggtagcgtgaaagcaactctactaaacaagaattggtccacatatattctatgctgttgaaagcataaccctctcagtctcaggtgaaacctccatctgagaaggcctgcaatatgaatgaaattagacttgtgacaaataatgctaattggcaaaaaaaaaaagcaaccaaagtaatttcctgtcaggtgctcgggttgtctaagatctgacaagctcttcttttatgacagactatatagcacatctgaaattgtggaaatatattcacgataaattcctcgtgagccacaaaaattttgctcaatgccttctttgccaatctattctcaggttataatggttatcatgcatgtcttgcccacaataattgctacttctcaaaatgttttttcttaatgtaacaattagtccacagagaatgcaactgcatcctagagataaaagatcttatttgaggacactacagttgtatgaattgtgatgaagataattttgtaggatcaaagtaaatttccaggcttccaaccaaagaaaaagagtgcgttttgaatagtgagcaataaaagcttttccagtttctctatgctccaatatactccatgacaacactagatcaacaggagaaacccaggaaataacagtcaaactcaacatgttctatttcagcctttgttttttacaggaaagggggaattctaatgcataaagtggaaactaacatatcagcttagcatctagggaggcactcgagaattaagacatcctacattgacttctcttctaagtctcaacatatatatgaaaaaattgtgctccctgtattacattgtatcccttatctattacgggctttatggtaacaaccaaaacacatgtccaacagaatatctcgctaacagtctgaaacttgacacccccaaaatgattcaaccatgacaataaagcaatggtaataaaatttataggtggtactgaagtaacatagaatcccttttgcaagaatcagtttatcctgcacgtaacaaataaagatcaccatctagcaacaaggcaaaaagaaaaggcacgatttccaagggaggttaccattctgaagtcggaaacacaagagaaaaaaacaactgtgtcatgtaatttattgaggagtgctgcagcaaatagtgtgtacatcagctgtaaggtgaaacaggctagtgctaaatgtctgagtcagcaatgcactcatcttcacacaagtatctgaaacatcatttgatgtcataaaactaagagaacatgcagttaatgacacctgataagcgatactgcatatggttgcagaaaaaaatgcacatatatacttctgctttaaatactgagttctgacacagtctgagttactacggcaggggtcaactgtttattggactaatggcttcgataaagagatgtcaaaactaaagatgacagtataagaggacagatatagcacagtttttaaatatctttgatccacataacatgatactccaatatattctgtattttctttaaaatcgctcactgaaaatagtggcagtcataccagtagtgtcaagtaatgtgaatccaattaagaggtattccaccacattcatgtcaacatttcttgatgtggtcaacaaccattctgtgctttcatgtttgtttaaatgggaataaaagagcatgggacctgacaccacacaaattgaagctccacacacataactttctgatcacggaaagtgcagtaatacaaacacaaaacgtagttctaattcaaagtttctcttatatctattgaagaggggttatgtccctttaggtatgtcaaagagacatgtccagtggaaagttgacagtaataccaataagcagcaactaccaaatataattgctagaagtaaacccaggagcacaatacctggtacaactaacatgtgcaagggcgctgttccaaactttgtcctgaaaaaaaaatgtgaaagtaaaggttgtgaagaaaggaaaatattaagtagagcgaagaggaaatttcaccgaaaggatgtcatccactgaagtccagagaggttcaaacggccaatccgatacactccactgaactgtgtactgagagtcacgcatttttgtctccaggatgcacaaaccagttaaccacttcgacagaaggcacttggatggtacaaaaatgccaatgaaaggcagaaacataaatagatatccacaagcttcagttcaaaattaattgattgatcatgtttaaatggacctcatacaggcataatgtccattgaaaaaagagtgcaacgaggggggaagtaaatataataaataaaaaaagaacagccataaagctgtaaaacagtgattgtgatctactaccgatataaatatttacaaacgaaaagaagaaaattgtaaagttaatctgcaaatccctcccaagtgcacgatttcagcttttctgtggcttgagcacagatgcagaagcagaacaacaagcaatgctgtcaaggtaatcctgtgtcaaatagcagtgagccttatgattcaattccaggcttccagcatgggtttgctttcccattcaatcatatctgaaaggatttttattatcttctttagttccacgaggcaaatccacacccagctgcctcccgaagcccctgtcaaatctccgagggcttccccttctttggggttctggggatctgggagccgaaatacatggacgaagtttatctcctgtatgatttctgaactgctttgtggcaccattcctgtcatatggcttggcagaatgagtttcatatctatcagcatactccctttgatcatcaccattcccatcatgcctatttcccctccccctttcgaagccataaggaagtcttccctgtgttgggcgatacaactctccagaccttggccgtccatgggagtccacatcaaacctgtcatttcttgaggtaactctcaggggtgggctcctccttgaatatcgctttttatgatcaggaagatcaacagttgagcagttcctcccatcagcccatgtagaagcatgttgagagtaagcacgatctcttgatgaagggctataacgcataactcgatcaccaaatccaggttgtctagaaggcgaagtcattcttcccattctaacttcagtcatgtaattaggcggagatctacttctactatgcctccataaacttgaactaccattcaccataacttcccttctgttcctaggtgatgtccaagcatgcggagatcgagaccttgaaccagaaggggatcggctgtgagcacgtgataggttaagtgaggctctatgttgcgggaacctcctttgtctactggccagtgagcaacgagctgagctcatatttacattagcatgatctttatccatatcaggcccatatctaacagatcgattaccactagtactgaagcgtctttctggggatgcttccctagcatgtgcaggacctctagacaccccacaacctccatctctgtcaattggagaaccacgtccagataaagggcggtatgagctactcaaagtgttgtttctcaccctcctagccattttactagcatttgcagtatcaaccgcctttaccaaggtgccatcaggtgcaacaacaaagccattgctctgcatctttgcaacagcagcttctgcagcattccttggaccaggcagtccgtaattataataatcaggtgatttgcgccaggtagtgcgagaattgtttgaattttccacccactgttccacccggctgctaccttgaatatgtcgtgatgctccacctctttcatgtgatttacgaatatcaatggttctttcagcctttgaacctgagccataaccatcatcagatctggatgaaaaaagaaaaggggtcataagattagtaattggggacatgataatggatcatcagtgtcgaattaccagcaagatgacagctaaaaaagttcaccagtaacttacctgcataactcatttatgtgggctctgtcaaatgatcttggccgatcagctcgtggttgcatatctccacttgataactccatatggcgcaatgattcaccacctccagctgtatctgatgtgctcaaaacacaccggttagatgaatcaactgtgtcccttgaatcatgttgagaatgccgctgatcttcaggtaacatatcccatcctgtgggctttgttctcagacttgaaagatcgtcccctaaaccatcattgaccctttcagactggttgactgttgcggaagatccagctattacatggcctggattcatctcatacattcgagtctccccattaactctcaagtgaacactaagagccttttcaccagtgcttccagcacacatcgttccagatccatcatctatgcaggtagttgaccatgaacacttcaatgcggctggtgaaacatcaccacctccattcctggaatgttttccattgaaattagcaactcgatcacctgtattctttgacatggagccaagagggaagggagaaatgcctggggcatcactcttgcaatctaacacctggtaattggcaggtttaacttcttcataacaatcatctccccaatactcgccagattcccttagttccccatcctcatattgagaatcatcctcttcagcaacaatatttccagtcccagcaagatctttaataatatgaggtgcctccgtttcattacagtgctccataaaattattcgatagaaccttcccgaggtagctttgttctgcagattgtgaatcggcaatgctgtccatgtcagtagttgatggttttatgcattctgaattgatagggggagctacacaggcaccatctatacgacatattaatgcattgctactgtcagtacaggtgagattattactaatagttgcatcagcaccctcttcttcatgggcatgggacataccacgatcagaagaacctgggttgtcattcatatgagaatcggagaggtccaaatcatcatctacatctgcagctttcttggagatgctcaattcattggtgacatgttcaactttgtcgtgacctgactgtccaattttactagttccagaatcaacatccaaaagatcctggttcttcaattcagatatgctttgttgagatgtttgcccaagtttatcattgctccagccaagatcagtagaacttttattgaaaacagttactgttgcaaggtttgtgctttcctcagaaactaacctacttgtgaaaggcttcactctggatcccagttcactcatttgaactgaattgatcccatcacagccatctgtagaaaccatctgggacaaacctacacaatcaagggctgaggcatgtgaaacatcaagtttctcctcaattacggtcaaagcaaaacgttcagtcataggaggcaaagagctgcaatcaggatcagaccctagctgtgattttactttggagatatcattgttatcaggcaactcctttgttcctgcagataaaccatcgcattctagcggtctcgattctaatactggtacattttgcggagacaggctgcacaaaggttgagatgaaccgtcaccagcaaaatcactttcgctctttgtagaagcatcttttggtgcatcaatcacaggagttttgtcctctgaaagatcaggaatgttaccagcaattgttgagtcaaaaggagcttgacacacctgcagcttgttcaacacattttcagcatcactacaactgcttatagcaaaagcaacaggatcaggatcagccgcatcaggaacatcatcaccaccacagtcagtgtcccatgcctccattgcaacattaagatcccagtgcaatcttgagtcacgggtgccattggaatgcttagtttccacaactgcatcctgcaagccgcctacagatttgtctggattacttgcgttgattgacatggtaacacctgaagacttcgtgtcagaagcagttgaagaatcatctgctttgtttgcactgctcaatgcagaaaaagacgcggaacagtccttctgagtgtgtgtagattcaacaagattttcacagttcaatctagtggcaaccacaggcttcgtatcaggaacagattcagacgactccagcagcgggtctgatttgcaatttgaagcatccagactatttagcatgtcctccttgatgttatttaggaaattcaattcagaactaccagtgatattttctggtttcctttcaacacagtgggctgacttcgaacattcgacattcaacgtgtcatcatccaactcgctcgtgcaggcagcagccgcaagtattgatatgccagaaaaatcatctacgccaaaatgctcttttgtttcctccatgtaatcaagtctaggtgttttaaccttatgatgctttccatgtgacgagatacctccacaggatctgctcaacagtttttcatatggatccactagcaatggagtgggtggaggtgatggagaacaatccataagaaatcttctcttttttattggaacatttcccacaggatcactaaagcgccgaccaagaatagataccccaaactgcaaagatgtcattaaatagttcataaaattggcattcaagaattgaattgactcttacttcattgtactctaaaggagaaaaataagaaccttctcagactcagaaacaggagcatcatcttgtgccaattcttgattagtagcattgccacatgcatagaaagatctaatttcatcccttattctgtcttctccagagaaagaggtccttgctctccttgcagctctttgccttctgtttacggtcttccatctcacctcaggatctataggccttggaagctccaagcccatggtgttgagcttgctgctacacgacggcccagctctgtctgttgttgattcaccaccacagcctttgcaggtcattgaaacacctgagttattaagattacgaagtgatgatggccttccagtacaggtgcacaatcgaatctgccaagagaaccaaactagtcaaaagatccatatccagtacagtatcagtaaaaaaaagtttaggcggaacatcaacccatagcaaactgaacacaatgataggctttcaacttggttgggaatacaagcagagcatgaacaacataagcataccatgaaaccaggccttcttcctgttgctcccaaagaaacaagagactgtttcacatcaactgcaccctcaggtccaatagatcccttaaaatcctctggaaaacaaaaacaacataaggttccggttgagcaccacaccaccaaagcgtacgatactgcttgaagaataatagcatcacaatccacatagcatgttcgaaagcaataggaaaaaactaaacgacgcttctgcagccatgccgccaccgcgcgccaattatatcagaaaataacttgaacccctcctgtagcaaaatttttaggaaaaactttgaactcccccgctccaaggctacttgagcacatatgggagtggagcaccagaaataatggaaaaccagaaggcttttacttccaggactgaatcccctatggcatcaacacggaacaacagctcagtcaactgccctcttccatcagcatccgcaccaacgagaacatctccttcctagaaaatcgatccccatgaaaaagaagaaaagcaggcagatctggggagctggacgaattcctggcgagcaccgcacgaccacctccatcccagattccacaacacgcagagagagaaccagattggttgattgaccccgagaagtccaaatccttcagacaaggcagatctgacaaccgaacctgttcctccgtaccccaggcgccaacacggcgaaacacacggcgatctccccagcggcgactggcggcggaggccaagcagagactactaagtcagatttcttaagatctagggttgcgtataccttttgctcctccggccttcctcatcaaaccccaagggcaaaatctctccctcctctcttcccacctgcgcgcgcgccgccgccggggctcagctttttcagtagaaatcgcgccgccccatccgctcttccgcttgcccttctcctcctccccttcctcgacggggattccttgcgtgcgctgctctcctgcgcgaagaaggaattcttcccccccccccccccccccaacacggctgtggctgatgctgctcctgctgctgccttttcccttccccctcgccttttgactcccgccctcgccggggcgggacccgatcggtgggcggcgccgcctccccctgccttccgtccgtccggtcgccgcgagccgcgtcgccgctgccgccgccgccgatttttttttttttttttggttttggaccctttccttgtgctacttcgccgcctgcggaggctgggagggggagaagaccaagaccatatttttccgtgatttttagggtgcgctcgatttacttatatataataatactcctatatatatataagtattttttttctcttctctccatggtggtggtggtgggtgtggagctatatagggacgggaatcaaagcctttggtcgatttacgggattgcccctggtgtgcggtgtgttggggatgagagaggtggaggctggttttgcttttactcctagattgttttagctggggtggatctcggccgtcggatcgcatcgggattgaccataatcagcttcagcggtagtctctcctttccaaattaatcatcatatatgttttttttcgaggaatcattatatatgtttattatgcaccaacaccaagataatttaaataacatcaatcaagatatcatacacatattctcccacaatgaatatatcattctattacatgatgattaatttgggaaagagggagtagttttttaaaagaattaaaacaagggtacctttaatggaattgtaaagttttaggccacttctaaaaataagttgtgaatcggtacttatagtatgagaacatgtatgatgatattagacaatagtgtactctttttgttccataaaaacccggatatgacgcattctagtattacgaatttatagaatggagagagcaacagtgcatgattttctcgatatgggctttgtacttagaccatgataggccaatgaatgaagtttgtggcaaataattgggttggactcaggcttttgaatttatgaacccataaaactttgcctaacctaagagataacatatatgcctcattaataggtcaacatcgaagacccaatgatcttaacataggtggtgtttgaatcttctgaagatgaagataaaaattaagtgtttcatgtaaaacgaggtggtaataatgaattaatatgatattttagagcaactttcatatagaattgtttcgcacaaaacacaccgtttagcagtttgaatagtgtgccatgagtatccaaaatttaatccaacttttgttggagaaaagaagagggcctagtttcttcttaataaatctacttgttgcacggtgctacttgttgtgttctttcccattagttcccaactcatatccatcgttttccgcgtgcacgcttttcaaactgctaaacggtacgcattttacaaaaaggttatggatgtgtttagttccacgccataattggaagtttaaataaattagaacgatatgatggaaaagttggaagtttatgtgtgtaggaaagttcggtgtgacggaaaagttggaagtttgaagaaaaaaattagaatctaaacagggcctatataggaaagttgctttaaaaaatcatattaatttatttttcaagttttttatagctaatacttaattaatcatgtgttaatctatcgcaccgatttgcgtgcataggggaggggttcccaacccctccaaaagcactagcccatggcccactgctctcccaccacatcggccatgccccacgactctcccctgtgtggttctacccatcaactaataacccaacataagcctccgttggctgtagctttgtagcttcttgtacccctactattgggaggatgctacgcgtcggacgtccaatttttcgtaaatatcggacgcccaacccctgactgccgcacgcctacgcatgcatgcacaatctctaccgtttctactctagttgattagcacatgtaaaaagtctatatgcttgcgcatgcatgactgcatggttcagcacttatctcaaccccactttttatttctttaaattaaatttccttctaaattaattatccgatttatgattcgatttcaccattaaactccttgcaattaaatcttcacaacaagatctcgcacggttatattttgatgagaaaaatcgaactttgtttcaccacttataaaaaaaatgtttcaccactaggtcaaaatgttccaactcactctaaaaaatgtttcagagaaatgcaacattcaagtaatactaaatgcaacaccgataatatcggtatgaaacattgactctcaatgagtgagacataaaaatcttgctcaaatgtttcaactcagtctataaaaatatttcagagaaatgtaacattcaagaaatactaactgcaacaccgataatcacaattaaatctttacgacaagatctcacatgattatttttataatttaatcataaggtattaacaattgaaacatcatataatatttgctgaaacatgataccgtgtgcaatatttttaattaattaatgaatacttattgaaacactcaatcaacacatatgcaacatttataaataaactagtgaaacataataaactacttactgaaacatacaaatagcaccatgtgatgcattaaagaaagatatatacattgcgacaataattaaatatgtgcaacataatagaatttcagttgaaacatcttattctcacatgtgaaacattaaatttaattggttgagacatatgtgtgttttttattataatatagtcatgtgagatcttgctgtaaaaatttaattgtaacgaatacaatggtgtaaacatatcgtagattggatgagtaatctggaagaaaaatcattttcaagtttgctaaaagggtgttatgtacatgcaaataatcttgtatcctctctcctccatgcatgccaatgctaagtaagggagcatatgtaacaggtgtgaaaagaaagtatctgacaaaaagaatacgaggctgcatgcagcaaaaccacaatgagacgcgtccgatttttttcaggagattagacaaccgggtggaagcattttccctactattggccacatttgcccatggcttcaccattcaccaactttgcatgtggttgtgtcctaattttttatacttgcaatttgatctctgggatttataaaactaagttatgccaagtttttagtgtagacttcaagcttttggtccattgtgcaagccaggttcacatatagaaaatgcaaccaaaaaaaagcatggctaaagccggtctcaatttggttcaaagatcccattttcttatagaacttgcttggaatttgaacatgtcaacctagcacctaacaataagataggtgaatgtatgatttaaggaggtttgaggatttgagggtgtgaaagtctcatgtattactaacagctatatgttttaaccaagaaactatgacaagtatctatcttgaaaacaagaagagctggatatgttttgatcatctagcttttccttgtatcatagcaaccatgaagagaatgtgtagaagtagaagtgatctatactttttgatttcaaaccatgtcatgtcagtgtattggtaaataacataatttaacaatgagcatggttatttaatcctgtagtagcttgttgccaatttcactagttcaaatttgttgtctcgtaaaatctttgacgatatcaaattagttccacaacttcgttcaaaaatctgttccaaaaccaacgctgactttattggctagccatggatgacaggccaactgtttcgcttatttatatactccctccatttcaaaatatttgacaccgttgactttttagcacatatttgaccgttcgtcttattcaaaaatatttgtgaaatatgtaaaactatatgtgtacatgaaagtatatttaacaatgaatcaaatgatataaaaagaataaataattacttaaattttttgaataagacaaatggtcaaacacgtactaaaaagtcaacggtgtcaaacattttgaaacggagggagtacttatttgaatcgctaattagtaaataaaaatatttataagtaaaacttttatatgcgtattcttagtgactcaagaacaagaacaaatgttataaaataaactatgataaaaaatcaaattataaaatttaaaatttcactatataagcctaatcaccatgagcgaaacaagtttgcggaccaagtggaccgtcgaatgaattttaccgaccaaaatgtacccttaagtacggatgtaactgggtcgatctacgaacccacttgtaaacaaaacttagtgggtaacctattaatttggtatatattacctccttttttaatatatgatgccattgactttttgtcacatgtttgaccatctatcttatttaaaaaaattacataattataatttattttgttgtgagttgtttatcactcaaagtattttaagcatgatttatatcttatacatttgcataaaatttttgaataaaacgaatggtcaaatgtttgtttaaaagtcaactacgtcatctattaaaaaacgaaacgaagggagcaagtggattcacgggttgacccacttatatccttaagtacgacaaaccgggccataacgcgggaaccaacgagttacctacttatttaacctgtaagaacaagttttgtaatagaggtgattgtcacataaaatattatccatatcatcgactaatttatagtgggcatctcatacaccacattacctctaatgtactaaccctaatgcaacataactatttattttatccactctcatgcaatcaacctcattcttttctctttcttccttaaagtttgtgatgagattacccttgcatgatggtggctcatcctgttagtgatatgccctaaaggcaatcatagagatgattgtatcacatactatgtttacatattgatccgactttgttccttgaaatggacaactcattattggttaatgaatatgtgattctttcatgagactctttatgttgtttgttactatttctaaaggatccctgatcaaatatcatatatggaacaaatatgtttaaatgatcaacacatgtattaattgatgatcatgtctcatggatcatggtatatgtcagggttatggatattacatacccaatagtaatcgactaagctcggcagggcccaccacataccatgtcttatacggaaacaaacctcgtatatagagggagttccggataaggaaggacaagaagagttatatatggaaatgataaggactactcggattgtatccatatttatctccctagtcttacttggacaagggggcaactatgagtataaatacaagctcccctaggaggagaggggacacacccaccacaatatacaaagccataagccaatacaagccaatacgccgccgtatattgacatcagagattagcctaggcatacaccatccggcacctataggggccggcaagagggatctagcaccatctctgatctcgccgagtacggattcaaggaggaagactaccttgtcgtcgactatgagttaattatttagtcgtcaagtcgacgacggatagatagattatcccagatattatatttgtgtgatccagatgaataaagagcaacaccggcttcggccaacaggatgtagggctattacctgtaagataaggggcccaaacctgtataaaaatccatgtctccatcttttttatctcaatctcgcatataccctggtaccaatgatccccataccatccaaatatcgtagtcgtgatatcaaacgtcgacagtatagagataccaaattaataatgtggacacatgttggggaacatgttattggatagacccaacatgagacacttcaaaagctatatgtgttgtgtcatcagtgatctcatttagtgctggtgttgaatccttagacctaagattatcatgattcccaacatgtgtagtagcttacctagggactgctaaatgctactccgtaattgggtagttataaaagtagttttcgggtatgttgtgaaacatgtagtgggatatgaataatcaagatgggatgtggtgggccccttgatgttgtagattatggaagtgcatggccatgccaaaggtgattgaggagtcaatcacaagttatataatctatacaggttcgagtgaacgattgagctattagaggatggcacatatctaaccttgagcttaatcgatatcgtgaggcaaaggggttcatacaagtatacactagaggttcagccgatatgatctttatgtatgctcggtgggtcaatacgttctgctaggggccgttgttgacacgtggaccgaaaatgagttttcgggttacagccgagtgtacatgaacctccaggatcgtacgcttaatgggccggaataaggggattggatggagatccaatatgagcttaattcggatagggatccgaataggagtcctatgggccttggaggctcgagtcatagatcctatatattcgtgagaggtgtgattggcggaggtattgcatcacgagcaaaaccctagccgtcactcccctccccgagcaaaaccctagtcacgcacgggtgctagcacatctacgcgtggcgttccgtccctgtacgtgtggataccggtagaggcgccactactttgcggtgctgatcggcgtgggaatacggcgaggggaacgcacgaggaggagaaggtcgagccggtgcgatcgactacttcctctacatcgacgtgcgctacttcgcgggagtttcttcgacttcttagcgcattcttccgctgcgcagcgcgtcgagtggtaacgatctatgatctaatacttgcatggttcctggtttacatgatagaaaattttgatttatgctatcgtagcctacgcgtattccatcacatcccctatcctctattctttcctccaccttatcatttaagcttaagggcccctttgaatcgtaggaatgaaaaaaatgaaggaataggaaaaacacaggatcctaacatgaatgaaagtataaaatagaggattgcaaaacacaggaaaaacatagaaattaccgtttgctcggaccgtaggaaaaaacacaagaatcatatgagggagatatgccccgtttggcacagctctagctcccaactcaacttacctggagccggagttgtgccaaacggtccagatcctctgtttttttggagtggagctagtagaggtactcctaaaaactgaactacgggggtggagctgggtttttctgctccacagctccactccacccccacaaaccactaccctttaattttgtagtctatttacacaaaaataccactcaactacccttcagtcatcctctcatcctgttctctctcctccccatctcctcccgatcccaaccgagctgcgggggcggcggcaggggcagcggcgtcggtggcgtgaggcggcgaaagcggcgggcggtgacgacgggcaggcggcgcgcggccgacgaagcacctagggacggcgaacgttcggtgggctggcggcgcgcggccggcagccgacgacgcgcctgggccgatggctattttttttcttttttttccagatctggagctgaaacgtatccaaacacttttcaacgagtcttcaactccaataggagctagctctcactggagttggagtttggagcccttcaaaaaggaaattttctaagagctttgagctctggctaagttttctccaagatctctataggattccattccataggaatttcaaaggattttatatgatccaatcatttgattcaaagacattcataagaatttttcatatatagtattgtaattcaaaattctctaaaaaaattgtttttcctcgaaatcaagatcctaccaagatgcttgtgcttagatactctctccgtcctagaatataaacatttttagagttggacacggttattaagaaaataggtagaagcgaatggtagagggttgtgattgattaagtagtggaggtaggtgagaaaagtgaatgatagagagttgtgattggttgaaaagagaatgttagtgaataaattgttatattttaggataaatcttatgtgataaaaagttgttatattttgggacgaatggagtatttatcgaccaacttgcattcttgcccaaagccctctctccctgtgtttccttcacatccactctcccatccaaattcccaagcccatctctctctctctctctctctctctctctctctccactccagtcgaggcacggccggctccccccgcgtcgccggcgagcagggcacgggcgtgtcgcgctcgcggacggcctcccctcccctcccctcgtcctagccttctcctccgtgcggcgcacggccggcgaggccacccagggttggtgacccaaggggggcgagagcgcggagacgcggcccccccatccatctccgtctcccccgtccggatcgaatccgaggtatccgctcttctttctctcttgtagcgctcgctcgtcgtcctccgcgcatgccatccccatgagtgagccggcgtgcgcgtgggttggagatccatcagtaattagaatatctagattggtttgtatcatccccaattaacctgtccacgcagcgaaccgtcttccggagaattggtgagcggagtggtgctgctgatatcaaatcatatagttgcgtgtaatttttgtatgtgttgctgcaggattgatgtagaggtgtggaatcaccgtaccatgttggcacatagtatttgtcgatatggccgtatggggtttatttagcgtgaaaccgattggcattacttggatcatgtcaacatagtgtttttttgttcagatatagccttttactgatcggtctgtgattgtgtgcctacctttgaagttacttccttcatttttttttctgctttcatatgctgatgcagcttctcactaaagcaacttctgcaaatattttctgttggatgtaaatgcacacttttttcgtcgaaataaatcttccataaaagaggagcacggtattaggtgtacccctgacactcactacaacttaagtgtgcttctgagattcttccttttctcgcaatttcataatatacataccaactactattgtgctacaaagatctattgtaactctagcattacacggtgggacttgctacctttttctttaacataaacggtatacatcgttggacaattccactaataagggattttctcttcaccttgcataatgtttttggttgtattgacaagcactgttttaatcctaaaactctctctctctctctctctctctctctctctctctggggtcttatatgtcctgctgttttgttgcctgctatagcattaggcatcaagttccttccagttactatgtgctggtccttttgttaggtttgtaaaatcatagttagttaactagccagatggacatattgcacattatctctctttttccccactttctgatatattacagctggtatatgctcatccatgccacacgttattgtataagtaaaacacactgtggtgaacaaaaatgccattctataacgcgcagctgtgaacattttttattggtgattttttttttggaaaatttatacagaaccagagcaagcagaaatatgccatgtttttccttctttattctactgaagaacaggacaaaattgtgtatatatgttctggtcacacaaaattatattgaaatcctttgaacacattggttgcttttcatttgtcaagtctaaggatgatcaagctggtcttttgtttcacaaagtcacttgtatgcttcttccatgagaagtcctttttattagttttatcagttatcacatcacgataaactcataggcagtgaagtcatgtttgtgtggttttgactggccccagatgacacaccctttttgtcatcttggatcgcacgtttgttattgtggacttgtggtattgtctgtgcgtgctacccattattccctttggctctttattttctaaaccaccccaagtttgtgctagcaggctagcattgacttacatatcttttctagcattattattaatataaccatggtgaacaaggtttctgaaaagtttaaatgcaaacatgatgataaaatgccttgttaataaattcagtctaatctaatggctaaagaaattaccttcactgaagatattaagcatgtgaatgtgtgtacatgttctgcagagtgaacacatgaacctatggaaaccaatgacattgccaacaaacaaactttatgaagttccctattgtagtactacctccgtcccaaaatataagcatttttagctatgaatctggacaactgtgtgtccagattcatagccaaaagttgctatatgttgggacggaggtagtatatattatgagaaagtgactatggtacatatgatgtaaaatactacctctgttttttaatatatgacgccgttgacattttgagatacgttttttgtaattatcatttattttttatgacttaatttattattaaaggttatttaagcatgacttatatttttatatgttggcacaaaagttttgaataagacgaatgatcaaacatatgtttaaaagtgaacggcatcatacattaaaaagcggagggtgtatgtgctacatgacctttttcctccatacggtaattatttcttagaagtggaagtggttaggagtggaaaatatcaagtgagagaactttcttttagctgaaaaatgtgtgtaagagccttgtttgcttttctgtgagattttccttaattcacactacgttcctttttttttttgtcaccgtgtatgaatttcaaaagaggggtcctattcatgttctaatgtgtgacattcttgagtaggtctataaatggcaggaagacaccgcatacctcgtgaatactatgatgaacgtcgaggatttcgtgatggccccccacctccacttgctcgagcaaggcccatctctccacgtcgcttggaggaggagctgtctagccgccgtgctgagatgcgcagaatccatgatgacaatcagcgcctagctgatgaaattgttggtctcaggcaggcaatgcctcgtctgaaggaagatctccatgccgcaagtcaagctatacccaagcttcgtgcagaaaaagaacttgagtcaagggagctgactcagaggaatctgaagttggaagctgaactacgttccttagaacccctcaggcaagatgccttacagctacggtccgaggccgggaaactacagtcaataaggcaagagatgactgcaaaggtgcaggggttgttaaaagagcttgagcatcagaattctgagaaccagaaaatacctgtcatgatagctgaacgtgatgctcttcggcaggaactagtccgaatgaggtactgaactattctgcatcatatttcgtgtaaaatgattgcttcttattgcttttcttgatggatcaagtgttagttctaagttgctgcttgaaggagcgcatttaggatcctttcctacagtttcaattctaaagaaaaaaagtggggtacttgagtatcatcttcctcttttcaccaggtggaagatcaaactgattaatatcactgtaggggaacccttgagtacgagaagaaggcaaggcctgatctgacagcacaggtgcaggcaatggagaaggatcttgtttctatggctcaggaatctgagaagctgagggctgagattaagaagagaaatgcacccagtaggtttcttttcttttgctagcttgaaagttatggaaatcaatggcgctgacccacaacaacatactatgtttgattttaggtttcagcggccatggagcttatggaccaccaatggcgactccagggatgggcctgcaaggcgtctatgatgatggctatccttccataggcagccgctatggcactggatcttgggcaccacatgatccccatggttatccacaactgtgactgggcttctgatcgttcttccctgggcagtgctttatcttcgtaatatcgcttgatggttgatactgatcgtgacaaagcttttctcttagtagaacttgtggtgcacagtagatggtcttttgggggtgcacttcaagtgttgttagtttagcatatgtagcaatataccagctatggttgccttggtacctctccaaaaaatgtaatcaatgatgactgtaagagggaattcagtgcaacgaagaagaaaaataggaactt

SEQ ID NO: 80173 - DNA, 2253 bp, Oryza sativa
tctctcattctccgaacataatttaaatgcacagcatctagaagtccttttcacttattcttaatttcattaaaaagcttagaaatgcttatattttagtaaaacataggcagtatatatgctcattaattcacctgaccttgatggtttatttttgatgattatatatattggaggagagaatttttcagaaaaaaaaaattgcagtgagagaattggaaaagatctgcaccaataatgggtaaagtatatattatatcagtagttcgttagagattctcgatggagagagatcgaaaggcgacgttggtccagaggaccagagaacaattttttccctcctagtcagcgtagaccatcttctactgtagcctacataattccattgcccagccagtggcgtgccgccacgtaggcgtctgttcatggtcattttctgctgaaattccattccgttactgataattttgtgacacgtcagcgtttgttcctcgcgtcaaaatcagaccatttgtcaaagggaatacttccacggatgggcgacacgtggatggctcccatcggtgatagggtgctcgatcccttttgcttaggagtatcagttcattatctgtgatgaaatccatcaccatgtgtcgatgcattgcatcctgcagtcagcaatcatatgtatgtttcagagaaactgtgaaaaagtcaaatttatattgctactcctatatgatcaggctggtcgattataaccaagggtcattttaagaaaaggaaattcgatcctgacaacgatggtggttggcatttctgtttactatttttgttgtaggttagtggtatttcttaaatttattttgataacgaaatcaaaccaacatccaaaagctcacttgttaaatcacttacttctggcatctacaaaatgaaaaaaaaggttctaacctaattaattaaaatatagggtcttttagggaaaaaactaaacgaaaaaactaacgcaccattatcgcaaaacaggaccaaacatattaaataagagaggagatcgcaaacatattcttgcgataaagagaaatataaaacttgataagcataacaaagacattgcatatcttggatggttacaaaagatatgagcagataagtgcagccataacattgaccaactccaacgcaagtgaaagcatatgaatgagcatcagccaccattttagtttctttgatagtcagcaaacaagcattaccgaacaagttggcaacccaaacccaaaatttgatgtcaccggttggatcatcagtaaccccgttacacaagaatcctaaatctggcatcattggttggatcatcggtaacctagcaaacaagacctaggtcttccccgtgatcctaacaaagggagaagtcattgataaagagatagaaaaagcaagatgctaaatatatttaacccatagacgaaagactaaccctagactatctaatacatttaaaacctgaaagacttttgagaaaacccaacaacttacttcacaacgacgagagacagagccttttcaacggatccccttatccctcgtgccaaccagaactcgagaaggcctgagaagttttatctacatgttgttttccttttcttttgagttaaaaatttacacggtataacactacaagaaatttgacatttgatggtgatctcaaaatgtcaaagtgaagtcctagctttgtcatagaacaagttatgtgacaaaattctagcgtcataaggctcgtcacggatgacacgtcggcaaaagtatctcgtgacaataataatgtgcatcgccatatatagaagcccagaacccataatgatgatatatggtcacaacaaagttgatttaattttttttacatatcatgtgcatgaagtttaattaggttatccgcagaccgcaaatacgtttaggcgattgacactaagaaaagtttaggcaatgatatatcgatcgactaatagcaaagctgttttctcaaccctatttaatttaagggagtatctaaaaaattgttgtaagatttttgaatgtaaaactttcaaatgtaactatagtataattgaagtgtaattacattgtaactgcactgtaactgcattgtaactacaatataacttatactcctataatatttgtattcaactatgatttgattggcttagcaccggggtcttacgcatgacatgtgtgaaatattcttaatctctagcaattttttttctt

SEQ ID NO: 80174 - DNA, 1753 bp, Oryza sativa
ttttatttctatctgaactcttatttttatttttttattctttggaacttattttattttttctgaattttagttaattaacctcatattctattctacatctactgttctctcaataatcatttttattttaaatttctgttatttctaaattgtattcttactctaactctcatttctatttatctactttcagaatttattttaatttttattccaaatttcaattaatctcatgttgtgttctagatggtctcttctttcaacaattcttattttttatactgatttttttgttatttttaaatcgtattcttacttgaactcttattttattttttataattttcaaatgtattttattttttattcttaattataattaatctcgtattatgttctaggggattactcttttagaattttttattctaaattttagttatttgtaaattttattgttacttgagctttttttttataattttgaaatttattttatttttaattcttaattataattattctcgtattatgttatgcatggactattctttcattattccttatttttttattctaaattttagttatttctaaattatatttttcaaattttagaatttattttatttttattccgaattttaattaatatctaattatgttctatatggactctttttcagtattccttattttattttgaattttagttatttttaaatatatttctacttgaaacttttttctttttatctaatccacagtgagcgtggtgccttctttcgagatttgcttttatagttttgtataatacagtagacaggtagaccgtagattcaagatttgatctaatactaacaaaaacatgatcaatatttaatgagatatttttagttattatcttttctcatctatgtatgtacgtggctaccaaaaatcaggagcattcagtctgtttgtttcctagtcctttccttgcatatggccatatacgtcagttggacttgatttttttttattacccgacgataatcaagccatgcaatccggttcagagagcacttgaagttggaacagaagtatatgtaagatttctttctttgtcagtccaagcaagattagtctatagtatttttccttctcttatacatacatatatccgatcaatctcgactgttaaaatctgaagctatcatgatctgatggtgtagatttctctttttcttcgattaatgtggcaatttctagccttcaaagcgaacttggtgtcttctttcaagactgtttttaataatataacttgggtttcgtttttataatttttagaagtcccatcaaacgctgtcattatactcctctacgactcgtccgctgtctcatctctttattgtcattgggattttaaaactcgaacataattatcgtttgggttcattttttttactatctagaagtcctgctaaaccatcagcggcttttccattgtacttctctacagctcgcccgctgcctcacctgttactgtcattaagatttaatcaaacataattattattggggtttactttttactttttagaagtcctgccaaccgctgtgcccgtattgcttaactgcatgttcattgtcgctattaggattctatttggggttttcttaatagtttttggatttcccatcaaccatcaccaatctactcctttatacgcatgttgcttctctcatttttactatcatttatcatttg

SEQ ID NO: 80175 - DNA, 15681 bp, Oryza sativa
caaatccgcgcgtttgaacgtgagagagagaggggaaaatggggggaaagggagagggaatcacggggaataattcccccctattgattgcacgcggggaggacgggggcggcgggattcgcggcggcggcgctagggcgcgggcgaggcggcgggagcggcgggaggaaggggatgacgggtgggccccacccgtcagcgagggtggcgggcgggcccgcccgtcagtggcgcgcgcgcggggagaggccggatgggccgcggggagaggagagggagggggaaggggatgggccgagccggcccaagagggagagggagggaaaggggacttttcagagtttttctttttataaaatcattttaactttgtttatttcttaataattattatttgtgctctgaaaattccactaaaatttatttacgcattttaggcttttaggaaatatacaaaaatcctctaagccttatttgacttttaactttgcacattttaattgttggaggctttcacacggattttaattattctaggcaccatttagaggatatattttagggtcgttttgggacgtgacagtgtggagcaagccaagaaatgcaaaagctgccagcggcatggccgaagccagacagcaccccagtacgagctgtagcctatcgcagtagtctggccttacgccagatgggggttggacatcattggccctttcccggtggcacgaaatgggtacaagtttgcaattgtagcaattgaatacttctctcgttggatcgaagccgaatcgcttggtgcgatcacttcggcagctgtataaaaatttgtgtggaagaacatcgtttgccatttcggagtgccgaaagaattcatcactgacaatggcaagcagtttgattctgacaagtttagagagatgtgcgaaggcccagacctgcaaatcaagttcgcttctgtcgcacacccacaatcgaacggggcagtcgaatgagcaaatggcaagatccttgaggcgctcaagaagaggcttgaaggggcggtgaagggcaaatggccggacgaaatgttatctgttctttgggcccttcggacgacccccacaaggccaaccaagtttagcctgttcatgctcctttatggtgacgaagcaatgaccccaacagagttagaggctaactcaccaagggtaatgttttctgaaggagaagatgggcgcgaggtgttgctcgaactcctcgaaagggtgagagtcgaagcactagaacacatgcgcaaatatgccaagagcactttggcaccttacaacaaaaaggttcaaccgatagagctgctgcctggctaaggaagaaggcgaacccaatggcggttggaaagcttgaatcgaagtgggaagggccatacctcatcaagaacaggtccaggacgggctcttttcgcttggcgacgctggaaggcgaagagttcgaccactcctggaacgctgcttctcttaagcgtttctatgtctagaaggggtggcaccccattcgccaacttgtaaaaatgtacatactattatgtaggcccttcggcacaaaaatacaaaaaaagaggaaaataaaaaaaggaaaaaaactggatgtagggctattatccatcctggaggcccgaaccagtatataatccatgtgtctttcacctttttacttgtgtaaatgataattcgtggaaaaaccctaaggcaaacacctgataagcgaaagcgccaggggggcgaaatgaatcgaccgaagcatcgctcgctgaacattgaaaccgcaacatcttgtttcgggaaataaataaccgaacacagtcatattcgatctatgtgaaaaacacgagcatttctttagcgcggaatactacagatcgaaaacggaagtaggaagctgaaaagtcagcagacatatttcgctaatatacgcaagggggccgacatatttcgacctaacaaaatcatgaaaggtgactatgcgtacaatagcgaaaaggaaataaaacacatcttcattaacttcgaaaaaaaatataggccatacaacatggtacaggcgaaagaaggtaacgggctttacagcctaacttacaaaaaaattacatctccacccccaaaacaccctccacgccctaaggtatgatctggcgaacttggttcgtcatcactactaatattatacactaccctaagaggagaagggggcgagacataaactagaccgtaacggcgttgggcgatcgcttcctgacgatcagtcctccgatgatttcaccaaaagcgagccatgtcctcccgatgctccacatggacacggtcgtagtcgtccatggttcgcccggggtgtgcccgcatccagctggaaactttcaaaaccttgtaactattgccatttattatcatctcgcaacatgaatacttaaatttcagcaagccttcaactgtgatgaatttctcattctttttacgccaatctctgaaaggaagccgaacacacaatttctagtgaagaccctgctaaaacaacataaaaaggggcaaatgggaaagcacaaggttaagagagggcgaagctcataaagcgggcaaaaagtgtagcccctattcgtgtacaaaatgatgcaaccatacatatcaaagccctaaaaacgggataattggcgaaacttggttcatctattccatataaaaaaggccattttcggctacagtacaaaagggggaaacatcggccaaatttacatcgttcgccttccgtggccaacgcaaaaaatctaaaaatctaaagagcgggcggagggcctcacacctctgggtgattatggccgatgtctaccccagcgcccgcatctgccccacctccttcgcccgctgcctcctcgccttgatccgccgcctctgcctttgccaagtgctcgagcaggcgcgccttggcagtagatcagccgtccatttgccagaattgtttgcgccaagcacgaagtgcggccgaaagatcctgacaactgacttcccaatcccccttcaccaacttggggaactcggcgatatgctcgcacccattttgttgtagcaggcccatggtaaaggccgctaacacacgcgcgtagcaatcgccgtatgcagtggtgcaatcagagaccacaccactggcctattgagtccactccgagaagtcaaaggcagaagcatcttcgtcggggactcctcgcaccttcgcccacatgtcggtaagggcaaggcaaagcgtgcggcacacggtctttgcggacttagtggtcttcaccatctcccgcgcgaaccgttgtgcgtctctcttagcggctgcttctaccttgctgacctcctgacgaagagcctccatcttcggctcggtaaggttatagtaatcagtcaaggcggtggactaatctcgttcttttttaagctcagccttgaggcgctcgatctcggccttcgctcgctccccttctccagctcaacttggagctgcttattctcagtcttcgtctccttaagggtgttggctaggttttccatttctagccccttgcggcccagttcttcatccttagcccgaagacgacttttaaagctgtcaaggcgagccctcacggttcgctcggtcgaacaatgagctgcgggtatctaaaaaaaagggggggctaaaatgaagaaaattagcataagttgtggaaaagcaacatttaaagcgggcgaacgacatacccagacggctaagcttttgacagcggtacagccctcgttgaactcgttcaactcagtgaacaggctcggacttccagccggagaaacgagatgacttaccccctcgatgaagggggtaagatccacccgggtctcgaaatcccaagggacgaagcagggcgccgtgagcgaatactctgaagccgacgtctcaacggccgccttcttcccgttttggatggccagcggtgaagtaggtggactgtgcggagggctcccgaagagcctggcagcagccttcacaacccggtcagcagaacctgaagtaccagctgcagcgctccctcccgcttcgcccgtgtcggtcgcagcatcgggagcggtcgaaagatcttggctccacccagcggccgaagtagaggtctcatccgaagactcgtcatcactgaaaacacaggcgacatcgacgaaccccttttttttggaggttttcttaactggccctcccttcaccaccttgcccgccgcaatcgaaaccaatgcctttgccctatgcaaatccttccggcgaaggggggagctgttcgactccaccccagttacgacgtggtctgggcttggggttggggtgtagccgtgcgtctcggtgcggttgtcggcgggctcattcgcggccggttcgaccgcaactttcgcctcctcctcatcctccccctcctcttcatcgtactggtcatcgacagtgtcctcatcgtcggcatcagagtcagtggaggcaggggcctttcgcttctgaggggccgattttgcttgctcgcgtttgcgcttcttcgaggtcccttcatcaccatcggccttggagggcttctcccgagaggggagatcgccatcatgcacacgattcgctcggccagccgccttccgtgtaagcagctggctgtattctgtgatcgacacatcgccgaccatcttccgagcttcggtttcagcctgaacaagagttagcactgcaaaaatgaaacgtctcatcatactggccgcaaagcagggaaaaaagagcgaaatgcaactgcatgtgggaaagcaaaagcctacctttcgccccctttggcatgacgagcttcggtaggccatcgacctcctcgtcctggttcacctcgacttgccatgactaggagagaggaaagatccgaagcatgcaaaactcttccaccaggtcacggcagctaaggtggaggcagaccttgcgaagcagggcgaaatgggcttccatagctccatcagtggcaaccctgggtttcctgtttggcacgatcgccctgcaccgccatcggagagctttcgccgcgtcggacctggcctcgaaggggatggagtggtataatcacttcgacatccagtggcaatcccacttggacatagaagcgctgtaatgccctgatattcgtttgggattaaaaatcgtttaataatgcattttctagaaattaaataaaagttcaagcaaatttaatcaagtgaattattgggagaattaaaattttccctcaaaaatcattggccgagaatattttacaatattctttgcgccctaaaataccctccggattttttcgtgaatttttggagctcaagaaataattttaaagtcatgaagttcattaaaataatttaaataaaaagaaaacaaattaaaaacctcctctctccctttgggccgctcccggcccaatccccctttccctcccgcggcccgtgcccctctctcccttcctcggccggcctcccctctcctctcttgggccgttggcccgtttccccttctcctcgcgcaaagtctaaataaccccctgaatcccctccccctttcgccgacaggtgggcccgaagaccccacttgtcaggtccatccccttcctctcgccggccacaaccgccgccatggccatccgttgccgcccacgtcgccctcgatttcggcctctcccgctcgcaccctcgcgccataaccgagtgaaatcggtccccctccacgtcctccaccatctccacgactttcccccaaaaaaagggcgcctgtttgacctccccacgaactccacgtcaccgcccactccatcgcttcccgccggcgagcgctgcttcgcccggccacgtctctgctccatttcccccttccaccacgaaaaccccctcctcaccgtgccaccctagcgccgtcgtcgccctctaactccggcggtcgtgcgtcgacgttccgggcctccttaggcctcgggcccctcctcctcagctccgcaatctcaagggaaggcctggcatcccctcatcaaagctcttcgtcgccagcatccattccccgctgtgagaggtgagcttctcccctcgttgccggcttccggctgagttttcacgtcgcctcgcgcctcctcccttttccctaacccttccaccgcgctccccaggtcgccatcctccacctcgcgtccgcggtacgccgtcggaccgccaccgccgcccgttgccctcgccaccttggcgcatggtgagtgctccctcctcctacccttttccccctccgctgcctcccgtgtccggtgccgcgtcgcgccaccatcgtcagcggccgtctggctggcgagccagccagcctcccccctcccttgccgattgggggtgccgcccgtggaccgcccgtggtcctggtccacggcgcacccgaggccgcggtggacgcggtccaccgtgtgcctgccccttgacccgctgacgtgtggggcccgcctgtcggcgccggcctcttagatgacgtcagcgcttaatcttttcctttgagaaaataattaattattgcgcaataattcgataataattctagaaattcatttaaatggctcaaaacttctaaaattcatatctaattcatccgaactccgaattcggccattcaacttgcaattttcatctaaaattgagatctacatgtttgtttactttttatgtactgtttccatagtttttattagagtttttcctcgttttgcgtgccagcgtgtagaatccgtcgtttcggaagtccacagtcacaaggaaaagagtttggaagattgtttgaagaagcaaggcaagtaacacattccccttgagcatgttgatcccaatttataaatgttttgccgtttgcaaataaatatgcatgttttgctaattacatgggatcagggtttacctatctgcctgcttgtgccatgtttacttgatatctgttctttgtcaaccgtgggtgataattcgactagcttgtgttacttatgttaacctagctataactatattcttagccatgcttaattgtcactagctcagttgatgggataattatagttttagacctgttagtatcaagacgagctgcttgctcgagacatctggccatgtttcatggtcataattatccaactaaaatgcgactgaatggtgggctgtgggtgcatggttttgctagtcgcacccatggcaattaaggaccggttcacgggaaaccctggaagacttatagtgcttaccacaagcgagagtgggtaactgcttgatctaaagtataactcgaccctttcctaggcaccagtggcgagggtgggcatgatggagttgggtcggctggggtatccggttgtccagctgccggattcaccgcggcgcacgaggggactgcctacctccgggatagggggtgggggtgaaaccttagcgtggtgtggatggttaggggagggttatgcggagggtcttatcacaatcactcgacatggtgacgtatctgcgcggacgcggtgacatgccggtagattgtgtcttgtgggtacagttgtgcacctctggccagagtaaaactattcgaatagccgtgcccgcggttatgggcgattgaccagattcaccgtgattagtcttacacttaataaatcaacccaatgcactgtagttcatgtgggttggttgggcctgttcaacgtggtgtagtgttgatcagtggagatttaatattaccttaattattcaacagttttactgttttgctcaacaaaatgttttacaactgcctttatgcaaatagccacaaatcatccttgcgttccccttgcacgtctgcatcattggtgtggcttgctgagtacggtggttgtactcagccttgctattattcccccttttaagaagtgtatagcttctgagccgaagacgaagttagaagaccaaggctcagacaccagttgagttttgcctgtggagtggagctgaagccccgctagtatcgctttttccgctgctactgctttcttttcggtgtgaggactaagtgcctcttctataagtattttacgctttatttacatttggaactgtaaattacttgtcgttttgtgtaccctggctggtcctgtacagggatttaatacacaaaatagtctggaaatttgtgctaaatatctaggcgtgacaagcgttaaccggccagagatcggagcgctcgggacgaacattgaagtttgttaacagtgaaatttgttaatcgacaaagacgtcattggcttagaatcattatcggctgcagcatctgctcgggacgaacattgaagttctgttaatagtgaaatttggtaatcggcaaagacatcatcggctgcagcatctcggaatcagtcgatgagagttatcaagtcgccaatagtcgcattcctgctatattcggttaaggaaatcaatctactaaaggaagcttatctctaagtgaccgagtttaaagaggatgcggcatggcagtttatctattaattaggaatagtttgttagtttccttttatctttaggaaggtgtgtttagtgtccgataaggactttatgttttccttttacctttaggttagtttctttcttgtccgacaaggacttgtatcaacccatgggtataaatatgtacacccgggctctatgtaatctatcgtcacgatcaatacaattcggcgcatcgccaccttttatcttttctactttattttatcgtccggcgggacttgacacctgatgcggggctgcatcggtgttcgatctccggcgaaggggtaagtccaatgttccgtcgccccaggcaattgtatcgtttacgtcggcgtcgttcaaggctgcatcagtacattcgacctcttggattgctctagtttggatgatatatttgcctacctatttattatgtctctgttaatctagtcttagcatatcaatttagctctatcggctgtctctcgctttagggtttctgccggtatcggctaaatcgcgttgctagattagattagcctaggcatctaccaccctgaaaatcagtcaacggcttgattgtctagatattgtgtttcttttcatacctagtgctgcatcagttaagtttgatctactaagtcgtgcttagaaccataatctctagcctgcttcttgattgccaataagggtttcatcggggtttcagctggtgagttatttgaacgttgcatcggctcataaggattgcatatacatataagttggatttagccgatgacaataaaggtttcactgtttaatctaatcttgtggatttcatgacatcggaccaccagccgatgtgtgctttaactttcggatcaatacttgttctactatatcatattgttagccgattggtttctactggattatattgctatattacatcatcatcagccgattgcctttatatcattatctaaattggacatatagccgattgcttaaaccctatcgctatctgctggtatcagcatcgtctattatcggctatcggctagaactactctatcggcttgtcagccgatcggctgttttgatctactatttgcatatcttgtcagttgcaggatcaaactgactggcacgcccgcatctcatcatatttggacctgcactggagctaagcagatctcccaggccgatgtgttcgattttctcatcaacaagatcacgctcccgaaccctgttttcttcgtccctgctggggtgaccacagtctttgagtttacagtggcgtagaaaatggtgccgaaaagctcgacgctcgattcaaacccagtagttcggcacgcccagtcaatcatgctaccagcaacgattcaagccaaatacgtcaagtgtacttaggtgaagcctccatgacgaaggctacggaacgaagacgacgaaggccagaaagccgcgtgggtacctcgtaggaccagccatgtgaggcgaagggtgtagacttcaccttgacaagctcgataccgaggaggtccaataggtcatccggtgcacggcgaagggtatgggccgaaggaaggagtcttcgcctcgacgagctcggcatcaagcaagcccaatgggccatcctggcctcttaggcctattcaccaataagctaacattcgccagtcggctcatggaaggcccatgtatccaaattacactgtgtacccacataaatgtccctttcataagggcaaccgtgtaaattcccctgtaaaacctaaaccctaatgcgggaacctgtaataggattataaatagccccctagggccatgtaaagggggatcccaagaaaaattttaatcaattagtatatttactatttccaatactgttgagtaaccacgtccttcgacgtacgcggttgtcacttcgacaacattatttgtgtgccgagaagaaaatcaagccacaagaattaaattggtgggtagattaaaagaaaggatttgaatatttggatcaagaatcaaaggataggttaacaaataattccaataacatcggaattgcaagggtttggtttgaaggattttccttggaccacaatttataaaataaaaagggtttacaaactaaatttgaataaaatgaattttgccaaaagaaggttttaaattaaaaccaaatcaggaaatatcccaagataaattttaaaggagaaccacaaaagaaatacaagagattttatgcaagtcagtttttaggaggtctctctaattatattttcatatgtttagaaggttaataagaacgtaagaaccggcatgatgcataattagaaaatagctaatttttagtacgttacacccagccaacttggccgactcagtctccatccaaccgagccgctgcatgctgcgtgttgcacagaacgcactcatttctcaatttctcactccaatctccttcgtgaacaccggcacttacacgcacacctcgtgaagcccgttgtgaagatctctctcatacaatgtctatccaccgtgtgccatctgtatccaacttcgtcacccggtatccttgaccatctggacctcaactcttccctgagtctagtctcgatccccaccgttgaccgaagttgacctccaagaatcctgactctagtcaccttgtcacatggtatcccgaccgcactagacctcttctcctccctgagcatattcccggtcctcaccattgactaatgctgatctcaagtcacctgcacacaatcagacaaaacaactgttcctgggcacatatatcacaacctgacccacattaatcacacacactcacatcaacatccacacatcttttcattgattaaattattttacaaagccaattgttcatcacaaatattaattatgacaatgatttcacatttgggagatcaaccaatgaatagtataacaagatgatgaatagtgaaagaggaaaagggtgagcaagggtgatggatagagaatggataaataaggaatatttagaccaatggattttttttggggattttatacccttctggcttctggttgaaatacctagagtattcatagaaaaaacaaaatagagtcctaagaatccaataaatattccacactttgagtgatcgagagaatcaattgaggagcaaagcaaagttataattttgtgttacttaaaaaaaaccccaagttgttcttcatgaaaagttagggtgacttgagtcaagattgttccatttctcaattgctcaggatcgcatggtagacactacaaagacccacaagtacatgtatggctttgaataatttgtttgcataattattagtaaggaagtcataaccctattgtagagtccatagccttcactcgggacgagcaaaggttaagtgtgggggtgttgttgatggtccttaaatcataatatttgatcgtcaatacttacataaaataaaattaaattatggtatccaacttagtggtagggattattactaatcatttccactagtattggtgaaatatgtgtatgcaagtattttgagaagaaaaaacatccgtcaaatgacaaactgcacctccgcgcattcaggacacatttacacatattggaggccctataagtcaattaaacaactctaaatgggcccaaccatcatgccaatgggctgagggcctcaaaattagtgtccacgaggaaaaatgggctgaacagagccgtcccgggttcggccgaacccttttggtggccgttgatctccaaattttacatggacggccttgatcacattctaatggcggttccggggtagtttgctcatttcgcatacgctgtaaccgtcatacctgcctataaaagaaggagctcactttcatttccaacacacaactttgagctgaattataagaggctctattgtatcttttgtacattagaatagggtagagagtgaggggaaactctggagaagtgcccgaaagtttggtgctcatccgacttctacctcgacgagtgtagcttcctaggaggaattctagaagagtaccggagctatcggtacactctgttccgggtctggagaacttcttctataaagtaagcatttgtgttcctttcttatgttatttaattactttgcttaagtaagatagatttccatctttgtgggttcattgtttagtatttatactaagtgctctagtactaggactctggataaagaagcaagttcatgcgtaattattagagtagtaattaataacttaggcgtggtgtctaggttagagattacctttgtttgttgtgtatcccacggattcgtcagaggtagacggcaggtggtgacaatcctagtaatcctctgttgacggtcattatcgatcagtttcgactgtcaatattactaaaataggagagaactagtgatgcttgcaatgcataagtatgttagaataataatattccactagtattaggagaatcgacatcacctcagactataaatcaatcggacgatgtcgagaaccagacttgtgtgtgaataggccatgaactcagaactgacatgatgaattgggccaaaattcacaagtctgtggagtggagcaatagaggaggccaccagccgaaattgggctagattcggccgaaccaatcctggcgccgttggatccaggttttggaatagacgtccaagattgcatcccaatgacggttggagggcacttcggacaattccccttccacaaccgtcataactacctttatataaggagctcactctcttcacttcaacacacacctcaagcaagagctctctcattcctctcaagtttagtttagtagtatctagctggtggaatagaattagaataggaatcacgagtcctgaagtctcagaagagtttgggtatggctctagcagctttcctttcctcttttgtaagctttgtacttttattagaatactcttctatatagatttatggtattgaaatactttctgagtatatgagtacctactttacattatgttcatgttatactgaatatacggctagcttatctaggagatgctttggtgcgggtatagtgtttgttatgcaattactctatgtcatgacgatgatattagagtagtatctgatagtttagacttggtgtctagattacgggatatcatatttggggttatatattgcggatgagaggtgggccgctgatggtgacagctcagtatggtattcctccgcgcctatatataatcctaagttaatttcctgaggagcgtattcctccgtatttagccccggttgtatggtcatgacgggctatcgtaaggaactcggcagtcaggggtggcttctcgaagtaccaggagggcatcggatagagggtattagctagtataccagttaactagaatgtatgtatactatgtatattagaagtataggaatagatttccttcctcttttctttccacttagcctatatgatatattatgaggacgagtagttaatgcttgtgtgtcactctacccttagattatcttaacccctacttagaatatgattctcacaagtaatatataaattattagttgagttctctctacatgatcttctcacggaataaaataaatacgataccttgaaatactctcggtgaaatgctacaatggtatatccgtgcatttgcggatgaactctgtaaccataatataccagaagtatttctgcactattgctgggaattatatttctagtaatgtcgttaagaaataccaacaaaagacttatacttactgcacaaggtgatttagcaattaatggatgctatacttaccaagtattaaggaggtacttcctgactaatgagagagagatggtaggtgagaagaagctgaccacattgtgtgtatttatccctccatttaaatattctttcttttctcttttcttggtatccatggaatgtaatggaatgtagcatgcatgaccatttcagaaaacactatcattttgcaacgtcatttttttacatatctttgcaaaatgatattttcattgtgttacatttttggcatcaacaaacaatagtgaacatttttttctctgtagattataataaaattattttttggaatgtagcataaatatgtaaaataacaatcatgtgtttttatttaatatatgcctagtgatatatcattttttacaatgtcattttttggacaccaatattgcaaactgatacttctgaattgtcaacaaactgtagtccacattattttctctgtagattataacaagattatattttggaatgtagcatatatatgtaaaaataacagtcatgtgttttttatttcaatatatgccaagtcatatatcatttttacaatgtcatttttggacatcagttttgcgaaatgcatttttgaaattccattatttttgcaaatattgtattcgcatggtgagtggagaatcatcttgatatattatgtcccaataaaaccaaacttagattaaatttcaaaaaatacaaaacaagttgtttagattaactttaaaaaaatcaacatacctaatatctaatcgcgtggagtaatctgaatgttgccaatgaatctaactaagaaaagagtcagttcaccgctctccataggttacctagatacggggaaacggatacgtgatacgtggatatattatttttgaacaaataaggacacgtggatacgtctatatatataaaaaataaaaaaatacatattataaataagggcaaagttagtgtaaaagaatagaaaatcagcacaagttagagtatcgactgtggtggtaggttagtttgatgaagaaaatcaacagaacttaatggtcaaatagagctggaatttactttctgtcagaaaaaaaaaaactcacaggccaaagctgtctcctcgaacatctcacgaatatgcagtggcatgaattggagtgttcaatgcagcagtactactcatatcaacagtacctactatatgatgtgcctatatagcaacttcaccgggaggttcatctttgatggtcattactgacactatggaacacggttgcgaggtgcatatgaa

SEQ ID NO: 80176 - DNA, 738 bp, Oryza sativa
ccgcataggcagagaggacgctggcaccaaggtggtagtaggtatacacaaggatcgctacgccagtttggatcctcaacacctcggcgtctagccattgacgaaagccggtcggatttgtaatgaagcaagtggagaagagagtactgaatgtgactgagttttgaaagattgtgaggcctcactcgttaaggcgacttatataggcgcaaaaaatcgagtgatacccctgacatgtgaacgtggtggggtatggtgggtacgcctgattggcgccgaaagatacatgcatgatcggcgccgaaagttacattggtcgtatgcgccaaatggcgggcaaatactcgtatcatacgcgaataaaggagactgtatcggtgcggcagaaagtagtcgtgcatgcgccgaaaggtatcgtgcacatataacaacaacgtagtcattacacaagcatacagtactggaaagtgaagcctgcaataacaaattaatatgtcattataaaaaatattacagtgcaactaacttatagtaaaacactgttcgtacctctcgacaaaggagtcgtgaaccgtgagtagctcaccgacgtccgtgcccggaacgtcccaagctgagccccctgcaccgcagtaaggtgagaccggtgtcggtgatctatcgccgggtccaacaactgaggtgtatcctgacgtgccatctctgaaaaatatagtgtttcgtgttagaacaattcaa

SEQ ID NO: 80177 - DNA, 5457 bp, Oryza sativa
tgttttttgaatgtacaatgccaccttgctcattttctgctggtgatacatgacatgaaactaaagtttggactaatgtataagtatagagcataaaagacttcattttgtagtaagtatgagttcctatcaaaaatatgattgttaccatttatttagtcccaacatgcatgctaaattaaccactaattctacagttccctgacagagactacaagaatggatcagactaaaaaatacctccagaaaaaacaaaaaacttgatgctagcagctcaaccagtactgagatctacctctaggttaacagagctgacagcatccaactaaaagaactgcatctctaattaactgcaaaaaactgttactggtttgcagactaaaatttctcatatacctcactagttgaatgatcctcactgcatgtgtgataattcctcatttcttgggactggcacattgatctcatatatttagactgcactaagcatgataattacactgcagaaaaaaccagagcacaacctactccatcaaattagaacatcatcttaccaaaactcattcatgatctaaaacaagagcaccatacgcccacccatatccccttctgaatcgcttccataacaaaatgaaatgctactgcagggtacaatactacaatgtattagaaagaacaggagaacaaattacaactctcccaaaccaaatcaagaaacatgccatacatacaccaagaaaactaaagtactgaacgaacccccaagaatcaagcagcagctacaagggcacgcacaaacctagccgggcaaccgccggcgggcgtcgcgcagcgaggaggaggaggcggatctgcgcctcagcgcctcctctgccagtgagtcgcgccgccttggatcccccctgtccccgcctgcttggagccgtgtgcccgcgctgccggctcgccgcctcgtcgtcgttgcaccaactgccgcggtgccacccgccgcgcccacgcgttggtgcctgcgatgcaagcgctgagaccggagagcgagattgggagctaactagaggaggcggaaaccctagaggaggagaacggaaacccaggaggaggagaggaggggaataaggagaagagcttacccttctcgccggaggaggagtctcggcggtggcgcgtctcgccggagaaggaggcgtggcggcgcccgctgttgttcgcgcgagagagaagcgactccggttgcgcgagcgagaagcagcggcggatcgagagaggaaaaattcccgacctccggaggtcagggacctttccctagggtttccccgcggattgggccgggaaatccctgcctcgtgggcttccaaatggacatggaataaaacccgtgacaatttcccccgtgggcttttctcccagggaatgggctgggatcccggtgggatcccgggctgccaaaggagcctaagaagaggtatgggcagtattgtgattacgaaattcactgaaactttatgaaacatgacaaaggagtctaatcggtaatacagtaacacggagagtacaagagaagttacatacgacttgagcccttatttccaggtctttcggtgctgaaagtgaattgggagccaaaaattctaacgacaaaccgcgtgcaggaggctgctaagaaattattgcctagaattatttggttccaatgttgacagatgccaccaatggccaaataagttaaaacatctgtcgctgcaattccggagatactctgatagataatgacctagcttgactattctgatagatactccgaaaaagttgatgcatactcgcgcttaatttactgtttgtttttgtcgatttatgcaatgtaatatgctaataacgatagcacgatcgacgactagatttttatctaaggtgcatgtactgctaccggcataatctaaaattaatggacgctcttgattgctcgcagaggagaaaaaagaactgcttttttaattaaaagaatagtatattatatatttttactgtgaatatatgataggacgacacgcttaaatttttatctaggcctgccatctatcggtatgatctaaagctctgattccaagaggtatttcttccgcgtgcttttagcggttgcgttgcgttagccttcctgtgctattcatagcctagctactccgttagttcgggcaagcaaaagttgagttcactctactactccgagactcctgagtgtttctgcaaaaacttgaggagaggggagagggtgatatccatggagatggccgacccagctgagagaagacggacgatcctgcgtcgtcgtctcgtcgacgagaaaactccatagcgtttcatctccgcttggcgatcatgttggtgatgatgctgagaaagctattactaaataccttcgtttaccctatgcccgtaggcatttgggatgaacaatgccaggtacgtccaccggccagatgatgtacaacgcatgcatttcctgacgtggctgacaacgtgagttacaacgtaaaatccggctatgtcgatcatgaaactgatggatcaccttaattacttttgatgcatgcagctggtttataagacaattatggcggtactccatgcgctcaatccgatactacggccacgtacacttggtcacaactcaggaacgcgtcgtgatatcttcggctcatcgccaggaggaggagatgccggccggcacgttttggtcgatattctgtcccatatttgttttaaattattttatcgttcaagctatattctactcactccatcccaaaaaagaaacatatccggtgaaaacgagctaagagctgaaactcgtgaaaatcatacctcaaagttttataaatttataaaaaaaattactagaaataggtgtagatatcaaatacattctcaccaaatcttaagtttaaactcaactttgtttaggacttaaaaaaaaagaaagttcaggtaaatagtaacatgatactattcagccaaaatttgccccttttttctattaaacgaagttgagtttggagttaagaattggtgagaatatttttcatatctacacctatctctagtaattatttaatgaatttacagaacttttaggtatgattttcacgagtttccaacccttagctcgttttcactggatatatcctccaaaaaaaaagtcaacttatacaaggatgggacacttcctacatgttaagattcattatactatgaagtgtcccattcttatctaggttggttttttttgggacggggagagtatgttaaacatgtctgtttgattatgtatagagtgattttataatatttgagaaggtatatattgagagtataaattttgatggtatctctcaggaagtgtaaattaaaattccccttagaaataagtatagtttaacaaactgataccatggttgccagttcaacgtaaaattatggtcatgtgattgtttgtgtatttacaatatgatgaactcgaccgtcttacttttgctgcagttccgaagcgaggaatctatggccgtcagttgtcagcagaacgagatacgacttggccacagctcatcaggggaacgagtactacaccctttcgctagaggtggtgcaggtggcggcgctcctttcgctcatggggaggagcacattgccatcgatattgatctgctactgcaagccactcccaatatattttctgcgcgagaagctagtccaactcctgtaagttgtccctacgctgacagccaattattaatactatcattagctagttcgtgaattagttcttcacgggttgcaacttaactacgatttttttttctttttgcgaactagaacgtgctagtgcctaaacttattgttccaataacaatgccttttattaggacttctatatagggataatgcttctcaaccgacgcatcggacgccaccgtttgactgcataaatcagccaggcaaagatgctttatgtgcatagcctcatgtactaaggcagggtttagttcccaaattttttttttcaaaaacatcacattaaatctttggacacatgtatgtatggagcattaaatctctactattataaaaactacctgggtggcccgcataattacgcggctagtacccatataaaattatctatttttaatatggttttacttaaattttatttaaattttattaaatagttatcttgttgtcttaatattttgaaagaccaaagcttatcatctacatatttctaattttatagttttcaaaaatcatattagttatccttacttttttgtcacccttccttttttttttgctttctcgatctaccattgcttctattcattctcgttgaatcctttaaaaattagacattgtagtttttagattttattgtctcgttgggttttatttttataatttttagaagtcccatcaaacgatgccaccatactcctctaaggcccgtccagtgcctctttttttttactgtcattgggattttaaaagtcaaatataattatcttttgagtttattttttactttctagaagtcctaccaaaccatcactggctttgccactatattcctgtacagccctctcctttttttctttcaaattttaaaaatcgaacatgattatcataggggtttattttttagaagtcccgctaaccgccgtgatcgtgcatctgaacggtttgtctgtcgtccctccttttaatcattattgggattctatttgggttatgttaataatttttagatgtcacatcaatagttaccactctacttttttacaggagttttacttctcccctcttacttgtcatttgttatcatttgttaatgtttaaaagtcccgtcaaacgctgccaccatattcttctttgattcgtccactgcctgctctctttattgtcaatgggattttaaaaatcgaacataattatcgtttgggttcatcttttactttctagaagtcctaccaaactatcagtggctttgccactatacttctcaatggcttgcccactccctccctctttaatgtctttgagattttaagaatctgaacttgattatcatttttttttactttttagaagtcccgccaactgttgtgacagtgttgcttaacgacatgtccatcgtccctacttttaattgtcattgagattttattttgggttttgttaaaatattttagatgtccaatctaccaccaccactttactcctttaaaggcatgttgcttctcctctctttattgttatttgtcagcgtttgtattctagataaacttcttttttgtaaagtccatatttttcattccaatattttttatttataaattatattcctacttgaactcttacaagtatttttctattttttagaatttatttttaattattctcgtcata

SEQ ID NO: 80178 - DNA, 2893 bp, Oryza sativa
tctactattataaaaattaaagatgtttttaccggtattttggtacgtcatccgtgtatgagttagtttttaagttcgtttgattttggaaatacacactcgtatatgagtcggtttttttaagatcgttcacttctggtaatacagaaggaatcatataagaaatatgtttaaaaaaaacttgcatcttaacttgagacgatcggactccttactgcagctcatgattttctatatatatatatatatatatatatatatatatatatatatatatatatatatatatatatatatatatatatatatatatccaagtgaacttccacagtgaatttcatcttaactaaaccatataacaataataagattaaaatagacttaacctgatgcaacgcacgaatatttttttctattttttctagtatagataaaaataaaaactaattacatagtttgtatggaaatcgtgagacgaattttttgagcctaattagtccatgattagccataagtgctacagtaacccgcatgtgctaatgacggtttaattaggctcaaaagattcgtctcgcggttatttttcattcgtgtccgaaaaccccttccgacatctggtaaaacatccgatatgacatccaatttttttttttcccaaacaacacaccttaatgcattatgcctttccctgtgcaactggtgctatctcccccttacccttagccttactcttgcatgcatataaggcttaatttattagtaagcttaaaatatttcttctcttggattacttatctggtctaccatccaaccacatcattgtattcgttgcaattaaatcattacaataagatattgcatgattatattctaatgaaaggaaaacatatgtttcaacaagtatttcaagaaaaaatgttttaatggctaaatttgttttcaccatgtaaaatttaatgtttgactggtgatcaattaaaacatttgaccgctaatttttgggaggaaatcagacatcctattggtagtagctttggttgtaagaaataatctgtacttattttcttattcgatagatcatatatatctatttataccaccaccataaatattggtaatgaaattaagtgagtataatttattatttttactggtagtgaaatacatgaatcaatgactaagactagttctaccgatgagactactatataacctgcacgctgtgggtccatacccacgctaatactagcctgtgtacattgttatcaccatagttatattgtgatgcccttctctatctaaaggattgtctggtaacagattctgatactaactccatcccctaccactattatataacttaaagtttaattgtaactactaggactgtgtatatttgacacttattctaatatacgccacatagatcatagaatcatcatgttgatccaccgatcctttagacttgagttgtcttctattgcacctccaccaagaagcgatagttagcctcctgacgaggttgtagtaagcttacagccactaaaaatagtaagcttaccgccactaaaaataatagctatctcataaactactactttagtctgaactccatatgcaatagtgtaccctcacacctcgtaaagctccgactccaccttcactctagccatcatcaaagtcatcttgcccttcataatttcaatagtattcttattccaaccagcttgaaatattgacccttcttcatgcaaggtttcaaactaaatcacaattcttttttgccctgatgcatgcctggctccttgaagaacatattcgcctccatctttcgtcttggttttcacttctcctgctcccatgactagataccctgcgtcatgcctaagtagacaaaacaaaactcacttgactgattggcatgaagagaatcattccttcctaggtatcacataaaacgacccaaccgagtacaatatataaaacgacccaaccgagtacaatatatgcgcttccggcttccgcatcattaagctatatgattgataatgtaagaagatcaccactagtatctttgagtcacttgaagaactcaccgcattaaccctaactcttatccttcagtgttggacaatcttgcttttatgtcccccaatcatcacatctaaagcaatgcaccatattccttttttatttttctttaccttattatgccctgcatgcttttttttgactggcaaaccttctacccgagaagtttcatgttcttcgtttctttctcatctgatcagaaaacagcaacatagaagtgatatctttaacttggattattttcatacgttatagtagtcaccacatgctcatatgatttaggttattaactttcacacccatctttgcattgttcacatgttctggcggatctgactcttcctatatctttagccctaacaaactcatgcttcaaatacatcttattagttagtcttggacataaataagtcaccaactttttttttctaaactgtctttggtgagctctccctcgtcgacctgaactgagacataaccgtatatcatcatatggattgatatcctctaacttacttccccacatgtcagtgactcaaaataagagggaagtaagttagaggatcctcttccatcaacatatatagctgcctgcaagtacatctccctggcctcagtggtcaaatctattgggactatcatattcgacacttattctaattatactacctgcagtaattatgtgaattagaagcttgtaacttgtaagattttgctaggacaatattttggatgttggcaataagctctttaaacataaatgcattcatatcttagttcatcaccatataattaagggaaa

SEQ ID NO: 80179 - DNA, 15997 bp, Oryza sativa
ttaaattgcttagtttttgctataaacagctcattgccatattcattaatttcgttagttttactattaagggtacaggggcttagttttactacaagcagtgagatgccgtattaatgggaatcacttcaagggggcttctcagtgtctgacatgttaattacaccatattaacatgtaaggtgcagccagcgctggcatcagtcggctctgttacatatctagtgttgttagagcgagtacaatagagtcagttgtaagcacacatgtaagagaaaagagaaaagagagaaggaaagtgggctacatagttgtagccagctgcaacacagactccaatacattgtgtgtacgaaaagtgggaccatatattaataatgtagtatatacttataggtaactattgtatgaatgagttattatgcttataggtaactattgtacgaatgagttattagattggctgtagataaactgaagctgtagttggctatactattaaacttgctcttaagggcagtagatggttacgattttccttctagattctagtaatgaaatagcatgccgccattaattataaaccaaacatgttattctagtcatgcaaaaacatttaagggcagtaggtggttacgattcttcttctagattctagtaatgaaaaagcgtgccaccattataaaccaaacatgttattctagtcatgcaaaaacagtctcaaatctataattttgtaataaattaatcaaaatacatgtaattttgtgaaattactttcattataaaccaaacacgtctaactttatagcgtgtttgattgaaaaaaataatatgatgtgctaaataatggatttcgtttctgttaatttcatttgttgcaggtgactccagatgaccgggtcgttgttgcacaaactttgcagacaatattagctagtattttacctttatgtgctgcatcgcggcctctttttaaggatggtcctgagtacgccaaggtcgtgacgtttggttttctgggtactatcgttcttgtcgcttatgctggggtgtttgccaaggcggccaacagcaaggccgcgttgaggctggtggtttctgcagctattgctgccatgacatttgccgtggcctctcagctatctggaatagggtacattgttaccgcttcacttactggtgccatcatggcggccttcataatgctggcagtataattcacgcccggcccccgctgctgtgaacggtaagagaattcatttagcggctagtagcagtagctaaagttttcactgtttcatttactccctatggggtgtatagtctcgtgcgttctattctatcccagtttaattatcacatagttcttgagttctttccaaaataatcatcatctaacaagtacatatttatttatttatttatttatgtaaagagaaaatgagtatcattgaacgctacacgcaaccaactaaaattaattcttataggtacaattacatgcaatatttaaaccttgatgcaatccacgggatacaaatcaacgtattaccttaacagatgagaattaattacagaataacgaaggtttagttgtcaatggtctctacgctatttgtttaggtgatgatcaaaatatagaatggagggattatcatattagaattagtactctaattcctgcacatatctaccattcatccatacagagcattttagaattaatcttaattagttcacacatatctaaccattcaacaaaatatatcgtatagtagagttgcagttttctatattgtttaagtttaagattaagattttacctcaatttccgttagcatgattttcaaactattatacggtgtgttccgtgtgaaaactttctatatagaaattactttaaaatatcaaatatatctatttctagagttgaacaaactattttatccatttatagaattatgtatgctttataaaagtacataagaacagtatctttcatgaatgcttgcttctgattattttatcttttcaacgtcagcagatggagcgggcgccggccacctgagttccaggagaaagaagcaatggaaaccaattgtatttgactgggtgattatgttgacaagatttttgctgtgtagtccttttcaaaatgtaaaaaatgtacgacgtcgttcattttttttaaacgtttgaccattcatcttattcaaaaattttagtataagtatataaaagtataagttaagattatattttatttaaaacaaatcaaaaaaaataaatagtatttttttaaaaaaataaataagataaatagtcaaacgttatgaaaaagtcaacgaaaccatacattttgaaattgaggaaacatcacagttacatacattttaaaattgaggaagtatcacagttgacatactaaacctcagcaatgtgttgctgtccgatcgatccgtgccataagggcatgcgagaacatttcgcagacactggttgcattatcaaataactcgaatcattggtgtgcagactttgacgtgttctgttgcatctttttgggttacttgtcatttgctatgcactctttgctataagatgacactttactcaggtagtgcacacattgcttaggtgatcatacaataatatgagcttcgttttgcgtgccggttcaacccctcctcccgaacacagcctaagtcgcccttcttaccgtttctgtcgaagttgtcgtcgccttagtcgccagagcaccataccacaccacccccaaccctattggccatcgtctgtccgttacgatttacacacccgttattttggttcagtcgtgtgacaacacactccgttgtgtactattcgaagcaatgacaaatgaagcaccaagagcaaggttaataggagagcccgttgttggttccaattagtagccatgtcatctatattaaatcttatagccaatctgtagtgcaaaagatgcattgtaacacgaatattttattaattttgtgggggccgccatcttccccaatctcttcctctcatctcttctctcccggttgtggatgcagggaatgacggtgtacctgcggcggctaaggcggaaaaagacgacggatgtggcagaggtggaaaagagcaacgtcagtggctactgtggacaatggccgcagcggcggcagatagacgcaacgagcgcggaggacgatctgcggggaaaaaccacaacaacggtggcaaaaacggatgtaggcgaccgaggcaggtggaatactggaatagaattgcaacgggggcggaagagggcgacggcaacggcgcgatggacgagggcagcggcgacgccgggcataatggacaagggtggcggatgcagttgacggcaacatcggtcatggcggacaaacacagcaggggcggacgtagtcatcaacgacagtgatagtggccacggcggacgttggcgacgccggcatacatgacgactgcgacctggttgagcgcgacggcgacgaaaacaggcaagagcagctcgcgcggtaacggtgtctgtgggcacggtgaatgcagacggaagcggcggcgcgagcgagagtggtgagacaggcacaggagatggcagcggccgcggtggacgaggatggccgccgcgggcgtggatggcgagacggacgtgggccactgccgcggaggacgaggacggtggcgaacatgaacggggacggacgcaaacgaggatggagcgatggcagccgtggcgggatgactgcaggcgaagacggtggccgcggaagacagcaatggcggcggccagggaggacgaggacgacagcatccacgaccgcgagtggggtgcgggacggcggcagccaaggccgcgggcgagggtgcgggcgacggcggcggcctcagaagacagcgacgacggcagccacgaccacgggcaagggtacgagcgggggtggcagcggcggcggcctcgaaagatagcgacggccgcaaccacgaccgtgggaaagggtgtgggacggcgtcggccacggaagaccgtgaacacaaaaggatgcgctgagccactgaggcacgggcgccgctagcgcgtgccatcgttgtgggccccacgcctcgggccacgcatatagccaggcaactaattagtcgcccgcctgttctctctcttcccctctcttctagctcaacaaaaatcctacgtggatctcttaccatccattattgtacttgctctaatgtgataatgaaaaatgatcataataaatcaacgggaaacataatatttcgtattgtggtaacataactctaattttaattcaacaataaacgtgtctaagtgagcgtagcttaactgattaggtttcttgtggtgcaaccaggttcaagtcccaaatttaacacggatgctcgtatttacaagtaatttttttagtggtagacgacatacccgtcgacaacaagatccattttcacaatgcttattatcagcaggttatggtctttgcagtttgcactgaactatctcagacccaccatggatcatccgagcatcatttggtacattacatgctgtacaagtcacagcaagaaaaccctgtaagttccatcttgtcccccagtgttctagtggagtaatttcctgccaacctcagtctacttccctacaagctaaagtgtcactgatcacgctgtccaagaaacaacatggaaaaaaactcgttgttctgtgtgtctaatctttgttctttctctctaaaccaagacaggccgctcttacaggccctcaatctcgagtgccttgcgcactatccaaaccaccctctctgcaacacaacagtaataaagcctaagtgacaaaaaggaaacagcagcaaactaaaataacatacttctgcgctgttttgtttttgtttatttcaatttaaatcataaattaagctaccacttacagttattaatggtgtgtttaagctatagctagaggaaaaactccaaataatgaacaaaagtgcccctaaaataatcttataggcattgttaatttcattctaacaattgcattaatagcagtaaatctagctacagcttaactgatagtgtaagcctctattaaaaacaaattcgacaagaaaacgaactaacctctctccaagcgtcgtgcatcctggatagccactgcagcatacacaggtaggatgacagctgcaaatagaaggggcagtaacgacaggctatcaagccaggtcttggaataggcagccataacatagccaataaaaagcgcaagcaaccctccagcgaagacaatggtacgctgcaaaacaagagaagcacaccaaaaaaggaagggaatcatatatccatgggaagtacaaagattacattgcattatcagaattagtcattaactgacgactccttctcatttcgattttcatacggagtctattagactcaaaactcaatcacacaaattatttcattatgtcaactcagaaagggtatcttttttaagcagtcttagttcccaacttaaccaaagacaaaaggtatcacatgttactaacttactatatctaacagttttgcatttcgttaactatatcatgtattttgtatttatatgattttgtttatcacaagtaaaaacttgcccatttttaaatgcaaacacaagaatgaaactcaccatgcagaagtaaaaaacccagttcctagtgatcgcgacaaccgcctctgccgctgcggtcgccggtgtaaaaaaagctgctatctccatggggctccgcctcctcctaacccctccagcttccatgctgataaggtgtttggtttagagcagggaaagcatcaacaagaaaaaacaacactatccaccagctaacaagtgtttacacatgcaaaagcaaggaatcatatagcaaagataaaggataatgtcagggaggtgaggcatcggacttgttcagtcaaacaaaatgctcatggtcactagtgcttaaatctggaagttcacactcctaaagacagtttcggttgtgaaaagtttccgtttttctcattgcataatagtaaccagccaagcaatcaactagacagtcattaccacacaaatgaaccagatttgaagtcaaatgtgtgggggaaattttagggcttgggaaaataataccttcggtcgtggttacccgccgtgcgccgccctctcagactccttcagccgcagccctccgccgcgccgccggccgtcgggttttgggaggagtgggggaagacacagggagggagggagggagggcgccgcctccgcctccgcctccgacgtgcgccgccgaccccgacgacgacgtgcgacttccctcccgccgcctctccttcctttctcctgcttcgaggggtagggcggaatggggtaatggggttgggagttgggacggaaggggtagggcggtggcaatttacccgtaatttggacgaaacttaatgggtagcggtgtcatcatgtcatccggttcaattcactctagttcaatttttagttggattttcccaaaccgccggggcgggatcaccgcgccctgacgataagcacgaaaccctgtaaaaattatcaaaattttaaattatattttaactttatttgaatttaaggaggttaccgtggtttttcttttactataccccgtggtaagggcggttaccggcggttttgcaaaccctggttggatccttttgggcggaggtgtcgtattctctaccagtgtcttctccctcctaatcatgagttcacgacatccggcggcaggcagatgaggctaagatttataaaaagaacatctagtttgatcgtcgatttttgagattttggaaagatgagtgctctagcttctgttttctagtttattttctggattctagaattacagtttctcataatctaaacgaaaagtttaactgtttggaggagcttctgattctgcggctgctagaaactccctaaacaaggctacacaatgttggtaactacgacataaggtattattactgactttaattttgttaatttatgtgggaacttcattgaaaaaattgaaacggaactatagtaataaaaatataaactagagagatggaacgtggtctatatcgctccacagtttcactcaagagatggctcttgtagttagttgtaggagttagagtcttatcaaaccaaacatgccctaatcgtgtggttgtgctctagctctaataaaaggtggatataggagctagagctctgaaaaaaccgttagtttcccacgacaccttgttgagtttatctactaacatatgctaacacaggatagggatcgtcgtgtaataacttgtcctccagaaccgcacaacacgacgcatccgacgagcgggtccgcttacacatatcacccgaaaagcgaggtgatatgtgtaagttggcccgcctgttggataggtgaggctacaagattagaaatctaagtgggcctttgtagaaaagtggttccttaataagagaagcttaccaaagtcatcgatgcaaatttctctgcaacaacgagcaccacatgtggctcaccacaaggtcgtcagtactgcaaaggagctcgttggacaagacgagcgcataagctcatcaccatcgtccttgattgcatagtgctcatgccccacggagagagctgacatcgacaatgacgcgaggcatctagtggaataaaagcatatgagagagaacaacgaggagggtggagaaatatccactaaatacgtatgtcttttcaaaatttggcatccaatccacgtatctttcaaattttgctatggggatgcgaattactaagttccatatcactccgttcgttatccatcatcgtagtccatctcgtctcactatatgtctgcctatataatacatatgagtaaacaccattgtcagatgactagaatagcataaactaaaaattcgtatatctgctgacatggattagatagcaaattccgaaggacatgcacatttatacatatccggtgccaaaacagtgaaatttcacgggaagagcgttcaatccaacggctcaaatcagccaccaactccccctgaaccaccatcgctagtcgctacagtgaattattgtctgtatttctttcagtagttgtatattccattttggcaacgccatcgccacgtcgcctcgccacccgaagcatcgaacccgaaacgctcaccccaaaattccccattccccaagccctaaccctagctttgatccgaccaccgcttcccctcccctcccatggacgacgacgccggcgacgcctcgccgccgccggccgccgcgggggttggcgccaccgccgcccagtcgcgggacatggcggcgtcgccgaccagctcccgctccgtgacggagacggtgaacggctcccaccgcttcgtgatccagggctactcgctcgccaaggggatgggcgtcgggaagcacatcgccagcgagaccttctccgtcggcggctaccagtgggcggtctacttctaccccgacgggaagaaccccgaggacaactccgcctacgtctccgtcttcatcgccctcgcctccgagggcaccgacgtccgcgccctcttcgagctcacgctgctcgaccagagcggcaagggcaagcacaaggtccactcccacttcgaccgctccctcgagtccggcccatacaccctcaagtaccgcggctccatgtggtaagcaaatcttctgcctcgatttggattcggtcgtgaggttggtgagttgcgttttatccattcgaatgtctagtttggatcggttagtgctgaattgcggatcgatgttggtagccaatgtgctatgtgtgattcagttgtgattgtcctgcaatggcgatttgagtattggcattatagttttcatgagattattgaggttcattcatgtgaataccatcatatcatatataatacttggcatttgcagctttacatttttagcagctcagaataccaatatatgtttctacaattatttgagttgggaggtgttagtgcccttgcaatagtttgttgtatgccatacagcttatatagtcacttttttagcggagttgatgcaaccatcagaactgcataatagaatttatagcccttgtgtttcagaagaaggaatcttaaaccttgtcttgaaactgtcaccttcttatgctttatattcattggttaggataagtttccttcttctattggactggccagtagccacccctaaaaatatttcatactgccaacatgcaatttgtgatttggttttgccgaattcatgcaaccactgtgttgtttgatttacctggctttcatgctttgggattgcttcattggaacattatgcattagctactgtcaagggattttggaatggttttaaacttttaatgcaatctgttgtcagcgattttttttgaactgttttgttagtttagatgcgtaccaatagcttattgttgtttcagattcgtacatttgaatctaactgaagtgacagataccattttactgaaatacggaaggtgagactcctattctgtactggtatgttagatataaatggcaaagacttctatctgacaatcgatatgcttaatgagtgtccattcttgtgttttgaaatatacagttaactatcttatcagtttctgataatcaattttattctcctttctttcaggggttacaaaaggttctttcggcgaaccgctcttgagacgtcggactttttgaaagatgattgcttgaagataaattgcactgtgggtgttgtggtgtcgactattgattactccagaccacactctatcctggttccagactctgatataggctatcattttggtacgcttttggacaatcatgaaggggtcgatgttgttcttagtgtgggaggagagagatttcatgcacataagttggtgttggctgcacgatctactgtatttagatcaaaatttttcgatgatgaggatggggagaagaatgagcctggtgagaatgatgatgtacaagagattgttattgatgatatggaaccaaaggttttcaaggtttgttccagcttcttattttgaatttattttatccttgtagctttagaagttcagaataagcacttactaatgcgaatttctttgcaggcaatgcttcattttatctacagagatacacttgttgatgataacgagttgggtgggtcaagctctgagggctctatcttcgatacattggcagcgaagttgttggctgcagcagacaagtatgacttagcaaggctaagattgctatgtgaatcttacttgtgcaaagccatttctgtggctacagttgcaagtactctagcattggctgatcgacaccatgctatggagcttaaagctgtttgcctaaagtttgctgcagaaaacctttcaggtgtgtaccttacattcacatcaattctggtttgcattcattgcgtcctatgggcccaattttggccctattttatgtcaatcaaaatgcttcagcatggagctgtgaatctgcaaaatatcttgatttggttcaataaataaattttagccctgtgtgcccagtgtgttcatttgtttggtcatgttgccatgggaaaagttccttgtactcatcattaaaacttaacaattgttcgttgtagacgcatccatgctttcagtatctgaaccaataacaaattctttagaccagcacagtttcatgttgtcaggtttgattttttttcttcggcagcttacagcatgttaaaaatgtgcactggctgcaaatttcttttaaagctctcaaaaattaaatgggaagtagcatgtgcatacttctggtatcttgttgcatttgttctattggtgatacagaacagaatacctgaaacgtgttaaggaagaagcgattataaaactatttatgttcttaaactggactggtacagcttgctagataaatagtggttaagtttgcaagtggagaataatattatgagatgagcggcatttactttttggtcagaattttagctctgttaaaattccattaacatatacaatttaattatttcagtaatttcatattttaaccattgtgcctggaaaattattgcttccacgtgtcatcgattgaaatctttaccttttggttgctttctggatgcaattatgtttatacggtttcataacattccagatacccttatgtctctgcagctgtaatccggaccgaaggattcgattacctcaaggacaactgcccatcacttcaatccgagatactgagaactctcgccggctgcgaagaggagtgcagcagcggcggcaagagccagagcgtgtggggtcagctctcggatggtggtgacacgagtggccgtagggttaggccaagaacctaaaagacccaccacataacactgaccttgtttagcgagcacctgtgtaaatggcgacatcaatatcatctgtatgtgacaaagatgagatctgatagttgacttggacttcatctcatcacgctctttttgcatcgtaattgctatgctgtttataagtttagctgattgtatttgatcctgtgacccgttgctgctgtgcggacgcttccataaactcactacaaaatggtgattttttgggacttgttcgaatcagctttcttctgctagtaacagatttgttttagctctctttagtttcgacttggatttatttgatcgaattggatggttatgctcagaaggtaaaaacttgcaaaggatttttgttcttaaccaaagggtcttggtttagaaattttgatatcttagcatactcacgcctgtgtggctgtgtgtggtttatggacgcttcctgtttgattagttatggacacttacattggttggatgagacaacctcaatccccgtccacacacagggattttatcaaaaaaaaaaagaaattattgaataaaagtgtgaattagagaaacttcgatgtgacttgagaaaaccaaacatcctgcaaagcggttgctttctcacgatccagcacttggattggcagatcccacggcgacgacacccattccgcctccttccgcggatctaacgcccttgcgtcttctcagctccccttctgtagagttcacccatttgccatctttatccatgtcttgcacaagctcatcgatcttccggaattgataaggccatcttgcgttgtacagaaattgccgaagatcgaaccggttatcctcgggcgaatagctctacagaaattgtccaacggcccaggttacagcagtgaagaaaagatcagatgttcatacgcatatgcactgaaaaagggaaaaatgcagtacctccgcatgataggatggtgtcaggacagtcatcttatgccggtttatcgcgtagtacttgaagaagtgcttcactttgtcagccacttcggagggggatagtgtcccacaccacctgtggcacaggttctgcggcaatatatgttagcattgtagtttatgcgccaaactctgctgaaattttatgttttgcgttgatcataatagaatctgatgatttaaagatccatttcaaatttaccctgttagatcctacatttttcagatgtatatttcattagcaaggcaatgctctacaccaaaacagcattataaacaaatacgactgaacaagtttgagttaaagcatgtctaatgtatttattattgcataggttgattttttatgattatttaaagtactactactattgtttttaagataagtagcaggcagcagcatttttttccaaccttctctatcatccatcgctcatcctacaagtgaggtgaactgtagccaaccctttaacttactgtttacttcagtccattttatattacagttgttcttctatacttaaatataacaacagcagaatatgtaaaaagctccagaaaaagaaatcccataaaaaggaaaatcctcaacaaagcagacttactccttatagtaattactgaaaatgccatctcgtttggaacagtaaaactaccctttggtcaaatatgcatataatcaaaacagcatgactcggttagagagatgcatgagaacgctagagctctaggtgagagttcaagggaaaaataaactaaagaatacacaaagattaaagtttgctgtgataggaaatatcctcttctgattaagctatcaaaagcatatcaaattcatagagaccaacctgaaacattgaaacaggaccacaacggaaaattttccttaaccttccatatattgacaactcctcgtatgtcattcccatgtccacctcatccaactaattaagcacaaataatgtcatatgagaacaagactaaaacaagatgagcattctgataaaaaatgataaaattctgcagtagccaactaagctatttcatgcagaactgaatttaatgaataatctataattggaatgatcagttgcaacagataaacatatgtagttctggtttttaggccataattgtttctagctttaacattaaattcaagccttttgctgttttgcaatatgtgatagagctcatgattagacaaaccatgttgtaattttgaactggaaattagagatcaaatttccaggatatgtaattacctgattatagtccgcacggatcggctcaagctctgcagtaggtggcgccgcttcaacctcagcaagggaagaatagtgaagatgaactgctgcccatcgcaggaaagcccggaggtcctgcttacttacacttccaatgggatttatatctgccgagctgcagtcatacttcatagaagaaaaatatagttatttatcatttccagttagttccagatatgatgtacaaaatttacggattcagaattaagaattcattaaggaaatgctatatacgtggttcctcttatctttacttacaaaaaccaggcaaactggccaaggcattacatctaaaagttagaacatctgggttgcactagtatttgagcaacttactttcgtcaaataaccacgcaatccttcatccacatttgaacttcccagaacaagatagaacccggatttgttatgaacccatggcataagtgacgccatcataaaggctagtaccatcctgattcgagcttgaatattttgcaatcccagattctcagtattggaacccccatcaacctgaattattttagcataaatagtagtcaacaaaatgtaataagaatgaaatgataagacataagggagtcaccgctcatgctaacttccatgtttgcaatctgattttcagatgatgtcagataaaccattgcagtcacaattgttcgttagaacttaaaccaagacaataatattaagttttgtcctcgacaagtgtataaataataacatattacagtttatccaaagagcattgtcaacaaggtgtcaaggtgtgacaggcgtcaaggtgatcagttagcaagcttgtgtagcagatcacctttgccttgagaccagattaaaacaaataatagaacctgatggtgcatcaaccaacttttggggtggcagatcactaccagatcgtgctacatatccaggtcaccaggctctgtagcaagacctttggtagtgagctcagaccatcactgctggatttgactacatgtggcagccactttcaccaatactgctaaccatggccacagtccacttaactccttcagcaatggctggtactcagctcctaccactagctcactgctgtatgggtgcggtgagttggccatgtggacttattgggcatcatgggttatgaggacccttgccattcattggcaatttaactatccgataacctcttttatgagctatacagtaaaaaagtacttcgtatatatcattgcaataatgccaacacatcaatgctttactgattaaggattgtcctttcatatttcaaactaaaacatcatacttcattgccacgttccatgtttaactatttacgctatttgcattccactttagcccacaataaattaaagacagtggtctaactgaactacacagtagaacaatgcatgcactttcttggtctcagtgtttatgcaattactggtagatttcttccagaccagtcttcattgccctggatcatatttttactacacatgggaatattttgcatctcattgttgttggataaacgtgtctttatagcctttgcagaaaaaaaaacacttccaaaaggataaaaacagcaagtccgcacatgtcaactcaactcctagaatgcagtcatgcaatttatgtaggaaattagagtagcatatcacaaataccttgtaccgtgggcgtttcccagtcaatctttcaaacaaagaaagcaatgcagatactatactatcaattggtacatccaagtggaatgaaccgatctcttcagcaagcattttcgctcgtgatcgagtaccttcagaactgtgacaaaaaagtagaacagtatgctagatgaataaaaagttactgttatagcatatatagataaatttacatacgaaatcgagaaatagtccatgcatcattgacatagattgatcatcagcatgtgtagccaatttcctctagtctaagacccttttgtcgtactcgcttatgagaatttggatcatctatgcaaacttcagaaacaataatatgcaatacatgtcagaaatgttattttcagttatattagaaaaaatataaatgatacaggaaaatagggtttgttagtgtcaatactggttttatcatattatttactagtatgttctttcaaaggtgttttgagttgcttattgctagaatctagcattgtcttataatctggtactccctctg

SEQ ID NO: 80180 - DNA, 2963 bp, Oryza sativa
tttcctaaacggagagctggaggaggagatctatatggatcaaccagacgggtatgtactagaaggtcaggagggaatggtgtgtaaactattgaaatccttgtatggcctcaagcaagcacctaagcaatggcatgagaagtttgacaccacgcttacatctgcaggctttgttgtgaacgaagctgacaaatgtgtatactatcgctatggtgggggagaaggggtgatcttgtgcttatatgtcgatgacatactgatctttgggaccagccttaatgtgattgaggaggtcaaagactatctgtccaagagttttgaaatgaaagatttgggagaggctgatgttattcttaacatcaaactacaaagaggagatgagggtgggattacacttgtgcaatcccactatgtggacaaggttttgagtcgctttggatatagtgactgcaagccagctcctactccttatgatcccagcgtgctattaaggaaaaaccgaagaatagcaagggatcagctgagatactctcaaatcattggttcattgatgtacttggctagcgcaacgaggcctgacatctcatttgctgtaagcaagctgagccggtttgtctcaaatccgggagatgatcattggcgggctctggaaagagtaatgcgctatctaaagggtactatgagctatggaattcactataccgggtatccaaaagtactagaagggtatagtgactcaaactggatatctgatgctgatgagataaaagccacaagtggatatgtgttcacacttggaggtggcgctgtttcctggaagtcttgcaagcagaccatcttaacgaggtcaacaatggaagcagaacttacagcactagatactgcgacagttgaggccgagtggcttcgtgaactcctgatggatttgccggtggttgaaaaaccagtgccagctatcctaatgaactgcgataatcaaatagtgattattaaagtgaacagttcaaaggacaacatgaagtcatctagacacatcaagagaagactgaaatctgtcagaaagcagaaaaactccggagtgatagcattggactatgtccaaacggctagaaatctggcagatcagtttaccaaggggctaccatgtaatgtgatagacagtgcatcgagggaaatgggcttgatacccacctaaggttgcataatagtggaaacctgtccattatgatcggagatcccgtgaatttggatggtgaaacaaactattgtgtgactgagagaagagacccttgaaaagggctcattttcatgatgtgcttctcttctttcctgcatggtaggatggcttatgtcttaatgtgatccgagtggcttttccaagcagagatgttgacctgcagaacatcttagaaggaacacacctatatgagttcgactgctagtcacagtctatgagatttgggtgatctctagatactcatgaaaggcctggagtatgacttataagctccaacccgagggaatactaatggttgcctagtatcagttatggaattgagtgaaacttaactgcacaagactgacaattcaaggcatagtccattgttcagttgtggtcaggtatagctccttttctaggtgaaagttcaacttaacagtcttcaccgaaacactggtatataaaagctgctatggaatagagagcattctcatgagccttgaaaatttggtggggattgttagatttaattgggtaattaatccatttaaatcaattaaatcaaataaattccaaggctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatggctagttgatgacatttagttgctctattcctcttcctattccattggtaacttacatcaattactcttaattgattgttggttgatggttgtgtagtgaaggatggttcatggctagttgatgacaattagttgctccattcctcttcctattccatgactcttactcttcatcttccattcctcttataaaatgggaatggatttgatctcccgcgagaaaaagaagacacactttcatccattttccaaagctgttgttgctacggtaatcccatcccgacgagtgtgtgcacacgcgttgggagagtaggcctccgaaaccacgcgttgctgcgacgtttgcacagacaggcgggcgatcatgtttttggggagcgcaaggcgcgactactcactgttcgtcaacatctacttcatcttcaccaacatgtcgaacactggagacaaggagaaggagactcccgtcaacaccaacggaggcaatactgcctcaaactccagcggaggaccattcttggggtataaccttattacattatttcaattagaagttttactgttaatgttcatcgcaatgtcaacattgtgtcattatgtgattgttgatgcttattcaacgttaagcatgctcatgttgattacattcaccactatcactggatcaaatcctattgtaaatatcatgtttattatcttgttattttggattaaaatatgccgaattatgaccaaatttccaacaagtccggcaactgcgagaagagcaacgacccggactgctgcgaggacggcaaggcgtacccgcagtaccggtgctcgccgccggtgacggcggccgccggcgccgtgctgacgctgaacagcttcgagaaggggaaggacggcggcgggccgtcggagtgctgtcgacggggtggttcgccggcatggcgcggtgcgggcaccgggtcatgatcacggcgagcggcggcagcgggaggtcggtggtggcgaaagtggtgga

SEQ ID NO: 80181 - DNA, 6619 bp, Oryza sativa
agaaaagcggaacaagcctccgctgtcataaccttttccaacaaaagtcccatatttagatacgacacatttattggactcaaacacaagtctaaaatcttctctacacaatagagagccgctaactagattcttctttattgaagggacatgctgcacattcttcagctgcacggtctttcccgaagtaaacttcagatcgaccgtaccaacaccatgaacagccgcaagcgacccgtttcccatcaacaaggaggaacctctcccgacctgataagaagaaaatagagaaatgtcagcacatacatgaatattagcaccagtgtccacccaccaatcaggtgaatgaaaaacagagagaactgtaggtaatattttaccgtaccccgatgttcctccgccctcactaatgatcatgttggcagacttcctgtctttgcgctcaggacagtccttggcccaatgcccagacttgccacacacaaagcagtctccctttgcctttcccttgcttttcttcttaaaattggttgcagccttgggtttgacatcaggcttgactttcttgttgttgtgggatgcatgagggttcttcttctgtaccatattggcactagaacctccctcaacctttttgccccggacgtcctttgccctcgccttctcctcaacacccaaagagccaatgagatcaggaacactgaactcttgtctcttgtgctttagagaagtggcaaagtccgaccaagaaggtggtagtttggcaataatgccacctgccacaaacttgtccggcaactcacagttgttgttctcaagttccttagccagcatctgaatctcatgagcttgttcaactacagaacggtcatcgaccatcttgtagtcatagaactgctccataacatacagctcactgccggcgtcagaaactccgaacttggcctcaagtgcatcccgcatgtccttcccagaaggcatgtgcatgtacacgtccactatgttgtcagcgagtacactgatcaatgctccacggaacaggcaatccgaagcctcgaacttagcctcttcctcaggagaaagaggtggttcacttcgtttgccccgtgaaacatagaagcactgcatcgctgtcaaccacaatagtgcacgtgttttccatctcttatagtttgaaccatcaaaggcatgtggtttcagtgcagcagcaaagccaactaccgaaaatgacctatcaggtttttggattgttggaaatttggtcataattcggcatattttaatccaaaataacaagataataaacatgatatttacaataggatttgatccagtgatagtggtgaatgtaatcaacatgagcatgcttaacgttgaataagcatcaacaatcacataatgacacaatgttgacattgcgatgaacattaacagtaaaacttctaattgaaataatgtaataaggttataccccaagaatggtcctccgctggagtttgaggcagtattgcctccgttggtgttgacgggagtctccttctccttgtctccagtgttcgacatgttggtgaagatgaagtagatgttgacgaacagtgagtagtcgcgccttgcgctccccaaaaacatgatcgcccgcccgtctgtgcaaacgtcgcagcaacgcgtggtttcggaggcctactctcccaacgcgtgtgcacacactcgtcgggatgggattaccgtagcaacaacagctttggaaaatggatgaaagtgtgtcttctttttctcgcgggagatcaaatccattcccattttataagaggaatggaagatgaagagtaagagtcatggaataggaagaggaatggagcaactaattgtcatcaactagccatgaaccatccttcactacacaaccatcaaccaacaatcaattaagagtaattgatgtaagttaccaatggaataggaagaggaatagagcaactaaatgtcatcaactagccatgaaccatcctccactacacaaccatcaaccatccatcaattaggactaattgatataagttaccaattccttaatcaaatggattaattctcaaaactcttcatcccattgatatcccatagaagaatgaattcacatgaattcctagcataatgagccttggaatttatttgatttaattgatttaaatggattaattacccaattaaatctaacaggacttccccgggaggtagccgctgggacggcacgcgccgccggcgacggcgccggggcggagggaggaggcgaggtgggtggtggagagcgcggccaggaggaagatcatcgccatggcggccactgctctggcactcgccatcttagctagttgttgcgctaccttgttgtcttcagttttcttgatgagtttgtgctttgatttgcttgatggaatgggattagagatgcatgaggttatatagctttgttgcttgcattagttaatcaattggttttctggcacggcaatccgttgctgtgtgtgttcagatgtagctacacgttcacggactcgcattatctctcgacgaactgacgtgccgttccaaacgattctccaataccttttttttttattatctgtacgttgtgaatctctttaatttcgtgtctaacatgcataaaattgattgttaataatcgtgcttaattaagctttagttcaactaactcgcatgttcaattgattggtaataatcgtgcttaagattcacctctttagggcaacaacaatgcttaaaatcttggtgaaaatttaggacccatcatacttatgtttatgaccacaatgtatatcataaaatcttatagctcatttttatggcatattgtggatgttcttagtgtctgtcaaggaggcacacgagtgttattttttttagtgtgtgcattttttgtaaagtatagttttgtgagtattgagaaataccaagaaatgacttatttgagcacacagtactacagctgccgtaaatcagtgtacccattcctataagaatccgtaattttttttgcgataaaaaaaaccgtctttttttttcgataaaaaaaaccgttgtatagcataaaaaccgtcaaattcattattctgtcgaccaaccgtcaagtaaaaaccgccgagtcgtaagggaatattcagttttgttggccgccgaaagggaatgacctctttagcgttcttcagacaagaccacacaacctcgaattctcccacgctcgcgttgagcccaagcttctcccacaccaccggcgacccgccgacggcgttgttccggcacggcggcgcgaacccgtcctcctcgcggcacccgttcacggagtcgcaatcgtccaccaccctggcgaccacggacgatcgtccgctcgccgcgccggcgacggcgaagacgcggatcctccggtggcagcggcggcggccgccgccgaggcgcagccacccggaggacagcgcgaccaccagctccgtgttccggtggaagcgcatgtcgcaggacgtggggacgcctccgtcgtcctcgccgtggtcgaacaccttcagcgtcaggatcgccggcgtcgtcctggccgatcgacaccggcggcgagcacctgaaccgcgggtagcgctcgccggcgacgcagcagtcatggctccccttgggacacctcgtctcgttgccgtggaggtagacgtagccgctggcatggcagctggccgctgcatcagagacgccatggatggtaggggaggtagacagcaagctcatggcctgcaagagagcaaacagaaatagtatagccttgtgttatccatgtctcctactactgatttcaaagtttcttcttcttcgttttctttttaacaatgattcaaagtttctttgatggaattcaaattcatgaattcaagttcatgttgaatggatggggttaattacatgcatgtgtggcatatatagggagctctatgtgggatgttccagcaattcgtatgctagtgttttgactggacatgtaacacaatgtgatttttcttggtttgtcgatcccaaggttattagtgttttgaccaagaaattttatgtgtttccatgtgcatgttagaagttgaatcatttgataatgttaagaccagtgtcgtgttgtgttgtgttgtgttgctcaatattagctttggtactagccagtgattcactgagcaacggagtagttaatagcattggtcattatctcaaaaaagtaaactgaaacttaattgagctggtcaaaattggcatccttgtgatcgctatgaaagattatgtttgtaccactgaaaaatcaggaagcatatatagcgcagtttccatgaatctatgttcatctaaaaaattcaatcccaaaatctcaaagcgcactgttattacttattaatactagtagcagcactgcagcaacactaatactaacaatgttattatctgaatatttcaggtactgtggtatatgcaattgaaaaagctgaatccaagtgtttttcttatctgtgacttttagtggaaaactgagattctttcttttgtttttgtcccagctcatttacatttctcttggactgctgtctgtacacatcacatatcctatataattttattgtacagttcatgtcttggagttgtcattttctaatagtttggactgatggataaaactcaaacatttctatcattggaaggattcaaaacatatttattgatgtggattagaacacttgattgtgttgtcatagagatcgaagatgcagtaaaggagtatcctatggcaaaagtaaacattacacataatgaaattcattgcattagtgtatcacatattgaacaagtgcctttatgtgctaacctcctttgctagttgtaaatttcagggtttcaacaattgcatagacatcaattaaaaaagaaaaaaattgaacaaaatgtctggcctattttcttctgaaatcttgtaattaatcatgatagctgtgccatcactaaagtactgaaatatataatgagtcatttttcccacaaaatgctagatctactagcactaaattattttagtgcaaataatactaaaacggcatcacattacaggactatatacacctcttataactctatttatgctgtatagctctgtagactgactactgttctacacctggatattgctatagagttacagttatgtaaggctgcatgcattttgtctgtcctgcttacagtttatcttacattttagagagcttttgtgttttcaatactagctgcatggatcaactgaagatacaggtcatttcacaactcacgagagaatacagggtcatacttaacatagcaacattctttatgaaagatagcagcacagtacacattcaacataagcattatgttgagtagaaaatttaatgtaacaacagaaacacacactgtaatgagcacttttggggaaatgacaaatgccagagtaacggcttattcgacgacaacttttacggggctctctactagtatacgacagtatacccgttgtaagtgcagggtaacgtatgtattaattaatgtgtatatatatatatgtgtgtgtgacgtggccatgacggcatggctggttcttcagacatcagaccaggtgaccttgaactcgccgacgccctcgtcgaggccgagcgccttccacaccgccggcgagccgtcgacgacgtcgttcgggcacggcggctcgaagttgtgctcggcgtcgcagccgttcaccgagtcgcactcgtcgacgaccctggccagcgcggaccggcccgttgcggcggcgacgcggatcatgcggttgcaccggctggcgccgtcgagccggagccagccgctggagagcgccaccaccatggcggtgtccgggtggaaccggccgtcgcaggacgacctcccgccgccgtcgccgccgcggggaagcttgttcagcgtcagcgtcgccggcgttggcctagccgaggacaccggcggcgagcacctgaactgcgggtaccggcggccggtgacgcagcagtcggagccgtgcgccctgttgcacttgccggcctttccgtgcaggaagccgctgatgtggcagccgccgtcgccgccgccgccgccgccgccttgcttcggcttcggctcgtgcttgccggtggccacggcggagacgccgccattgtcgccgccatggacgacggcgtgaagggacatcagctgcaagagagcgagcacgaccaataccttcacgttagccgccatggctggatcaaagtgagctcttcgctggcttaattttgatcttgtgagtgttgtggcaagtgtattatatagaaggacttgctcgaggagaagcagttaactgtggcattaatttggtttacctagcaagccatgtaaattcagccaaatttcattggttttgtaaccccagtaaaaacttgggtggtgaaaatatcacaagtttgtttgcacatgaagatggaatatcatatatatcgtgttacacataattaagctgggttaggacaacatagctagcgtaatctgaatccaagtgccgtttccgtaattg

SEQ ID NO: 80182 - DNA, 8661 bp, Oryza sativa
cgcaaccattgcaaggaagtcgttgtatgaagaagggcagacatgcagcttgctaaactgacacgtggtggacaacaatgaccggtctgtgactggtctgacgctggtcatgtcataggcagacaaccgcgcacccattttgcacctccttccagcggagtggaggtaggtatgacccatcccatcggagggtcattcggatagcagccattgcaaatctccgcccattaatgaaggaatgacagggtgatcccctatgtcagacgagtgaggacgctgggccacactcaaagacaagctatattttagcttccaagagaaggcgaacggggttttggtcaagagagggtgggtccccacccaaaagaagagtaggtagaagtggagcatgtggtatccccttgagttataaaaggaggaccttgcccaccaaagagagggacggagaagaaaaaaggggaaaggaggagcaaacgagttctagagtctaaacttgttctagctctcgaactctttgtagtttcttcatacacagatccaccagaacacaggagtagggtattacgcttctcagcggcccgaacctgtctacatcgcccgtgtctcgtgcattgcctctctcgcgaatattccacagaccgagggcttagaacctcacttagcgcccccggccgaaccggcaaaggggggcctgcgcggtctcccggtgaggagccccacgctccgtcagtactaataataatttgattgatataatagacaaaagaatccaacttcttcgcaatgtacactccctgcttcctttagtgtttagggaaaaaaagcatgcagaaaacatcaatttttctaagctttttaccattttaacgtaagttccttttcccctaagaactcatgtaaaaaatattttttgtctatactagaaaaagacgttttccagcggtacaacgactattaggagctataatgacattataattttacactaatttataatctacattggtcaaaaaataaatcacctaatagaaacatctaataaaaaatataaaatattttagagttggaccagggtttcacttatcgtgtgataatcgcatcacttatcacgcttatcgcgggggtacggtaggggaaaccggcgatatgatttggatgaattttgaccaaattcaaaattccggaaaaaatcgaaaaaaactgaaaaaattcatggatgtagcgcgataacatgccacctcatcgtccactagtaataattacaaggaaaaattggaaccatgccattataattttgcaaaatttaagatataccatcctgaaccacatgtcattgactcatatgagttctacatgtcattgagataccgatgacatatcttaaactttgcaaaattataatagcatgatttcaatttaccctaattacaaacaagcttatgcaagcatgcaacatatctataattcattgaattctacatatcaacatccaatcatttttcttcacattattttttcacaatatttttaacatatatatatatatatatatatatatatatccatcatttctatattacttaacatatattcatctatacaattaaagtgtagaatatcatatttcatctacaatctcatactaaatgtatttctctctaaacatactttgacaaaccaattttatttgttgttaataactaatataatttatacttttatacttttagctcgatcattaaaaaaatttagaagttacttggcaatttccgtagaaagcgtgggaaatcacctaatgtgtcccttcggtagacgtgcggacgcgttgtgtgcagtggaagaagggatagaaggacgactgcgctacaaaattccatgcatagaaaccttgagggttcatagcatgggtttgaacaacgtgtaaattgaattcctgccttttcttactccagtgttttcaaattcctacattcgaaagaaatcatgctttaacagagtactcccttcaacacagagctccctgcccattgcctcaaatcgtgtaaaaaaaataacttaaccttcagattaccatactcaaccgagcaaaagttcatcatgaacaaatgtctacaagaacaatactgacagcaataaaacgagctaacggattctgctgcaagtccttggacattgagcacaggaccattcatcagtagcaaatgctacagaaaaggaaatgtttgttgctcagctatcagcatacatctttggtcgatcaaggatgtaaataaaaaaaaatctgacaattaagcttgaacacttacaaagtatggatgttttccatgagcacattgtcaaaatatctctgaatatgaagttgcatgatcatacatgtattttacagaagacaacgcatacaaagacctccagcatgctttcagcttacatttttcttgaccagtagcaagaccttttttctcccatacgttgccattgatgcaagtttacaaggtggcccaaaggagttaatctgtgacatctcaaaagggaaggaaaagaaacaaacaaaaaataagtctttagtcaacaatgtgcatcattggcgatgtacaacaaaccagttttttttttcttcagagaagaaaataacaaggcacctgcattagtgtccatttccatgcgtctcatgttctgcttcctctgcatcctcaaaacgttggtcattgatctgaagctgcataaggacattatgaggtttttgttcgagttagctcatgagattggcaggggaaggaacaaaagagttttatcttagtatacagatcaaactgttcagaaagtaactgtttgatgtttataataattttgaaaggataatcaactgccaccctgaatcacacggtatatctgtatatgaattaactataccttaacatattatgtgacaaaaacagtaagaaatatacatatggtcgtagtttctaaataaaatgacgtgagaggatgccattaccaattcctataccatatgttgtagtaaatacagattatattcacaggagcccgaagaaaagaaaaaacctttacaaccaagcttataacacaagagttttatttcacttgcaatcgtttcacagaatcatataaagcataaaacataatggtagaacaaaccaacagcatacctcaactacagcatgagtaatatcatgttcatcagtttgacctatcgggttgacatctgaaaactcacattagcatcacttcctgaatgcaagataatacataaaagattatgcataacgtttggatgaacacaaaagagaaatgaacagggcgaattcttaccaccagtcatatcttcatcaccttcatctctatgagcccagccattctcttcatcactctctggtaattaaaaaggcatacatcaaacaaagaacattcttttattgtttattaactattaaaacttaccagcattaggatcggggttcaattcagcacaatgtgagaatgcttcaaagagtccatccactgaaacttctgtcaaggatccaagatataatgtgaatatataatagaagatacaaatgcttcaagaaatagtattagtcaattcttcaaataaatagcatttcaaactgctggaaataaaaaatatatctgccatgatgatctgcagtatgatactaattatgcaaggtagtttattcttgattagctattaatcccaacagagaaccatttgtaactgaataacataagacaagcaaatttttacttgtgaaggaacagaatgcacacattacattcttaaagtagtaccctctagagtgaagacctactcttcaagaataaacaaatctaatcatgactattagttgctacagtcatgagaataaattaaaaataaagagctaatgaaaaatgaacatagagcattagaaatgatagttatttcatgtaaacctgcactcatatcaaaatttagtatgcaagcatcagaggtagatttatacaaggaaaaccaataaatgctcctacatcagacaatttactgtaaaaaggatacactgacaaggatcagatggtatgatacgcatctcagtgactttcgatagctctgtttccacatttacttcggagtctgattcatcggactcctcatcagaaccatcttctgtctcaatctttgaaaattccaacaaagggaatagcaaacattagaatcagataataaaagataacaccgaaaatagacaaagaatcaattgtgatatgccaaattcactaaatacatcaacatcacatttcagaattcaaaatttagcagctacaagagctctaaacaaaaaccacgaagaactccgcacccacccagcatacaggacaaatgatatatccagactaggatcactcttgagttgaaaattatgtaccagctctatgaagattacaaaaaggctgcacgtgataaattacatccatacatttatctttcaactatttgctactatgctagtagcaaaaatcaccttcactggtgtttgctgcgtacaaactgaaatctactaatgctataagatcaaaaggataaaaccaaagagaataaacaatagcagtgtccatccgttagtacccggtgaaccaaaggagaaaatttctgccaatcctctcaaagaaaaggaaaataaactccaccttagtcaaatgggtcatagcctgtagtttgtcacggcggcaacatctgtagcagggagttcaaagcagaagccagcggcccagcctgtgaatcggcccagaagggagaagcagcccaactcccgtttccctgcgagtgtgtggacccagtagtgattggctgggccactgtcagtgagtgagagaggctgtgtagtgcgatgctatataagccggcaggattgagaggaaggggatcgaatcatgtaatcaaacatactcaaattcaattccatctctctcctgttcaattctgttctgttcttcttcttcttcttcctcaagccaactctctcaatctcttcccttctctactcgaccgaatctctcctacgagttcgagaccgtgacaatttggtatcagagcaatttcgatcctggagaagccacgatatacttcccgtttgcaacttcaagtcgaagcgatggagaagcagaacattgatttcggcaaggtgttgatggagatctaggagtccttggtgaggctgaatcgtgctcaaggcgaaactcaagcagcggtcgtcaagctagatcgcgaagtgagcagttggagacctcaagtagaagcagcagttcaggagttgcgtgaggaagtcggcgaccttcgtcagcaactggatctcgtcggcaaaatgaagcaggcttctccggcgacgtcttcccctccagcaccatggcgcgggcctcaagggcttcttcgcgccgccgggacgccgcctcggtcttcgccgcccgccgttcccgggcagcggcggcgtcaaggaccccccgggcggcgtcgagcttctttcctagctccgccgcctagctcccgtattggaggcggagatcgtcccgcgcctcgttcagcacggcggtggcaatgagggcagcctctcgcttctcctccacctccctggcaatctccgccagctccttccgacgggcctcgagctctcaggtgtgccggcttctttcctagctccgccgcctagctcccgtattggaggcggagatcgtcccgcgcctcgttcagcacggcggtggcaatgagggcagcctctcgcttctcctccacctccctggcaatctccgccagctccttccgacgggcctcgagctctcaggtgtgccggcggtgtgccttgcggcccgcctccaccatggcctccaccgagcattgcccctcttcgacacgcgctcacgccgcgtcgagctccgcccgctctgcctgcaggacctccatctgggcatttaacccatccaacaccgtggtgttcgcagtggccaaggcttgcagaaggggctccgcgctcagtggggcagcggaaggcatgggagagagccgcctcggtgagaatgccgcacggctcggcccgccgatcgacgtgccggactcggggacgtcccccgaacctggctcgtcctgagcgtcgcccgaggagtcgggcccgagcggtgcgcctgcggcctagtcgtgggtggcctcggaagtcatcgtcgcctcgggcggagtcgggtcgggggcttggcaggccgcctggcgtgcgcgtgccacctccgcctcccgggcggactcctcggcccggcggagcctggcctcctcccgagcggcttcctcagcctggcgagcccggacggcctcctgggcagcctcctcggcttcccgaaggcggtccgcggcttctcgccggtcagcttcccgcctccgggcctccgcggtcgccgtatcctcggcctcagaccggccggacttggaatggcgggaggggcgcgacgggatctcgctgaagcagaagaaaaaccagaagacaaaaagaaacaggtaagtgaaaactcgctttgaaagaatgaattcggccgtagtaggcgcggggacgaacctgcgaggaggtcggttaaacgaccaccttgggggggagatgaggtttccccggcttggctcggtcccccccatcttgcggagccgtttctttttccgctccccctcgggctgcggcgttggcgcggcaccttccgagcgcctgctgctagcacgcaccgccccgccccctcggggaggagatggggaaggggtaccctcctgcttcctcttcccccgggcgtcggcagggcggctgccccccgggcccccgtcgcggggcccagaagcacgaccccctcctggggtagattgttcccccctgcggctcccgcccgcgccatcgtggcctcgaggagcccgctcctccgacgccccgaccgccatcatgatggtcaagatgttggcgcgatctggatcgctgcagagggggaggactccttgggggatgagggacgcctccacggagctgagattcagcacccgttggaccaccatcttgaaatcctcaggggcccagtcccatctgcccccctggtgggtcctcatgtagtccttcgacccggtgtactcccaggcgccccgggcgcgccgctggagcggcgcgatccggcgacgaaggtagtcgtcgtacaccatggcccccgtgagcccctaggatcgcaggcccgccaggcggtcaaggacggtgtcgtagccgtctcccagatctaccggcacgcgccagctggaggcctgcgccgggggctggctcggaagtcggaggcgcgcttcgtcggcgaggggggtgtagaaccagtcgctcttccagtcgtcccacttcttgcgcaggacgcagggaatgtagcggctcagcaccggcccccgcggctggaagtagcagccaccgaccaccgacggcggcgacactggctgtacggtgaagaaccaccggaacagccgaagagatgggcgcaccccgataaacatctcgcacaggtgtgcgaagatggccaacgtcattaccgcgttgggggtgaggtgcgccatctggagatcataatgctccagaacatccatgaagaaagaagagaatggcgggactagccctgccattgcaaaagagaggaagaagacggaccgccccgggtaacgtggcgccgggcgtccctcgcccagcgcgaccatctcccggccggtggcagattccggcatgaagcggcgcggtagcccagcctgcctctcgctcacgatgcgggaaggcggcagcacgctaccatcgagcggtgcggagccccgtgccatgacgccggcagaggaggaacttgagaacgagcgagtgcggcgagggtagggcacaggaaacgaagagttagagcgcaagcggcgaaggcaaggggaataatggcgagaggaaggaaacgaatctcttcctcggcgtctttatacccttgccaacgctctgcccggctcctcgcttcccgcgcccactatctcgccccctcgtttcttgcgcccacgcctctgctaatcccactcgcccgtttgcggcgcacgaggccgtggcagtcgagatgggacatatcgtgcgcgcgttaacttcgctcgccgaccgaagcgccatcatcacgtctccaggcgaaacgaactgactcgtcccgattcgcgcgctgctcgagtgatgtggcagtctcgaagaggccgctcattattatcgatcagttttccctgccaatgcgtgcgacttgcgaccgctgagttcctacccgcctgtagagaccggccccacctgtcaccagatctaaagaatggcgtcacgcccgagcgcttccctcgaggggggcgatcgccctggcgtgacgccgggggctactgtcgatgacatggggccgagggtatcatgactagaggttagggtagccgcagtcacccacgtggcccgggtcgggcccgagggtgacgagacctccccgccttttgtctccccgaggggtcgggccgctcccgtttcggccccgagggcaggggcgccccgaccccctgtggttttgacgccacgtgtatggtttaggtgagcacagcagggctcacctaaccgcatttattgcggtttg

SEQ ID NO: 80183 - DNA, 11089 bp, Oryza sativa
gcccaacggcttagggaggggtttctttgaactttttcaaataaaacaatttgtgaaatgttgtttcaattaataaaaatacttcccttgctcaaataattcccagaaaaatctagaaaatagaggagcaagtatagtatttaataaaattttatgtagctcatttttatattgaaaattttcctagaaaattagggtttagcttgtaggcttttaaaataatttctaaaaatgatttaaaatatgcatttttaatttagttgatttttagggcgtgacaaacctaccccccttaaacggaatctcgtccttgagattcagaagaactggcgaacagatgaggatgagctgacttcaattcatcttctcgttcccaagtggcttcttcttctgaatgattactccactgaaccttgcagaaccgtataacgcgattcctggtattcctctcgcttacttccaaaattctgactggcttctcaacataagttaaatcttcttgaagctctatacgatctggatctgcttcctccgtaggtacacataaacatttcttcaactgtgacacgtggaacacgtcgtgtattcccgccattgacggagacaactctaactgataagctacttcacctcttcgactcacaatcttaaaaggtcccacaaaacgcggtgccaatttccctcacaatcttaaaaggtcccacaaaacgcggtgccaatttccctttggtttggaaacgatgaacacctcgtaacggcgtaacccgaaggtatacataatctccttcttcaaaagccaaatctctacgacgattgtcggcatagctcttctgtcgtgactgagcaacgtgcaacctttattggataatcttcactttttcttctgcctgtcgcaatatgtctgtcccgaagacttgacgttcaccggtttgatcccaaaggagcggcgtacggcactttcgaccatataatgcttcatacggagccatttgcaaactagcttgataactattgttatatgagaattccgcgtacggcaaattcttatcccaacttccaccaaaatctagaacacaggctctcaacatatcttctaaaatttggtttactctttccgtctgaccatctgtttgagggtgataagcagtactgaaattcaaacgggtacccaattctaattgtaatttctgccagaacttcgaagtaaactggctacctctatctgacactatcttcttaggaacaccatgcaaacataccactctggccatgtataactctgcaagcttattccccgtataggttgttttgaccggtatgaagtgagcgacttttgtcaaccgatcaaccactacccaaatagaatcatgtcctgccgacgttctaggtagaccggttataaaatccattcctatttcttcccacttccactctggaatcttcaacggttgtaacagaccagctggtttctgatgttctgccttgacccgctgacatacatcacatagtgccacatattctgctatctcacgtcgcatactggcccaccagaattgttgctttaagtcttggtacatcttagtgcttctagggtgaatggaatacaaagtttcatgagcttctttcatgatagtatccttcaactccttattttctgggacgcaaattctttctcctaaccacacagttccttgctcatcttctacaaaaccgatggcttttcctcttctcatgttctttttaatttcttgtatatcaggatcattcacttgagcttctctcacttgatcaaacagagtaggttgagcttccaaagcggccacaaaacctttgctgactattcccaaattcaacctttcaaattcttggcataactcccaaggtaaatgtcgaccttctgacatattacagtagcttttcctgctaagggcatcggctacaacatttgctttccccgggtgatagtggatttccatatcataatctttaatcaactctaaccatcttcgctgacgcatgttcaaatcaggttgagtgaaaatgtacttcaaacttttatgatccgtatacatctctgtacggttaccgaaaagataatgacgccaaatcttcaatgcatgcaccacagctgccaattctaggtcatgcgttgggtagttattctcatgaggacgtaattgcctagatgcataggcaaccacctttccttcttgcatcaacacacaacccaaaccgagtcgggatgcatcacaatacacttggaaacctttcctcgaatcaggcaaaattaacacaggcgcagtcactagccttttcttcagttcttggaaacttcgttcacaatcctctgtccacttgtacttcacttccttctgaagcagacgagtcattggtctggcgatctttgaaaagttctcaataaacctgcagtaatacccagcaagtccaaggaaactacgaatttctgaaaccgtcttgggttgcttccaacttaatactgactccacattgcttggatctactgccactcctccacacgagatgacatgaccaagaaacttcacttcggacaaccaaaattcacatttactgaacttggcataaagctaatgctcacgtagtttctctaaagctagacgaagatgctcttcatgttcttccttcgtcttagagtaaataagaatgtcatcaataaacaccacgacaaacttatccagatattccatgaacaccttgttcatcagattcatgaaaaaggctggggcattagtgagtccaaacgacataacggtacattcgaacaaaccataccgagttgtgaaggcggtctttggtatatcttcctcacggattcgaagttgatgatatccggaacggagatctatcttggagaaaactgtagcaccttccagttgatcgaacaggtcatcaattctgggtagaggatacttattcttgatagtgacctcattcaacgctcgataatccacgcacattctctgagtatgatctttcttctccacaaagatgactggtgctccccatggcgaagtactgggtctgatgtatcctttctgaagcaaatcatccacctgtctcttcacctcagctaactcattagctgccattctgtatggtctcttatggatagggttggttccaggtaccaagtctatccgaaactctatgtccctcttaggtggcatacctggcaaatcctcgggaaacacgtcggggtagtcttgtactatgggaatctcttgtagagcaacttggtttaagatcacaccatgatatttaggagaggacacaaagaaagaaacggtttccccattgctactggttaaggtcaccttacggttggcacaatctataactcctctgtgacgagataaccagtccatccctaagataacatctagatctttggattctagcaagataagcgaggatgggaaaggaacttcttctatttctatggtagcggaaggacaatactgggtcgaaaatacttggttgcctggggtattaactagtaaaggtctcccaagactaataacttccatcccatgattgctcgcaaaacttttagacaaaaatgaatgtgtagcaccggaatcaaaaagcacagttgcgggtatagagttaacaggaaacgtacccaaaaccacatctggtgcattctgagcttctgctgctgcaacatgattaacacgtgccttcggtgctggaacattagagttgttcggggttggggcattcttcacacgccgaggcttaggacacttatcagcataatgtcctggatcaccacaattgaagcatatcactggcttgcttccctgttccttcctaacgggctggttctgagctggagttgctgcaggacgagcaaccgtgttacggttgtcattgccacgattaccagtattgttgttgtagaactggcgttgggggcagacaactgatgaagatcctccttgagggtacggtggagcttgaggtccagtaacgagacgcggcctctggttactgccctgttgtgccttgaattgggcagccctgtgcttcttctgctccatccggttatacttgtcttcctgacgaatcgccttgtccaccaactgctggaaatcccggaaatccgtagacatcaaggcatacgacaactcatcattcagtccctccaagaacttctcctgacgttcctcatcggtacgaacatcctctggagcatagcgagctaaacggttgaaatcatggaggtactcggtgaccgaacgagatccctggttgagtgctctaaattctctcttctttagagctacaacacccgttggtatgtgtgtcttcttgaaagcggccatgaattcctgccacgtaataggctctccttcagccctgccttggcgaaaatgatcccaccattcagcagcaggtctatgcagttgatgcgaagcaaaagaaactttctcctgctcagtacactggatcaaatccaaattcttctccaccgcatgcagccaatctcctgcttctactggattggtggtgcttgaaaaggtagggggtctcacacgtaagaaatctgccagcttgttttggggaggtggggtggattctgattctgattgtttgcctgctgattctgtgcctgctgcactaacagattgatcagttgtgtttgttgggccagaatctgagctagcgtgggatctcctccattgttagtagctccacttccacttccggtgcgcgtgttcaccatctgacgataagcagagacaacaggaaagaacgacagagagacacccttagaacggagttatttaattaatttaaattctatattgctattaactgtgtatgattacatttaagttgcattaacactatctcaccaactatcttacactctgacaagcaaaagaactagactcatgctgttacatcccacccatgatgtaagcaacaactaaaacccacacactcacaagcaaacttaaacaagcaatctaacacagcgaactacggcaacgttctaactaagcgactaatcccgccttgcgtcggaacgaagcgatgaatcttcttcctctggagtagctggctctctttcttcaggatcttcctcctcttcctcatcacttatgatgtcgatgacaggttcagcacgatcgggcacagcttcacccatcacatgaatcttcgaagctaactggagacgaggtggcggacagattctctttcttggagtgaggcgaagcttgggtgttggcggcggcgtttctcctttaagttcagctaattccttctgtagacggtacaccttgctctccaacttgcaaatcttgcctcgattccagttttccctgtcatgagctgctttgtctcgttccacacttactgcatccatagcactaagcatatgcaccgcatgcatcagagtggcactctcttcaccatcaggacaggtatagattccatagtcttgaccatgaggcttgtgaggatgatactggaaagctgatgaatccaactcttcttcaaagtgttcacgcaactctccaatggccaccaacgctgcttcttgacaagcatggcagtatgatcttcctccagcttcgaacttaaaagacggaaggtcttcactatcactagccaacgtcacacgaacacgacacttctcctcgtcggggtcatgggaaatttggcgatactcgggagcaacttcatagcctacctcaaaagccatcaacctcagctccctgacgaatcctaacaccttgatcaaatttctcagtgaatggggcggcatctaaagaaacatagaagagaagaattaatgcatatttttctaagttagctgcaccaactagacttaactgatttttgaccaaaaaggaagaaaagaaaagacacatacaaagctattttataaatatttttagaatttaacttttttggacagagacaaaaaaatttttttttttgacaaataacaaaaataaactaaaatacttatgatctattataagcacggtacagtgtcaccataggaaagatgagtagtactagtgctatcatgattgtatcgataccataatggatgtacagtgccgacaaatcaataagacttggtaaagagagaaagaaacattttgagaaggacgaatttttgcttttaaaagaaaagaaattgaattaaataaatttttgtgcataaccttgcatgtgctgccaacttaattaatttataagagactagagaagagcagttctatttttttcaaaatattttgaaggctacttaaggtttaccatttggcttatcctaaggtcaaggtggctctgataccaacttgtcatgccgggaatttctatccaaaattccaagcgcttacatgtgtgttaaaccctcgtccaggaatcaaccgaggcacacaatgacaatttgataatagagtacaaataaataactatcgaataatcgcaaataataaattattacagaggtggatagttcctctcaaagaaaaacattctacgcatcggaaaaaaaaaactataacaaactacggaacagctatggcgactccactccacaggcatcttaaccgagaacaagcctaatccaccagatcatcaccttcactgagatactcctcttctgatgaatgaatattgcaagaatgagcatatgacatactcaacaagtcacacagcaaatatgcaagtgcacaggataacaaaggatggcataatatagctcatttgcagaaacagcatttaataaatatttaagagaatagtaaaacggttgtataattaatcaatattaaataaacaccacacaacacacccatgttgcataggcccaaccacatttgaacaaccaaccccagttgaacaaattaaacctcctaaccaggaattatccattccaaactaggaattaaattaattaccacattattaccattaatgagtagtgtgagactaatcacgaaaaacattgctcaactcacccataaccgcgggtacggctattcgaatagtttaaactctgaccagaggtgtaccactgtacccacaagacacaaccccacatcatgtcaccatgtgcctcaataccaccacggtacctcggaaaggagttgtgacaataccccttgcacaacataacccattacagcgcacctttcctggatcataatcacccccttataaacaaggtatggactccccagcgacccccatggacttctcgccacttctcagtctggcgcactataatgaatcacgctatacaaaagataaagccgttgcccacgctggcttgtggttggcacgataaatgtatcacaacagtagctcgcgaaccggtccttaattgtcatgagcacaaccatcaaaaccatatgctcacaacccaccttagccaggttttaattatcaattaattaacatcacacgatttaccatcgtgagctaccattgaatataaccctaattaataataaaataatttagatttaacccctttagttagctaatgtttctaagcatggctaagcaaacatacatatatagcatttagctgaaccaatccaatatataaggttcatgctaatcatattataacccataggaaaataaagtcatcttcggccattaattaactgggaaaggttcaccacccgatgacattcgaaaacaatgcatagttgaaataaaataatagctttaaacgggttcaacatgctcaaagggttgtttaggatctgtgtgacttgccttgggcttccgcaaacgcttcggaaccttcctcaacggaaacgctctcctccggaacgtcggaaactaaagcaaataaacaaaatcaacaaaacagtacaaaaacaagcataaacagtacatgtggatatttttaacatgtagatcttgattttagaagaatttagcaacttgaaccacctaaaacggatctacggttatttagttatgattttccgaagttttaatctattagaaaattggaaaaaagaaaagaaaaaggagatgatgacgtcatgctgacgtcagcaatggcggccggttagggtttgcgagctcgccggagctagggcggtcgaccgggggattggaggacacctacgcgtagaggacatcgagacgaacccgatggtactcaccacgacgacaaacgatgcacgacgacggccggcgacgagagggcaacggcggcggctcggcttgcgcggcgacggcgggctacggcggtcggcggcaaagaaggatgggcggccgagcttctcctcaccacggcgctcctatcagcggcggcggcaagcggcggcgacggcggaggcggcgcagcgacgacgccgaagacggccggcggcggcggcgagcttggcgcgcgtggcggcggcgctatggggcacgggagaggacgggaaagggggcaaacgggagaggacgacgaggggatgctttataaagcattagattgaagagattggactccaaacgagaggaatcgactcgggaaaaaattcaaactcggttttagggataaaatcaaaacgaactcgattcggatcaaatcctcaacgattcgctccgattcttgggggaaaagaaagaggagaacgagaggaacaaaacccctcaaaaacccggaggaatcggggtcggattgaggcggatttggaggtagaaggcggcggcaaagcggcggctcgggcggctcggccggaggttgaagacgagcccgacatgtgggccccacatgtcggtgactcgagagagaggagggcgggcggcggctgggccggcgtgggccgcgcggaagagagaggatgttgggccgaattcggcccaacggcttagggaggggtttctttgaactttttcaaataaaacaatttgtgaaatgttgtttcaattaataaaaatacttcccttgctcaaataattcccagaaaaatctagaaaatagaggagcaagtatagtatttaataaaattttatctagctcatttttatattgaaaattttcctagaaaattagggtttagcttgtaggcttttaaaataatttctaaaaatgatttaaaatatgcatttttaatttagttgatttttagggcgtgacaatccccttacaaaaacagtttgaaaattttcagaaaaatttctctgaggccgatctgaccgaaggtgtacagccggtctgaccaagggtcggtctgaccactgctgtaccgttggtctgactggtgctcagtctgaccgaagcacagccgccggattgactggtcgccggtctgaccgcgggacccattgcggtctgaccggtttcctcgagaaaacaccagatttttgccactttgattttgcaaaagcaatttctctctgctttttctatctatgagctaatctaaaacaaaaaccaacaagatgtccatctttaccacaaaaagaacaagcatcctttttctttagaagaagatggttttgaaatatttgtttttgtttattttagtgttgtagaaagagagggcataactccagcagacttgaaaactgttttcttagcactaggtttggtcaaaatttagccatgttcagtcacactcaaaacattgggttgattttttattgaaaaagtcatgaacatcaaaacgaacacccctattgtagctagtcactttagattgatccaaaataatgttaagttgtttcttaccatcagaaaatctttgcaaagaacttttcaaataagaaacctatttttccaaattagcacaattttcacaatctaccatgacacttttgctttttcgacatttggggcaagaaagcacttcattggttttcacaacatcttccatgtactcaacacgacctaaagcatgttttagtttcatcttgtttagtgtgcatattgagcaatcaaaaacactttgttgttgttgttttaactttttagcacaaaccatgttaaacatcaaactagcatgaaaagatatttgatatttttttcaacaactttttagttaaaaacaactcatccaaagtacgtgtgtgcaagacaaaaccaagagcaagacaagatctatttttcaaatgatgtgcaacgttgacatctctaatttttgaaatttcatgcattaaaacctcacaatttttgcaaccatcatcattaggaataagagattttaatctataaattttagaattaagggattcaataataaattcctgttttctatacatcttctcacacttcttattttttgtacttaaaataagaatagcttcctcaaaagaactcacatcattgtcttcacactctgaatctgattcaccatgtgccatgaagcaaacaccggagatgttctttcccttatcttcatcttcactttctccatctacatcgcttagtggctcaaaagcggcatagactttctcaaacatcttcttgagattctccttggtcttcttccccttgaatgtgctcttagactttgttctccttagtcttctctccaccattgtcttcctttttgcctctcctaagcttaggacaatgcgaacgattgagatcaagagcaccacattcaaagcaacgatcgatttggaccacttcttttcctgtacctaacattattcatagctcgagaaaacttattaatgaccaaaaccatgtcctcctcctcgaactattcgagttgctcattcgacatggcattaattaaagcaagaatagtagtaattcgatgaagaagcaccaacatccaaagaagtcaaggaagaaaccaaatcactagacttagagtcaactttacaagaaataatattcatctcatgtgttttgagttttgtgtaaagcgaatccaaagtcaaagtaaacatatcaacagactcctgaattgatgtaactttcatctcccaaatagacatgtcaagaccattcaaaaagtgacgagaaacctcagattgtgtgtaatttatatcataagaagaatcaacagatttaagatcactaaaaattttttgaacctagaaagatagtcattca

SEQ ID NO: 80184 - DNA, 4295 bp, Oryza sativa
atttgcctgttataacagaaggctttcttttcagttctttctgattctcattacttggtgaatattccatagtgaattcactgcattctgaccagatgaactgttctttgcaggaaaacaatcctgccatttgctttgctgatgtagacaaaaccaaagaagtcgacccagcagaatcccaggaaaagatagcttctttacaactcacattcgacatagtctgcgatatttctcggtctaccaagaattcacttattacaaaacaggaactttttcacaatattcttgctaacaacttggagatagaagagacaggtatagcatggatctaacaattccaaccattttgtacttattgtctcatgctatactgaatgatttccctccttttatggactatcacttgacaggggagatagaagaacagctgcatattttggaggacctgtctcctgattggatatctaagaaggtgatacctggtggagatattctttacaggttagttttacatgacttgtatagggcatctgctaatatgtgttttgtgttcatttctaaataccatagtatctacaatcactatacaattctttttagtggacatgtaatttagagatattttacgggtgtcattaagtataaacgcctttgtttcccatgttgcagcattaaagaaatagcagatcagaaatcagttcgtgcaagactcgtagaagtcatatgagatactactgatgctttcaaggccgaagaatcaacaatgtgatgtgactactgatgttgtaggacttgatcagctggattgctgaaatcccaacttaccatcatgaaatcctctggattgctccttaatttcttcgtctacttccaaacattagcagaaacaaacgcagattactcaacatgttcttttactggcactcgacatttgagtaatcctctggatctctttagtgctgacatggtttggaattcacaccaccatataataggattgaaccatgctatctgtgagactctgaacagccttgttagattgcacgagagcacaagtgctgtggttgttcccacgagaatgcgatgttgcaaattcgatcggtttgtgtatgaatacgatgtaatgtaggtatgtagcacatgctcgtatggttctctgagtgtactatgttagtcatgagcgaagtgagggaattccttcagattggatcccttaggagagagagagagaaggtattatgaaatgtaatcagatctttgacgatccagtattagctagcaagtatatggactcagactttgatgattacctagtgtatgtattagcttcaccctttgaacatctcatttactctctctagctctcgattttactaataggaatgccaagtacataggtcgatgaaagttgacatctattttatcttacgccacttactttagcttgatttcgtgggagacacccaattgaatgatctcaagtgggttctattaccatgtgtttctggagctgatttcattcgagtagtttcttttttgtcttcaatccctttcctattcctctccacttggtgatgtgtggtgataatggtgcactagtgatgctggttgtatgatcctagtggtcacttgataatgctactgtaatcccaattgcagtactgtatttcctagaattattatgtaagcattcatctatgcattcatggcatatagacatcattcagcaaaccaagtcaattgacctagaacccttaaaaagattcttctattattataagtgtggtgatctttcaaatcaatatatcggtgtgatggtgtcaactgttaaccccaaataaattttctcaaccgcactgctctcaagtataactgttgcactttctacaaggcacattaacaatgaaatcatatagtcatacaagacaataatcaatttgcagaaagttgcagtcccaaggtcgtgtggatatatacgaatggatatgtacttacgttcctttcatgattctggtagcaaagctggattatataagctttgacgggttcatatttttctggattacaaactttgacgggttcgtttttcgtgatttgcttcacacacgctctctgacgagagcaactcctcgcccattcgatatgcgggtatacgcttctgttctgggcgaacttagagcatctccaacagttagccatctcatctcactcttcaagttaaaaaatatcaaacatagcaagaaaatgtgatccaacagcctctctatttagatggctaagccatctcactggccaaatgaccagctcggatggccaaatctagccagtcagtttggctggccaaacacagcatcaacggctagaagctgcaatctctcatctgcctctccccatcgacgccgagttcctcctccggccgcccgcgagccggccgccgcctcccctccagccgtcgtcgccctggccagccgccgcctcctctccagccgccgtcgcccctgccggccgccgcctacccttcgagtgccgtcgacggcaagagagggagggctcgacggcgacgagggagagcaagggaggccgccgaggagcagctccacgcgccagtcgccgtcgcctcactcgcccgccgccgttgccatcctcatcccaagctccgccaccgccccccatgccgatgtcgccttccccatcgcgagctccgccgccccccatgccgatgtcgccttccccatcctgagctccgccgccgcccctcccaagccgatgtcgccgtcgcttgctgctttcccgtgctgcctcccacgccatcagcatctgcggtcgacgggaaggaaggaaaggggaaaagaagaaaagaaaagagaaggaagaggaaggagagagagagagaggggaagaagaggagtagagactgtgatgtgtgtctatttgttattttagagaggattaatagagagtctgttggagtgagtatctagtttaactaggcaaattagatgaagagttggctatatgggtgtttagagactccgatttgaagaagctgttggaaatgctcttataattcatcttgttcatcagactacttccacaatagagtagataatttacgataaatatagtctattaagatgtattaaaaattttagtggaaaatttattattaatttagaaacaccaatagatatgaaatttcatacgtaagacgatttgaattttttaaagtaaaacttacagttttatagaaaagagatagcaatatttttaatgtttgatttaatgaaaactaacttagtattattgatgttggtaaatttttttataaatttaatcaaagttaaacaaaatttaattagagaaagaaaccaagcatcttagggtctgtttagatccatttaaaatagcaaatgacaaatggcaaaaattttggtatagcaaaagtattagttggtgtttagatgcatcctaaacttttgccattctagcactaaagtgagagagagaaagagagagggagtggtccaaagcactttttggcacaatttgctactatagactagcaaatgccaaatgacaaattgccaagttttactactagtgtttagatctaaaatagcaaaaagtgcttcaaaatggcaaaactggaggatctaaacagggccttatatcattaagcagagggggactagtaaaaatgttgtaatttttttaacctctgaacaacgttaaagaaaacggaaaatcagttgttttacggtttggaggattaggctgcttgctcggttgggaaccattcccttcgcatgaaaaatggagcggtatattaacacgtgattaattaagtattagctatttttcttttaaaaatagatcaatatgattttttaagcaacttttgtataggaactttttgtaaaaaaaaaagcaccgtttagcagtttgaaaaacgtacgcgtgaaaaagatgaatatgagttgagaaaacggggaaaagaacacaaccttagtcaggaaagcatccaacattaggcttgggattctgcacagcgcagtctcaaaccttagctttagcaatgttttaaatagcggggtaagacatttagcagtcagtttcaaccagttttagcggataaattatacatgagaaagagctagaatccttctcaaacaaccgtaaggggaagatattcctctagtcaatggtcaactgtacgcgcgcgttcatctccttatatcttcaagctgtcaatgctgcatcaacatcacactagcacagcgcaagaaaatggcggg

SEQ ID NO: 80185 - DNA, 6004 bp, Oryza sativa
catcacacatagaccccactatgattgtaatgagagagcaagtgcacaggaataaatttggtccatttagtgctcaccatgtgcatatactactacagttacatactactctcaacaagtaaacgtaagatgagaaacccaaaagtcaaggaataatatttctcaggaagggacgacgctgctataaataagtactaattcaggacaagcagtatgcacagtgaacattctatttacctgccaatgccttgaaaccttactctaataaattccaaagcagtactaaaaagggtttttttttccagtttctggacataaactgaactcgagataaatttgaaaatatattgttcatttttttccacaaaaatatccaggatgcaatttttttggcataaatataccatcgatctcgctgaaccattgagcgaaaatgacatgagcatgacgacgcaggtgatgtcgcgcggggatagtgcgagaccgcgcggtgtcgcgcgctacaccctgtctcgcagaacagaacagcgagaccaatcggtctctcatatggaatcagcgacagcgaacgtccatgtcttttggctactctttaattaatgattaattacctaagtaacaattaaataataatcagtgattaactatcctgattagcgattaattaataaataaataatcgctaatcaggataattaatcaattggaagcagccagccgttcggtcccacccgctggtaatgcgagaccgctcggtctcgcagcctcgccgcacgacaccacgcggtctcgcagccatcgtcgtgcaacggttgtgcgagatcgacagtatatttgtcaaacaaactgcatcccgaatattcttgagaaagaaaacaaatgaacactatattttcaaatttaattcaactgaactcctctaacacggtatgagcattgtgcgcatcgaaatggcaatcttagcctatctgcactaacagcctgccccttggatgattgatagtgaaatcctccagaaaattgtgcaagctaaaaacaaaaaagggtgtatagtttttagctggcctcaattgttttgattaatgccctccacccagaagaagttggttatgatattataatcagagccccagatgaagccaacagcaagaggtttggccatgggtgtgtacagaagcttctagtgatatatagtactacatttttattagtagtatgaccaatagcacacaggcaaaacactcttatgggctgataattatactactaacgataccaacaaataaagcaattgagaattgcatgatagtggtactactgtcatttaaagaaaaaagataaaaagctgaactaattatgcagattaggcctgacagagaaacatgttgtggaaagcaagctgctgttcataccagtcttgtccttgctttctgaagacatcagctcttgatcctagcttcaggcaggccatggtggagctcctccaaaatggtcaggacgatggataccactacatcaatgaaccaccagcccaccagagtttcttcagatcaaaggctgaatggttcgagctttccacacactcttacaccaaaccctaataaggaaattgagaaaaaagtaacaagaacaccactttcccccgaggaaaaaaaactcaatccactctaaaatcgccaaagtgaagaacacggactgaataccatcagagggcgaagctgaagatcgtgcagattacacggagcagccagacgaagttgcacatctacagaacaagagattacttcaacccccaaaaggaaaaacaaatcctcccaaaactcctgaaattcccacacccacgcaaggaaagcagatgcctttcgaagccaaaaaaaactctgatctacaccaacctaaaccccccaacagaaaaatccctcgctaaaccatcaacaccgacacccccaagaacccccccaaaatcgaaactttgagacaggaactcgagccccccaaatcagaactccaagagaagaaaccaccaaccaaagaatcaacccaagaaaccagcaatccctgctcctgcagtggtagaagaactgggagagagagagagtaaagtgaagtgcaggccgaaacaggggggtggttcttgggtttgtttgggtctttgggtgcggatgtggtcctaggaatgtttatggcagggggcatacaagaacattcttttttgtggcctcatcacagtttcccatggagaagaggacagaggaggagaatggaatggaaattggaagggggaagaggagaggagatgtgatgactgatgaaggaaggaggaggaggtggaggagaggtggtgatggtcagggtgtggggcccactgccagcaggctctcgatccactttgggtgtactgtactgtggctccctgatttctgattctctgtcccagatggaccgtttaggctgagtttatttccaaactttttcttcgaaatataaattttttcatcacatcaaaacttgtttacacatataaacttttaacttttctgtcacatcaattcaatttcaaccaaatttttaattttaacgtgaactaaatacacccttaatggaagatcatgtcacttgcaacttaacttcctctcaatagtgtagttattttttttcagatttcgagaaattatagttatagaaattaaaaaataaattagaagtcacaaactagaaaagtacagtttttctatatttttgtaaattgatctgtttctcataattttaaacttcctcaaacagatgtgtcttctttcaaccattattgacagccatggaagaaggtggtggtagaataatcctccttgaacagtagtaggagtacactggttaggctcagatcaattcatcagtcagttggtaggttattggctttttgcatcaggtcatacctgtgggccctccagattgaggtctagatgattctcactttggcatctactcctacagtcatactccactctgatgtccatccagtttagctctggaaaggaacagtctatatgattcatgccggccatactttggcatattgggccattttagagcttgtttattttaatacgaaaataaatgttaccatttggtgataaagttaacgattgataatatcaaattttggtaaaattagaaatataaaggtgttgttttgtttgatgccttactaaaatttggtatagttttaggagtagaaggttaaagaattattaaattttggtagagtttggcaagattatggtggtaaaatcttgttacctctgaatttagttaggttttattttgacagtgtagtgaacaattcttagctaatcaatttattggtagtttcaaaagtttagtagagtaccgcattggtttaccaaaaaaattgtctcgatccaagctctaaccatgcactgtactgaagtcgccaatgattagtaagggttggtttggtttgaggcctaaatttggcttatcaatatttgacaatttcaatattgtttagtgtctatttggtttgaagctaaattttggcatgcctaagaaaatagatcatttcaatagttaacttaggctattttggcttcaatccaaatacaactttgccttcccaaaattagtcatgcgaaaacttaccaaaatttggtattgccaaatattggtaaggtcaatttaggtcccaaaccaaaccagccctaaggcacattttggtgcatccaaaacagcctttcccatgttcaggctttcattttgttaacttaccattggcaaccaaaacttaaattttgaaagttgattttaggggaaacaatttatgctaatatattttccaacttttatttctaaacagctaataattcatatataacagttttactaataaattattttcagtttatttatttgtttcttttaggattatcagttatacctcaactgatcagaaccaagtaacttttttacttgcacacttggcttcagatgtacagctaattcgatataattgtactccaaaatctcttatattatgagactgggggaataataagaatgctaaatattttcaattaccacgaagatcttttttaaaaaataccttcatttcaagggaagcctgaaacaaaaatttacctttgcatctcagtatggaataacactaaaaaaaggcagatatgaagagatggaatatcttaggaagcttgtaatacctgtacttttggcattttttttttcacacaaaaagttggtgctgtctctgttcagccagccacgcatgattagggtccatgccatgctttggattggggcttggaatcggatgcctgccttgtgtttgaaggcaacatgcatggttctactagattccactggagcttggatggacactcccaatcatacaagagagaagcaaaacaaaaaggaagaatggatgttgcaactgtaagaagaataggagtatgtgaaataaactcaggtagagtactagttacatttttaccgcgtattttatactgaaaaagggtttctctctcgcgctacaataaatatctagagatgcttgtggtcaggcttcaagaatttgcagtgtcaatatgttttagatatttagaagaggtacattagtgtcacatacataatattataaatttataatattggattttttttaatactctgtgttattttaaacacgatatatggagacgtatacgtacgttcatatgggcgcacatatatacatcatatcacaatgaaccatatacccatcttacttctactagtcagacaatatgatagacaatatgcataggttccattacaaggaaccggtatactttacacccatttcaccgatacactattagcactaaactaaggccttgtttagttccaaagtttttttttcaaacgtccaattttccatcacatcaaacatttcatacacacacaatttttctatcacatcgtaccaatttcaactaaatttttaaacttcagcgtgaactaaacacagcctaatcgatgtttaaaactaataactttttttatctatatagtaacggcctatatgttttagccgaataatcgtccatcatcgtcatctcagcgcacgcccaaaatagttgcttgagaataaagggatgaacgaacgaacagtaaaagccagagagttctattctctatagtctctatgcttatgctaccgatgaatctagactgttgggttcgaatccgacggtcacagtcacacttcctctaccaaagcagtgcacacagatgatatcaacccttggaagaatttttagataatgaaaatagattacatctccggattctgtcataagacacacagccataagtttaatagtaataaaaaaggtaaagataaaaataaatcaaaatgataaataatgtgatgggacaaatccccaactcccattattattgaatagcgttaaactcataatttgtttagctagcaattcaaactacgccacacgtagtaaaataagagaccttttggctaccgattataagagtgtacccttgaaacaattaaaagtattttttgggtggttgtaaaatttcatttttacatgagtctgtggacccgtcgaaatgtttatggtgtgaaaatgaaatgcacgagatcattccaaagtgttatgtctatgtgcgggcggtgcctagttacagtttctgtgggttgggccaaaattaggcccaccttgctatgatgcagtgctatggatgagtgaactaatgggccctagctaggccgtcagctcgttcatgaatctttcaggatgaattttttttatttttaattttttttattaaaagttttacaaatataattttccattttgaaaattgacggaagtagtcgcctaccgccctctgggagggcgatttttaaaaatcgccatcccagagggcggcgaaaatgacgtggcagacggccgttcgctctcgggcg

SEQ ID NO: 80186 - DNA, 1244 bp, Oryza sativa
gtcaagtgccaagttctgccaaatgataagtaaaaacttggcaaagagggtggcgatgcgccgagagtagttgtattgatcgttgagatagtttacaataaccccgtgtgtacatatttatacccatgggtagatacgagtacttcttggacaagaaagaaacttttctaaagataaaaggaaaatataaagtccttatcagacactaaacacacttttctaaagataaaaggaaactactaaatcatgcctaattaatagatagaattacgccgccatgtcgcatcctccttgaactcggtcacttttggataagcttcctttattcagataatttccttaatcaaatctagtaagaatccgactattggtgacttgacaattcccatcggccaattccaggactctgaagccgatcctgactctaggccgatgatgacttcgaggcttaccaaatttcaaatttcactgttaacaactatacaacctaaaatgattatcttcttgggagatgatcgtcttgggacagcgagagtaggattcaacaccaagtttctccttggttttccaactggtttttgagtaatgggggagtgaagcttcatagtaaacccatcatcctgtcgtgtgtagaagcccttttcaaggaggatctaaaaaccggattcttggtgtccaaacttaggctgagttcgttggttaagttttcaacacatatctcgtttttcgcgctcacgtttcccaaattactaaatggtgcgttttttataaattatatacaaaagttgttttaaaaaacatattaattcatttgcaaaaaactaatacttaaataatcatgcgcgcgctaatgagttgctttgttttgcgtgcttagaggattagttcccaacacacaatacccaacacagccttagagcctgtttaggggagcttctagcagaaacagcttctcacaaaatctccacctccccaaacagattgtcactctgattctaagcttctcacaaaatctccaccacccccaaacagtctagattgtcactctgattctgataaaatgtagttctagaaaataaactagaacccagaagctggaaaacccagctttcatattctaagaagctggctactaacgaacatattcttaaaatcttaagctccccaaacatggatttattggatccaggaaaataaaaaaaatcccacgctagccttacctagaaaagaatttttatttttta

SEQ ID NO: 80187 - DNA, 2876 bp, Oryza sativa
  unsure (1)..(2876): unsure at all n locations
ccattgccaagaaatggtcaagaatcttgtggacacaatccacatcatagagcgtttcaacagactcagagatgtttggaatcagaagatcttccagggtagccttatcaagctgcatacctatccgtctctccaagtttgacacgcaagaagggctggcttttaggatgattgctgtccgcagaagaccaaataacagcttgcaagatgtgacccccctttggaaaggtaacagtctatcaatttcctcaagtaggtacttttgttcctcttcagaagggattgatgttaaagatgatattgaaaggcaactgctgacatcactgatgcttttacgccgattcaggccaggtaaacgccttttggcatagtggttcaaggatccaacaataatatcctgattgattcctcggtattccatagctgagattacttttttgtataatggaaggcttaagcatgaaacatcatcataccaccaatcagggctgctatgtcttggccttgctccggtgctaatgccattccacaagacgcttcctcctggactctgcatggggcctccgtactggacaactggccacccaaataaatcaggatcagtacatgatctagttgcaactgagtcgatgcacctctttacgatttgcaatttttcagcaagatcaatgatgtcatcacaggtatggagggccttgattgaatctttccaactcctaaggactgtttgggtaaggaagttctctgtctgcgcaatcaaattcccctcagcaatctcttcagtcatctcgagatattcagcagcacagcgaagatgcacaacattggaggcagtcatttcgaacttaacaccatagcagaacttagcagttagttcaaaagcctttgctcccccaggaatatccgataggtcaatgacacaactgttgtctccattctcaatcttctctcggatacaacgctccaaaaggccactctttgataatagaggaaactgcaaaatagaaaaagaacttgctttttacaaagtaattatcttcacaagattgtatctatttttccctccctaatacaaattatctactccccccgtcccaaatataagcatttttaggctctgacactgtcttcgagatgctactttgaccaacaatatctataaaagtaagatgttttaaataaaaatagttgcatattatgatggtttgtttaatgataaatctagtaatatgaatatcaattttacatgattgatcttttttgtttttttgctattaatagtcaaagttaaaaatgtttgacttctcactatactaaaaatgcttatattttgggacagagggagtagtatgttttggtacaaaggtttcccaggctgaaagcaaagcgtaagccagttgcataaatgctaaaagaaacatattgcaaaagaaaggaactcttgaatgaactagtgatgaaaatcttaccttgtgaagatgaaaagattgctccccaactgtgacggttatatcactaggaagaccggttgtgcaatacctatataatgaacatgctcgtcatcaatacttttcagtttggacaatatttttccagcaaaaaattcatatgtaaaaagctagaagtttagggactggaatagacacaagagccactctacaagtgtggggcacctaaccagatccttctaggtttctgccaccccacggtcaattgctatagatgatactccctccgtttcgaaatgtttgacgccgttgactttttagcacatgtttgactgttcntnttattcnnaaaatttaagtaattattaattttttttcaatcatttgatttattgttaaatatacttttatgtatacatatagttttacacatttcactaaagtttttgaattaagacaaacgatcaaacatgtttaaaaaagtcaacggcgtcaaacatttagggaaggagggagtatataggagtatattgccacatgtatacacacacataaagttgcatatgcatgcctgcttacctggttgttgagatatatgcatgatatatataggctgtgatggctttgggagttgaacaccacgtagcaattcttatccccaatgttatccgtcttcattcccatcactcattcacaagctagctagcaaacctgcagatatatcactactagctagtagtatccggcaaactacctgatcgatcaataggattactactatgccttaatggaaagacatccttgtaaatatgcaattatcacttttttatttgactggaaattaatatataggatacacacatatgtagttactccgctcattaatatataaaattcttacactaaaactagtaacaccatggagggactaacaatctatatactaggtgaaaccccgcgtgttactacggaagttcagtatgatgacaatagctaaacaacatgaacttacataagttaatatggtttatgataatttaaatttaaatagtatataaaatgatgattcaaatgtaaaagtaagatgatgcggttttatgagaaaggaaagggagtgagatactttggaccatagattaatcatctaaggttaaagtaattgatgtgatatgatttaatgggagaagagagaaatagcactaagtgaggatgaatcatataggtatatatgatattataaaaaatgatgaagaaatatattgaaatattatgtgaattatgtgggatgatgatttaacatgtttatattgaaaaactctaaaatttaacaaattataaaattgttagtggatgatgatgtggcatcttgttaatgcatgatgatgtgtcatctttacatgttgagctttaaaatttagtgtgttataa

SEQ ID NO: 80188 - DNA, 93749 bp, Oryza sativa
accaaccgggagtaaaaataattggggtctgtcttgaaccccacaacttcttgaaccgggactaaaaatgatctttagtcccggttgatgttaccaaccaggactaaagatcaagaagtacctctcaacttttaaaccgggactaaatatgttttttagtctcggtttttattagaaccgggactattgtggaatttggctgaccgaccaaagatggtttctccaccggtgaggattctagggttgcgtttctaagggttcccatcccaaaagacctccactatgtggcatgaccccttccttttatggtacaagcagggatttacgatgcctttatcaccgagggaatgcccatgtctagtcttgtcattatcccctctaaaacccttgaatttaatgggagaattaccatggacgattgtttttatcgtgcctcgggctccctgacaaggggcccaggacagctgggtcttgcttccctcgccacgtgctccaaactaggcttggtggacccaagccaagtcatagcacatccatcatcgtttttctcatttcttgatggtgaagtatgaaaccacctaccggtgctagcatctaactgtacatgtgtgtggccgtttagagctagcataaggtgaattactacctacctggagatttcctcccaaatggccccgttgagggtcgcttcctgcaacaccgtgtccatctcgggtcggatcgtgagcagctccagtgtatcctgccgaagccacctgttgtcagccgacgagccattctcgtcacccttcacgctggccagcctatcgtggttgagggagctcccgtggctccaccgagctgctcacctgcctgctcctgcttctgccttgttcttacagccagcgatggcgtctggggtttgagggggaggggggagggaagggggccaagcaaacggtgaaaaggcgagacagagcaacgtcaatggcatcttagagttcaaaagcgagggctgggacggtggattgggagattaggggagcgatggaggttcgaggcaacgacggcggcatcgtcaagggttaagagggggagaggacgagagtgatgctgcggggattggcaagggtggcgattgagggatggaagtatgctaggtgggaggtagaggcgatctgagacattggatctaacgtagatgggccgttggatttgacgaatgaggtgcgcaggagtgtagttagtgaactatatggtagatacctgtcgaaacaaattttcggcaatatgaaaagggggtagcgcacgagacctaaaagtggatggatgcggagacaaaggatttagacaggttcaggccctctcgatgagaggtaataccctactcctgtttggggatttgaatccaccgggtgtatattgatctgacgatcagtttgtgtcatgccccctagagggcctcctgtccaccttatataggatggggggcaggattacaagatagaaaccttaaccaatacggtatcggtttcctaaatctattttacaatattatcaaatcaggactttaggccgcttcataatataaaaggaaacgtaatacccaagtcatgatcggttaaatattccatagatataagctatcccctatgactagtcggataaccatgccgtgtgggtatggggtacccataatctccacagtagcccctgagaccttcacagtcggaaagataatcttctctcgaactagattactccaaagccgtgtgcttcaatcatcctcgccatgatctcccgagtacttttaccaaatatgaagactgtggagggctgaaaaataaagtcaggtgcatcgagtagatgtacctaatagatgcaccaactgagtggttttgataatcgtagtcaaacaagtaacttaatattaatatatagcatatgcggtatgaatccctgaataacatgatccgagtgatataccgacttatgatgcgtgcaacctaaagctgactacattattgaatacacatagcaaaacagctataaagaagcttgtatgttgtgaataaataactttccaaagtattgggcatacaccatgcgcacactgctttaacagatgtgcttgagtccctaaaagacacatggtttcactacacctgaaaatatatggcatatgtggtataaaatccgagtaaataaactcataaggatttatcaatcgtctgaaaaatgaccaaaatatataatcagcctaagccataatattggtcaataaaaatacacacttacgtggcaaaaagcaatgatgttgtatccaatcaattgcttgataaacccaaacagcgccatgactatataaaaaagtcagcggggcagctatataaagctttactgtttgacaccttttaagatgcattgtaccaactcctaaaaagttgagtaactgcggtataaaaggattttaaggtattggacactagatcacgcgcacttttgcctaagcaaaaagatgcctaagtccctaaaagaacgtgacatgccacacctgaaaatatgggctgcagacatattaggcctaggccaaaaaatatgccttcgacaccctttaaaggatgacgcatgtaacatgctcccgagtaataaatcttttcgggtgatatagaccaagtgtagctcatatgaataacttctgatctcagtgattatcctttatgggatactccaaaatagatataacaattgaattccgactggcgcaagtattcggttgataacccttacggggaataataaatagtccagtctttaagcataaaaaatagacccatgatcatcaaattcatgttgcatgtatccggaacaagtccaaattgaaggtatgacacttgtgtttgaggtagtaagcccctgagcatatagcgtgtccttttgttgtagtcacaattgtccattgatggtagctgacgcagttggcatagagacaagacgaccaatatagagagaatattgcccaccagaggtggcaaaaatattggtggtagtgaagatagtgataccaatcaaaagtgatgaagttgcacaaccgtgaaggcaaagaaaccagtcggcagcagtcaggtcagccagcaatgaagatgaaggcgcccagcgataaagttgtgtagccatggcagcgaaataatcagtcggtgacagacgatgcagttggtgaagaagatgaagatgcccattagtggcgacataataagccatccataaaggcgaggataccggtcggtggtgacgaaagcaagccgacggtgaagatgtagacacgcatcaaaggcgatgacgaaatccaccaatcatgaagatgaagaaaatagtcggcggcgacaaacgcaaccgatagtaatgatgataagcagcaatcatagatgatcaaatataatgacgaagttgcccatcaatagcagtagagtgggctatgttgaagaggctatgttgaatagggatattgatgaagatgacgatgtcgatgatccagtcaatagcagtgtagcaaccgatgataatgacgaagacgctcatcagcgtttgcatagtaggtcaaccgtgaaggcgaaataacaagtcggcaatgacggaagcaattggagacgaagacatagtcatccattagcaacagcagagatgtcagggccgatgaattagaggtgctggtgatgaagtcaatgacaataatccatcaaactgttgagaagatatcgaagctcgagtagtttccttggcgcgagagtgtgtataacgaagattgatgcaaagctccttgatttataaagatggcagtagaatttggtgttatagctgttgcagattcttcacttggaggaaagtagatgctcttgcccaactcatcaaaactgaacttattggttgataactccaaactcccgaacatgtagattaaatttcaaaattgatactggaaatatttggagtagattgtgacggcgtgaagaagccaaaattgccggtgtaataattggagtcgctgaaattaaatgacggttctgaagcgtagacgaagataataactccccgaattgactcgttgattgattgattgcttaatcttgacataaagcttgtcgaattttgatagtcttgtatttgtgtagcccccgactctttggttagttgagaaacaactgaacatagagtcgagaactgtagcttcttgtagtcgaatagtcattgcttgagtaaagatgcatgttgaagatgtccgagtagaaatattgaagattggaacaccacttgttgtaataatataacacggcatcatatttggtgacgcatgccgagatgtcgaagctcctgtagacgtcgtggttggtgaagtaggaaagcggtagtgaagacatataattgtgaagataaaagcaccagccggcggcggcataaccagtcggcgacggaagacgatgatgtccatcagtagtggtagctgtataaaccagacgtagaggcgagggcattagtcaacagcagacgagacgaccgacgataaagacgataaagccaatcaacactagcagaatcatgcagccatgaaagtgaataaaccagtcggcagcagacgtaggcagcttgtgttgaagatgctgacgcctattagcggtgacggcgatgtagccagccgtgaagaagatagcatcagttggcgtcataacaggctagccgtgcaggcggtgacaccagtcggcggcggatgaggcggccggtcagtgaagcggccggtcggtgaagacgtagacgcccaacaacggtggcataataggccagccgtgcaggcggaaacaccagtcggcggcggacgaggcggccggtcggtgaagatgtagacgcccaacaacggcggcataataggccaaccgtgcaggcggaaacaccagtcggtggcggacgaggcggccggtcggtgaagacatagaagcccaacaacggcggcataataggccagccgtgcaggcggaaacaccagtcaacggcggacgaggcggccggtcggtgaagacttagacgcccaacaacggcggcataaagcccagccgtgcaggtagaaacaccagtcagcggcggacgaggcggccggtcggtgaagacgtagacgcccaacaacggtgttgtgaccaaccaaccgtatagacgaagacaccagtcggcggcggcgacggcaagccagtggtgatgttctgactgatccattcctggggcgtaagagataagcttaaagccatgaatcccttttatgcatatctggatctggatcctgcagaacgaacatataggatgagtagtatctgatgtaaatataatacttcgagaaaaattcaagtattttaaaatatttataaatatgtatttcttctcttgtcaattttgatttcccctagcagatgactcattatgtttaaacactctgcccgactagtcatagccatcaagcaccgggagtcggcctaagcacttcccaaacatgcatatgagtgacatgagttcgtcattaatggaacaaagtttcatgggtcggagtttactactcgggtacttttgcaattattaagagcagaaaataaattatcttatctctatgcttttgatttattccgaataatacttagcaccttacgttattcggtccatccaacaagcccccaggtgctaggaatcggcccaaaggcaactatccattggcaaaccaaacggaaagcataggaagatggaactccataactcgataggcacttttgtattcagaatatgtcgcaagcaatcaagataaatattatgaaaattgtttaaaaaatatgatataacatctatagccccccgactcactagtcaacggcgaaccagttgatgtagtgaggcaaaggaaaaggcaaaatatcatataaagaataaaataaatgatgacttagctttgtcatattccccttgattatggcagaggtggccaatgtgggaacaaagtcgtccatcaataataatgaagacacccgtcggcggcgacgaaggcgatcgacggtgaaagtgtggacgcccatgaacggtggtgtggccgaccagccgtataggcgaggacaccagtcggcagcgacggaggcaggccggcggtgaagtcgtagaagcccaacaacagcggcataataggccagccgtgcaggcagaaacgctagtcggcggcggcgaaggccagccggtcggtgaagatgtggacgcccatgaacggtggtgtgaccaaccaaccgtataggcgaggacaccagtcggcggcgacggaggcaagccgccggtgaagtcgtagacgcccaacaacggcggcataataggccaaccgtgcaggcggaaacaccagtcggcggtggcaaaggccagccagtcagtgatgaagtacaagcgatgatacatgcaaagacaagaaattgcacatcaacctgtggttagatatttgtaaaaaaaaaataactgatataataatcaatagatccaaacacatggcttgattggcacttgatagagaggcctgcataaccataagcacaaaagcgcatgcacgattgcatgtggttcattggctcctcgttctgtccggcagctgccgtccctgtacaggacttgtataaccatcgacttgttcagcgagtagttcgacgtacaactgcatggtcaaaggactcggccgaatcgacgacaggaaatatatacagataatagattgatctgtaaaaaaataaataaatcaaagattaattttaataatctatgaattggaacagctaacccgatatctgaacaatttaataggggtgtgatctgcccggtcgacaatgacggatatggccgtcagtgggtatggtcgacaatccaatccagtcatcggtgttagatccattgatgagcgcgtgaggccgcaattggtggagatcatgacaccatgcgaacgtgcgacggccgtatagagtaacgtgacgtccaaaatgcatggatcaagacatgcagccggcgagttgcgcagcgacttgtgtcctgtactccgcttcagcctcgatatgatcatcaccgtgatagcatgatggcagtatgacatcaccacgcactcagcagtacatgcatgaaatcaaggagagaaaacaacgtagagtaacatgtgattagggatcaatctaaataaaattaaagtggaaagccaaaccaggtaatagttgcatagatcgatatatgtgatgatgccaaatattatggccacgagctagccggttgatcttgatctcaagcttctttatcgttccaccggtctgcatgcacactcatgattggttgccctggcaagcagtcggcggcttcacggcgtgcagcacgcacacacatcttgtgagcgagaatccagggaccagtgcatccatgcatgccaagatgatcatcagcgctgaacgtgcaaacgcccggcgacgttgctaattggatcgacattgatcttttttctttctgaagttgatttccatcgcactcgttgataggaaactcggcgtcacccctacctggcgcgccaactgtcgaaacaaattttcggcaatatgaaaagagggtagcatacgagacctaaaagtggatggatgcggagacaaaggatttagacaggttcaggccctttcgatgagaggtaataccctactcctgtttggggatttgaattcgccgggtgtatattgatctgacgatcagtttgtgtcatgccccctagagggcctcctgcccaccttatataggatggggggcaggattacaagatagaaaccttaaccaatacggtatcggtttcctaaatctattttacaatattattaaatcaggattttaggccgctccataatataaaaggaaacgtaaaacccaagtcatgatcggttacatattccatagatataagctatcccctatgactagtcggataaccatgccgtgttggtatggggtcattgtgttgttgataagcaggattcacaacatgaaggacctgtacattcaaagggtggaaatcttgtaccttcatatttttattgtgctcagatgtggagcttctgtagcaaggactgggatggccagccccagtgatatggccaaagtgatgacggccaacccaactgaaagtaacctgctgcaaaaacccaagtcagcagcacgtttttaggaggtgttgaggtgatgtcatatttttgaaacttaaagtagtgcgatctctaggaaatacaacacaactacaagatcctctttggccgaccaagagtcaatttctctaatttgaaatatatgccatcaagtcttacaatactgataattagtgggcagaattatccattagttagcaatatggtgcccaagtccaacaagatagttcccttgtcatatttcttctacgtgtactgaactgtggatttttcatgttcaataaagaataaactctgatgaacaatttcaatgtactgaaagtatcagacgtccatactcagtagagatttaggatatgtagtagatatcgtttatataggtgacagtaactgcattgtaccattagttagtcatattttttcgacatacactgatcttcagattctgctgttacactcaataaacactaatcactaatgaataatttcaatattatgcagcatcatagatatatatatatatatatatatacttcagttgaggcatcagacatgtaaatattgttcatgtagaagacaataacaatgttgtgcagctaccttactactctgatttcttcgggcatctccaatttaacaaaaacagaggcttgtgcaaaactagaaagatgtgaattactaaaagatgatgggcaattttcttttttggccaatggaatatgtcaaaagcatgtttatcccatagtaaaggtctgacgttggtacttatctctacatcataagggctaacattctgttactaactatagctctaaaagaatatcgcaaagagaaggatatccctaattctggcataagctaaaccattaaaaaccataaaagtctgattccttaaatttgcccaaaaaaaacaatagttgtttcagctccagacatgcaaagacgtgaaaagattgtctatagaataacatacaagattaacatcttttgagttaaaagatgatattaatgatccatgaccacattagaaatttctgtggagggcaacaatttgtaggtggaatccaagctcaaaggaaataatttcagaagagttagcaacaaaaaaaaaaagctatgttagctactatttggaaattaggttcatggaaagttcagtggttattcattagtcacaaatgactatatgtacctcagatgtcaggatcacgagagataagtggggcaaactgtttagaccaaaatatgcaccttcgttaattaagtcctcataataatggcacagaatgtcactgaattcttgaccgccttgcaaaatgtttgccacgctgtggaataatattatattttccagctcctctccaatggtctctgttggccaacaaaaaggttctgaactccttttcaagttttggatcagaagcaaagccattttccttcatttcatcataatactctaaagctctttgcatgcatccgtgtttgatcaaaccttgcacaactgacatatagtgtgaataagaaggtctgatgtcatatcttttcatttcattccagagcttcaaagcatgtccaggttcattcaattgaaaaaatctatcaataagcatgagaaatgtatcactcttaggaccacagccatcatccttcatttttttcaagaacttcagggtttcatcaatgttttcttgtctcagaaatgtatggtatgtcaaaatggttggaacaattcccttcagcatcatgtcctccaacaccatccgtgcttcatcaagcttgcgactttcgcaaagcggaactatcatactgttgtaagttttgacgtttggttggaggccttcatcgataattctagtgaatatattctgtacatccttcatgcaattctcttttgtcaggacatagataagagaattataaacagcaatactaggagtccaacccctctttttcatctcatcgtaaaccctcagggtatcaaaaaggtttccaacttttgcaaaacaactgaccatgagggtataagatgtgccatcaggagtaatgcagtaatttgacatttctctccaaattctctttgcttcagctatatcagtgattacattgcaccaaccatctagaataatattgaaaccttctgcagtaagtgggaagaatttctttctcacgagaagcaattcctcagcatcctctatgtttttatttttgcaaagagcacgaagaagggagtaaaatacagtttgatctgcttccgttttaaacttctccattgcatcaaatgtcttgattgctttgttcacttcattggcagctgcatacctgaaatagccatgtccttacagtgagatgaccgtcgaccattatgcaacaaataaaaacaactcaactaaaaaaaaacaaaaaaagaagtgctactacaatatggactgctgcaaagcaggcattatgatgtccccctcacagcaagacgacaaatggacccgtatatatttttcatccaatgcataagttcaacaagattaaaggagccaaatcccagaattaccactagttaaaacactaacaacacaggaaatggtaacttacggacttgcaacagctttatattcccaaacactaatccattcaataaatcgatccaaccatgaatatttgttgaccatcatagacaatagcacagttataacataatattcaagtggatcctggatccatagaagctgcttgtttgcaacagttttacttcctaatatgattgtgcaagctgataactgcttgttcaccaaatcaatatgatgtacaagtcccttgagggaggcgcacattcagtggcagtaccaatcagtaaggcggaccaaatcattcaaaatgcaggcatacatcaccataaacaagtagcaaacacataattctgacaagccaatcaacaacagttgaatactgcccaagcaatcaaatacttatgccatagcagtagcactatcacaaagctgtttcttatctcaacatggaaagctatatactcctctgtacagaaaaatggagacagattacgaagaggagagaacccacctctccatcacgatgaccatggcgcggctggtgagcaccccgcggcgcagcatgcggcgcacgaccgcccacgcgaggtcgaaccgccgcgccttccccgcggcccatatggtcaggtgccacgcctcggcaggcggcgggggagggggcggtggccccgcgcgctccccggcggcggcgcacccctcctccccccaccggagcgcgagggccgccgcgtccgggtcgcggcggagctcccagagcgcgcggacgaggaggtcgcggcgggaggcaggaggtaggcccggggagggcggcgaggacaggagaagcgacagcgcgtgcttcggggaggacgcggcggtggaggcgtcggagaggcggtggaggaaggcggcgagctcgccgtcgccgtcgggggcccgggggagggggtggtcgggaggctcgaagtcgctgtcgtcggagggggagggggagtgggcggcgaggaggcagaggtgccgagattgggggaggagggcgcgtaggacgtggcggcggagggcggcggcggcgagcggcggcggcgccatgcgaggtgggaggcgaggcaacggcgagtgggaaatgaggtgcggtgcggagagaggggggtgttttggggaagattttttggtcatgcgggttcaatctcgaggcgtcgtcgtctgtcgtcgattggtgtcatatcgtccgtttgatcacgagaaacatcatggaaaatgacaatccagtccaagctcttctctctttgcattgatccagtgcaatcatcgcaaacaacaactgtggcggcagctcgagctgaaatcaagcacaacgttaattcctttcatattattatgtttttcttatcttatgtttttccaatccgcaaataagcctttatatttttagaaaaaaaaattcaaaggtataggggttgttttgttctcccaaacttgctaaaggttgtcaccccttatgtctaacaagttcaattaataagttagtctattgattcatagtcacgcttgtgataaaattccatttaatttttctggtttcatatgtcaccaactcaaaataatatgttacaatttagataagcaattcaaaaaaagtatgataaatgttggtatccaagcaacctattagtatagcaacctacttgtcgacgggtgatacccgtagaccggatatagagggtattggggtacgttggtacaaggatctacgtagtacaacatcaagcaaacaaaagacaagaattatactggttcaggccctttgataggtaataaccctaatccagttgatgtgggattatatggtagaaaatacaggttacaaagggaacaagggaacttgtcggatccggcgagattgtagtcgagttgtttcgactagctcccgatgacttggctcctcgtaggctccggcttcgtaggctgtgttggttgtgttggccctgagattcaatgccctaaaccttccccggggggtcccttttatattacagatctggaggtctccacgtagaactcggaggtatcagaccctatacgatacgccaacgacccagttctgcccgagtatgattcttctcgtctgtagattccgtgaaaggtttctttataatatacaggaaatatccgcatgcgcgtgggtatgccatatcgatatgtaacgtatatcgaagggtaaagggtatgcgtaacccgtaaccctgacagtagcccccaacttctgcttaaaataaactcgtgcaaccatttgcaacttcgggtgtcgagattgttgttattcccggtgcgaggaccgcggagatagaccgtagtcgagcacgccatttgaagcccaacggtcacgagcgaattttaaactaaagtccagaaaaccgccgcgcgtaacggacccagaaatttccgacgggcatctctctctgttccctggaattcgcaccgtcgatagtgcgcctatttaaaggaattttgggagtccattttgaagtccgccaaacctgttaaacacacaccacctccaagcactctttgccttctccgccgccgcaagaaaccctagttcatcaacctaggctcgtttttcggcgaccttcgatcagcaatggacctcggcaaatcggcttccaccagtgcaacgttgaagaaactccaggaggatggcgctcttcctggtcgtggaaccatggagagggaagcaggaggtactaatcctcagcccatcttgggtcgcatgattgcgatcgaagattatgttctctccggttttctccctccaccttccgaatttcttctcctggttttgaatttctatggtcttaggttgacatgtggagtgcgcatgtcaacggtgcagccttcctatcttttccaggctagcgcttacacatgttttatagttgcaaaacctaattataataatccgcaaatctccatataacaacattaaactttggatcaccatgtcttggtcatacaaaatctgaatcgacccgttcaagtctcctaatatttgttataacctaaagaaccttgtgcctttctttttatgtattgttattgcttctttataggcttgtagctttgcttgtgtgcttcgcgtagcttctgtcgttctggaggttcccgaagcgtggtttgcggtcgtcgccgaaggttcggaaggccgttctctctgagcaaggcaagtcacatcatccttgatcatattgaatcccagtttataaaattattttgatttaaattaatgcattatcgctttatttaaattcccgcgttatcactgttttatttagccatgcctatttatctttgttatgaccttatcgttgttgttattgttattattaccttgttcaccctaggaaaataaaaccccaactagtgggtactctattcatggttccactagtaggaatttaggtagatgcttcgccgattaattaggcaacattaggtggttttataactttagactttgggaattctcatatcatttagacactatggaatggttggcttatgttggaattggacacacacctccccctctattcaaaacccccaaaatggttttaggctgggctcgaggtgcatggttgggttttgttagtcgtacctcgggtactataaggattaagctcgggcctctgttgcaaagcactaccgtacttccacatgtctagtgggtaaggcttagtttgtggctcagtctggttataaacaaaggtacacggatggagatggacgaagtcgggggtcgatggacatctctaggacaaatgaaggctacacgagctgcggcccggtagtcgagatgtcatggcacagggttggtgtccttctgctaggggctcaatcctgtctgcctgtcccggaggttccggccgtaggtggggttgggtcggtactcttgtttatggctaggatgggttgggaactatgtcacatcttccgtccgtatgccgtggtggtatgtggcacgtggttacacgtgaggaagatgtgtcttgtgggtaaagatgtacaccactgatcagagtataacctattcgaatagctgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatcttgtatagctctaggatcgtgtttaccaaatcgctttgggaaactaagtgacttttaaatgctgtttactgcaaaacttaacccctatattataactcccttgtactcccttgcatttattctgcacttgtgggtgtgtcttgttgagtacggtggttgtactcagtctcgctcaatttttcccaaacccagaagaggagttcctggaagatgaaggctttggtgtctagctcgtgcctgccgtcaagcgcctgtggttgtcgcgctagtcttccgctgtttttcgtttgtcttcttgtgtgctgggccttcaccgcccatgtaataaattatctatttacgcttccgcttgttaaactctgaattgtatcaacttttggtgtaccttgcctcctgggacaaggaataatacacgcacgtaaggaacgcccattgggttatttccggtcgtgacacgatctctaacaccggatttgaaggcgcgaattacaaaagcgtcggtgatttcaggaattgtgtttctgccctcgttgaaacgtcgaacatattccctcaatgattcacccgagttctgtgtcaacgcgtgtaggtcgtcttcgatcgcgtggcgcttgtatgttccttggaaattggcgatgaattgttgccacaggtctgcccacgaagagattgagtagggaggaagatgcatcagccatgaacgtgcagaacccttcaacgcggttggtaaatagttcgctaacgcgttgtcatctgctccggcaacatagagtactgtggagtagacttgaaggaactcctctgggtcggtgctcccatcatacttttctattgctccgggtcggaatctctcaggccatcggacatcacgtagggaacgaccgaaagctctacacccagcgttgggggcggtgggttgtcggcggtcgtgtgtgcttcgtggatgtctgtctgacgatgaggaggacgcggatgatgacgatgacgatgggtcgcttggttccagcgtacgattacgaggatgacggcctggatctcgggaatcctgtcgtcgtcttccgctgttgtctcggcgccgatctccatcgtcgtcatcgatacggcggcggccatgaccagtattgtctggcacccgtcgttcgcgatcgttgtgatcgtggtggttgtcgtggtcccggtcctcgtttgagtggtctcctcgatttccgttatcatggcgccgtgaagagacatgacgccgagagcgattcacgttgtctcatgtgcgtcgtgcttctcggtggccgttgatttaatctcgaagatcgccagtgccgcgaggtggaggggtagctcgttgaggtgattccctccgttccggatcttcaccattggcctcgctagttggtggctgctcctggtgtgctgcggtagcggcttcttcaaacgcgttgctgaggttagtcaccgattcccgtagttgttctgtccaacgctcgaggtcaacattcagaacgggatcgtaaggagtttccctcagtatcgcttgaacggccctgatgtgctgggctggagtagtcgattgattccccacttctgtgttggtgtgcgctgacgtgccaacgtcatcgatagccaatacctcccgcggcgcgctcgttgtcgatgacccatagtcctcaaggagatgtaagaccgatggtttgtgaggatcgatatcgattaccccaacgaatcgatttgaagttggagtcactctttgttacttgctgttatccctgatggggacatatgacttaggagatagagctttcatggcgccgagaaagactttgcagctcgagaggtcgtgattctttgtcttgtgaataggacaatagacatcccgagttggagaagtacgctgaattccacgttctttgcaggcgcgaatttcagcacagacgttgaggaaaacccagcaatcttgcagagtgtgtttcttggttttgtggataggacaccaagaccttgtggcttcggaagtcatctttgtcggctcgtggttcatgtcggaaggacaaagtttggccgtatcagaatccttctcgagcttggatgtcgtcgatattccgttctccgtctcgatgggaggatatttcgacatggaatcgccttggttcgtagccactgcgttctcgtctccggtcattggaggaccggttgagatcggcgtcgtggtgtaaaccgggaagacgatttcaccgacttgagtccataccagcattgttgaagtagtgagtacttggctgaggctggtgctgacgttgttgtcgacgaagctggatgacatagtagtagaaccttgagtaccaaggccccctacctggcgtaccactgtcgacgggtgatacccgtagaccggatatagagggtattggggtacgttggtacaaggatctacgtagtacgacatcaagcaaacaaaagacaagaattatactggttcaggccccttgacaggtaataaccctaatccagttgatgtgggattatatggtagaaaacacaggttacaaagggaacaagggaacttgtcggatccggcgagattgtagtcgagttgtttcgactagctcccgatgatttggctccttgtaggttccggcttcgtaggctgtgtaggttgtgttggccctgagattcaatgccctaaaccttccccgggggtcccttttatatcgcagatctagaggtcttcacgtagaactcgcatgtatcagaccctatacgatacgccaacgacccagttctgtccgagtaggactcttctcgtctttagactccgtgaaaggtttccttagaatatacaggaaatatccgcatgcgcgtgggtatgccatatcgatatgtaacgtatatcgaagggtaaagggtatgcctaacccgtaaccctgacactactatattctgagacgaaaggagtattaatttctagttttagcatcagctctaggctctagaataatcttgaattcatctatttatcaaaaaacagaaacatgtaatgcatttgctttacttttcttacatattatataaccaaataacacttttaaatatttcacactttcactggaaaaaaaacatttatgtcctatttcgcagaggaaaagtttcattttttgcacacagttgtcatttcatcgcttctccctatgactaatttgcctacaatcaaatttcctttgcgaattaactccaaactaaaaggggtacctataaaacattcgacagaatggaaaactttcaattgtaaatactatataattacattgtaactatattttataactatattgtaactgctatgtaactgcaatataagtaatatgtaactcatatataactctgaaaaattggatggatcaattggttagttgaatgagcatgcaagctacaggtctcgggttcgatccttgctgtgcagcacaaatctcaaagcatatcgtatggttaaaaattttacagttttcacccttttccatttttctctccacagcacaaatctcaaagcatatcgtatggttaaaaatttgacagttttcacccctaaaaactgttgacagtataatagcaaatccgaactaaaaaaaaataacaaaaataaaccttaataaaataagataaatccgatctcaactctaatcggatgtaaaaaaaaaatcataaaatagacgaaagcagcaactacgcacgtgcagccgtggaggcgtggactcactcgcaatcgcacaaaaacgaactacggcggcggcggcgatgggaggcgagaccaccggtgttagcggcggcggattccgcaggcggttggagtactacctgtacagcggcgagaagaagcacgtcgtcgccggcatcgccatcttcgccgccatcttcggcgttccctggtacttcatgagccgaggtacccctgatcatcactgccctcggcctgctctttatcattccgattttcttcgaatcaggcggtggagtcgttagattcacctaggccggagtcctgttccgcgttcaaatttgatccgcagccgtttaggggagctagggttcttggtaatctcagccttagcacagttcgtcgtgttgcttccccctttctggttgctggattggggcttcgaggtagtactagtagtaaggttgttaaggcgaaggttccattttgctcttgtagtgttaatggtatttggtaggacggagcagtgtgcaaaatagttcaatatgaggatttttggtttgagtattctctgtttctttttcatgatttgagaccattttttaggggaattgcgtgaaatgtatttggatcgtatgaactgctatggatttaaggttctatgtttcgtgcaaaacttgagacatttgaccggatagaaaatgcaagcattttatgtggaacgtattaacttcacaaaaatcataatagtagtagactattacaggccttcgttactacatcgtgttcagatcttctttaccattgtggttgcaatgttctaagattgccatggtcagtaagaagtataagatgagataacaaaagttggaagtaaatcgaacatgaaaagttgctattagtggataatgaattataagagacgtatgctcccctgttgattgatacacataacactatatgatgctctgaattttgtaaatttcttttgcttgacagcttcatttgacagctttagaatgaaagaagcatatgcatgtgcactgggtgaggagaattatagcttaaggcttcttgcaaccctgaattagcaacattttgcagtttagcatttgttgtgtcattaccttgatattcttatgaaccaaacagagcacacattaattccaaaccatgtagtattggatttcaatttgttatacactttctatatccttctattgaaattgataccccaacttaatatatggttacaggtgttctactcaaagtctcaaaccattcagcatttagttatggcttctgttaacttataggacacaatgtatagctttatcagtaagctatacgcataggtcatagggtgtgtttggatcgtgggcaagagagatactaacctaacttagcaaagagagctacttggtatctaaaataactctgtgcgcaagtttgcttgttttaactgttcataaagcttgaccaatgcagcaagccaaattggcttgctttcgttgacaatcatgcaaccccaagagaaaaaaaacactctgttggcagttactgcttgcgaggatcttaagagacatggccataacaaacaattgaaaagatattgatgataagaatctcatcagacttgactaaattaaagaagctgtttaaactaaactgaatccagatttattgatatgctactgctttttcagccttcccttgcacaatctactttgacccatatagctggagctggtcccatgacaatgtgtgcatatgatggtgttgttattagtgtatcattggaatctccacttcttatcgtctttctggttttacttttgtttactgctaaattctaatgaccaattgaaaatttgtggggcctttgttcctttttgaagtgtttttttaatgataaggacatcgaattgattttgtccctttttcgaagtggtgttatgccactaaactgttagctatttgtaacacacatttctgcattgtcagagtgatcaaagtgtttctcattaaaaatcagatatgattagtgctgatttttgtttcagaatgcatgttgatttttgttgaagtagcccttaaattaccgaagtttctgaatactatttttggtacatgaataccagttgattaattgattatgcaatgcatatcctgcagggacaaagcatcaatctcaccaagattacatggaaaaagctaacaaggcgaggtcggagagactttcttctggacagtcatcagcaccaaaagcatgaagtagtaatccgtaactcagatctgtgaaacctcagcattcatagttttgatctataatctagctgagcactttatctattgggtgaaataagcaggccatctcttgaatattgaccctgatgacatgatcttgtcagtttcagaaaccatgtgtaaacttcacatgaaattttgtcaaatgtagcctttctgttcactttatgcgcaattctgtaggagatgatcaacaagcaccagatttttgtctatcaaatattcaaatggtggttctcgagccaatttaacctttgcgtttgactttagaatcattattttcatgatgttcctacggtgtgtttatgatattgactacggggtatgccaagtgctgagatttttcagttaagtcgcaaggtgaatttagccgtgggacattttcaaaaataaatgaaaatgttgaaggaacacggttgtcgtggcgtttcgcaccatctgaacattactatgttgcgaaataaacttcaaattattttctcttatgcatgtagaccttttcctcaaacttgatgtttcttcgccgaatgtactacgacaaattttgccttttataggattgcctacaaatcctagcattggtacaaatctaagttattctaggaaatataaaaacaaactgaactaaattattctaaagtcacagggtgtagtgatcctctgtcctaaaatataacaacttttggctctaaaaatgtttatattttaggatggagggagtaataaatatcaaaccgaacaaaaaaaaggcaaattttgctacaggacatcgcgattatgtgtatttagatcagggacaccgcgaaagtgaagctttggggaaagacatcccataatcgtggttatttgctgatggacactgcgccgtctagcgtagacttgccatgctgacgtggctgacgggaggctgttttttgacgcggtcggacgtaaatacccctgcgccttatctcctcttatccactcagtttggctccattcgcaagcagtaccagtgaatctggcattgtagctggacggcggcggcgaggatcgtcttcgtcaaaggcggcgaccgcttgaagtcggcgtggtccctttggtagacgtagaggggagggagctcgttggcagcgacgatgtcttccgcttcttctttctcacgtgcttcttcctctcgggttcggcgtgattcacaggtcagtgagttgcctcttgtgaaatgtccattctgcaagggcgattcaacggtagtggagcggacatgcaagaaggaagagaatttcaaccgcaagttttatcgatgcctcaccggacaatatgtaagttgttctttgcaatccccaatttttctagggtttgagttgaaatcgagtttgtcatttgataagctgtgtgctcattgttgttatttttagacaagtgcacaatgtaagtttttcatgtggcaaggggattatgctgtttggttggtgaaggaaggtttccttcatggatggacagattgcaatgctcacaggatagaagatgatgtcccagaatcagtgaaggcttcattgaaaggactacatgatggaattgagaagataagatgtgagatgaaggaggcaatgagtagaatttgtatgtttgggattgcatttgtgactgcttttgttatgtttgttgccatgaatgtaatgaagtaggaccatgtaatgaagtaatgagttcaattgtgatgaatcaaaatttgtgcacttaatgtaatgaagtagaaccatgtaatgcagtattgcaggaaatatttgtgtttgcccaaaattgagatgtaatgcaagaaatatttgttgttgacatttcagaatcataaggcatatgaagtagcaactatatgaataacaaccattttcctccatttcagcaataggactttcatagataggtgaagtcatgtcttgcaacatatacataggtagctaaagtcatggcttgcaaaataagggatgtctttcagctggcaatttcacatatacacaaaagacaagtcttgctactacttcagctagaaatttcaacaaaataacctactctaatagcattggattacagcttctttgcagtcctggtaaccacagccttccttttgttggctttaaatggacttgcatgttctggggatgcaacactcttgctccttgtaactagtccagggatgtcatccacctgcatagcaacttgtgcaggggcttgatcaccagcaccagtaggggcttgatcaccacaagcagcaccaccaacaggggcttgatcagcagcagcagcatgagcttgatcagcagcagcaccaacaccagcagggccttgatcagcaacatcagcatgggcttgatcagcagcaggggcagcagtagatgtggcttgatcagcactatcagcagcagcaggaggaggcctgtgaaagagatattgaacaaatattttaaaaacaaaatggcaactgaaaacttgatcaaaacatgacacacttacatagtgttgttaccaccagtaggcacttgtttaggcttggatttcttctttctaactctcttaggcttgggtggagctgggggaggggcatctgggtcatatacaggttcattgcatgtcttttgtaggtggccaaagccatggcaccccttgcatctccttcttttctttcctgaaccaccttcttcaacaccaatgaacctccttgttctaggtcttccagctgatctcttcagtattggtggccacatcttgaatcctgtgtccactttctcccataggctcttgtctggcattggaggcacaactgtggaataggcaaccctgaacatggccactgaatagtaggggctgacatagtcttctagctccacttctctcagggatccaataaaagagatggcatgcctacatgggaggcctgttagctgccattcattgcaactacattcttgtttggtcaagtccacagtgtgtctccatgttgtcaagtcccttttttgcaccactgacttcacctacaaatggcagactcttgtggtgattgtagttgagattcctacttttgtcatggagttgcttcattacatttcctaggatattgccttgcagcttaagagataatttgtgccttgtacacatcctctccatgatcatctgcctaatcttgtcaagcaactcaactataggtagtgacttctctagcctaatccaactattaaatgtctatgcaatgttgtttatcatgaagtggagaagctagaccttgcccacaaatgctggtgattctcttcaatccattgcattgctcttggtgaagcctctttcatgatattaaaatgcctgtcaaaaacatctttcctatatgctcttgaggcaggccacaaatttctttcaaatacttctccatggaaccttttctgaaaattcttgtacaaatgcctcatgcactctctatgctctactccattgttgaacacccttgtcactgcagcatctatgcccttgcctgcatcagtagacagtactaggacttctggagatccaattgccttattcaaacaaaccatgaaccattcccagtttttctttgtttcagatccaaagacagcatagggcactgggaacatccaattgtggccatctataccaatagctgaagccaactgccctctccacttgcctgttaacacagttgaatcaatgcctaaatatggcctgcacccattcaaaaatccatttatacaaggcttcaaagcaataaacatcctactaaacctatgcttctcattaatcacatcatactctatctccactatactaccaggagatctcttctcaatctcagctttaaaactatacactacctcaaaactttgctcccagccaccaagtatctcatctaaagccatctgcctaccatcccatactacatagtatgacagggtgattaaatacttctcctccaaagtcttctttagagcagcagcccctatggttggatcttctctaagcttgttgataaccctgtctttaacccaagaattgctggccatgcaattattctccaatttgcctgtgctagcacacctatgctcatatggcatgttctttatctgcaaccaaaaagggacagtaaacatccaaaccattattcagttgcaaaacattaaatgacaaagaagtaaaacaaaagagctacatacctgccaagttctaccatctggcaacctagaagcatggatcctccatttgcacttctttgccttgcaataagctctgtatcttgtggcctcagagtagggcactgcaagctcaacctctttcaggacagcatattgtctcatacacctcttaaaacaaattacatcctaaaaagtaacaccaacttctatccttggattgcctacatcagttatatggattagaggctcacaacccctattatcattgacttctaaatcatctactggatcatcattctcttcatcaccatcagattcctcaggagtgtaatttggatcattagcctcatcatctgacaccagctcattgtaattctccctctcatcactaactcctacatactcaacctcatcaaactcaccccatggatctggatttggcattgattgatcagtagctttgtccctggacttgctatttttttttggtgggaaccttttttgtggtagcatctctggtaggaacattgtcagcctgacttgcttgtgtgggtaaaaccatactcagtggaaccactgttttagcttcatccacacaagacacaatttgggaacaaggctcactcactgtcacttgcaatggaagcttcctaacatcccagtattggttaaatgcctctaataacacagcatcagaacaaatttctacatccctacccactctcttgtcccagaaagtcactctaagctcctgcgcactaccacggatgatttcatcatccaagtccttcatcaaatctatcaagcttattgtgtctttatctacaacccacttatgtggagatgatacatgataatcttggctaccattatccatatactcaacataagcaacaaccctaaccacaactctgcatgcagagttcggatccatcctacaatgcaacggcaaatgaagagaaaaaggggatcccaaatcagatccaccaaaccatgcatcctaatgcatcccaatcgaatcaaagagaggaaaaacgaatcaaagagaagaggaatccaaacttaccctttcggaatccatttcggcattggcggcgctgccgccagcgcagattccaccgcctcctacgacggtgaagccatcaccgccggtcaaacttgcatcccaccagcgacaatgcctgggcacagccagtatcgagggtgacggaatcggtgggaatgggcactgtttggatggaatcggtagagctagggttctaccacccgtactgcttgcgagtggataagaggagataaggcgcaagggtatttacgtctgaccgtgtcaaaaaacagcctcccgtcagccacgtcagcacggcaagtctacgctagacggcgcggtgttcatcaacaaataaccacgattatgggatgtctttccccaaagcttcactttcgcggtgtccctgagctaaatacacataatcgcgatgtcctgtagcaaaatttcccaaaaaaaaaatacatccagaatgcatgcacacgaaaatctgacatatctggagagaatataggagcggctcgggcggcgatccgtgatggcgagctcgccgttcttgccgtacctgaggcggaacgtggtcatgtgcagctcgcacttgtcgccgtcgccccagcaccgccagtatcggggccgctctcacgacctgccctcgacgaggcagaacttgccgccgccgcccatagggacgagcgtcgcgtcgtcctcgactgtcgaggtcatcaccaccatctcgcacagcttccagttgggctcctcctcgtggctcccggcggcgacgatgtcgcaggagcagagtttgccgtggcggtgagagtcgcaatggaggccgacccacgcgtcgagctcgccgtcatagtgcgcctcgccacggaacggcagcagccagtcgccgtggcgcgtccactcgccgcgctcggtgtcgtaggagaaggtccccgccatcttcttcgcctccgcctccgccgcctgcgcggcgacgtggtcatcaccgtgcccggggcggggcacgctccaattctctatggagacgaagatggcgctgcctccggggcgcacggcgtgcgatgtgatccggcggtgcgcgtggtcgttgtcgaacgggaccggcgacgggtcgtggctccaagaccaccgctccgtcgccaacggatcctcttcgaggcggtgcatcgccgcgtcgatgcgagggcggcagtccactgaccggtcggacggcgtgaacgcgtacagcttgttcccggcggcgtcccaccgctccagcgcctccgggaggcggtgcacgaaggcctgcgccgccgtcttggtgtcgtacacgacagcgaggccatctttgtcgctgaacgggtagcccttggccacgatgttgctgcccagcgcggcgaactgcgcgctgctgcccatcatcttcaaccgggagtgcacgtactcgaatcggacagccggcgccggaagacgcctgtaggtccgtgccggcagatagtccgtggcggcgacggtgacgagctgatcgtctgcgtcggcctcgttgccgtcaaggtccatcttgtgcacgctgaatcccctgctccagtcgtcgagcacaacgtacaggtgctgcctttgcggcggccaccagctgcgacgcgaggacccctcaccgttgttcaccgacgacgttgttgaggtcgtcgtcgtcgtgggtgtgggtgtggagacgacgaagtcatcataatcgtcatcgtcgtcggtgtaactgtaatcatcgcaatccgtgaagtatctccgtggtgaaaggagcacaccgcctgcgccggccagagcagccaacaacacagcgcgtggatggtggcttgcggcggcacatggccggagatgacaattagatcggcggagaagcgattgcagcattcgaattttttgcacccactctcccgaggattccggaaaggtaaaacctaggtgtatatgactcggacctatatatagcggatggaaattttacagcactagaaaaaaaatgcttccatgatatgagaatttaagaaaatattgttggcaactttttttgacaagttgacaagcacgatcgcagcaccttaagctttgcggtgatcctagagtcgccaaccacctcgatctagcaaagagctaaacctagatgtgttttgataactaaaccggctagcggagccgatttctagataactacccgtctcgtgggcaaaacggaaggttttcaggacaaacctacaaagagatgtcgcactctcgcagcggcggcggacggtttacggcgcaaactgacaaagatggacaaactaagagaaaactaaaagcaatatgaaaaaacgattcgattgattgattgtagattggttttttacaatgaaccggccatgtccattatataggggttggtcttgccctctacaggctctcctccaagtccaactccgggtagaaaccaaaggaaacccgaaacatgccttcccgagcaaggaaacctcaagacccgacgaaacacagtcggactcggacctgccggtcagaccggccacacaccgccggtctgaccggccctcaactggcagtctgaccggccaacacacggcggtcagaccggcccactcggaggaaaccggtagatttccaaattttggcaatctttcctattttaatcctaggtgccaaatttgggtgtaaacacatgccccctgccttttttatgaacaacgtgaatctaaaagcatagaacatgttttggtctaaggacgataatccaattaccggccatagtacctcctaagcgtcttgccaaacgctcgggaagtatttcttcaagtatttcccgttgattgctcgctaaaaacgctccccttgaagtgtctctaaaaaatatgcgttccctcgaacaatgccgcatactcgataaggaccctcccaactaagagaccacataccgaactccttggatcgagtacccaaaggcaaaattgtcttccaaactaagtctccaactagaaacaactttgctttcacccttttgttgtacgccttagccaccctcttcttctctttctctatttcttccaatgccttcaagcgcttgtcgatgacttcatcaagattgtcttccatcaacgtcttgtaatcttcacttgacaaaccatcttgcttgatataacgaagagaatcaagatttacttccaccggtaaaacggcttcttgaccataaaccaactcaaaaggagcgactttagtggcatcatgtttagaaatcctatgcgcccacaatgcttcggaaagcacctcatgccacctctttgggtgttcctcaatcttcttcttcactgatttcaacaatgtcttattactcgattcgacttgtccattagcttgagcgtaataaggagaagaactcaacaatttaataccataagattcggtaaaactcttcacttccttagacataaaagaagcaccttgatccgtagttaatgtttgtgtaataccgaatctatggataatatgcttcaaaataaagtcaattacctccgtatgagtcatattcttcaaaggcatggcttcggcccacttggtgaagtaatccgtagcaactagcacgaacatatgcccctttgatgacgaaggataaatttgaccaatgaaatccaaagcccatcctcggaacggccatggtttgattatgggattcaacaaggcggcgggcgccaattgaacattgccgaaccgttgacaagcctcgcatcctctataatatttgaagcaatcatcaatcatcttcggccaatagaaccctactctcctaagcaaccaattcatcttgtgggccgattgatgagttccacaaattccttcatgtacctctcccatagccactttagattgatcttcatctaagcacttcaacaagacaccatctatatttcggcgatacaaatctccatcaagcaatgtatatttgaatgcttgccgccgaattttccgatcaaccttaagtgtaggatctttcaaatatcgaatcaaaggaattctccaatcctcttctgttcccttggcacaaatgtccgaattcacacttaattcggcctctaaattgattgaagcgtgccccccagcgctctgcccagaaccggtcagactggccacgcagggccggtcagaccgctcggggtcgccggtcagaccggcggcatgcggccggtcagaccgcccctgctcaccggtcagaccggccgtgcaatgccggtcagaccgcccctggtctccagttttgccaatttcgcacaaagatttaaaatcaagcaccggctcttctaatatcagaaataatcccttcttcacattatagccagatgcttgttgtgacaagtcatttgctctagaattatcatgcctagcaatatgtctaatagcaaaattatcaaaattggcaataatatctaaacatgaatcgaggtacctatttagtgatccgtccaagcatttgtagactccagcgacttgttgcaccaccaattccgaatcaccaaaagcctccacgtatttagctccaaccatctccataacttgtaagccgaataatatagcattgtattcagcttgattatttgtacaataatactccaaatgaaccgatgcttcatcacacatgccattaggtgaaaacaaaactacccctatgccctgaccttctttgcaagaagaacgatcaaaataaatcttccaaggtataactttaactaagcaaacctctccctcatagcaatatctatatgatggtctactataaaatcacatacaatttggcatttcatagatttcaatggttcataaggcaaatcatattctatcaaagcatatgcccacttgccaattctcccacttagaattggcctttgcaacatgtgtttaataacatcggcttgacaagtaactatgcatgtactagataacaaataatgcctcaatttgctacaagcatagtataaacatagacaaagtctctctataaaaacatacctcgtttcggcatccaaaagagggcggctcaaatatgtaatgatatattccttgccatcttcctcttgcgccaaaacggcaccaataactttgtcttcggaggcaatatataaccgaaaaggctttccggctttaggtgctcgcacaacgggtggagtagacaaatatctcttcaactcttcaaacgcctcttgttgttttgccccccaagtaaaatcggcttcttttttcaaacaaagtataggaacaaaagcatcgattttacccgctaggttagaaataaacctcctcaaataattcatgttacctagcaactttttaacctccttcttacatgtcggcgctttgaaatcacgaatcttttctatcttcttaggatcaatctcaactcctctctcatgcaccatgaatcctaagaacttccccgccgacacaccaaaagcacatttaagtgggttcatcttcaaaccataccggcgcatcctctcaaaagctaacctcatatcggctatgtgtcattccataccatccgatttgacaacaatatcatcaatgtagacctctaagataatacctagcaaatcatgaaagattaaattcatcgccctttgatatgttgcaccggcgttcttcaacccaaaagtcatgaccacccactcaaataaaccaacaaatcccgggcaccaaaaagccgtcttgtacatatcctcttccgccataaagatttgactgtagccagcattaccatccaaaaagctaatcaccttatgacccgaggcatcattaatcatcatgtcggctataggcataggatattcatctttgggattaactttatttagatctctaaaatctatgcaaactctaatcttaccactccccttcttctccaccgggactatgctagagacccactctgcataacgacacggcctaataaaccccgccttcaacaaccgatcaatctcctctttgactcggtcatatagcaaaggattaaaacgacgaggtggttgcttataaggcctaaaacccggtttaattggaagccgatgctcaacgagctcacggctaagacccggcatctcgtggtactcccatgcaaaaccatcaacatactctttaagtagctcgattatcttaaccttataatcggctctcatgtttttgtttacgaaagtcggccttggtttagtttcatcacctatatctacttcttccaaaggatcggccaatgtaaacccttttccaagcttctccacttcatcaaaatcttcaacagtttctccaatatcgttctttgtagaccgatattcttgcaccctcttttgtaaccactctaaattagcctctttactcattatacaaatttatatggcttagccgtgctacactagccggctttacagagataggtacaaatttgccatcggagatactaataaaatcatagctagaaagatccctccccgataagtattggatattcccatgacaccactcaaaagtagcatcggccattgcaacctcggctgatgtatccgcttgaacaatttcaacatcatctccgtcccattgaattaaacattgatgcaaggtagaaggcacggaacaattggcatggatccaacaacgacacaaaataacattgtagttaccttgcacatcgacgatgaagaaagcggttggtagcgtcttgtttcccacggtgagctccgccgaaaagatacccttcgcctccgttggttcaccattgaagccattgagaatcatgttggtcttcttcaactcatcatcctcacgccccaacttcttgaataatgagtacggcatcaagttcatggcggcacctccatccactagcatcctagagaccggcttcccatcaacatggcctttgagatagagacactacaagatatgtgtggctttttgacgtatttaataagacacatgccataatgtcactatatcatataatttatgatattttatttcaggcatttcaacttaatgacaataaaaagttgtgtgtcacaataaatgtcatatagctagtctaatgtcatccagtgacaatatttagtatgtcataagacctatttgtgtgtcacaaattattcggcgacgatgaagagatgttgtgtccatgccgtcagtgtttgaatcgggttccccaatttaaaggacgggtgcatgatcacttgcatattcatgggatggctactgcttacactagatggatacatcatggagaaccattggaggttgtaccacatgaaattgatgaccatgttgatgaggatactagtctcaatgaggattttgacatgaatgtggatgaggaagatgacactgatgatggaattcatggtatggtagaggagttgtacacagctgaagaagaaggtcaagggaaaaagtctatgtttgcaattctattggaagagatgaaacaagaactgtaccctggtggtccttgcacaaggttttcttttgtggtgaagttacttcatatcaagtcattttaccgaatttctaatgttgcattcacagtgttgctgaagttgttgtcatcatcattcccaaattgctctattcctgcatcaaacgaggaagcaaagcgacttatctgtgcattggggcttggatataattcaatccatgtgtgcccaaataattgtgttctatttaggaagaatttagaaaaaaatgatgtttgtccggtttgtggtgcatcaagatggaaagacaatggtggaaggaagaagattcctgagaaggttttgcgacattttccattgattcctaggctgaagagaattttttcttccaaaagaacggcagaggaggtgcaatggcataagttgaagaggaagccagtggagaatgagctcaggcatccagctgatggcgagtcatggaaaaactttgacagaaagtatgggtggtttgcagaagatgcaaggaacatcagacttggccttgctattgatggtttcaatccatttggtaaaatgagctcctcgtatagcatgtggccagtgtttcttatcccgtacaattttcctccatgggaatgtgtagagcaatcaaactttatcatgggcctgcttatccctggtcgagaatgcccaggaaaggacattgatgttttcttggagccacttattgaggagctgctagagctttggaaaggtgtccctactgttgatgcacttactaagaagaagtttgatctacatgctgctataatatggtgcattcatgattatcctggtttgagcacattgtcaggtagagtcacaagaggttattatgcatgtgtgcattgtgataaaaacccttgctccaaaaggataaggaatatgatatgttacattggccatcggcgtttccttgctagggaccatccatggaggagaagcaaggtgtttgatggtaatgttgaaaaccgtgagaagccagagaaatttaccacggatgagctgatggagcaactggagagggtcaaggatgttagaccaggaaagcatcctgaaagcaaaaaaagaaagtgggacgaagagggccaatgttggaagcgaaggtcatgtttgtgggatttgccgtattggtcgagtttgaagctgcggcataatcttgatgtgatgcacattgagaaaaatatatgtgagtacatccttggtacatttctaggcatggctgggaagtcaaagtacagtacaaattctaggcttgatttggaagatatgggtattaggaagcatttacacttgatccgtgatggagattcatatagttctcctcatgccccttacacaatgactaaaacacagaaggctgatttttatgattttttgaagagtgtaacatttccagatggatatgcttccaacttagcaacatgtgttactgcagatggatgcaacctccaaggattgaaaactcatgattgtcatattcttcttcaaaggattatacctgctgctgtacgaggaatcatgcccaaggacataaacgaagcacttgctgaattaggtaatttttttcagcaactatgtgcaaaaactttgaacttagatgtgctggaaagattgaaagctaacatcccaatcattctgtgcaagcttgagaaaatatttcctccttctttctttgatgtgatgctacacctggctgtccatttacctgaagaggcaatttttagaggtccagtacaatatggatggatgtacccaatagaaagaaggttattaacattgaaacggtttgtgaggaacatggcaaggcctgaagggtccattgcagaagcatatgttgctgctgagtgtttgactatttgctcgaagtactttggtgatgatgttgagacacgacacaatcgggagggcagaaatagagagcgtgttgctattgtgaaaaaagacctatctgttttccagcatggagttgatcttcttggagcaccaagtcttacatatcttgaacatgattgtgaaaaaatggtttggttcgtgctaaacaattgtctggaggttgagccatatattgagtatgtcatcgcatctactattttcattgtttcttggatcttacttattagccctaatgtttgaattaactatcatttttaggatatataagaaagagttggagaatgaaggatgtcctaatgttcaaaaaacccttgagaagcaattttctcgctggtttaagaagcacgtgagtttgatctctattactttatttcatcattttcttcctggtttaagaagcaaactttttatgtcaattatttttttgtgcagattacaaaacttcgttacgtggatagacaagacataaatgatgagctatttgcgctgtcatgtgagcctgatctgcgagttcgaatttaatcagcttgacttgtcaacggtgttcgattccacactgtagaccgtgagaaaaatagaagaacacaaaatagcggaattatggttgagggtacacatgataaccaggaaattgacttctatggttccttgaaagaaataattgagcttagatacaatgcagattcaagtggcgataggacggtggttctatttcgatgtgattggtttgacactcatggaaagaagttccgaatgaaggaagatgggttcttcaaaagcataaaccatggcagcttgtggtacaaagatgatccatttattctagcaacacaagcaacaaaggtattttatttgttagacaccaagtatcatgagaaatggcgagttgttcaaaaattttcacatagacacttgtggagtgtggctgaaaatgacaatgaggatatacccaatgctgtggtattgtcctaccaagacgatgattgtgaaggtgtgcatgttcaacttactgaaggatgtctagaaaatgaccagccagttagtgaaggtggttttcgtgttgatgctagtgtagttgatgacctccgtatacaaagagaagcggaagggcaacaagatgagtcgggcgacagtgaagatgaaactggatggcaatatgtgagtgataatgaaggtccaacattccctctagaagatgacgatgatagcaattatgagtagatttagttgtggtttcaatttagttgtcgatgaatgatgacttggactatgtggattattttgtttaaatagcctgtactgcaattgatgctgatgttgtgtgatgctgctgtgttgctggtactactgttttgctgctgtgttgctgcagctgcagctgctgtgttgctcctgctgctgtgttgccgtgctgctgtgctgcagctgctgtgttgctgatgctgttttgctgctgaaattgctggtttgctgcgaatgctgctgaaattgctgctggtactgctgagatgctgttgaaattgttgctgctactgaaaacttgcagatacagctattttgctgcagctgctgctgttttgtggctgttgctattttgctgctacagatgcagctgatgctgtatgatgctctaataatatagaactaattaaaaagtatatatgaatctcaaattattacaatcccaataataagagttttctgaaatttaataaaaataacattgttgactaacaaataatataggtatccacccactaatattggtctccatgacgttgccacaaatgttcgatgagatcctcttgcaaccggttgcgaattgtcttgtcattaatttttggatgaggaaatcagccacctgagtagtttttctctcttcttaatcttcaacatcttcgatcacgccggccacaacttcattgccgccgtggagctcgcccactccatgtgccatggacaagctcgaccatgccttcaccgttgaggggatcacctgaggtacgtggggccgacaggatctagtgacggcggcctccctcgatgccagatctggtgatggcggcctccataggtgcacgggagggggctcctagtgctcctagagggacgagagggaggtcggcctgacgctagatcaatctgagctgttcattttgatcagcagctctttttcccttccccaccacgaactgcctctccccctccgccgctccgtctccgtcctccctgttccctcaccggcggtgcctctccccctccgcccctccctctccctcgccatgaggttgcaggaggactcgacggtggtgggcggcggcaagcggcggatgacgtacttaaaacccaactcaaatacggatctggatttccaaaagcaaacgaacataaaaactgggcacatacacggatgacgtaccaaagtaccagcaaaaacatcttcaatttttataatagtagagatagagattttcccatcggagaaggattgaagcgggatcgatcgcacgcgcgttggatgattttttttggtgacggacgaaaattctcacccggaagccttacatatttttttaagtaggtatagatgtgtaacaatgaataggaaaaaacggggcgtgcgccatatttctattatccttgtaaccttacatattttaatccaccaagaatgttctgtacaacttgaaaataaaaatatgtactgcattgtgaccttgcagatagaattattttagagaccttggttcaatatagtgctgcataatctagagttgacacttgtttatgctgcttgttgctcgctgttgctgcacactcccagggtatcatttgaatgctatttaatgatatgttcatgctcttgtccagagtcaattcacaatcaacacagatgctgatccagtgatagctgcattttctgatttgctcaaaaatggacagcggcagatgagatacaggctaaagaagaaatatttcaatggtataccagcaaatgaagttagaacaacttcaccgctaagctctatgactgacaatgagtggaaacaactcgtggacatgtggtctaccccaaagcataaggtatatctttccttaatatctatcataaatgttgccttacaaaatatgaattgtctgtccagtaatgtttgtctttctataggaaaaatgtataaaaaacaaagatagccgtgagttagttcaataccaccagatgacaggatctcggagctatgttgcacaatgctatgtcatggtaagataaaccgttgcatctctacaaacttttgtgatttttagttgatataggagcttgtatatgtccagaatgtccactagcagcttgtatgtgtcttgagtgggttgaatattcagaactattgtctaatttacagaattgtgctttggtggcgtctcggctaaaatcacccatattcaggatatgggtgattttatcccagccaacaaggtcctgcatgtgggtgattttagacaatatttcagaaaagtagacaacagtttggtgttctatgttttccttgttttggtcataagtggctgctattgttcagcttggcgacaatagtgcagccagcttttgtcgcctgcagctgttgccctccataaatgatgtgttcattgtcaataatggtttgctcgttcatctctagactaagggcattaaattggatttttgagctgctactattcatttaacttttcacgtgcttttagttaacttctttaaaaaaaatatgcttttagttatttatttttctatttgtatgtaatttcaaaagcaaaccaaatttaaggatgtgccaccaactgcgattgatattttcaaggacacccactgcagtagcaagtcaggttttaatgagaacgcaaaggatgccattgtgagtacctttccctatctggttactatgaacaacacaatagattactacatatctccatatggacatcagataatacctatatatattctggacactatcatagaaggttttattccaatcatttcatttcttccactaggttgcatttctatatggacatcattacacatatattgttctgggtacacatacataactagcatagaaaatctgattttttttttggttttattgttgctaggctcaaatggaggcctatgttgctcaaccaacagaagaaggcaaagatccaaagactcctgttgaagctgtagctcatgttctgccaaaatcaacttttcttcgcaatgttggcatgcagtccacagagatgaagaaaaatgccaaagctgctgcaatgaatgatcatgtacgtgagctagagagtgaattgcatgctgagaagatgggatcagccagaatgcaattgcagatagctgatctacataagcaattagaggaccagaaagaggtagcaaggaagaatgaagaagaaactgagaagctgaggcatcaaggaagtgaaatccaaagcttccttcgctccttgtttggcagcaagtttgcatcatcagatgctcagcagtaagctctcatactcaattaggttctagatgatattttggtaacactgaacttgcaaccattgtgattgtgggatgttattttggtgctgttgtgcttctggccgttgtgctgttgctgctgtgcttttggccattgtgctgctgctgctgctgtgaagctattgcaaatatgctgttgttgctctcaatgtagcaggaagatgaaatttgatactttggatatgtattgaattagtggatagatgtactgatattgaattttaagacttgtggaatgtgaaatgcatgtgacattgcaatcatttgtggaatgttaattcatttgaatctgattttgtatgtgctgaaatattgtatctgggctgaattgtatgggctaaaaaaaattagttgagttatgtgggctaaaaaaattatatgggctggaaaaatatatgggctaaattgtaggggctggaaaaatcatatgggctgaattgtgcgggctagaaaaatcatatgggccgaattggtgtgggctgaaaatttgtacaggctgcactcattaaaaagaagcaaataatatgctgggccaactagaaacaaccccagaaaaaaaaatatttgtggcccatgagctacatgggctttagcaggccgaatcttattttgtgacgttttttttcaaccatgtcaactgccaagtcagctgccacgtggcaagccctaggattttgtgacaataaagcaatgtcatatgcttgtgacaatagatgtacaaacgtcacatactaaatttataacggtggctttttgacgtttgaaattacgtcaaccgtttgtcacaaattgtaatttttgacataaatttcacatattatgacataataaaatgtcaaaaagccacacacctcttgtagtgagaggcttcatgtgacggtttgactcatcgggcttctcaaaaaccgcgtctttatgacctaatgagaattgagcaacctcggcttcatccatagcacaaaactccataggcaacatacataccatgttgatatccatgtcttcttctggagatgattcacctttatcaaccgattgctcctccttctcctctacaacaaccggcttttccttctctatggatttatgcctccataccgtggtggtcgtaactcattaaaccttttatctctttgttcttcggcttttttctctcttatctcttgagcccgaagacgttgcaaccttctcttttgagtagccgtcaaatccttaggcatccacctaggattcggctctgttccaggaggtaaataatgtcctctattgattttgcttagagacgatgaagccctcacatcaccctttgcaatcctcctatcaaaccggcgctggagcccggtcagaccggacgtagaccaccggtcagaccggccagatgcgcctgtcagaccgacatttggtgcgggtcagaccggcctgaagcgtcggtcagaccggtgtcggttgggcggtcggaccggcctgatggcccggtcagaccaaccacatggctgcggtcagaccggccagaggacccggtcagaccggccgactgcgatgagctggtatcggcttcggattttttgtttggggacactccaactccatctccagaaggtattggcacatcatgagaccccactttgatagtaatcacctccgaagtcctcacctccaccttgacgcgctttccttcccttttttcttcattagcccgattcttaccataaaaccggctattgtttggtgaagacaaacgctcatgaattggcctcctcggtcctccccacccttgattgaattgcattggaggcatatgattgaacattggtggcgtcgccccccatggcatgaagtaaggataaggataacccagcggtggcattggataagaaccccatgacatgtcttgtggatgatgatatgaaggggaatgtgaccgtcttggtgaatgaccaaatcgctccctaggaggtgatcttggtcttttccctttgttgcgagccctctcaccaccttgcttagctccactcttattctccttccaaacgtcaacctccggcttctttggcactatcatcttaggccttggttcgccaatgaccactcctttttccttagcagatttggcttgctccggccgaatcaactccttatcattgaaattaattgtgttcaccggaaaaggatcatgatcaagcttcatcttggagccatcggtgaacttcaatcgtccttcatctatggccgattgaacctgtcgtcgaaacacattgcaatcattagtagaatgagaatgagaatcatgccatttacaatatgctcgacgtttcaactcttcttgagatggtatgacatggcctttaggtaatctaatttgtttttcttgtaaaagataatcaaaaatcttatcgcacttggccacatcaaaactatatttaacctcactttgccaatctttgcgaggagtcggcattaggttggagcaaacaaaaggcttgtttttgttagtccatgaccattcagcaacatatatatcatgatcaccctcctcctcactatcgctagcctcagggtaatcaatcacattaacattaggctttttgtcatatgttctaacaagttttttattatccttgacccggctttcttgagccaaagccatttgcataagttgactaacatcaagaaattgttggccatctagtctttctctaagaggagcaattaaaccattaaaagcaagaccagccaaatctctatcagttatattcaagctataacatcggtttctaacatccctaaatctcttaatataatcaatgacaggctcattatacttttgcttaaccgatgttaaatcacataacctaagctcagtttctccagtatagaaataatcatgaaatttttcttctaattgagcccaagtatgaatagaatttgccggtaaagaagtaaaccatgtaaaagcattaccggacaaagataaagaaaacaagcgcaatttaaaagtatcactattagcctcaccacattgcgccaaaaattgacctacatgctcccatgtggtcttaccatcctcaccactaaacttggtaaattcggaaactctataattacggggaaacggcacattatcataataatcaggatacggctttttgtaaatcctagcacgattcctagtttcaatcccgaatctattcctaataatctcactaattatatcctccatattattaggcccatgttgatttggcggtggatttggtggcctaataggttgtgtttgtggcgcaatatgattatgttggccttgtctaggatcgggaggataccccctagcaacatcattataagcattaggaacatgtgggggaacttggggactacttgtagcagtagatataggcggatcaaatgttctaagatgatacaaataactagcattagtcattggatctattccctgtatcggaataattgtgccggtctgaccggcccagggcctggtctgaccggcatccagaggcgcggtcggaccggcctgagtaccggtctgaccgccggggtaatacccggtcggaccggccgtttggccggtcggaccgacggctaagtcgcggtatgaccggccgtcaggcccggtcagaccggccgtgtgtgccgctccatcggtttttctacccgtttgatctataggaggttggttagcagtggtaaaggctttatcctttgacatgtaatcggccataagagggccgaatttaacccttaaaaactcatcaaacttaccctcaaaagttgcatctaacttatctttaaaagaaatcatagatgaatctattgtagatgctacttgttgttggatagattgtgttacctcatcattacttaccaaatcgggggcgagcttaggacgtggcccgggcttgatgatcacgccttgacgagtcctagtgcttgccctcatcaacgcctcccgtgtgagttcgttgatgtactcctccatagctttgtggtcctctccttcgaaatcctccaatgtgaccagtatcacattggatggctctacctccgtcttggatggcggcttcgtcatggcgaagtcgaagttgagttgacgatgaacggatctcctccctagcggagtcgccaaaaatcgtgttggcaactttttttaacaagttgacaagcatgatcgcagcaccttaagccttgcgatgatcctagagtcgccaaccacctcgatctagcaaagagctaaacctagatgggttttgataactaaaccagctagcggagctgatttctagataactacccgtctcgtgggcaaaacgaaaggttttcaggacaaacctacaaagagatgtcacactctcgcagcggcgccggacggtttacggcgcaaaccgacaaagatggacaaactaagagaaaactaaaagcaatatgaaaaaatgattcgattgattgattgtagattggttttttacaatgaaccagccatgtcccttttataggggttggtcttgccctctacaggccctcctccacgtccaactcagggtagaaaccaaaggaaacccgaaacatgccttcccgagcaaggaaacctcgagacctgacgaaacacagtcggactcggacctgccggtcagaccggcggtgtgtggccggtctgaccggccctcaaccggctgtctgaccggccaacacacggcggtcagactggcccactcggaggaaaccggtagatttctaaattttggcaatctttcctatttttatcccaggtgccaaatttgggtgtaaacaaatatattcctaaaaaattaagaaagtttaaaaaaggaataaaaaaaggccactttgtaccccgccggcctgctagggcatttgcgcatgcagcccatgtaaaccacaggacccaatggtgctgcggcccaagaatggaggcccacccgacgggggatcgatccgagtcgttcattttgatggacggcacggattgatgctgaatccatcaaaacaatcgatgacaagaaccctaaccctaattcacattttcccctcccctccgccttccccactacccccatcaatgctctccctcccaccaccgttggcccctttcctccttgtcgggtgctgctgcctccccgctcctcgccatatatggccttaggaggcggtggcagtgcagctcgaccgagccaccgccggcagccactccgcgcccccttctcgttgaatctggccataggaggcagtggtggcagcttgaaagcgacagcgagggctgaagctcgacggtggcaagctcatactgctcatgtctctggtgaggtttggtgactggattttttgttcgatttgtgtttttttttcccattcaccattcttcaatttttgtattttcaaactgaattttaaagttgattttaagatattttcaatgtagtttctattttagtattaaattttaagtcgctagcaatacatatataaatgttttagctataaattaatttttatctccaaataagttgtttttttgacttattagagaatactgacaaccaatgaggaccttaatctgtgttcgacggtgtgagaaagtgaaaataaatcttgttttctgcatgcatgttacccgaattgataaatgacgtgttttttcaaaagaaaaatctgtagattttttacttaaaaatcatattaattcatttttcaggtttaaaatagttaatactcattaatcatattgtaatgacttagttttttgtatcttatcattgttatcttttctcatttactcaaacactctaaggttgtgttcggcacttagggatgggaattaatccctcgcacacgcaaaacggagtaactcattaacacatgattaattaagtattaatcctattttttgaaaaaatgattaatatgatttttttaaagcaactttcatatagatttagcagtttgaaaaaacacataatttagcagtttaaaaagcgtgcacacgaaaaaaagagagaggtgagatgggaaaacttggaaactaactcagcctaagtggtggtaattttgggataaattttaaacccaaaatagcagcttttttttttggaagggatggagtaaattagcgacctcatattttcgcttatgcttatgcttatcaaccaaaatttgaattttcaacctcaaatttgaagttaattttgaggttttttcatcgaagtttattttagatcgctaagaacacgtatataaaagttttatttgcatatcacttttcgtttgcaaatatgccgtttcacttattcaacgtgaataagcaaaacgatggggctgtagaatgcaaagtgggcccacagggtgtctatgtaattgtttttctcatatatggttcatacgataaaaaaatgttaaaccgtgtgttttttgcaaatgaaaagaagagtaaatcactttgggccattttttattggcgttgtttcgctttgcatcaccctttaaccatttttttacacttttgaccgggttattttacctttatagcactttgtaccaccgtcagttgttttatccatccacatctaaattgtcatatatcaaataaacggtttacatacagctaacggagtttattgacgaataagggcaggagtactcgaggtcattcatatgcatgagaaaagattaacagaggcaagattacccggtctaaagtaaaaacattggtttaagggtgatcaaaagcgaaacatcagtaataaagatggtccaaaataaaatttactctaaaagaaattttatagaaaaaaatatcttaaaaaacatattaatccattttttaggtttaaaataattagtacttattaatcatatgctaataacttgtctcattttacgtatcttaccattcttctcttcgctcaaatacaccctaagggttagttaatttgggacaaattttaaaccgaaataagcagttatttggagatggagggagtaaattagatcgtgaagtgggcccatagctgtacgtaattacttttcgagagaatcccttatatgccactacaaattggccagtccccttatgtgccactcaaaattagcttctcccttttatgccactggttcaagtttttcgccgctcccaacactatagcgttagttgactgttagtcaaatgttagttttttaaatgaccaatatgccctctcaactaaaaaaatgtgtaaatttcaaaaaaatcataactaatttattttaaatcttttttgagtgaacaaaattttgtcagaaccagtgaaaaatgctctttgtataagtattgttggaaaactatatgttttgtgcttatattgaaaatttatttgtgatggtgatggctaaaattgcatgtgatgaaaaaaaaatcaattttcatatgttgtatccagtagctatattagtactaaaatacctaccattggttgtataccaactctcaagggcaaatgcgtctttttactatgaagttagcggtcaactggcggtggagtgacggcaatggcataaaagggaggacaaacttgaaccggtggcatagaagggagaagccaatttgaagtggcatataagggaaccagttaatttggagtggcatataaggaattctatagttcataaggtaaaaaatcgaggaatattaattaataaaataagaggacttaaatagaagaggtagagagctgacatacaaaatctaccatcggtacattaagattatcgtgtgtcctgaaacatatgtgcttccattgtgaatatctcaaaagtacacgatcttcacaagaattcaatgaaaaattgagctaattcctataaactctaccaaaatattagcattaattacccttagcaattatacaagccatacaaagagcacgccaaccagcacgtttatttttccgaagagctggctcttgccttctccaaaaactgttcattacccttattatattgaagacttgctaaatagtacggcatgtgaaacatttacataattgaccgaataaaacattctgcattttagcacattaatatgtttttacttgttggcccattatgcggcaaagccacgtctcttttcatatgttattttgagctcagatttttttttgcaagttttcatttatctaagttatcacaaatgctaccgatcattgtcacttagttaatttatactccatctcatatatatctaagaaatcaaactaattccaaataattatttatgtattctaacgaaaaatataaatattcacaggatatttttagttggtgcgccaaaggcgcaccctttttctagtctactaatctaaagccagcacttttgccgacattccattggtccacgtgacattccattgcacatatatgtagtaattgcttattttatgatatatggagcatcaagatgcagacgttgttgctatctaaaggattgtggtatattgttgagaatggctacaaggagtattctggtagagacactcttacggcggaacagaagaagtctttggtagagtatcggataacggacgccaaggccttgttcttagatcccacaaggagttgcggaaagtctatttccgcgtattatcggggccaagaactccaaggcagcatatgacaagtttgtggtgtgacatttgtcaaaaatctagtcatactgcagatatgtgctggaagaaaatgacctgcaacaaatgcaaacgaaagggtcatattgcaaaatattgcaggtcttgagaaattaatcgggctaatttttcacaagaaaaggaaaaaaaatctgaagaaatggttttctcttgccatactgctcaataagaaaataatgatgtttgggttattaatagtggttgtacaaaccacatggctgctgatccaaatttatttcgagaaatggattcatctgatccaaatttatttcaagaaatggatttatcatatcatgcaaagattcacatgggtaatggctctatagtgcaaagtgaaggctaatgtacggttgttgttcaaacaacagatggtccaaaatttataacggatgttttgctggtacccgatctaaggcaaaatttgctaagtattgggcaacttctagaacacgggtactctgtttattttgaggatttttcttgcaaaatattggaccgtaaaaataatcatttggttgccaaaataaatatggagaagaataggaattttctattaaggatgaaccatccaactcaaatggctctcaaaagtgaagtcgatatttctaatctatggcacaagagaatgggtcatctcaattacaaagcactaaagctactcagggcaaaaggcatggttcaaggccttccatttattactctaaaatccaacccatgtgaaggttgtgtgtttggaaaacaaatacaagcttctttcccacgcagtggagcttggagagcaagtgcaccgttggaactagtgcgcacttatatagttggtaaagtgccaacaatctcagaaggaggaaattggtactttatcacatttattgatgattatacagaatgatctgggtatattttctaaaagaaaaatcagcagccctggatattcaaaaaattcaaggctatggtggaaaattagagtaatcgaaaaattaaagtattacgcaacgatcaaggaggagaatatatctcaaaagaatttgagaaatattgtgaaaatgttggcattcgaagataattaacgacaggctatagtgctcaacaaaatggagttgctaaaaggaaaaatcgaacaattaatggcatggcaaactctatgctccaagacaaagctatgcctaaatctttctgggctgaagcagttaacactgcagtttatattttaaatagtagtcctacaaaggcagtaccaaaccgttcatcttttgaagcttagtatggtaaaaagcctatcattggacatatgagagtatttggttgcatttgctatgctcaagtgctagcacaaaagaaagtaaaatctgataataaaagtgattggtccatatttgttggctatgctgatggtatcaaacgctatagactttataatttggagaaaaagaacattatcatcagcagagatgtgatttttgatgaaagtgctatttggaactggaagtctccagaagcctccggtactccattattgccaaccactacaatcacactaggccaaccacatatgtatggcaatcatgaagtggaagatcaaactccaagtcaagatgcatcaagtccaaggtcaaggtcaagcttcagttcggattcaagcccgagtagtgaagagcaaatttctacaccggaattagctccaagatgtgtaagaagtatggttaaattattataatctacttctcaacaaagagggacaaaacaatatgaattttccaattattctgttgttgagtcactgttttcaagaagcaaaaaaaacataaaaattgggttaaagccatggaagatgagattcgtatgattgagaagaataatacctaggagttggttgatcgatctaaagatggagaagttattggagttgaaatgggtttataagacagctaaatccagatggctcaattcagaaatataaagcaagacttgtggcaaaaggctttatgcaaaagcctgatattgactactatgagaaatatgctcctgttgcaaggctagagacaattcgtacaataattactctagcagctcaaaacaagtggaagatatatcaacttgttgtgaaatcggctttcttaaatggctatcttgatgaagaaatttatgttaaacaacttgaagggtttttagttcaagggggagaaaacaaagtattctgacttaagaagacattatacagattaaagcaaacacctagagcatggtacagtcaaattgataagtactttattcaaaaaggatttgccaagagcataagtgaggctactctatatgtcaagaggctagatatggacattttaattgtctcacactctcactatatgttgatgacgatatataccagtaatagtgagaagatgatgcaatattttaaaaaggacatgatgaatacatatgagatgagtgatatgggcttgttgcactatttcctaggaatggaagtgcatcatagtactgaagggatatttatatcacaaagaaaatatgcagaaaatattctgaagaaaattaagatggataactgcaagtcagttacaaccccttgttgccaaatgaaaagcaaaaggcaagagatggtgctgataaagcagatccaacaatttacagaagcttggttggaagtttattatatttgaccgcaacacgaccggatattatgttattatgtttgcggcaagtttattatcaagatatatgtttagcccaagtcagttaaattttactactgcgaagagagttttgcggtatatcaaagggaccacaggttatgttatatggtacaagccagttaagaattaaaattaattggctacacggatagtgattgggctggatgtcttgatgatatgaagagcacatccggatatgccttctcacttagctcaggtatatgctcctggtcaacaaagaaacaaaatattgttgctttatcttcagccgaagcagaatatgtagcaacatcaaaagccgtgtcacaagctgtttggttaagaagaattatggaagacatagacgagaggcttacacaaatttattgtgacggtcaatttgcaattgttatcggtgaaaatccagtcaatcatgacaggacaaaacacattgtatccgggaaacagttgatcgctaggaagttaaattgctatcggtgaaaatccagtcagtcatgagcagttggcagatatatttgccaattctttatccaaagaaaaattcatccacgattgagaaatgattggagtatgcatgaagtgaattaacggggagtttgatagagttaattcacttctataaactagtaatatgcccgtactaaacgctacggtgcaatttcatttctctttaataatttttagaatttcatgttagcaaaaaaatatttttatatgatctatgcatttgaactttaattcaattcatatcgtacataaaatatatttcatgtaaagtgcagaactatgatattgcgtgggcacaataaaactttacaaggtgaggcccacatgtaagtgataagagaaaaactaaaaagcgtagggcccacttgttagccctattctccctctctatcctttcccccaaaaaaacagcagagcaagcggagacggcggcgatggcagtggtgcgggtgatggcagtggtgcggtggatggcgatggcggtggtgcgggctgtctgcggtgcattatccatttaagttgtatggataaccatataaaaaaataatccagaacaattttgtaagcatatatatatatatatatatatatatatatataatacagaccataattacaatctcaaatgacagcctagtgcaaactgacgcatctagtgcgagatagtatgtagaagataatcacacgacattccatataaaaggtgatggcgtgctgtacaaaacaagaggacgatggtgagtaacattccgatgagcaatttactatattctgcaatatttttttgaattaatttagatcatgcgaacctacctttgctcaccagtcaagaacatctttatacacgatatttctagtgctcttccctgttgaatcaacttctttctttggctttgccaaaatccttgttgttagccttgacacaccccttgacaatgcgacatataggtgaccatgtgaaaacacgggctctggaagatagatcccaacatttgggatggtttgtccttgtgatttgttaatggtcattacgaaactaaaacgtattgggaattgcttcctcttgaatttgaaaggtagagatatatcgtcggagggagacaaagggatccgtgggataaacacccttttgctggcatgttgtccaccaacaatctcagcatcaattgcattatcttgaaaagctctaaccattagtctagtcccgttgcacaatccattatttggattaaggttgcgaagaagaatcacgggacaattgatttttattattagctcgtgtggtgggagaccatttagagtaatagagttaaggtagtctagaggatagctattgtgagggtcatcatcaacagagtcaaagctgtgattaaccttggcctgccctggaaatctgtcaatcatattaacattcagcttgtccacataatcattttttgtggatacaatggcacgtgtgctcatataagatgcagagcttgcattctttttatcatcaaacgagggaaacacatgattaatcaattcgtgtactaaatcctcgctatccccataagcaatcacaatttcatcaggcaaacgaacattatcatttctgatagtgttttcagtgccatttccaattctaaggagatattccgaaaatcatgtatcagattgagccctatgttcaattattgatccaattctaaggagatattccatcaattattgatttgtttcatgatattgaagtatattattcaaagggattgtgactgtttggataacagggagaggcggtgatattttgtcacatcaaattgagattttaaatagcatccatgcattcaaattacagaaaaaacttgcataccatgacttataagcagctccttaatatgtggatatgcacatatacacgtaatagatatgtgacactatagttcacaatcacatccactatttaccagcaaatctacatttgtacttgaatagtattaccttctctgtcgtgcagtggagagggttccggagatcactttgtggtgtcgcagtagagaagggggcacaggggcaaggagtcctggtagttggcatcggcgatctggaggcgaaaatcggcgccaacatatgtttagtctatattggtgtaagcttgaatgaaaagggaaatgcaaataaaaaacatatgagcctataacatttcatcccaaaatataccactgattattgtctagtaatttgttttctcatccttctccaattcaatacatattagagcccaaccataattccataatctgaatctacactaaataacttgaggtatttattccaacacccagcaattcaaggtagctgcccatccagcttcttttacttagcattctactgataaaagaaaaactatcgtggatctctaaaagaaattagagctagcatgactaaaaatccgatatgttttattatttcagaattaattcttggcatgtaatactcaattgtagcagaaaatagcaacagatactgatcattcacgcaataacaatcacaattgaactgtatggtaaattgatatggatcatgtccaagaacccgctgtcaactggaatagaaaatatgaatgaaatgctaatacagggaaagtgctcagttcagagtgaggtaaaaacatgaccaggcagcatttttgggcagaacctcacaaaaagcaccggttgtcctactattcataataagaatatataatgtattgtaattctaaaacactaaccatgattctattaaagcggttgtcaacgtccatggccgccagtctccatccagactacaacacgcacaacagtaacagccaaaatccgtcaaaacaaacataacaaagaagtcagtctctgtatatggctcaaataaggggataaaatcaatattctcaaagatatatggctgtccttagagagtaatagaaaccctgaaaaaaaattgtcctatcaataaaacaggtaaaataatactcctacctgagaagctaatagaaaagagcattcaataatatacacggtcggcgtggaggggcgccggcggcgtcacgcgcgaaggcggggtgtcggaatcgacagatcgacggcggcgcgcggcggcggcgggagagggaaagagtggagcggcgacggttagggttaggcggcgaccggcgttgcgcggggtaggggtgaggagatgcgacgacggcggagaggcagaggggcggcgcgggagaggagagaaatcgaggagcggcggacgcgggatcgacggcgaactggcgttgggatgaactcaagtggggaggggcggcgctgcgtggggcgtcgggcatcgacggggaagcgcgtgattcgggcggagatgggggagcgcgattctggacggtgtttgcgtggacgatttcagccgttagattagatgattctggatcgttggatttgataattcaacaactcattttactcatactcatccatcattggacaaatccgatggcttacattcatctgcgttgattcaacggcaaagatcggtccttgtccacccgcacttttcctttccttcctcactctttcccctaatcactcccggatttccctttcctttccaaccgcgcacaccgacacaccagtacacgaccaaccagcccaacactgtcatgcttgtggcactccacgccggcgagacgccgccgccgtgtcacctgctttgacggctccgcttctttacgatggcctctatcgacgacgcagcttctccgcacgccgctgacatccacggcgagagtccgtcgccgacaccaagtctcctttgtcggatcgtctccccataaccgcgagtccgtctcctgcagccgcacctgccgtcgactgtgtggggatcgattttggagatgaacagtgggcatggcggtggccgtcgttcgtgcttggggggataccaattgcgagcagtgagcctggccttcctatcccatgggccatggcgccgctgattcccggaacagatacccggcggcgcccatgccgcccatctcctgacgtttgcttccacgagtccccacgcgccccagcccatggcgccctcctgtgtgttaaaaatttggttataattcgacatattttaatccaaaatattaagacaataaacatgacatacataattagaagcgatcttgtgataaggctaaacataaacatgagcatgcttaagataaaataagcatagccatcgttgacattcacataagattgaaatcctatggataacattgtgaacatgtaaataacaagaagaaaatcaaataaagttagaatcttatatccagagaatggtgcagaagatattgaggcattcgtattgcttccgttgatgttgtctcctccgttctctcaagtagaagccatggtgaaccagaagtagtggaagatgaaacgttgtcgtcgaagaacgaagaacaggagcagtcgcgcttcaagcgctacccaaaaacttgatcgcccacctacccgtgcaagttctcaagcggacggagtttcggaggcacctgctcgtcccgtacacctgtgcgcgcaggtgaacagaaccggggaaggattctgcagctcaggaacagaggaggaggaactcgaagtgcaagagttgggaagaacttctccacgtccttcacgtcgctgcagagtatatacatatatatatatatatatatacccatatgggactccatggtgcccgggctccaaggtataaaacacacaaaatctcttgaaatttttttaaaaaaataaattgtgagtatatacttaggtatatgaatttgattcataccaatacctaacaacaaaataactcaaactcaactttatttcacaattcattattacatacctagcgaattatatgctttgatgttatataactagaaccaaaatctaacaaaaagaaaagttcaaactcagttcaaacttgtttgaacttgttagtaaagaagttaaagttcatacctaaatatttaaaaaaaattcatactcattcaaattgggtatatactcaattttaatcttcgagcccatactccatgtagcaccagttaaattacctatatatatatatatatatatatatatatgtgtgtgtgtgtgtgtgtgtgtgtatgcgagcgcgagagtaacgttcggagtcatcaaccgccgtgtttaatttcgtaaccgacgcgctcgttagttcggaatcaattcacggcgtttaattccgtaaccgacgcgctcattaatacgaaatcaattctccatgtttattaccgtccgttacaaagtgagagagagaaaacagctgtagctgcctgcctcgcctcgtcccaccccacctggctgtccgcacaccatctcaaccggtcaacagagacttttcactagttccgtatttaagttgagacctcttcacatagatttccaaggtggtattattacccatagcacttaatgtgggccaatggaatttattaggatttaattgggcctaacccattaatctaacaatccccaccaaatttcatggctcacaagaaatgctctcgattctgatcctgtttgttataccagtgtttcggtggagacttttaagttggacatccacctaggaaaagagctacaccagatcacaactgaacagtggactatgccttgaattatcagtcttgtgcgattcaggtttcactcaaacccttaaatggtactggactatcgtttgcatcccctctgtttggagcatataagtcatactcctggccttttcatgagtatctagagatcaccaagatctcatagactgtgactagcagtcggactcatataggtatgttccttctaagatgttctgtaggccaacatctctgctttatgaaaagccactcggatcacattaaagtgtataccatcctaccatacagattagaagagaagtgcatcatgaagataggctcattttagggtctcttctctcagctacactatagtttgttttgccatccaaattcacgggatctccgatcacaatggacaggtttccactattgtccaactctaagtgggtctcaagcccatctccctcgatgcacagtctatcacattacgtggtagccccttggtaaactgatctgccagattttttgccgtctagacatagtcgaatgctatcactccggagtttttctgctttctgacagacttcagtcttcttttaacatgcctggatgacttcatgttgtccttcgaactgttcactttaataatcactgtttgattatcacagttcatcaggattgctggtactggtttttcaaccactggcaagtccatcaggagctcacgaagccattcggcctcaactgtggcagtatctaaagctgtgagttctgcttccattgttgacctcgttaagattgtctgcttgcaagacttccaggaaacagcgccccctacaagtgtgaacacatacccacttgtggcctttatctcatcagcatcagatatccagtttgaatcactatagccctccagcacttttgggtacccggcgtagtgaatttcatagctcattgtcccttttagatagcgcattactctttcaagagcatgccaatgatcatctcccggatttaaaacaaaccggctcaacttgctcacagcaaatgagatgtcagacctcgttgcactagctaagtacatcaatgaaccaatgatctgagagtatctcaattgatcccttgctattcttcggtttttccttaatagcacactgggatcataaggagtaggagctgccttgcagtcactataaccaaagcgactcaagaccttgtccacatagtgagattgcacaagtgtaatcccaccctcatctcctctcagtagtttaatgttaagaataacatgtgccactcccaaatccttcatttcaaagcttttggacagaaagtccttgacctcctcaatcacattgaggctggtcccaaagatcaatatgtcatcgacatataaacacaagatcactccctctaccccaccatagcgatagtacacaatttgtcagcttcgttcacaacaaagccagcagatgtaagtgtattgtcaaactctcatgccattgcttaggcgcttgtttgagaccatacaaggacttcaacagcttacacaccattcccttctgaccttctagtacatacccatctggttgatccatatagatctcctcctccaactctccattgaggaaagctgtcttaacatccatctgatggccgagtagaccatgagaggctgccagagcgagtagtactcgaatcatggtcaagcgagcaaccggtgaataagtgtcgaaaaagtcctcgccttctttttgggtacaacccttggccacaagccttgccttgtacttttcaattgtatcatcaggcctaagctttttcttgaaaaaccattcgcattctacaggcttgcacccatatggacgctcgacaactttccaagtaccattagacataattgagtccatctcattgcttaccgcttccttccaatagtcagcgtcaggagatgaatatgcctcttcaatggttcttgcagtatcatccacaagatatacaatgtagtcatctccaaaagactttgcagtcctttgtctcttactctttcgagttgctacaatgttatcctcctcaggattttcctcaagcgtttgatcaatatgttcttcggcacaaagtgctcaggggataaaataggttcttgactagaagtgctaggtgcatttttcataggaaattcattctaaaaaaatgtggcatctctggactcagtaattgtaccaacacgcatgtcgggtaatccagaatttactattaagaacctatatcccacactgtggatagcataaccaaggaacacacaatctacggtctttggtccaagtttacgctttttggctataggtacatttagcttggccaaacagccccatgtgcgctggtgagagagatttaatttcttcctttcccattcctcgaatggtgttacttccttatgcttagaaggaattctatttaggacatgacacgcagtcaatattgcctcaccccaccattccttggaaagtcctgtagtgtctaacatggcattcaccatctcagttagagtgcggttctttctttcggctaccccgtttgactggggtgaatagggaggcgtcttatcatgaataattccatactcttcgcagaaagaaataaattcattggaaaaatactctccacccctatcagacctcaaccgtttgattttcctttccagttggttttctacctcagccttatagatcttgaagtaatgtaatgcttcatcctttgatttcaataggtacacatagcagaatctagtgcaatcatctatcagtgtcatgaaatatttctttccccctttagtcaacacgtcgttcatttcgtacagatcggaatgaacaagttctagtggtgccaaattcctcgcctcagatgccttgtgaggcttgcgaggttgtttcgattgaacacaagtatggcacttagagcctttgactaaagtgaattttggaattaaactcatgttggctaagcgtgtcatacaaccaaaattcacatgacagagtcgtgaatgccacacattagactcatcatcatcattgcttacatggttcacaactttattacacatatcatccaaggaaaagcggaacaagcctccgctgtcataaccttttccaataaacgttccatatttagatatgacacatttattggattcaaacacaagtctaaaaccatctctacacaatagagagccgctaactagattcttctttattgaagggacatgctgcatgttcttcagctgcacgatctttcccgaagtaaactctagatcgaccgtaccaacaccatgaatagccgcaagcgatccgtttcccatcaacaaggagaaacctctcccgacctgataagaagaaaacatggaaatgtcggcacacacatgaatattagcaccagtatcaacccaccaatcaggtgagtgacagacagagagaactgtaggtaaaaatttaccatacctcgatgttcctccgccctcactaataaccatgtttgcagacttcttgtccttgcgctcaggacaatccttagcccaatgcccagacttgccacacacaaagcaacctccttttgcctttctcttgcctttcttcttaaaattggttgtagccttgggtttgacgtcaggtttgacttttttgttgttgttgtgggatgcgtgagggtcttcttctacaccaaattggcgctagaacctctctcgatctttttgccccggttgtcctttaccctcgcattctcctcaacacccaaagagccaataagatcagtaacactgaactcttgcatcttgtgttttagagaagtagcaaagtccgtccaagaaggtggcaatttgacaataatgccacctgtcacaaacttgtccggcaactcacagttgttgttctcaagttcctttgccaacatctgaatctcatgagcatgttccactacagaacgatcatcgaccatcttgtagtcatagaactgctccatgacatacagctcgctgccggcatcggaaaccccgaacttggcctcaagagcatcccacatgtccttccctgaaggcatgtgcatatacacgtccacaatattgtcggcgagcacactgatcaatgctccacagaacaagcaatccgcagccttgaacttagcctcctcctcaggtgagagaggcggttcactcggtttgccccgtgagacaaacaaacaatgcatcgccgtcaaccacaaaagtgcacgtgctttccatcttttataatttgaaccatcgaaagcatatggttttagtgatgcaacaaagtcaactaccgaaaaagacctatcaagtttttggattgttggaaatttggtcataattcggcatattttaatccaaaatattaagacaataaacatgacatttgaaatttgagtagatctagcgacagtgctagatgtgtaatagtgaaacgttgtaccccgagaatggccctccgttggagtttgaggcagtattgcctccgttggtgttgacgagaggctccttctccttgtctccagtgttgttgttgtcaccggttgtcgacatgttggtgaagatgatgtagagcagtcgcgcttgaagcgctacctaaaaacttgatcacccgcctacccgtgcaggttctcaagcggacggagtttcggaggtacctgctcgttccgatcacccgtgcacgcgggatgaacagaaccggggaaacaaagagacagcgcaggaacagaaggagagtatcgccaaggaacaatagtaggaggaagacacacactttgacagcctttgccttgcgttatatgtagagagagagatctccattaccacacaaataaatctcatttgttgtgaaggttaccacaaaattaatctcatttgttgtgaaggttaccacataatgaatcttccatttgttatgaaggttacaacaaataaatctctcatttgttgtggatgttacaacacaatgaatctctcatttgttgtggaggttacaacacaatgaatctctcatttgttgtggaggttacaacacaatgaatttcatttgttaatggtgactttattctcatctgttacaaaacgaaagagcagcaggcaggctcggctcggtcggccgcctcgcctcgctacgcccacggccgaggccgactcggcatgcgcgcatgcgtgtggcagtccaaccatcacctcaaccggtcaacagggaatctctaatatcaccctatttaagttgaggttcttccacctaaattttcaaggcagtattattctctctaacattacttgtgggctcttgagattttagttgaattaaattgggacatatgagacaagaaagttcgcttcatttgatggcttttaacatgatttcacactttttcctatggttcgtccagatgagtacaggcctagcagtgacttccatgcatactcttttcatgtcatcctaccataccctctgatttggtcccgttagtggatacaagcctaggcgagattctcgctctcaggttcggtcctctacgagcggatacaaatcacggatacaaacataaattttgcataattcaccataaattaaacaagcacttgcttcggtcatgcttcatggcttcgagccatgctagtagtgatacaggcatagtgataaacaaaattaattgagcatactaattaattagcacgcacatttgctagttttgacatatgttcagccatatttctctaacaagaattaaaataaaatggcgtttattttctttccgtggtcagagataggaaatagatgtgcgcatgcatatattttctccttccatctattcatctacaaaatgttggataaatcacgaactacgccgagtcatgacggccggccataaaattaaccaacactcgcttcggttacacttcacggcttcgagccatgctagtagtaatacaagtggagtgaaaattataatctcaaaatcatctgcatacatatatttgcttaaaacagtgtatatatactcactgcaccatatataaagtgtagtataaaaaataatctgatatacgcacatgcatgcatccatatactctggccgtgcattttccttccaattgcaaattaaccatgtacgcacaacaagtggcgacatcgtgatagtcgaccataaatcaaacaaatacccacttcggttacgcttcatggtacagggccatgctagtagtaatacaggtgtggtgaaaatcaaaataggcaatgcaatgtgccgcaccaaaatccagtgacatgttgataataatggcgctaaaataaatactcgtttggctacgccccgcgagtgctcaggaaaaatttatatatgcgtgctacatataggaaaaaataaagtcacaatgccaaacaaggaagctatgtataaatttgctaccatacacgcagtgatattaaaaaccaacaaattagtgggcatctaaaatacttggacgcccaaaataaaataaacatataaatggaaatctacagaagattctacggctgcgacatctggagctttaggatagattttcctttttagccttttagcggtcatgtaattttattttctttcatgttggaattcctaatcaggggttttctctacggagatgtaattaacagaatttctatgtaaatgtatgaattctggaagtaatggactcgcaatttctgatttttatttatttattgcatttaaatcaaattgtctgtaatgatttgtagatagcagacctactattacgactgtcccggttttcccgtcgtcagattctggcacgcccggtgggacatacttctcccctcatctctgagttccaacatgtagaccgcaaatatgcaaaaaaaaaaggagataaatgcacatatccttagtagaaaaattcacgtactcatgtgcttcatccaaagcgctttatgaaattattatatgcatgctatggttttacagaaccagatcggttactcaaggagagggacctaaaccggtcaaatgtagtcattcacggcttcaaccaagcaggccaagaagccttgagcactatatcgttggtcctaaaactggaaccattgtccacctatgtgaccttccgtataattgatgccactacttcatataacgcgttacttgggcgcccatggctgcacgagaaccaagtagtgccatctactctacataagtgcatcaaatataaggataaatcaggagaaactgtgagaattttcgccgatgaaaggccattcacggtggctgaatccttttacacggatgctaaattctacattgagcccatcgaaaagatacagaaaccaaaagcaaagtcgctaacagaacatttcgtcacaagtggaagttatggtgaatcgtcttcaaaccggaaaatataccaatatataccaagcaaccggagaaaggagggtgagccaatatttcgtataatgaataggccatccgctagcaaagcaaatgggatatgacacccttaccggaccatctctatgtgatggccgagggcagctcgcgccgttcgagaaaatattgtctcaagcacagctcgaagcgttgcagcaagataagaaattaaaagagaagaaatatggacttggttatcaggtttgcaggacctcagccaagctcgtggacgcaacgatggcatctccacaaatggaggatgggaatcaacccaccatcgatgaattggaagaaatagatattgggacacctgatatcatcgcccaatttttattagcaagcacctatccgaagaaaataagaaaaaaataccataactttctttcagctaacaaggacgtgtttgcttggtcttatgaagaaatgcctggtttaagccctacggttgctgtccaccagctagctgtgcaggaggatatccccccggtcaagcagccgcagagaaggttccgaccagagctcctcccaaaaattgaggccgaggttgacaagctcatagctgtcgggtttattagagaagtcaaataccctacatgggtctcaaatattgtacctgtaaggaagaaaaataaccagatccgcgtatgtgttgattttatagatttaaataaagcatgtccaaaggacgacttccccattcccatttccgaaattctgaatgatgccactatgggatatgaaatattctcctttatggatggtttttcaggatacaaccaaataaaattagcaccggaggacgaggagttaaccgcgttccgaacgcctaagggcatatattgttatgaagtcatgcccttcggattaaaaaacaccggcactacttaccagcgcgccatgacagtcgtcttggacgggttattatatgaaattgtcgaatgctatatagatgacatcgtcatgaaatcaaaacgcgaagaagatcatctgcaacatttagccatagtgttcgagaccctcagaaagcacgaacccaaaaggaaccctatgaaatgtgcatttggtgtattgtccggaaaatttctcggatttatagtcatgaaacaaggaattcggatcaacccgacaaaaatacaagcaatagtgaaaatgccaccacccgtgaacctacataagctgaaaagtcttcagggtcacttagcatatattaggcgttttatctcaaatttatcagggagatgcaaacctttttcccgcctgatgaaaaaaggagttccatttcagtgggatcaagcgtgtcaaaatgcattccaagatattaaaagatacttaattaatcctccagttttaagtgctccagttaaagggcggcctctcatactatacacggctgcgatgcctacctccctaggtgcactgttggcacaaaataatgatgatggaaaaaagacagcattatattatctcagccgcacattagtgggggcagaatgcaattatttagacgtggaaaaaatatatctagcgcttgtcttcgcagcacaaaaacttcggcactatatgctagaacacaccatacacctcgtgtcgggggcggacccattctgatatatattgagtaaaatggtcctctcaggaagattagctatatgggcgatgtttttgtcgcagtttgacattatatttgtcccacaaaaatcaataaaaggacaagccttagcaaacttcctcgctgcacatccaattccggatgagtttcccattgatgacgacttacctgacgaggaagtatttgcgacctcaatttttaacccatcatggaaaatgtattttgacggcgcgcgtcgccggtcgggggcaggcgcgggtgtggtttttgtcacacccaacgaaagcataattccatattcgttcactttaacgacggcagtgtctaataatgctgctgaatatgaggcactgattgtaacacccaaaaaaaaaggtttggttgttggttttgagttgctttacagaagtaaataagttcgatagaaattaatggtagaaaaaaaaatacctatagaagtggaccaacctgggaaggcccataaacccagcccattgtttcttctctaataccctagaggaggaggggccggattcccccttctttccccccaaacgacgccaacactgctgccccctccctcctttgtacggtcttgggtgttctctcctctccacgacatttccactttcatagatctgttgcgtcgtatgatgaatcaagaaactagttgtaaaaacggaatgagaaggaggagaggaacaagaggagtggtgaattggtgtttcccgtcatctttattcttgttctccataaaaccttaggtgagacttccccactgttttaatgttgtttttgggtgtttttagagttgcaattcgtgggtaattagggtttagataaggaggttttgttgctatgattcggattggtaattctactctcgggaagatttacgaatgtaacacccaaaaaaaaggtttggttgttggttttgagttgctttacagaagtaaataagttcgatagaaattaatggtagaaaaaaatacctatagaagtgggccaacctgggaaggcccataaacccagcccattgtttcttctctaataccctagaggaggaggggccggattcccccttctttccccccaaacgacgccaacactgccgccccctccctcctttgtacggtcttgggtgttctctcctctccacgacatttccactttcatagatctgttgtgtcgtatgatgaatcaagaaactagttgcaaaaacggaatgagaaggaggagaggaacaagaggagtggtgaattggcgttcccgtcatctttattcttgttctccataaaaccctaggttgtggtgctccggatcatgcttggtatcgtctctttattgttcgagtcttttcatgtatttgctgtgacatgtttgcatgaaaggatgggattagctacacagtcgcacaacatgatctcacttagtcatgagtattgtaatatgctgataagattacttgtgtttagaaataatgggctaattaattactagagttgttgaccattggttaactacttttttcaagcctatccctacatgtcagtcaattgttgtatcataaacttaatctatatgttgatgcttctgcgatgtttttttttctaaggtagttgttaccgaaatttgcttgttttggcacttatgtgtggttgtttagtggcatctagacttatgtggttttctggggtgttacactgataatcggccttgagatagccttgaatatgcggctagacacactctatatatgatgattcacaactgataatcaaccagcttgctggaaaatacgcagtaaaaaaggaaggtttaatggcttactccctccatccaaaaatgtttgacaccgttgacttttttaaatatgtttgactgttcgtcttattcaaaaaatttaagtaattattaattctttttctatcatttgatttattgttaaatatccttttatgtatacatatagttttacttattttacaaaagtttttgaataagacgaacggtcaaacatgtttaaaaaaatcaacagcgtcgatttaggaaaggagggagtatttcacgagagcaaaacaactcatggccatgttcgcaaatctaaatatcgaacatgttgttagaagtcaaaatgagagagttgacgctctaaccagcttggctgctagcatgtcagtcaattcttattaaataatggacattcaagttgagcagcgtagagtattaccggtactcattgaaaaggaggaagaaattccatcggcagctatgataaccgatgttcacgaaatagaggcaggagattggagaactcccctcctggaatatttattgcacggatatttacctttagaagcatccgaaagatctagaattagaaaaagggtgactcgttatacgtgcattaatgacacgttgtactgacgtgcatacgacggaatgctactgcgttgcatcgcgggtgatgaggtcgtagacgctttaaataaagtgcatgctggagtttgcggtgcacatcagtctggatctaaattgtactatcaattaaaacacttaggttattattggccgactatgtttgaggattctatgaaattctcgaagaaatgtcatgagtatcaaatacacgctgactttatccatcaaccacatgagctgctgcatcctactaacatggcatggccattcgaaatgtgggggaatggatgtagtcggacaaattcaaccgccatcatctaaaggacataaattcatcctcgccgctaccgactatttctccaaatgggcggaagtcgtgccattgaaagaggttaaagctgaaaatgttgaaaattttattaggacacatctcatataccgttttggcatcccttctcggattatgtccgataatggttctccattcaaaaatgcactgatcgaaaagttgtgcgcgaagtttaaaattaagcataatttctccacagcatataacactgcggccaatggacaagcggaggcgttcaataaaactctctgtaaacttttgaagaaagtggttacaaagaataagcgagactggcatgataagctgctcgaggccctgtgggcatatagaacaacaacacgcacgccgaccggaatgactccttactctttagtgtttggaggggaagcgatcttacctatagaagttcaaatcccgtcactgagggttgctattcatgaaaatatagcagaagtcgaagcggcaaaacaacgcggaaactctaatgcgcgatcgatcgctaccgcgatcgggtagcgatcaccacctctcccccctccctccctccatgtttcattttttggcaccgcattactttcctattttagtaaatttatgtacctaaagtttatacacctaaagtttatagacccaaagtttataaatcaaaagtttatatatccgattcaaatttaaatttgaattcaaatatttttatagtatttttatacatctaaagtttatagacctaaagtttacaagtcaaaagtttcaaatttgaatttgaattatatccgattcaaatttgaatttgaattcaaatattttctatatatagtatttctatacatctaaagtttatacacctaaagtttatagatacaaagtttataagtcaaaagtttacataccgattcaaatttgaatttgaattcaaatattttctatatatagtatttctatacatctaaagtttatacacctaaactcaaagtttataagtcaaaagtttacatacccaattcaagtttgaatttgaattcaaatttttatatatagtatttctatacataaatttttctaactttttgtttttttaaattttttttgtggtttactgtagtagaaggggaggaggaagaggggagagagagggggagtagggggacggaagggtgatcgctggagcgatcacccgcccattaggcgtgcccaaaacaacgcttagatgaattagagaaattggaaggtaaaaggctgcaggcgttacaaaatttggaagcctatcaggctagagcatcgcgagccttcgataaacggctcaaaagaaggtcattcaaacaaggagacttagtgcttgctcttatccgccctatgaatattacacatcgaatgtagggaaaatttgagccaaaatgggagggtccctatgtcatgaggaagtagcgcgtacaggatcatctcgccggacggtgaatattatccggcacctataaatggaaaattcttgaaacgctattatgcataaaaaggataaaataaaaataataacaaataataatgaaaatactgcaccaagatctcaagtgcctaaactgtgcaatatataagaaataggggtgtgtgtgtatataagctaaaaatgaatcatacacactccatcactaaaataataataataataataataataataaaacaaacgctccatcgccgcacgagcttaaactgtaggcgacgaaaaaaaatcactcgcgctccatcgcagctcgagtttaaactgtaggcaacaaataaaaaataatcacacacgctctttagctttacaggcctacactataagcgtaaaaaaaacaaacaaatcacaaacactccatcactacaagtaaaaaataataataataataaaacaaatgctccatcgctacacgagcttaaactgtacgcgatataaaaaaaaatcatgcatgctccaccgctgcactgcacgagcgtaaactgtaggcgacaaaaaaaaaagcccacggctccatgagctcaacctctgggtgatatgtttatacatgtatatgtgggcttaaagactagtaaatgatgatagttaataaagttaaaacaattaaacactccaaagcctcaggtattcggagtgtggcgtacatgtgcaaatactgacaaaattaataaaattccccaaagtccgcaagtgctgaccaaaacaaattgcagcacagagtattgaccttcagagtcaagcaaatgtgctccttaattttctcaacaacgtttcttacaacgggcacaggaatagttgtgactataaacctcacgtgcaacaagtccctacgaatccgaaattatatgtcgagctccggatgcaaaaacaaaattttgacacccgcagctcgagggaggatctgttgacaccaatttcggctcgtgtcttaaacaaggtatattcgatataaattaatgtataatctcaaatataatgtaaaaatataataaaaaataaagaaataaaagtggaaataaacagtcaaaacagtcaaatgaataaatagagtaaaatggcgaccaaaaataaatgtccacaatataaaatctctcatttgttgtagaggttacaatacaatgaatctctcatttattgtggatgttacaacacaatgaatctctcatttgttgtggaggttacaacacaatgaatttcatttgttaatggtgactttattctcatctgttataaaacagatgttataaaacggaagagcagcaggcaggctcggctcggtcggccgcctcgcctcgctacgcccacggccgaggccgactcggcatgcgcgcatgcgtgtggcagtccaaccatcacctcaaccggtcaacatggaatctctaatatcaccctatttaagttgaggttcttccacctaaattttcaaggcagtattattctctctaacattatttgtgggctcttgagattttagttgaattaaattgggacatatgagacaagaaagttcgcttcatttgatggcttttaacatgatttcacactttttcctatggtctggccagatgagtacgggcctagcagtgacttccatgcatactcttttcatgtcatcataccataccctctgatttggtcccgttagtggatacaagcctaggcgagattctcgctctcaggttcggtcctctacgagcggatacaaatcacggatacaaattgcataattcaccataaattaaacaagcacttgcttcggtcatgcttcatggcttcgagccgtgctagtagtgatacaggcatagtgataaacaaaattaattgagcatactaattagcatgcacatatgctagttttgacatatgttcagccatatttctctaacaagaattaaaataaaatggtgtttattttctttccatggttagagataggaaatagatgtacgcatgcatatattttctcattccatctgtttatctacaaaatgttggataaatcacgaactacgccgagtcatgacggccggccataaaattaaccaacactcgcttcggttacgcttcacggcttcgagccatgctagtagtaatacaagtggagtgaaaattataatctcaaaatcatctgcatacatatatttgcttaaaatagtgtatatatacttgttgcaccatatataaagtgcagtataaaaaataatctgatatacgcacatgcatgcatccatatactctggccgtgcattttccttccaattgcaaattaaccatgtacgcacgacaagtggcgacatcgtgatagtcgaccataaatcaaacaaatacccacttcggttacgcttgatggtataaggccatgctagtagtaatacaggtgtgccgcaccaaaatcccgtggcatgttgataataatggcgctaaaataaatactcgtttggttacgccccgcgagtgctcaggaaaattcatcaatttatatatgcgtgctacatataggaaaaaataaagtcacaatgccaaaaaaggaagctatgtataaatttgctaccatacacgcagtgatattaaaaaccaacaaattagtgggcatctaaaatacttggacgcccaaaatgaaataaacatataaatggaaatctacagaagattctacagctgcgacatctggagctttaggatagattttcctttttatccttttagcgctcatgtaattttattttctttcatgttggaattcctaatcaggggttttctctacggagatgtaattaacagaatttctatctaaatgtatgaattctggaagtaatggactcgcaatttctgatttttatttatttattgcatttaaattaaattgtctctaacgatttgcggataacggacctactataacgaccgtcccagttttcccatcgtcaattttctatatggatcatctatgtgatcctaatccatgcaagatttgggactaactatttgattgctcctgaactgatcttcagaaaatactctactgttaggtgttagattcagaaatgctgtcttttccggtttgttgaaattagttccaatttgaagaaatcatgtttgacttttagtgattgaattaatttagtggcagagaaattagaacaatagcctagttaactactttttctcaggaagtatttaggcccttcatcagtgtatttgcagaccttgctgaaacattcaggccatacctcctggaaggagaaaatgttgctgcgcagccttgctgccctcagatgttctttatacactgatgaagaacaaaaaaacatagagagcaaaaaaaaaagataaaattttgatagaattataacgttaaaactgttagatttttttcgacggataaaatataatgaatttgaggttaagattttacacgtaagtataatactattgaaagtacatgcattattttttctagattttttggtgatatttattagttggtatgtacggtgtatacaagtgagaacttgtgtggataggatatgtttccaacttgtttatgcccacatgttaatggaatagctcttcatcaatctatttatgtggacatatgttgtcttaaaatatgtattaaagtgactatatataatggtgaatgttcttaattattttttctagacaatataatatttttgcattttgtcttaaatatatttttttatatgatcgcttaattggatcgattctaagaaaatcaattttactgtcatcaaatttaatgatttattaactaaaatattatgtcatcgtagcgtagcacgggcatattactagtaggagtgtagttggtgaattatagggtaggtttgtagatgtctctctaagactgtgtttagatccaggagtgaaaagttttagcgtgtcacatcggatatacggacactaatttgaagtattaaatgtagactaataacaacacaaattatagattccacctataaactgcgacacgaatttattaagcatcattaatccattattagcaaatgtttactcagggccgtgccatcaaatttgtaggccctgtacaaggctctaagtgaggcctaaatcaagtaccaaatatagctaaaataatgtatatactgcagagcaaatgcgatatatcaacaacagtacatttttgaactcttgttttataatcagaaactgtcaaactgaaaatggagaatgttcgttgctgttgctagcttgctgcctagtgccttgcttgttggttgcttgctaagttgctatatgctagatgaatgaaaatatgaaattagatgagccggctagcggcctggcgctcagaagagacgagacgtcgagactcgagacgaactgaataagtcacagatacgaaaaagaaatacaatacaaaaagccgtgaggcctcggggctcggagtcgagaatacgaagcgccacgcatgtgaagtcgccacgcggagatatgcgcgtactcgaacggggttctggcgctctggcctcacacgaatacatgggccttctctggttgggctgattttttgaggccctggaaatttggagaccctgtacggtcacacaggtcgcacgcccttctgcatggccctgtgtttatgtgtttattgtagcacaacattgtcaaattatggactaattaggtttaaaaaattcgtctcgcaatttatacgcaaactgtgtaattaattatttgtttatctatatttaatactctatgcatatattcaaacgtttgatgtggtaggataaaaaaatttaccagggaactaaacaggccctaactctccctaccatacttgatactagtaccaaaagtcaatgtgcagtacaaccattatctgtaaaaatctagagaaagtgtagactctccctacatgtatgcagtgtagtagtactaggagagtactagctaggatgggtagatttcttcggcttctaccatagggtgtgttcgctattcatggatcccaatcggatccttccacacggaaaacggagtagttcattagcgcgtgattaattttgtattagctttttttaaaaatagattaatttgattttttaagcaacttttgtatcgaaactttttgaaaaaaaacacgccgtttagcagtttaaaaagtatgcacgcgaaaaacgagagagaggttaggaaaaggggcatccgaacactccaatagagtgtcttcgatactcacgtttgggaacggtactctctaccacggaaaacggattagtttattagcacgggattaattaagtattagctattttattaaaaaaggaacaatatgatttttaaacaacttttatatagaaatatttttaaaaaagcaccgtttagcagtttgaaaaacgtgcgtgcgaaaaacgagaaggaggggttgggaacccggaaaaaccaatgcatgtgtaagtgcctgatgatgtatccattcatcaaacaagcaagctactagtagggcctctcacagtgcaagctatgtcgcccgtacccctagcccaaaaggttggtccaaaaacacccacctcatagtgcaagcacccatatatgtatggtttaattggatgaaggcactagtaaaggtaccaagcccacagtgggtgtgaccctagacgtgttaccacacatttatttctctcaattaccctcgcctgctactcacgcgagtattcttctcctctcctcggcgcgaccgcctcctcctctctcccgcatcgccgcgcctcctcctctcctgccacgccaccgtgcctcctcgcctcccacgccacggcgcggtccacggcgccgcctcgtcgcaagaaaccacgcgcgcaccggcgagtctttcccctccctctctgtcccacgctctgcttctcctccctcacacgcgccgaggaggaagcgggcacgggagaagggcggaagcaggcggcgtccccggtgacggcggtccggagtagggcggacttcgccggcggtggtgttaacgaccaaatttgataagatatgaaccaggttcgacattggaatcgaagcagattcggcaaagagatggattcgaagaacagagtgtgcatcggttgtgaagacatcggttggggtatgcatcggctgagatggatcggttagaggatggctgatgcaaccaatagagctgatatagctgatttcgatggagatagcttcgaggctgtttctggaatcaatcgatgtgcttaacaaggattgccacaatggagataaagctctcagataggcaattgtatctattaattaggatatcttatgtaatttctttagagatatgtttgggcaaaagtctgccgcaaagacttatagtgtcttagagtttgttagagatagtagtcgtgtccggcaatgacatattttgtatctcgggtataaatatgacccgaacccatgtaatcaaacaacacatgttcaataacactttcggcgcatcgccacccttttactttcgttctattttgacgagttcttgctttcgggttgagctgcatcgattcaatcttcaactagaggtaaacttgtcatgacggtttgcgttctcaggattagtgcttccatctttataacactctaatcttgtttatgtaattttttgagttatcatatatactttataatctctattagtttcgctatataacttgtcatcggctagtttttactgttagagagtagccgatagagttagatctcattattaatctagattataccgtatatctaccatctcttataggttttcatcatcttgtttagatcttacagttatctttatgcttaatgctgcatcggttgagtttgatctattaagtttatctataattgtgatatctagcctgttttatgatcatcaatagagatagtatcagagtttcagccgatcttacctgatttagttattcttatctcatatgcttgtttgttatgctaaatctgccctttatattaagatcttgttgcattgaagttatattaggtttattatttaatatatcttgcttgtctcaaatcttgatatagagtggtatcggagtattagccgatacatggtagatctatctgatcggctatgctataaacttctatataatctttgctttaatatatatttcgacttaagtaatttatactgtcttggcatgatgaccgatctatcccaatcacttagttcaagtatataccgaagtaaagattatatgttgttaatatctacagccgattgagtagatttagttttatcatttttattcattattgccgatcgagtcaaacatgacatcggctcgaagataaatgatatgtcattggcaactagccgatcggctatcatttatggatttaaccacggtttttcttattcttgttgattgcatgatcaaatcaactggcacgctcatgaacctaaaggcgagattttggacctgcaaaggagttaagcagatcttccaggccagtgtgtgtttttcacatcaacagacgactggcgcactggcgcggcggcgggaggcgtccccggtggcggcggctggcgcggtgtggcggcgagcagccggagcgtggggctgcagttccggcgccgccacaaccggatccagcggttcagcgttcgatctggccggggtcggcaagagtggacggctcaacgccgacgggcggctggcagcaggagcggacggcttctccacctcgccgatttcccccttccttttctctaccaaattactcaagaaatattgttggtttggtccgcatctgtggtggtttccttccttttctctaccaaattactcgagaaattttgttggtttggtccgcacctgtggtggtttgggagggaatttgttgtgcgtttggggggatttcagttcgtcgatgattccgttggagggtgatttggggttttctgtaggtggattcggcgcgagggcataaggcagtgaagaaacgctgcccacagcgcgcgtgcctcgcttttccctgtccgctcgcgccctcgccgcaacaaagtttcgcatagctcaggtaggggacgagaaacctagctaagggacgggccccgtcgccacgtcgacctgaatccgagctggcgcgacgaggtcccggtccagctcaccgcactgtgagaggcctaaagagctgtctactcttgagctgtccactcttgcatcacacttgctcctcctccagtacatcctctgcttcagaacgtgctcaacaaatatttaagcaccaacatcctctagtttggaagctgtgttcggaagccttggttgagaacccaacttctatgcatggaaaacggagcattccattagcacatgattaattaagtactattagctaatttttttaaaaaaaaaatggaacaatatgatttttttaagcaactttcgtatagaaacttttttaaaaaacacaccgtttagcggtttgaaaaacctgcataccgaaaacgagagagattaatgaaccctgagttcctctcaacactcaaggctgttgttggcccgatctttcggtgagttgtgataactacgatttgggagaaacgttgacgatccgactacaaccgtacgagacgttgtgttgcgccttagcgatcgatacacctctccgtgggttgctgatcttgccggtgcagataaaccctattcctgcaagcaaatcgaagaaacaagcaagaacaagataaaagcaatctgatattgcaaataggaatttaatacaaatgataagttggggttccaaagaacaagcagacggatggtctagccgacacgcgcgctgcaagcaagtagcaatggctaaactttaatctatcaaaaacccaagaaaccctgaaggggtacctaactatttatagaggtgggaggatgaccaagagggtccaagggtcatgctccaccagattggggcgcaccccacatgggccccacatgggccagggtcccaaacaaagttacaagcccattggcccaatacaggagacgcagcaccttgcttttgtgattgcggccaaacgagatagatttccgagatgaggctggatccgttggaaggaggacttcgagagctttccatcaagtactcacgggcccaaaacggagcacgtatgtagatttggcggccgtttgaagtcagcaatgtaacacgtggccgaatcagattgcagcacatggaggacttgatcgtgctccacctggctggggcgcaccccacatgggccccacctgggccggggtcccagacgaagttacaagcccataggcccattataggtgacgcagcaccttgttgcttcaattgcggctcaataagatggaattttgcaatgaggctggatccattggaaagaggactccaagagctttccatcaagtactcacgggccgaaaacggaggtcgtatgcagattcggcagccgtttgaagtcagcagtgtaataggtggccgaatcggattccagcacttggaggacttgatcttgatatcttcttgttgattcatgatgtgagcaatggtcgtatccatagtagccatggtcacatcatcctccccttcttcacagaaaaccgtcctcggtttttccatatggtgctcttcgcgcagtccactgaaaacaacctgtttcttgcaatcaaaacaagacaaactcgagacaatatgattagcagtaacatgtctctctagcttgcatattttatccggaactacaagatgttctaaatctgaacaaatgtaaactctatacaccaaaaatattcctctatcattatattcgccaaagatatgaaaaatagcattagttggacatggcaaatcagatttagcaaataatttctccttcaaattatcgagctcacaaaaatcatcaaactgaacatagcccaaagtatttaaagaagatagcaattcgcgttcctctacttcattagcaatgtgaacaacatgcttagaatcagcacacaaagaaatagtagaactaacatgttcattcactagttgtggcatggatataagtgaaacattatcacacaactcttctttatcacaaggaacagcaagtaaatcaacttgtgacaaaggcaactcagtaattgattccactaatggttgctctactatagcatgaaaagtggacaagtgtagctcaccttgagaatactcaccttcatttctctcagcaccatttaatttaccttgcgaactttcttcagataatgtagctgcatcagccttctcctcattcgcgagtgatggaaatgacatctcaaacatatcgttcttctcattttggagacttttctgaacttcctgcaaaacatcagtgataggaggcacaagcatatcttgttgctccattggattctccaaaattttgcgctcaacaatacaagcaagcatgaacaattggcctatatgattatatgtcacattaacaagcccagcctgaatattgaaattaagccctctgaaaaatctagtcattgtgttctcattagattcttgtaaaccactataagtgatacaaattttaaaatcatgaaagtactccctaacagttttgtcaccttgttttagatgttcccatttctcaaggagagcacgtctatagtatgaaaacacaaatctttttctcatcagtattttgcattcatcccaagtttcaagcttattccccacagtatgccaccaaaaagatgcagaaccggtacacttattactagcagccttaatcatttgagcattagaaaaatcatactcatcaaattgtttttctactgctagctcccaattaatgtatgcagcggaatcatactttccatcatagactggtaacttacatgcaacttgtgcaaaattatagtcatgtacctcatatgcatcacgtgaagaagtcgtcatatctcgtcgaaggtgtagatgttgacgttgagcatgaccatcttgtttccccttgcgcaatcctgccatggttagcagcaaacaagaaacatacacaagaatatacacgctcctatcaactactaggtactggcagctcaaatctcacacacacactcaagcttttaaccaagctcttacaagatcttaccaatgcaagtggaatggtgatgtacaccgactcaaccaagcaccccaatagaggttggatatatcgatgcctcggcaaacacttgccgtacggttgcaatcaaatctgtggagctctgggtaggcttaaatatgtagcaaaggaatagcaaatgctcaaatcagagaacgcaaagttgaataattgttcaaagtcaagtaccgtgctggtcctaggctagaacgtactagagacgcgagcctagacacaaacggtaccacaaaatagcaccagaaacaactcaagcacactctgatgtatgaagttcagctcaaacaaaacaatattttctcttttctttctttcttctttcttcttttctttttttttccttttcttttctgattttttttggtgcggctttttttttcttttttttttcacctttctgccttttttttctcactttttttcttattttttttaacaaaaactgactcaaggaccttaatgtaagattacagggactcaaacataaatataaaatttatagggactcaaatgtaaaagtctaaacccaaaattaaaattatacaaaaaatggaatgctgaatttatgccggttccgtttttccaaacagatctcaaaaccgacaccaaacaaaaattcgccaaggtgtttgacacaactcggaacggtggaagagagggagggagtcggactcggccaaaggggcgagtgggactcggccaggaggtggagtggatggcagccgaatttggtgtatgggataaaaaggaaactgatttttaaccaatccaatctactatatctttccaaaacaaacttgactacttccaaaatcagatatggtaattcaccttcctcctctcgtgcacgacacaggcacggccaaaacaaacacacacaaggatcggcaaactctagatgcaactcaagaactccaaaactaaccgatagaaacttctgaaaactacaaaaatagaaccgtggcagcgagccgattccgttttcgtaggtcccgacaacaacagagacacggtggcagcgacgactgtggtacaaaacgtgaccagaactcgagactctaaacgaactagacgctaagaccagcaacacgacgtgacgatgcaacacaaaattcaacaaagcaaaaactgaaaagaacaatgcaatggcacaatatggctaggtaaatgatacgaatttttttgtatggctattttctggttataggaagataaaaactcaccgagcaacgaaagctctgataccacctgatgaaccctgagttcctctcaacactcaaggctattgttggcccgatctttcggtgagttgtgataactacgatttgggagaaacgttgacgatccgactacaaccgtacgagacgttgtgttgcgccttagcgatcgatacacctctccgtgggttgctgatcttgccggtgcagataaaccctattcctgcaagcaaatcgaagaaacaagcaagaacaagataaaagcaatctgatattgcaaataggaatttaatacaaatgataagttggggttccaaagaacaagcagacggacggtctagccgacacgcgcgctgcaagcaagtagcaatggctaaactttaatctatcaaaaacccaagaaaccctgaaggggtacctaactatttatagaggtgggaggatgaccaagagggtccaagggtcatgctccaccagattggggcgcaccccacatgggccccacatgggccagggtcccaaacaaagttacaagcccattggcccaatacaggagacgcagcaccttgcttttgtgattgcggccaaacgagatagatttccgagatgaggctggatccgttggaaggaggacttcgagagctttccatcaagtactcacgggcccaaaacggagcacgtatgtagatttggcggccgtttgaagtcagcaatgtaacacgtggccgaatcagattgcagcacatggaggacttgatcgtgctccacctggctggggcgcaccccacatgggccccacctgggccggggtcccagacgaagttacaagcccataggcccattataggtgacgcagcaccttgttgcttcaattgcggctcaataagatggaattttgcaatgaggctggatccattggaaagaggactccaagagctttccatcaagtactcacgggccgaaaacggaggtcgtatgcagattcggcagccgtttgaagtcagcagtgtagtaggtggccgaatcggattccagcacttggaggacttgatcttgatatcttcttgttgattcatgatgtgagcaatggtcgtatccatagtagctatggtcacatcagacatgagttgggaaacttcggtgtacttttttttccaaaagaaattagggaaggcccaaaaagtaagatggaattgaacgggatcagatcgtccgcgtgcgagccgtttcgatccccctacctcctcctcgtacgataagtacgcaccccgagcgctcacgcgcttcgcatcccgcaaaaccccggtagaacccgcacccgcacccgcacccgcaccgccatggagttccggtaccgcgacggcgacgaccgcagccggtcctcccctcccccgccgccgccgcccacggcgagctctggatccgcccgtgtgctcccggccaacgaaggttacttaattaattattctcgatcgatcgatcgatctcgctatctgcgtctttttttttggtatcgtttcctttcttgatcagacgatgggcatcgtggcgcagacggcgggggcacgggagactacaacgggggtgattcggccgtgtcgctggggcagtcgtcttcaccgtcggcggctggtcgcgacgagctgcggcaggcgaagaagcagaagataatggagcggatcctgcgggaggaggcggaggaatgggagctcgagtcggaggtccgccgggagatcatggagcacatcttcccgttgctgaggagatctgggaatgcacggccgccgacgccggcggcggcggcggcgctcctgcaggttcgatcatcatgtcttttttcgtctacctcgattttgggttgttttaattttgatcgatattgaatatttgtttctagattctagcttaccttctcctactgctccgactagccgcttggactaatagcgtaccactaaatgttccgttaaattaatatagaccgtgtaatgaagaccatacccttagacattttacaaaagctatagagatcaaataataatattgtatactccctccattccaaattgattattttataggtgcaccaaaacaaaaaaaaataataactctctcatactatatttactcgagcaacaaactcaatgtatgcaccatccccactatttcctagtcaataacaaatcaagatattgcatgtgggttatatatacttagggggtggcccctctctcccaaacacccccttatgtgcatggatgcatgcatcaatgtccatttactccaatgcacaaataacgaatagacttaatgaataaacataaatatatatagatcatttaggaataaccttaaaaaaacctatatgtagatcaatttggaatggagggagtaacgtgtatctcgatcgttcatgtttttccattacatgtcttatttgatgacaatataacttttttatgaataatatactaataggattgataatccatatatggattcattactatagtcatatttcatcttcacaatgacctaagaataagtaattctatttattatccatttaaatattctactagttattccttgtaaacacgcgattcattaatatttacgtttctcaatgcccatgtagccaatcatgtgtagaagaatagacaatcatgtgtagaagaatagagagtcacgcattaaatccgagaaagtcaataagaggataggtggttggattgaaatatgtctatcaaaactaaatttttcagatttggaaatatgtctatcaaaagtagattgagggagtataatatagtacatttttatgtaaattgctttgggatttgcgatgacatgccgatgaagaagcacaataggaagattaatactattgtttaaaagcaatgaatttcaagtcgtgtcgtttatggatagaaattaatgcaatcaccgaaatgaggtgtgctatgaaacctcaaggatatatgctctcctctttagaaaactcttggtcaaaaaaaagttagaaaactggaaaagaaaacacttagaaattgtgtcaaccacctattgttttagaaacatacactgtcaaaatactaaagttgtggatggtatttcacattattaattatatggtcgtactcacaacatgagtccagttgtggatgatatttagaaggaaaaagtacgaattacctcccccgaactatcacagtcgtctgaattacccccctgaatcacaaaaccggacattcttcacccccaactatgcaaaccggacgaattaccctctcgacccaatccacggtggttttggtctacgtggcgtacgcgtggcagctgagtcagcattctattcattaaaaaaataacgggacctacatgtcatactcttcctctctctcactcttcctctctcttctcttctctctctctcactattcctctctcacgggcgggaggcggacacggagctgcggcggcggtggccggcgggtgacgctgaggcggcggcggtgggggatgagggtgacacggagccggcggcggtagcgcggcctcgccggagtcggacgtcgctacggcggaagaggagaggtcacgcaatgtggaggcgaggcgggtcgtgtcgcggcggcggagcacggcgtgggcctcggcgaggagctgcttcagtgcttgagcaccaggggcagcggagggggaccgaggacggcgacggccgggggcagactagttgggggcgacggtgccgcgcgcgcacggggaggcacacggcggcgtcgctttcttcccgcgctccagggccgcgctcgcacgagggggcaccggcggcggcgacagcgcacgagggagaaggctgggccggcgagcatgttcgtgcgggaccggcggcggacgggggcggaggccctgcggatctggaaagacgatgcgggaccccgacggcccccgtgcaccgccgtccgccgcctgcccccacgcgccgccgttgtccacggcgtcgggccgccgagcgcacttgtgccgcccttactcgccgccgtccgccgcgcgcccccacgcgccgccatcgtccgcggctccgcgccgctgtgcgcacttgcgccacccccacttgctgccgtcgtccgcagctctgcgccaccgtgcgcacttgcgccgcccctactagccgtcatccgccgcgcgcccccacgcaccgtcgtcgtccgcggctccgcgccgctgtgcgcacttgcgccgcccccactcgccgctgtcgtcccctccgcacttgcgcggttgttgcgcccgcgtgcaccagtgagagagaacggagagagaaattaggaagaggtgaagtggaggcatgacaggtggaccccaccaatttttttaaaaaaaatggtgactggactgccacgtgtatgccacggggtcaaggggggtaattcttctggtattgaaagttcgaggtgaagaatgtccggttttgtggttcagggggtaattcggacgaccacgatagttcgggggggtaattcgtactttttcctatttagaaacaaatctatttggttttctcaacattggtgaccagtctacaccaatccatgagttgtaactgtatgaacaatgacatgaactatctaataccatctaaataatcccaacggtcgattttgaaggtcggtttcataggccataattatgcttgcaagtgcgatataattcagttgtttgtatggcttgccacatcctcgtggatctatttttagagagttcatgggtaactaagatggtcacagttcctgatttgttgtatattggcccccgatgttcatgtatctgaataaactagtttctattaatctacaacatgcacttctattatcgagatatgatcaaactgttaaaaaactaagaaaacactttgaaattgcagcaaccatctattgttgaagaaacatgcaatgtttgtggatgatattttgcattattaaccgtgttcatactcacaacatatgagtcaagttgtggataatatttagaaacaaatctatttggttttctcaatgttggtggccagtctacaccaattcatgagttgtaactatatgaacaacaccatgaactatctaataccgtctaaataatcccaacagtagattttgaaggttggtttcatagtccacgattacgcttgtaagtgcaatataattcatttgactgtatggcttgcaacatcctcgtggatctatttttaggctcagttcggtagtacaggtacccaactcctcgttttccgcgcgcacgctttttaaactgctaaactgtcagggttatgataccacatacctaatagtagttgactaaatctcggcaggatccaccacataccatgtcctatacagaagcaaccttcggatataggaggagttctggataatgaaagacaaccagagttctacatgaaaatgacaaggactactcggattgtatccatattggtttccctagttctacttggacaaggggacaactatgggtataaatacaagcccccctaggaggacagggggacaaccatcatgagacgatcaacacccaatacaatcgacatagaagccacaatatagaagcctacatatgccaagacacgccgccggatatcgacttcagggataagcacgactagtaccctacggtgtctccagatactgtcaggagagacgaaagcgttatctctgatctcgccgggcgcggattcgaggaggaagactaccctgttgttgactacgagtcagatcgtcagaccgccatgtcgataacagttagataggctaccccaaacattgtactggtgtgattatcatgaataaaagcaataccggctttggccaacaggatgtagggttattacctaacaattcaggggcccgaacctgtataaaaatccctgtctccatctcttttgcctcagtctcgcgtatatcctagcaccaacgatccccatactgtccaaataccgtagtcgtgacatcaaacgtcgacataaacggtgtgttttttgcaaaaagtttctatacgaaagttgcttaaaaaaatcatattaatctatttttgaaaaaaaagctaaaacttaattaatcacgcactaaaacgttgcttcgttttgtgtgccggggagtgatggttcccaaccctcactcccaaacagagccttagagagttcttgggtaaatgagatatgatatatagtcatagttcctgatttgttgtatatcccccccccccccaatgttcatgtatctaaatagactaggtgctattaatctaccacatgcctttctattactaggatatgatcaaaactgttataaaactaaaaaaaaactttgaattgcagcgaccatctattgttgaagaaacatgcaatgtttgtggatgatattcccattattaactatatatttatactcacaacatatgagacgagttgtggttgatatttagaaagaaaatctatttaaccttctcaactttgtggtcagtctactccagttcataagttgtacctatataaataataacatcctgaactatctagtactatctaaataatcccaacagtgtgtttgaagtcctattttataggccatgcttatgtgcgcaagtgcaatataattcagttaccctgtaaggcttgccacccacatcttcatggatctagagatcaagcgtaattgagatagtcattgttctgggttgtactatatggcttccaatgttcacatgtctaaaaagggaaactctattcatcactcgaagggatatcctctcgattttcatgctacttaaaaggtcataaaaatattaaataaattaataagataaataaatatatgatatatcacttcacgaacatgtatattcaaattcaacttatataagtagaaacaaaaataacaaatttgattcggaatagaactttcaatttgcagtcaaatttgttatttttctttctataattgtttaattccaatttgaacttggcaactttgtgcaatgacatctatcttgccaagtttttaaatattttttgatgactttttaaataaaatgcacaaaacaagagaatattctctggatggataaaattccatctctgtctaaatatattactagttcttactatttctacaacattcggttctgtttttaaggatggctctaatattaatttatgtatgtgttgttgtaccttaatttctatctccatctttgtttcaaaatataagtattaaaatataagtattaagtacgaaggttagttaagttgaaaaggtggtactgtgcactagaatttcttttattttgtatacttgattttggatttaaaattttttatgtcttactatatcgatgttgtcaatattcactattccctctgtcctaaatgatgaggtttatatttttttctacacgatctttaataatatactttaaccattaatttattacgtgttatgtttccgacgaatatgaaattagcttaatataaaaatatttaaaatataaatctagtaatataatatgtatatatatggttagtataattattaatcaaaaacttaattaggacgccgtataggacggagggaatacttccttccgtgttgttcttatatacgtgttctaaaagttgacgagcgtgttcatttcacgcagggcgccgtcacgaatgcaaacgcatcatcatcggcggccgccttgccggccaagaggaagaagaaccccgccgcagcagcgtccgccgtctccgccgcgacgagtagcaagaagcccaaggccgccgacctgacctgcgccgtctgcggcatcacgtcgaccggcgagaaggctatgcaggaccatctcaacgggaagagccacaagaagaaggcggccgcgctcgcgctgtctgcaccgccgccgccgccgccggcggaacccgagcccgagcccgagcaggacgaggaggatgcggcgtcgatgatcccgccggcttcggacggcggcggcggcggtggcggcggcttcagtccgacgaagctgagcatgctgacgagcgccggagtcgtgtacgaggtgatgcagatggacggctacctcctctgcgagggctgcaatgtcaggacggccgaccgcgtcaccatgatgtgccacctcgacggcggcaagcacgtctccaaggccacgaagctgaagcagcagcaagccgggaagccgccggcgccagcgacggcgactgcctctcctatgaatggcgtgaaagcagcgggggcgccgccaacaacagctgctgccgccgacggcgagcatggaacggtggtggtggaggtcgacggcgagccacacgccatgcggaggctggacgaggtcttcattatctgcgatgtctgcaacgtgaaggcgccgtcggtgactgtcatgcggtcgcacctcgccgggaggaagcacaagtccatggccgcggcgacggcgaaggcgaagggtgccgaagctgccgcctccaccaccatggccgctgctggcaaagttggcgggaaccttgaggcgggagccatggcagtagcagaaggtgtcgccaccaacaacgtcgccgacaacacttgtccggagaagggaaccgtcgacatcgtcgtcggcggcgagcaccacgccgtcaagcagatcggcgagttcctcgggtgcgcgtcctgcaacgtgatggcgacgtcggagagcggcatgaggctacacctagccggaaagaagcacaggaacaaatcgatggctgaaaaggcggccatggacgacatggagattgtgaaggccaggtcgaaggaaacggcggccgccgccgccgcctcctcgccatcgtctgcgccgcgagctgtcgtcgctgcacaaacgggcgatggctctgtggcgcccatggaagtcgaccaaactgcagaggccagagatggcggcgcgccggtggccgccgacgccgcggcggcggcggctgccaccggcgggcagcagcaggtgaaggtccaggtggaggggaggatgttggcggtgctgcgtgaggcgaacggcgcgctgctgtgcgagccctgcggcgtgcgctgctccggcaagaccgacatggtgctgcacctctacaccaaggagcactcggacaagtgcggcgcgcatccaccggcttgagtcacttcacgcgaacgtggagtggatttttaaacttttggacgtcctcacattatttacatattatctaaatgaatttcttttaaaaaatttcctcttatagataggacgaacaaagaacaaagttttttgatcacttacttcgctcgccctttttgatcggggaagataaattaatatgtgatgtatcgctttataaataataagttaaaatttaacttttaaaattaagaaaataaattaaacgactgttaacatatatttattgttaaatttgttttttaacatataaaatttaaggaaaaagtacgaattacccccctgaacaattgcggtcggccgaattacccccctaaacccaaaaatcagtcattgctcatcctgaactttcaataccggacgaattacccccctcgatccaattcacagcggttttgtcctacgtagcgtacgcgtggcaatccggtcagtattttctttcttaaaaaaattgtgggacccacttgtcatactctccttcctctcttcctctctttctatcttcactctctctgtgtcacggtgacggggagtgcgagcggcgcgtgggggcggactggcggtgtgcggcggcgcgagcggcagaggacggcggtggaatggcggcgagcggcgcgcgggggcggacgggcggtgggcggtggcgtgagcggcgcgcgggggcggactggcagcgagcggcggcgcgagcgaggcacgggggcggactggcggtgatcggcggcgcgagcggcgcgcgggggcggactggcggcgagcggcagcgcgagcggcgcgcggggtcggactagcttctcccctccgccgcctcctctcctagcctcccttccgccgccgccgccgcctccacgctgccatctgccgtcgagagccccggttctccacccacgcggcgacgatggcgggcgttctgcgcggccacaacgacatggtcatggcaat

SEQ ID NO: 80189 - DNA, 7641 bp, Oryza sativa
ggcccccttgccgccctgggggagggcgatttttgcctcccccctataaagcccagtcccccctctctgaaatttcattatattcactaaaaatccaaaaaaaacgaaagagagagaggggagggcagcagaaggggagcggcgaagccctgctggttcgctcacttcatcacaggtttgctctcatacatcttttgcatttgtactaatatgttatgtttgagtatatatgttgcgttttagttttagttctatatattttagcatatctgtagcacacagcacatatgtgtagatccagagcatagaatataatagtatgaattgagacatagacagtagtgttaattgtaagatgtagtttagtttgatctggagaatgtaacctacttttagaattttggagaacaatattgtagagaatgtaacttagggcgtagtacagaaatgcgaggttaacgcagttattgttttcatcaggcacaatgtcaaataaggtcacatttcagatagttcacggtgaaggaaatattagatttggtccagatggtgttgatctgtcagattttgtaataacatctaagggcatcgataggcctgcggagagaacatttcagtcaatttatagttggttgttgagaggatttagaatagaccaagaagtctacacaatgtcagtatcagttgtagtgagtcatgcaacagaaggttatttttgggaactaatgccgatggacagcactgctgcttggtgacggtatgtggaaatggcttttgaacggtcatggcccctcgttatatttgtgtcggtacaagagaaagatataaatgtttcaatgcaaaccgaagatgtagagggtcctatcaaggcaggggatgttgttggaccatcgatgcaaaatgaggaaaatcaaccaagggaggagcaggccatgggcatggcggatgagggggagagagtcggtataattgttgatgaaatggagagggaagattcggataatgaggaagcggacgacgacgcatcatccgatgaggaaggtgatgtaatggccactgattgggcaaatgaggacttttctggacttgttacatcagagggtgatcatgtaccctgggagtataaggagaacgaggtaattgacggtgcaaggtatgctcataaggatgagatgaaggaggtggtgaagcattgggcagtttccttgtagagagagtttagggtggtcaagtcaacaaattatgtgtatgaagtgaggtgcatgaaggaagattgtccgtggcgtgtccatgcatataagggtaaatggaatgattattggaaagttaccattgtgaccgagcacaagtgctacttacaaggggtggagaagtatcaccgaaacatcacttcagctttcgtggcaagtgagatgtacaacagtgttgttggtaacattggctttgaaccaaaatcaattattaggcacatcgagaacaaattcaagtacaccataagctatgcaaaggcctggagagccaaacaaaagattattgagatgaggtatggcacatttgaagcttcttatgataatttgcctcgtttgttagccaccattgcccagaggaataataatacttactatgacctacatacatttacatcggttgatgatcgaacaaagagtgtgttgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttgtacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcgtccatcagaaatttcactcagtggattgagaatgagcctaaggagaagtggtctctattgttcgacaccgatggatctcggtatggtataatgacaaccaatttggcagaggtgtacaactgggtaatgcgaggagttcgggtacttccattggttgctattgttgaattcatccttcacggcacgcaagcgtactttagggatcgatacaagaaaattggtccgtccatggccgataacaacatagtgtttggcaacgtagtgacaaagtacatggaagataaaatcaaaaaggcacggagacatagagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttacattccagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctatcgatttaggaaataaaatgctgttgtgatgtgatgagtgttcggactaaatacttctatcgtgtaatttcaattgaatgttgttgtaatgagtacctccgactattgttgtactagtagtattgcgaactattcggtgttgtatcataatgttattgtgatgagtgttcggactaagtactcatatcgtgtaactgcagttattgttgtaattagaaatattccgtatggtgacacttttgtttgtttgtactcttgtttaatatgtgttagtaattcgcttatgaacatttattacttatgttgaactaattatttatatgtttctgatcaatctatttgatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgtgttgtacttatgtttgaagtttgctctatacaggttgcgtgcggcaggccttctaccactttgtaggcttgttgaggcggcggcggacgaccgtgacccagcgaagcggtgggatgcagaccggtcactccttgccgctctggtagaccgctggagacctgagacgcacacgttccaccttccctgtggggagatggctccgacactgcaggacgtgtcgtacctgctcgggctaccgctggcgggagcaccagttggtcccgtggacggtgtttttgggtggaaggaggatatcactgcgcgcttcgagcaggtgatgcgccttccacacctaggaccggccaacacccttcctccgtactctacagtcgggcctagcaaggcttggttgctccagttcactgtaagtaaataagttgttattatcatacatgcttatttgcgatcaacagagtgttttgtactaacatttcattcttaattgtaggcggaccttctgcaccctgacgctgatgataactcggtccgacgctcccttgaggcgtacctgttgtggttgttcgggtgggtgatgttcactagcacccacgggtacgctgtggacttccggctggtccactacgcacggtccatcgcggatgctcagccacaggacgtgccgcagtggagctggggttatgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtgaccagaggacggtcccacgatggggacttactggtgtcgacgtggggttagtgcaacttcgctgcgttataagtttatcagtcgtcttctttttttatttcacataacatgtctaattccgatcatgtttattgcagcgtcgttacgctcacgtccaggtgagacgaggttacccagacttcgtgttcgagtttgaccgtctccagccgagcgacgtcatctgggagccgtacacagaagaggccgtcgctgcgagagcaccgctaggactttcgtcgttgtgcacacgcgaccaggcttactggctcaccatcctaccgatggtgttcgacattttcgttgagcctcactgcccgcagcgtgtgatgagacagttcggacttaggcaggtgtttccgggcaacgtgcagccgaccgtcctccctgccgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccctagagccgcacgttgccgctgtgacggacgcgtatcccacgcaccgtgaccgagactacttcgtgggggtacgtcggatttgtattagttcttacaattatttcatttatcttgcataatataggacaactactgaatttttttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgcacacctaccgtcggagcaggacctcgacctacggtacctgtttcgcacggtactgctcagcccagaggtttcttaagttttgtttctgtttttgtacgaaaacatcaccccgtcataacttgatgttccatcctcgcaggacctcgtttgccttcgagcacccctggcttcggagcagtgcgacctacagcaccggtttcgcacagtacagttcagcccagagattagttcatttttgtttcagcttttgcacgaatatgtcaccatgttttaacggcacgtttcctcatcgcaggacctcgtctgccttcgagcgcgttcgcaggcacgaccggcgtttccgcgagctccgcaggggcgttcgccacctcttcgggcgcgttcgccagctcttcctctcacggagcgtcgatccctcgcccacacggtactttactttttattaatactattaaatacctgtatgaaactgatggtccttgtccagcaggatttgcagccgggatcttcggtactggggcctcttcgtctcacgccggtaggactggtcctactagccagttctacgacgacgacttgcacggtgcacaccaccacgacgtactaggctcctctcagcttggaggagctccagaggagcacactcaggagcagccagagatcacacctgtacaggcaggacgggttggccgtgccgtacccccggaccgactcacgtactcccaggggcacattagggcgcagggtaggagggataggggtaagaggcctcgtcagtagtgttctacctcttcattccttatgtgaccgtttcttttagcttacaaacttgtaaagcagtactacttttgctattactactgcagtactacttgtgtttgtctcgtctacatagttcttttcattcatatggtgctagaacaacttatgctcacgacaacacactttcggcgcttcacggtagtgtcagatccagtagcgcgcacagtccacaacagcacacatgaaaagcggcagctcgagttgtcactatcaactttcggcgctgcctgttgacataaagtgaatcacgcccacgcgtgattgtcttgtcacatctaatgaataatgtatctcattgagttcacatatattgcagtgaaaacgacgctatataattgacaatctgaaggcaacctcttcatatcttctttcccactagcacacaacacacgaaaatggaagcgccattccttgagcgtctcaactggcgaagcgatccttttgctggttggtttccaccatggtgtgaccgtcctttgtgcgattgtggggatggatgcatactcaagtcttccctcatgatacaaactcggggcaggagattcttccaatgcgcgaactttgatcaggtatgcttcatctattcgaagttcaaatggataaaaaaactaacttcttcgtacacaattgtaacatcttacgcagacatatcgtccaatgtgcaacttcatcgagtgggtagacatggagaacccacaaaatgacggaacccgtgcttacccacgtagtgaaacaagatcggactacctaaggcggaaggatgagcatgaatgtcgaattgctgctgaggctttagaatggcacgtaaatcccctaggactccccacgtggcgtgagcgtccggagtgtcgttgtggtgaccgttgtcaggtcataaggtccgtaaggcaccgaactcgaggacaaaggtgtttcgtgtgtccaaacattgtcgacgatgatttcgtggtaattacaactattcttttcatcactcctcagtactatcattaacttaactatcccaaaatggatgtacataggaggatgtaaggaaatgtcaattcgtacaatggattgacacagtcagagttacttcaagtggcgggccgataacgcaacctgaatcgaccatacagttcattcatgcttggatggagtacgaacgtcgggtggaaat

SEQ ID NO: 80190 - DNA, 2340 bp, Oryza sativa
aagatcaagcagcacgctttggcaacaggcgacgccatgcagcgagtggctcactacttcgccaaggggctttaggcacggctagctggcagcgggaagcatctgtatcagaatcatgtgcgcatgtcgttggtggagtacctcaaggtgtacaagctctacatggcagcctgctgcttcaagaaggtggcgctcatgtttgctgccatgacaatcatgcaagctgtgcaagggaagaagaggctgcacatagttgattatggcatacgctgtgggctgcactggccagacctgttccgccggctggggagcagggaagacgggccgccagaggtgaggatcaccatcgttgacatcccccagccggcgtttcgtccatttcagcgtattgaggaggctgggcattgcctgagcagctgtgccaatgagtttcgtgtgccattcagattccaagctgttgcagcagcaaagtgggagacagttggtgccgaggacctgcacatcgagcctgatgaggtgcttgtggtgaatgacctctggagtttcagtgctctgatggacgagagcgtcttctgcgacgggccaaaccccagggatgttgccctccgtaacatcagcaagatgcagccagacgtgttcatccaaggcatcaccaatgatagctatggtgcctccttcctgtcacgcttccgtgcagtgctcttgtattactcggctctgtttgacatactggacgcgaccaccccaagggatagtgggctgcggctggcgctggagcagaacgttctggggccttacgccctcaacgccatcgcctgtgagggtgcagacctggtggagcgccctgagaagtacaaacagtggcaggccaggaaccaccgtgcaggcatgcagcagctgaaactgagaccagatatcgttgatacaatcagggacgaggtgaacaagtaccatcacaaggactttctgctgggagaggacgggcagtggctgctgcagggatggatgggacgaatcctctttgctcactccgcatgggtgcgccaatcacaagacacttcctccggatgactgtttggtttctttcttttcttctttttctgcataaaaaatgcaagttagtagacttatctttggacatgaaaagtgcatcactcttcttgtgtgcacagaatgctacagtgatttgcattttaacagccaggcaagtttctttaattataaacgtgttagtattgtcaacatgtagagcatggacacctagagtaatacttacgcgtacttctagtactttgattgctccagttgcaacatggcctgtttatttttccttgtaagagccatcagctgtataatatgccaaaaaggaggagaaggtgggtgatgtatccaagccaagcatggaaaacatcaaaccctgtactcagcaaaattaaaacaccaccatgctatcaatcaccaggaaaattgttgggtatgaatgggttgaaggaattgatgcctccatccttttccgtcttcttcggccttaccaagagcaccacaagaaaatgcaaattagaaaaatgaataatactggaatagtgttgctgcatattatggttctattctgcacttgcctggattttgcctctacaaactgcagtctacagacattatgtgttgagtcctttcaacttgaagaattgactgagtacagtaacatagttcagggtgaagttgttaagttgccttgcacctgccctttttacaaagatttgacatctgcacatatttatctgtcaaacagcttggattgaatttgcaaattgcctttgcattatgagaatatacaatacccaggtcacaggctacatcattcactatgttacatggtcctcagctacatcattcaatcagataagactggtgtagttttggctgcttccttgtatcaatgcaatagagtcctctgttctccatcaaattatatttaatgatcattgcttctttagataggacaagggaagaagtggctccaaaaccaagatttgcagattgttaaggatcaaagaaacattgaggaatggaagggccaagccatcagtaccacaaggtaccagtgctcctagcctatcagattaaaattctatactattattgtgctaatacaacaggattccagggtatacaattcctcagcggtactgataaaccagcacaattgttagtaaagacatggtttccaagttcatagtagaaagtcaattaccagttatcacaacaatcctcctggtagaaattctgaacatctgatcaccttctcaacatggcatgagtcgatactattgtaaacaaatt

SEQ ID NO: 80191 - DNA, 1939 bp, Oryza sativa
gcagggaagacgggccgccagaggtgaggatcaccatcgttgacatcccccagcctgggtttcgtccatttcagcgtattgaggcggcagggcattgcctgagcagctgtgccaatgagttccgcgtgccattcagattccaagctgttgtagcagcaaagtgggagacggttggtgccgaggacctgcacatcgagcctgatgaggtgcttgtggtgaatgacctctggagtttcagtgctctgatggacgagagtatcttctgcgatgggccaaaccccagggatgttgccctccgtaacatcagcaagatgcagccagacgtgttcatccaaggcatcatcaatggtggctatggtgcctccttcctgtcacgctttcgtggagcgctcttgtattactcggctctgtttgacatgctggacgccaccaccccaagggagagtgggctgcggctggcgctggagcagaacgttctggggccttatgccctcaacgccatcgcctgtgagggtgcagacctggtggagcgccctgagaagtacagacagtggcaggccaggaaccaccgtgcaggcatgcagcagctgaaactgagaccagatatcgttgatacaatcagggaagaggtgaacaagtaccaccataaggactttctgctgggagaggacgggcagtggctgctgcagggatggatggggcgagtcctctttgctcactccgcatgggtgccacaacaacaagacaattcctccggatgactgtttggttttttttttcttttcttctttttctgcataaaaaatgcaagttagtagacttatctttggacatgaaaagtgcatcgtgtgcacagaatgttacagcgatttgcattttagcagcctggcaagtttctttaattatgaacgtgctagtattgtcaacatgtagagcaaggacacctagagtaatacttaccagtactagaagtactttgattgctccagttgcaacatgacctgtttattttccttgtaacagccatcagccgtataatatgccaacaaggaggagaaggtgggtaatgaatccaagccaagcatggaaaacatcaaaccctgttctcagcaaaactaaaacaccaccatgctatcaatcaccaggaaaattgttgggtatgaatgggttgaaggaattgatgcctccatccttttccgtcctcttcggccttaccaagagcatcacaagaaaatgcaaattagaaaaatgaataatactggaatagtgttgctgcatattatggttctattctgcacttgcctggattttgcctctacaaactgcagtctacagacattatgtgttgagtcctttcaacttgaagaattgactgagtacagtaacatagttcagggtgaagttgttaagttgccttgcacctgccctttttacaaagatttgacatctgcacatatttatctgtcaaacagcatggattgaatttgcaaattgcctttgcattatgagcatatacaatacccaggtcacaggctgcatcattcactatgttacatggtcctcagctacatcattcaatcagataagactggtgtagttttggctgctgccttgtatcaatgcaatagagtcctctgttctcccatcaaattatatctaatgatcattgcttcttttgataggacgagggaagaagtggctccaaaaccaagatttgcagattgttaaggatcaaagaaacattgaggaatggaagagccaaggcatcagtaccacaaggcatcactgctcctagcctatcagatgaaaattctatactattcttgtgctaatacaacaggattcctgggaatacaattcctcagcggtactgataaaccagcacaattgttactaaggacgtggtttccaagttcatagtagaaagtcaattaccagt

SEQ ID NO: 80192 - DNA, 6413 bp, Oryza sativa
atatatataatcatcaaaaataaaccatcaaggtcaggtgaattaatgagcatatatactgcctatgttttactaaaatataagcatttctaagctttttaatgaaattaagaataagtgaaaaggacttctagatgctgtgcatttaaattatgttcggagaatgagagatagttaggggtaaaattagatgtaaattaaataagcagttgttcggtggggaagtaactgtattttggcataaatttttaaacacggatcatatagctactccatccatttcaaaatacaaggtacaatatttttttccgatgtttcataatataagtctcatacaattaattagcacattactatctcctaaatttgtttctttaatcaccactcccaagatctttaattccattaattgaatacatcatcacatgtattgtattattaaggtatcaaacaaagatgtgataattagtatttgtgttagtgatggttatatcttatcttttgtgatagagggtagaacggagtgagcattcctgattgtacatggagcttcaaatatcagtagatattttctgtacgggatatatatggccatagctaccagagaagtcgatcaagttggaattgacgatgacatagtttatctaatttatatccttctcattgtgataatgaagtgtgttaagttaagcctatcttatcataaggagtatgatgaattttaggagtaaatttcacataaacccataaactgggacactttgttagatgatgataattttgagaaaactttaaaaatcttaggtgatgatcaaactgggatagaggaactatatcacaaaactatagatttattgataaatttatcacaaaattacaaatttaattaaggccaagtatcacaaaattacatatttaatattgaaattatcacaaaactacagattatagagtttaaatccctagcaccgcggttatgttggagctataaacgttgcagttttatgattaaattggcactaaaacatttagttttgtgataaatttgctattaatatttatttttgtgacacgtcattttaaatatatatagtttcatgagaaattccatgctaaatctgcagttttgtgatacaacacacactataaatatattttatagttttgcgatagtttgatcgagtatctatagttttgtgaaattttatttatttttaatttaagttgcaaacaagctcctttaccagcacgttggacttggacgtttggcttgccacttccccctcttgtcttgatgagcacagatcgatttatattttattcagcacagatttggatcacgcttcccctgcaaatcttcaatccgatctctgcaagactgctactgcaatacggagtagacctcctgacagttacaggtacaaaacgtacggcttataaccgaaaaccaccaccccaaaaaaggccaagctcagctcaacaaacgtatcaccctgcatgcatgcaaacacgactgattaagcaaagctactccttctaatccgcagctgcagcaaaaaactaacaaacttgccttgagaattgagctcagaatcgaatcaaattaacttgcacttctctagtattaatctttcgcaagcagccgcaaagaaagctgtgagaattattggcgcgtaggaaagaaagaaagaagagaaaagattctgtcgttggagaggagaggagagtaattcgcccatatccgaaaggcatcatctctccatccatccatccacccatccatggtgatgatgatgatgctgatgattcatccatccatccaccatcgtcgtcgtcgccgcgagcgagcgagcgaacgattgatttctttgcagattccgagaatttatcccaaacgaatccggccatcatccccctctccctttaaatccacctccctcccagcttcgtctcctgccaccgtggagcactcgatctccaagctcatctagctcttcttgcttcagcttcttcctctctctcacagttcatcacacttggctttttgagtcaggtgcttgttcttcctgctgttcttgccttggtaatgctcttgatctcttcttagatgtaatcttgggttagctagcatgcagttcttggggtttatctcatctttctgtagtttagtgtgtcaggtttagtagtaattgttcgtcgagaaaacaaaatgatatatgggttggatgaatggagaagaatgtggttcagttcagtgtgatcatcttcttgttgtggctctgaatcgaatgagctgtgaatttggtgaatttgcaggcatatgcaggaccagctgatctgcagcggctgcaggcgcgtcgtccagtacaggagaggggtcgccggcgtctgctgcccgggctgcaacacgctcaccgccgtcaacccgtcagcggtggccgacatgtcggagctcatctgcagcggctgccccacgctgctgttctacaaccgcggcgcctccaacatccgctgccccagctgcaacaggctcaactccaccagatcaggtgaatgatcatatttttgcacatactatatctttctctgaaaagatcatatttgcagctgattcagagctgcaaattgggatgaaattaatctactgaaatctgagctgatcatggatggttttatttggtggttcagccaaccagattgcacacctgacatgcgggcagtgccggacgactctgatgcacccacctggagcctcaactgtgcagtgtgcaacctgcagatatgttaaccatgtcagggtatgttctcatctctgaatgtttctaccctctatatttctcgcatcgcgcattcgctctccggtttcgctctctggtagtaatcatcgtcggctcatcggctcggtgataaccagggttggaaattccgaaacgaaatttccgaaatttcggacattttagacctctctgatatgatattatttcggccaaatttttttatttttttaattttttcgtgaactttggtaatatttgttcaaattcaactaaattttattcaaaatttcggaaatttcagaccgaaatttcaaaaaatttggcatttccatgaggaccgatcaaatcggctaaaccgaaaggtttaaccctggtgataaatagttagtgtgttcttgaatgatctttccacaactgaacagcaacctgagttgatcaactggaaagatggaataaccttttaactttgcctagaatatcagtagtcggcacaggtttttctgaagctgaaaatatggaattttcaattagattttctcatttctgtgaacaaaatttcatgggaccattgactgaacaaaccagcacttgcttttatctttaattttgcatcaactaggggatgcatatggttctcctcttcttaaaaaagatgacaactttggtaggttcagcttgctccatggtttttcatggaatcagttctcaaagtaggcatgtacctatgattagccagcagaactcgatgcctcggccaagatttttatcttccaattccgttatcaggacaatgaaactaaatgatgatggtccattgggacaaatgaaacaatctgaatcttatgtgatgtcaaatgttccatgatgacgatgctagctttgttctctgaatttccttttctttctcctacttgcaggatgctcggcctcaaactgtccttgtagagaatcctaagacactggatgataagggcaagctggtaagcctcatctctaggctatatatctctactatctactactttaaaagacgcagtcctcccatcccaccctaccgcacgcagcacgagaaaatcttgtaataaaccgaaccggcccacccaccgcaccctccttcccgcaccgcgtgagagaaaaaaaaagtgcacgtccgacttccatgtcgtcttctcgctagaaaaaccgagtttcagtatcagacaaaaatatgatagttgtttttatgggtccattgcaacgcctagacatttaactagtagtaccctaaaaccaaaatttccttctgaatttttttcttggaatagcagaaagtttcacttctgaaatgatagctgaagagtacatgtatttcagctctgaaatgtccagttgattgactgttctgttttgttatggtataggtgagcaatgtggttgttggtgtcacctcatggaaaagatgatgaacaggggctcatctagggtttaatcccaagggtctatggatgattgatacccttggtggatttgtatcattactacaaagctattgttaaatcaagtgtgttttgaagcttgatataaacaagagaaaaacaatagggcaaaaaatgaagaaaaaaatatatccgaaatgtgccatgtttgtgcttcttttgtgagaaaaaaaaatgtaaatatgctggctatggtgctagcctatgtgctttttagcaaaaaggaatggaaatgagatgagcagcattgtgtcctggaatttttatcctcatcctctttttatttctgccttggacaagctgagtcaacattgcacttgctctctgggagtttttgattcttcatgcagttgaaaaaaaaacttgaaaccactgttgagaaaaaagatagtgatggccacaggagatgaggaatcatgccttgttcttttactgtggatagacagattgatctttccaggcaaaataagcttcttcagaaagacttcttaataagatttgactgtttaggattatccagtttaagctctagagaaaagggtatataaagacatggcatgggttgctttcatggagctgataaaatatgccttttctatattgaaaaatcaaatattagtatttatgaaaaaataatttaaggacattttgattcgtagttttttctcatagaaaaaatgcaggaataagtcttttgtagcagtaaacacttttaagaaatatcataatgttttttttaaaaaataaggactaaaagaaatacacaaagcaaattttctggaccttgtaaattaagaaatccccaaccagcttggtcaaaaacagtacgagatgctagcaaaggttggagtataagatggcacttgtttgaccttacatgtccatatcaatattttttttcattgacagattaagtagtattgtccacatcagtttaaattttcgttgatatattaggcaccattttccgtaccagttttatttttcggtcataaattaagtgccatagtccatatcattttatttttcattgacaaattaagcactataggtgacatcatatcgccttcatgcgaagcttccatactgaaacaacaagattagaaccttcatatacccatgtctgatgtgattggcttcatgtatcatcagtcctcgttccaaggattgaccaaaactaaaactacttaacgtgcgtaaaacaaatgtaagaatgagtcatgaatacgtgtaaaattcaaggacttatcttaattcaggaagggaaaaagaacatagctcagaagacgcacacatacacgcacaagcagaagaatatacttcataaatcctcatcctatgctccaagagacgaaagcgtaaatcccttaattcatctgtcccaaaatatagctacctaatataggatgtgacattacctagtactacgaatctggacagcctacacatacatgcacaagaagaagagtataccctataaatcctcatcctacgctccaagagacgaaagcgtaaatctcttaattcctctgtcctaaaatgtagctaatgtgacattaccaagtactacgaatctggacctagtacaggaggctgtccagattcgtagtactaggtaatgtctcatcatgtactagttagctatattttgggacggggaagtatcttataacgtaatcgagtgtgcttaatatttatgtgtaccaacaaattgtaaaagtaggatgtgtatgtgtggtgtgctttggtgtatgcatgtgcgcatattctattcaattaaatgaaaatacacatatatggagcaccgatcgaaggcaaaacccatgttcatatataggaatttaaaataaaaatacagcaaaacaaatcctcgatcttagccccaataaaaaataaaaaatcagctcgtgatctattatagctcaaactacaaggtaataaaaaaacctattaaaccgacaaattttaatcaaacctgatgaacaaatcaaggcaaaacgaattaaactaacattatataacacctacacatcgtgagatccatgcatcatcagagagagattcccaaattagtcaaccccaatgccaagattaccaccctcattatcctccgcattataatcacctgaccaaccttaattaattaagctaaatttcacgc

SEQ ID NO: 80193 - DNA, 26963 bp, Oryza sativa
cgtggactggggaatggggacggaggggataaggattggaatggttagggttacacaattgctttatatactctatgctttgggcctggtttttatgggccatatgggccaaatacacaggatattactacacacatacttttatatcgggcctccacggagggcggggacgggggacggggaaccaaacccgcccccgccagacccgacggagaatactttctctccatttgattccccatggagacacaattaataccatcaccatcacctaatgggagaattctccacgggggaccggggaccgggtacccattgccatctctaggccggttgttatatgccgatgtattaaaaaacgacgttgatgatattttatgtgttagtagttttttttaaaaaaaaactcgcacatgtattacaaatacatacattgtatccaaaaagagctggattcatctttaaagccagtcccctctaatcctctctctcttccctggaattcctcacctcctctccttgcttctctccccactacaattcttttaggcaaaatttgttacaagacactgaaagattacggtctttgctgtgagacacccgaagatcgtgtatttgctcgtggacactataaaaaagtggtaattagctgctggacactcatcccattattttattatttccggtcaaaatggagagagaagagttgcgtaagtaccaaaatacccctgtacagtgttcttcctctcacttcttttcttttccccatcttcttcttcgcagtggagcagagggcgacggcaaccggcccgagccgggacggctcggccacggcggggcggcagcggcggcgcatcgcccacgcgctgccggcgacgccctccgcgtcggcgcgatgcgcggcggcggcggcgggctcaacttcttcggtcgcgctcccatgccgcccgcctagtcgacctcatcacctcgccgtggcccacccgcgtcgtcacgtccaagcacaccgccccctcgtcgcatgctccgcggtgagctcccgaggaagccgcgcagccgtgtctgtgaggcactggcaacgtcgtcgaggccgtccgccacgagtgctccatcatgggtgaaatccgcgcgctccacaacatggacgacgacgaggtcttcgcctacgccaaccgcatcgccgcgccctacgacctcgtcatgcagaccaagcagctgggccgcctccccgtcgtgcagttcgcgaccggcaacgtcgccacccccgccgacgccgccctcatgatgcagcccggctgcgacggcgtcttcgtcagctcgggcatcttcaagagcggcgaccccgcacgccgcgcccacgccatcgtgcaggccgtcacccactgcaggtcatcgcgtccaagcacgccgccgcctcgtcgtcctcgctggcacaccttcgccgtggagctctgcccggtgtgccgcgacagagaaagagaggaagagatgaacggagagaaagagaggaagaagaacagagaaagagagattgacaagtgggcccatagacaaatttgcctttaaccaaagtttctctctccattttgaccggaaataataaaataatggaaggagtgttcagcagctaattaccacttttttacagtatccacgagcaaataaacgatctttgggtgtctcacagcaaagatcacaatctttcggtgttctgtagcaaattttgccattgaatgtgaggaccgatgactatgagtgctaatctgtctgtctatcagtaaagagtacggggcatgacgctctttcccacctcctgttcatcaattgggattcatttatcgatcagatgcatttcggggaataaacttttccagactagtactatgccaaattggagagagagtatgccgatatacatagttaataaaaacccgtagcgccccattactttctgtttttatatctttttatatttttttcttctcggagaatttaatgtgtattggactactttggaaaagtttctcgtgtatatgcagaattttaaacagaagctcccacaagctgacagcttgtgtttgtttcgaagaacccctcaaccttgaagaaaagtataaaaagacgcggaaaaatttttgcttctaagaatatataacgctctaaacatattagtagaagggtgttttcacataagagctatccctcaacccaacacacaccaaaccatccacttcttggatagttcgcctactttcagttcatggaaaaattatttatttattcagcttaacctttggtttgccctacgtctcagctctgcccttaatatgattgtgatgttcatatggagctctcgatggtctgagttgattgaggttaacaaactaaagttacttaatcgtggatcagttctaatttatatagatattcctttatattagagcatcatttttttcaaatgatacactacttaaaaagaacctcataggaagcactatcataggtattggtacataaaaaacgacacatatgagattttcccttttttcataggtctataaataaaaactggtataatgacttacatatgttggtttataaaaaaaggcaccaataatccctcaactcatatgtatcggttcttataggtagccgttcttgtaataaaccggtagctatgagtgcatcgtaacaggtgtcgatttttattggaaatcggcacatatggtcatcatttatctgccgaccgttgaaaattaaaagcggcacctacgttggcgctgctaatatatgtgtgttttgcacataacttttttatataaaatcggatgaagataaattttatatcaaatttctagagcacggtaagttctgcatctttgtagttgatgatatttttatttgagatcatttggaagtctgaaatatgtgaatttattttggataagtgaatttctaaaagttcctagatctatttggataagtgaatttctaaattttctaaacgatctccgatggaggcagaatctatatgaaagttatatatctaaatgagatctataattttgtagttgaaaatattttcatttcagctcatttatagtattaaatagtagtaaaaagactttgagtggagattgaggttgtgggctcgaaccgttctaactccatgcgcttgaaaataatgaaaaaatattgtgagttgtccaaaccaaagtgtgaccatgtataaatgactagtaaaatacaaaatattttttgggttttttttcgagcatgtaaaaataaaatagaggtgcaccttatagggaaatattcatttggtttattttgagccaataaaaataaaaaaaatcatctttataagtgtcgattctaaattatatccggtaaatcttgtgagtaggaaccaaagtatgaccatggatatgtagtaaaatacaaaatattttttttgtttttttagccctaaaaataaaaaaacgggtatacccctatatttgtcgattccaattagaacgggtaccaaactaccaataaggatatcattggtgcccctcgttagtaccatctgacgggtgttggttggggagtcaacactatgtagggtttatgtaataatgacatgctacccataatttgttttttctttacacctagtacctcatgtcgcaccactagctgtgtgacgtggcactgcgatccctctatcaggaacatcagtttatatatattatcatgtgttgttcaagctcgggtctcgcattaggcacatagcctgtcttatgttggtgactgtttttggtcgcagtcatttgtagtttcttaagcatggtacatatttgtttacatccactcgaacacgtatggatcattagttcgacacttcaagtattcaagtcattctgtatgaactcaaagtgacaacggaggagtttcaagcacttttttacgtccattacaacttgtgtgaatcatttcgtaacgaatggagtgcacatagagttcacatcaaattgagttaaatcatgccttgtacactcaaaatgacaatcgaggacttcaagcgcttttctacatcccctacaacgcgtgtgaatcaattcattcacaataaattaatggagtgaatattgagttcagaacaaatagagaccaatcattctatatggattaaaagtgttattatattagaggagattcaagtatttttcctgcatccactgcaacgcgtgtgactcgtcggtccgcaactgaagtaatgaaaattgagtttatacctgcatggatcaaaagttacattataggagtttcaagtgctttcttatatacattcccatgcgaatcattggttcgcaacaaatgggaagaatcattctgtatgtacttaacttgacattagaggagtttcaagtatttcttttaacatccattataactcgtttgaatcattcatttgcaatgaacggagtgaaaattgagtttggatgggagggttttttcctccgtaatttttgtatcttcttaatgaaatgactcacaatactaattatcttgcatgttcgagaaaatatgtggttcaagctatagggttacaggtggtactttttgttgccctgtgcaatctttgggtgattcggaatgatgtacatcatatcgatgttccagagtctcctaacgttgtcatggagaggatcgctttttggttggaagaatgggcaaatctgaatagtggtaaatcaccagctgttcactacccggcgaaatggtggcaaacgccttctagcggctggttcaaggtgaacatagatggagcattcatggcgtctgaacttaaggggtctgggagctgctagctagagtagttctgaggaataacaagggtaagattttgggggcagcatatattagcatgccaaggggctctgagtctggctataaaaatgggagttgcagagttgattctgaaaacggatatgttacatgtggtgaatatgctatctgaagaagagttcaatcattcaaagtataggacagttatccaagagttgaaatgtaagctcaggtacttccacatgttttaatgcaagattgttaatttgttattctcgccacaagaataagggcatttagcgaccctttcccatgacccacggatgaaagagtcaccagaatgtatgcctctattattttgcgactcttcttggttgtgagattatgatagctggtgacacattggatgacttttgcagaagactcaaggttcacaaatctagtgataagagcaaccgcaatgtatactaccaaagtggataataatgtgggcccagggttcaggtggtaacagttattacaaatctcacaatgtgctatgcctattctgcaaattaaggtggggtccaccttaaaaagaatcattgtaaaactatctcctatagccatgctagtacaaaaagattcccatatctacagaaaatattgtttattctcttgttaccggcagtagcacagtggcccggtagtagttattgtctctacccacaatgcttcttacctggttataagtctatattaattacttgttacctgctttttgttcaacattgtggttgcccttaccagctggtgacacattggatggctgtctgtagaagagtcaaagtttttaagtcttggtgaccccttacaagtgccatgtgttgtttgtttaattgtagaaacacttatgtttaattttctagggaacggtttacgaactggtcctcggttcccctatgttccttatgtcttactcccttcgtcctaaaatataaagaattttaggtaaatatgacacatacatcctagtacaatcattctaaatagactccatgtctagaattattgtactaaaatatatcacatccaccaaaatacttgagacggagggagtatcttgatgatggctatgaagagcccagtatgtttgaataaagtgtctttaggctgtgctgtttagggcactcacagtgcgtagccaacactgccacctagactaagaactttgtatgcaacaacctccacagtgcacgtggtcttctttttccttcacagtggtcccacccttctctctcctcactttttacctcctctcctatctctccctgccttccccaaccaggccacaaaactgctccctcctctagtgcgccgccggcgcctcccacacaccgccgtcgcccctctccccctccgccggcgtccctctccccctccggatctggcggcccgccggcggcgacacggcgcgggagccgaaggcggacgaccctgaggcgatctcggcgaagggcgctagcggcggatgaccccgaggcgggctcagcggagcgcgccggcggcaacggggcggagacggcggcgcggtcggcgacggtgccgaggcggccaccctctcctcccctgaagcggcggcggcgccaccgcgctgcttcggcttcgccttgggcttcttcgacgaggaggaggacgccgcggcgccgcccttcggcctccccatggcgcgggcgcgtctctctctctccttccgggcagcgcttgctgacgagacggcggcggcaggcggctagatccagctcgggcggagaggcggcgccgggagttggtttggtttgcttcttctctacttcaacggttggtcgacttcaatgcaagaaagcatcggcagcaattgctcctcccgtttagttaatgtcgtccatggcctccaacgaaggtattcttctcttctttctcaaatattctgtttctcgcatatatgtttgctccttttttttttccttctgctcgcttctctcttcttctgttcgtcttggtgatgacgaaactgaaggagtatttggtgattgaatctgcagaggccggattcccttctctcctgtgggatgaactcaacgacgacgcggggcaggatgaactcgacgacgacgcgagcgcgggagaacgacgaaacgaggtcacgacctccacaatgcgcgcaagtgcctgttcctcacgccgctcgccctggatttggccgaggaacgcgtgaccaaagttggacgcgcggacttgagaaaagtgtgccagaagctaacgtggcaaggaatctatgcgctggcgcagtgaggctgaacgccatctcaccgcattgtaaatggccttagtgtgagttctagctagcttctaaaaatacaataaccagatttgtggcacacggatgttggacagttggagtgctgttttaggagtctctgaaaagtgaccaagaatctggcccttgggttaatgacaaatttgattcaacgataatacatgaatttaattgaatatacacatgattttacaccactgactgtagtgacaaaaaaaatatttcagctctatagatgcaatcaaatcgtaaatgcgttaattttaaaactacctgtctatctgaagaaacaaaatagcaaggtcagctgtaatagatagatgccagaacaactaacaagtcggtcagaagaagcccgatagcatcaaatacgtattttggggcaaataaaccccagacctgcaaagtttgacattgcatagtgtcacataaagtccaccataattaattagcaaaagcaggaatactcgtggtattcttatgtggcgctggggtaaaaattaccatcaagtgacgccgttgaatggtaacacaaatgattgtaagcgttgttgtgattgatgtaattaaaccatacatcaaaagcacctaagtgaaacaaaacagacaaggggccccatcgatcagtaagcaaacaaacagaaaacataatttggtctccaaatggagttccataatgcatgcaagatcagtactccctccggttccatgattcttaacattttggatagggttgaggtcaaacttttgtaactttgaacatcaataactttaaatatatttagtttaaaggaagtagaacaacataaaaaataaatatatttagtttaaaggaagtagaacaacataaaaaagtaaacacgcatttatttattgtatatatatattataatagaaaaacaaagtcaaagatgtattttgaaggccgtgtcattgtccaaaacgtcaagaattatgaaacgagagggagtactacgctttgtcctattgtttatattctgggagctccaaattattttttgtatccaatattttagtgcctaactacttgcagtatatttgaatttggcatagataccttgaagttagtattttaggctgctgctttgtaacgttaaactggtccagaaaaaaataaaactactccatatttctaactaattacctgtattaatctggtgacagtggcatcattcaccttgctgttcttggatgcagaattgtaccagcatatggcaataaacggaagactaagaacaggcagtatgtgagaaacgccaaaagtatcaatggaaagaagaaggccttgtcggataatatggaaatgatcaaacctgtaaaattaattgttgtgataagtaaaccgtgtgcatcatgagagatgcctttcagcatttatatttggaacatgattacactcacccaatgaatgcagcaccataacggaggccatcaaaggtacacctgaaacataatttttgatcaacaatgtattttcaacaactccatctaaaaatatgaattaaatcacatcagatacagaaaatacaaattgtacatgcattttattccagactaggaaacaaattgcatactaaaaatgcattattaacagaaagataaattctaactaaaagataaaggtcagtaacatccacacagcaaagaaattaccaatgacccgtcagataaaatagacaaactgccagaaagctccattgtgttactgaaacagagtcagcagcatgtattcctttgtcaagtttcagctctctctgatttttctgctgtaactttattatacaccatgctgcaaaatgaaaaagaaaatcacatgccatgctcttaattaggacataacaggaaaagaatctcaaatagtgcccaaagtagtaattgccatgttctgagaagcaaccatatgtctaggaatagagctcacagtacctatagtcatacaaattagagccacaaagggaccttgtcttcccaacaagatcaagatagtaggactccaggagcacagcatgacagctgacaaactagttatcctttcattcatcttcaaatgatcagttgacccaaacaaccgataaaatgcagatattgctaatgataaacctccaatagtgtatacaaggcgaggagctaaacttattccagtctctctagtagctttagtatgagagagcaaagtactttcagaagcccaatgaattgctataaatatataactcaagatgcttccagacataacagagtacttcaagaatctatgactgatcgcataggatatgcacttcaaaattatataggccactaaggtaagagatatgatggggaatatttccatgagatcactgcaaaaacttgaaccaaacaggccacaaataatgctgactgggtggtcatttgaaattattgacccagaaatttgttttgacatcccaaactcaatcccaaatcgtatgaaaatattaaggaggagaaaaacaaactcctgcgaataaatagagtaaaagtagatcagaagttgactatacataataatagaataaaactgaggtcaacacagggaaattgggagcattaattgtgataagaatattaacttctatgatgaattttccttttgtggctgagtgccacacactggcaatgcaactcgtggccaaaagaaagtttgcaactctaccttctgccactgcatcacaagaaatagatgcatgaataagcaggtgcaccaaataaatttataatatttgatgaggttggtatatctgacaaactcacatatatagctattggataggaaacttgctgcccgaattgcaaccaatgcaaaagcaaagaaatttttcggaatgaaacttgaacttgctctttccttttctgaaatttgatcaatattcaacttcacaagcatacatgcctgagtactaactgacagtatcataactgaaagaccaatgcccatcagccataaatcaaactcagtccatgcagagcgagcaagctttgcaaagctctccaagaagtcagagtatgcatcaatttgcaaccgcagagctgaacttgtgcattccttatttgcgcactcctttaattcatcctgactgcttgtttccactggacatgtagacctcaggacagaggaccaatttgcctgagcttttgaatacagatctgcaacatggttcaggtcttctgctcgaaatccaataacagaagtggcagaatatcgatcaatgtacctctttacctatgagggttaactgaaaatcagcgtagagcttcagcaatccacccaaccaaacaaatacaaatgaactttcatattacctgccaacaatttatacagagagcttcagcatatctccgcatccatgcttctagatcattctgctgtgtacaatcattggcaccgatctgttgattatcccatgttccagcactcagagcatacaattctgggtttacacgtccaatgctagatatggcacaatagaacacatttcgtaaatatactgaattaagtactacaactatggaaggatgtagggacaatagcaattgaaaaataaaatcaagtcgaatcagtatatataatgaaaaaaaaaagcaactagatagtgtctctagtcaaaccagatagtagcacacactgcaaacaacagaaacaagcaagtaccaagtaaagcgtacacaccttccaaaaggaaaaggtataccaagtagcgctgctatagttactgcaaaatcaagctaagaacaaggagaaaaattaagcaatattgatcatataagccatcaacataaaagaatgcagttagcactgacctgctgcatagtgctgacgcacacctctttaccatgctagaaaagaaataaacgtgtgattagtaggcacattactacagtcacaaataaaagcaagcaaaatctggctaaacaaaatgtactacgattaacatgtatcttggccaaaaactgtattacatcaatcactgcttatttcaaatttacattcctaaaatctacaggccctcattcccactcttttcattaaaaaacgctgcatgcagtacttcatagccatgcataacacagtcagagtagagtttaaaatagtcaatcactttgccctacggttttagatgtcaaaccaaatatacaacagtaaggcattcaatatggaagcaagggattagaaaaatatcttctgtacgcaattctagtttaagtgttctagacaaaaaaaatgtaactcaggttataatatggccaatgaatattaattataattgtttgaaaacttagtcctgatcataacattatcgccatacatggcaagatagctcaaatcataattagttagcagaacatataggataagaaaatgtaccagatcagcgttgcataaatttttaccaagaacagacaagacagcatttggtggggtcttcggactccatgcaaagagcgatgtttcaacctataatagtaacagcattagttatgtagacatgattaccatttagtgttcctcttcagcatttagcaacaaaacataagatagatcacctcttcagcagttcctccaccatgatcaccatttagtgtttggccatgatcccccattacaagaagtaaagtattctcatggggaccacccgatgttgatagacttttcaatgtgtcaattacatcctgtatgagttaaatatagcagcatttgattatcatagttaatatggccatcatatgggaataaagaacataatgaggtcaaatttaaaagaatgataagcaggtaagcataaagccacattatatatttgtgcatgaggtgactgacctctaggatccgattgtattgctccaacttctggatcattggggtagagtcaacaccgaatatatgccctgcatggtcctaaaggaagttgatctcacatgttctttattcaaaacggacaggataaaaggattaaatttttaagctaaggcataagagaatgcacaataacttaccacgccaaggaaatgtgcaataagaacgtcccaatcatttttgtgtaatgatggaagcaagtgctcaataacaccattgtctacctgatatatacgataaatacaattactggtaatttcatggaaaatttatgggaggaaaaaaactcgcactgcagaacaaggaaaagaatggtacaaaagatatgacatactgtgtcaagatctttaacgttaaaagaagggtaaggatatgacttgttgaaatgttcagggtataactggatccaagtatcgtctcccatcatgacgaccctctttccatttttggcaaactgattgagtacaaagaaacaataggcaacacatacttccacggttagttatccagaataaactgagtaagtttactgacaccatatttgtaatgttagatgcaagatgagattgtgacaagaacctgatgcattatgttgttcttttactattgctggagctccaaagctattccccacatcaataaatgtaggcagaccacctgtcgtcagagcctgagtatagaattttacagcaaggatgttaaagcctgggggtgaagaacacacaaagttacaaccatttgattgcactgaatcgtgcagagcatatcaggtcaactcaattcatgaatgcatataatgcgataatcttatactgcactgaattgaggaaaggacaacaatttttcagggtaactctgttgatgaatgaatgaatatctggattaacaacaacagaaacagagttgatcaccttaagacgttgaaggctagtcgtcggtggatcagcaagcgctttgaatatcctagcagaggtcttctcatcagcagccaatctttgcagaacctgcagtttgtccatccatggttgcctctctgcagcgaatcatggcctcatctcagagttacaaatcacattctcacatgttacacgttgagcattatagtaatacataaaaggagtaaatcaccttgaaagaatgtacttggtgccacaaaatcgaacctgcaggacagtgcattgcacaactgtgtcagctccaaacttatcctactttctcggtaacccaacactgagtataatcgcagtagccaacaagagatttaatttctctcttggggaatctaagattcgaggggtggtgattttacctgagggcgtcgaggacgacgatgacgaggcggtcgacggcgggcgggggccaggaggagcagcccggggagatgccgatgcggtcgtcgcggtggctgtggacgtcgagctcggtgcgggtgaggaggaagccgcgggtgaagaggtagatggcgagcgagtggaacatgaggacggcgaggaacagcagcggccacgcgcggcggcgggtgtggctccccggcgccgccatggatcccgtcagcgaaccgcggcgagatctggcggggggcgggtggggatggtggaggcgtgcgccgtagcgcggcgagcggcgtggcttgtggcggcgtcggacggcgtgttggatgggcctaattagtgggcctacggctttttgggcttactggcccatcaacgctcatgtcttctactgggctggatgcaacatgctgtagttgggctatttaggcatagtaaaatggaataagtgcacttaccatccctcatctttccgtctggtttaattagcatacttattaaacctcgatatcattaaatggttttgcggttttaaaaagatttaggtgaagatgtctgatattgaggtttaaacataatggacagaaagatgagggatgacaaatggacttattcctagtaaaatgcgtgaccatagcccgtcaaaatgttccactgctgatcagacggttaaactgctaatggtggacagttctaatcgagaggctgccctacagtaggaatgcaggatatgctttgacgatatttcttcagtggttcagtggatcaagtgtgtagcgctgcgtcccaaaatataagctactccctccattaaaaaaaaatcaatttagaaagagatgtgtccggagagagtaaaacgaatgtgacattttttttaaggacggagagagtaaaacgaatgtgacatttttcttaaggacggagagagtaaaacggatgtgacattttctagcccttttgtccagattcgtattctctatagattcgtaagaatgtttgaaatgagcgagacaagcagtagagagtatttcatgatcaaataccctcctgtaacaatcaccggattcgacggaatcccacgacagaaggggccgaacaaacaaaaattgaatccaataccaaatttcatgtggttgaagcaaaactggcgagttacacacctcttacatgagaaagatccatagcatccgcgcacatataaaagacccagatacactaaaccagttggatgtccgttacacgcatggcaatcggaaccgagattctaagcagcagagaaacaagacaggtaggtctaaggtagtgctagtttggcagcattacacatcagcgatcgtcacctcgacctcgacaccaggctcgatggtgatggaggtgatctgcttcacaacatctgggagctgatgagatcgatcacccgcttgtggatgcggaactcgaaacgatcccatgtgtttgttcctggtcagaaaagaacgcaaaatagtcctgaattagcacaagaaaacccaaccaatgtgaagttaagccaacaagatgtcagcaaatttccctagcttaagcaactagcatccaaagtggtttcatctaacaaagagcgtccagtttaactgttgcaagcataaactgacctgaagatatattgatgaaagataagcatgaaagtaaaaaaactgtcaatcatcagaacaatatgctacaactacatgagcataggtaaacaggggtacaggatgattggcacacaaaaaggatatacattacaagttaaacatatcatgtactttgtccaattaacaaatcaatgaattcacataataataaatcccatgaaacaaactcacatgtccacttaaatgggcgtaaagtttgatcctttagtttagtgatgtctttttgcaaccaagtctcttgcgcaatgcaggcttcgagcctatggttgctataatagtgggaagagcactaatcttgtttatcaatggattccttctctaatactacctccatttataaatatatgacaccgttgacttttaaatctacgtttgaccactcgtcttactcaaaaaagttatacaggtatcattaattttgccatgacttgttttatcatcaaatataccttaagcctcacttatatttttatatttgctcgattttttgaataagacgaattgtcaacatatatctaaaagtcaacagcgtcatacatttaaaaacagagggagtacaatactacatccatcccaaggtgtaactatatctagctatgaatctagacaagttcatatccagattcaaagccaaagagagctacattttgggcaggaggttttactacactgcgacctttgtaggttaggagccaaaaagataaatagtaaccagaggagtaacaaactatgatactccctccgtcccaaaataaacaaacctagtacaggactaggaagtgccacatccccgtactagctttgtttattttgggacagagggagtacctagcaagctacgagactagccagtagtttcttgtgccactggtactcgatcccataacagttatcactagtccataacaaaccttaaatttaaaagtagcattgctattattaccaatcatactaaactatcaggatacaagagggccagcccacaaacccacttataggccatttaagtgcaccaacctatggtttacccacttgaatagcccataaatgggttcaaaagccagcccacttgcattccaatagaataccaacatatgtgccttccaaatccctgctaaacaaaatcttactaaaccttcttgacttcagaacttggcttggctatctttaaaattatgacatgtggagaataataacactaaaattgaagaaacgtctgtatattctgcccccttaatatgagactgtgggggtaacggcaagttttctgagcttgcctctagatcattcccttatctagaagtgaataacataggaatatcctagtttgttgtagcttgacagtgtccatcgcttgctatcccgctgcccatccatctccatgcatgaaatggttgggtgatgaaatggttgggtcgacaaagaacaggtaaaccaaacttattcaccacaaacctccaatagtaacccttctactcaacttgctataccatgtgctttcactcgaaaacttaaacattcatccttcattacattttggtggcaacttgttgctggtagtctttattgcagattttagatagccgaaagtcactataagaacatggccatacaacaataacacttagtgaagtactctaactaaggcaaatttcaacaaagagattgcctgaaaaatcaaatagttttgactaaatgattccaatggtcacacaatccacactagtcaccaaccaagagcactaatttagaccaggatctagcttaaccaagcatctatacactggcatctatacagtggcatctgtctccaccaatccatttcctaaccacctaaaccaaagctatacccatgagtcgaaacataccacaaaaacaaatggattcaaacccaatcaagcattgcaattagaggtggctgcaactggtcaataccttcaccgcacggcgacttgcgggtggtgatgtggagcaccttggtggggatcctgacggggcccttgacgcgcagctgcttgtccttggcgcccttcaccagatcagcgcaaactgcaaccataaacacacgaatcagcttcgcgctctcagcaaaaaaaaatccgatctaatctaatcctctctgaacgacaacgaactgaaactatagaagaaaaagagaaagaatggattacccttctcgaggttcttgacgttcttggaggagagggtgatgcggatgcggttgagctgcagctcccgcgcctcctccatgccgagcttcccgcccttcatcgcgccgccggcgccgtacaccgcagccgccgccatgtttgcttcgcctcgcctcgcgttctccgctccgctcgctcggggggtggggttggtggtgctcggggatggcggcgcgggtggcgttagggtttcggagggggcggaggttcgctcggaagggccatttatataggagatgatatgggctcggcccaactctaactaacctctgaatgggctgtctctcagactctcactctctcttcttttggctgtctgaaattggaaaagtgtatggtttttttagggtaatatatgatatatatttttttgaggtgcaacataatcaaagattcaaagtggccatcttttatgcttttgtaggattttattagtttattgtcaggttattctctaggaatatttgtttataaaggatatagaacaagaatagattaataaaagggattttagattagtagtacgcaatgctagaaagtcttataacctgaaacaaaggtagtacttgtcgatgacatggggccgagggtatcatgactagaggtttgggtagccgcggtcacccttgggtcgggcctgagggtgacgagacctccccgccttttatctccccgaggggtcgggccgctcccgtttcggccccgagggcaggggcgccccgaccccctgtggttttgacgccacgtgtatggtttaggtgagcacagcagggctcacctaaccgcatttattgcggtttggacgagcgcgccacgccgcatttaatgcagcgcagcgctcatccggtccgtgaccggtcgcagtgtgtgaccggtcacagaccggtcagatcgcgggttaggtggcaacaggcggcctgacacacgcctcgccccgtcccgtcggattgatgagagcctccaggcactcgtccctagccggagccggcgtgctacctcctggagttggcacgtcagtcccgcccagatatattccaggcttcatcgcaaccattgcaaggaagtcgttgtatgaagaagggcagacatgcagcttgctaaactgacacgtggtggacaacaatgaccggtctgtgactggtctgacgctggtcatgtcataggcagacaaccgcgcacccattttgcacctccttccagcggagtggaggtaggtatgacccatcccatcggagggtcattcggatagcagccattgcaaatctccgcccattaatgaaggaatgacagggtgatcccctatgtcagacgagtgaggacgctgggccacactcaaagacaagctatattttagcttccaagagaaggcgaacggggttttggtcaagagagggtgggtccccacccaaaagaagagtaggtagaagtggagcatgtggtatccccttgagttataaaaggaggaccttgcccaccaaagagagggacggagaagaaaaaaggggaaaggaggagcaaacgagttctagagtctaaacttgttctagctctcgaactctttgtagtttcttcatacacagatccaccagaacacaggagtagggtattacgcttctcagcggcccgaacctgtctacatcgcccatgtctcgtgcattgcctctctcgcgaatattccacagaccgagggcttagaacctcacttagcgccccccgccgaaccggcaaaggggggcctgcgcggtctctcggtgaggagccccacgctccgtcatctggcgcgccatgtagggggcgcgtgtgtttttctaagctctcatcctctttcgtgtgcgccaagcttctcccgttcaacccaatggccgaacgagcaaaagcgcacaacctctctctgagtgctagcggtgacgacggggagcagaacccgcgccgtcgagctcgtactccaccgcccccctctcgccgaagtcttaggcgggaggaggcgctcgagggggtcgaaagatccgcaactttgccgcccacgagcgatggagaaggacggcgagacggagagcgtcgcctcctcgtctacggcgatggcagcacgccccagggcgtgctccaagctgcgggcgcgctcttgcgtcacccgcccgtcgtccccgatccagagactctagcccgacgttggttggatgacgtggccgacttggtcatgacggcgcagcagcgcctaggtgccggtgggcggtcttccgccaccaaggcctctggcgctgctaccgccggctccgtgtcgtcgaggtggagggcgcggcgagcggcggctgttacccgccgttcgtctgccattctctcgtcaacgcctccgacccaggaagatgtgcgtggggggccggatgcccgcctcggtttcgagcgtcggcgcaatggtcgtcgtgctgcccacgcaacggagggcgcctcctcgtccggagcgccacttcagtacgggcgcgggggccagccctccgtgcccccggttggtggtgttggctgtagagcctttgtggcgagccttcgaaacgtccgttggcccccaaggttccggcccaccatcgccgaaaaatatgacggaagcgtcaaccccgccgagtttctccaggtctacacgaccgggatcgaggacgccgggggtgacgacagggtcatggcgaatttctttcccatggccctgaagggacaggcgcggggttggctaatgaacttgccacccgcgtcggtccactcttgggaggatttgtgccagcagttcaccatgaacttccaaggcacatatcagcgcccaggtgaagaagcggacttgcacgcggtacagcgaagggatgatgagtcacttcgctcgtacattcagcggttctgtcaagtccgcaacaccataccatgcatccctgcacacgtggtgatctacgcgttcaggggggcgtgcggcacaaccgcatgctcgaaaagatcgcctccaaggagccccagactaccgcggagctttttcagctcgcggaccgagtggctcgcaaggaggaggcctggacctggaactcctccggttccggtgtggcagcttcggccgcccccgggtccgctgctcggtcagggcggcgggacaggaggaggaagaagaggtcggcccattccgacgacgagggtcatgtcctcgccgtcgagggtgcttcgcgggccacccgaaaggggaggcctgcgagcgacaaaaagaaggaggccggcgctcccagcagggagcgcccgactggcaagtggtgcaccgtgcacaacacctccctccacgacctcgcggactgccgcgcggtcaaaagtttggctgagcggacgaggaagtgggaagaggagaggaggcaggagcgccgtgagggcaaggccccggcggctccctccggcaaccggcgaagtgaggccaagcaaaagggacccaccgaggacatcgacgatggcgacctggggccaccatcgccaccgtcgatgggggagcgtgcactcacgcttctcgccggagcctcaaggccatgaagcgagagcttttggccgctgcccctacccatgaggcgacgcggcgggcacgatggtcggaggttaccctcaccttcgaccagaccgaccacccgccgtgcgttgcccggggagggcagatcgcgatggtggtttcccccaccatttgcaatgtgaagttggggcgagtcctcatagatgggggcgcagccctcaatatcctttcccccgcggccttcgacgccatcaaggtcccggggatggtgctccgaccgtcccagccgatcatcggtgtgacgccggggcacacttggccgctaggtcatatcgacctcccggtcactttcggtggttccgccaacttccgcacggagcgggtgagcttcgatgtggcggacctcagtctgccctacaacgcggtcctggggaggcccgcgttggtgaagttcatggtggcggtccactatgcctacctccagatgaagatgccgggccccggtggccccatcaccgtccatggcgacctcaaagtcgcgcttgcttgtatggagcagcgcgcggaccacctcgccgcggcgtccaagcccgcgggcagcgacgagaggcttagaccctccgtcccagccgccccgaggcagcggatgatcacgtacgacaaggtcccggtcaaggaggttgccctgggcgacggcccgtccaagaccactcgaatcggtgatcttctggacgacaaataggaagacgcgctcgtctccttcctgcgggcaaacgccgacgtcttcgcatggagaccggcggacatgcccggggtccccagggaggtgattgagcaccgtctcgccgtgcggccggacgcaaggccggttcggcagaaagtgcggcggcaggccccggaacgtcaagccttcatctgcgaggaggtggcgcgacttctggaggccggatttatccgagaggtcatccatccggagtggctggcgaacccggtcgtcgttcccaagtcgaacggcaagcttcggatgtgcatcgactacactgaccttaacaagacatgtcctaaggacccttacccccttccacgcatagatcagattgtcgactccactgcggggtgcgaccttttgtgttttctagatgcatactctggttatcatcagattcgcatggctagggaggatgaggaaaaaactgcattcattacccccataggaacttattgttatacgacaatgcctttcgggttaaagaatgcaggtcctacttttcaacgtactactcgaatttctttgggtagccaaataggacgtaatgttgaggcctatgttgatgacttggttgtgaagacgcacaaccaagagaccttactcttggatttagcggaaactttcgaaagtctccgctccgctcgcataaagctgaaccccgacaaatgcgtgttcggcgtgcctgcgggtaagcttctcgggttcttggtctctgcccgaggcatcgaggccaacctcgagaagatacgagctatagagcggatgcgccccccagccagcttagggatgtgcaatgcatcaccggctgcatggccgccctaagtcggttcatatcgaggctgggagagaaggcgctactcctatttaagctcctcaaacgctccaggccgtttacctggacagaggaggctgagcgggccttcactcagttgaaggattacctcagttctcccccgatcctggtcgccccggagccagatgagccgctgctactctacctcgcggcaaccccgcaggtggtcagcgcagcgttggtcgtggagcgcgacgaggacaaccctcacttcgcgcgtccccaccctgtgtcgactcgacccgggagagagcagggaggagaggcccccgagtcgaacggcggcccgaggcccccgacggccggagctggccctccgcccgcttgtccgacggtgccaggcgcccccgacccccaggatggcctcggggccactgcgggaaggccgcgcctgtcgccctctgaccccgaggtcatcggcgcagaagccaagtgcgccccgtgcggcctctcggacgaagagcgccctggagatgcggcccttagcgaagaggatcggccccgccgaaaggtgcagcggcccgtctacttcgttagcgaggccctccgggacgccaagacccgataccctcaggcccagaagatgctttacgctattctaatgacttcgaggaagttgcgccattattttcaggcgcatcgggtctcggtggttacgtcttaccccctcggccaaatcttgcataaccgagagggtactggacgggtggtgaaatgggcaatcgaactctctgaatttgatttgcactttgaaccatgccacgcgatcaagagccaggccctcaccgactttgtggcagagtggaccccagctctcgagcccgtctccgccctcgaggccagcttgggcccctcacagctgcctcacaccgcctgctgggtgatgtagttcgacggctccctgtctcttcagggcgccggtgcgggggtcacgttgacctcgccgagtggagacgtcctcagatacctggttcgcctcgactttagggcaaccaacaatatggcggactacgagggactccttgcaggactcagggtggcagctggactggggatccgccgcctccttgtgttaggcgactcccagctggtcgtaaaccaggtctgtaaggagtaccggtgctctgacccggagatggacgcttacgtacgccaggtgcggcgtatggagcgccatttcgacgggatagagcttcggcacgtgcccagacgggataacgcggtcgccgacgaactctcaaggcttgcttcctcgcgagcccagaccccaccgggcagctttgaagaaaggcttgcccagccgtcggcgcgacccgaccccctaggggagacggacgcgcctgaacggcccccgaggcccgtcggagtccaagcctcgggacccgaggggagcgctcccagctcccttagattgattgcttggaatcgctcagatccaggcgtacctcgcagataagactctacccgaggaccgcgaagggagtgaacgcgtccagcgcatctccaagcgctacgtgctggtggaagagaccctctatcggcgcgcggctaacggagtcctcctgaagtgcattcctcgggaataaggcgtcgagcttcttgccgatatccatgaaggcgagtgcggagcccactccgcctcacgcaccttggttggcaaggcctttcgccagggtttctattggccgacggctctcaacgatgcggtcgacctggtccggcagtgcaaggcgtgccaattccacgccaagcagactcatcagctggcccaggccctgcagaccatacctctttcatggccatttgctgtctgggggctcgatatcctaggtccgttcaggcgggccccgggcgggttcgagtatctgtatgtcgctgtcgacaagttcactaagtggcccgaggcttatccggtcgtcaagatcgataagcactccgcgcttaaattcatcaagggcatcactgctcggtttggggtgcctaaccgtatcattacggataacagcacccagttcactagtgaactcttcggtgactattgtgaagacatgggcatcaagctctgcttcgcctcccccgcccaccccagaagcaatagccaagtggagcgcgccaacgcggaaatcctcaagggccttaaaaccaagaccttcaacatcctcaagaagcacggcgactcgtggatcgaggagttgccagcggtgctctgggcgaaccgaaccacgccaagccgagcaaccggggaaacgcctttcttccttgtctacggcgcggaggcggttctcccatccgagctcaccctgaggtcccctcgggccaccatgtactgcgaggctgatcaagatcagcttcgcagagatgacctcgactacttggaagaacgaaggcggcgcgcggccctccgagccgcgcgctaccagcagagcctgcagcgctaccatcagcgccacgtccgggcccgatcactctgcgtcgacgacctcgtcctacgccgcgtccaaacgcgtgctggattgagcaagctctcaccaatgtgggagggtccgtatcgagtgattggcgtcccccggccgggctccgttcggctggccacaggcgacggcacggagctgcctaacccgtggaacatcgaacaccttcgtcgcttctacccctaatgggagttggatgtcaggtctcgggctcgggccaaccccgcacccccctcgggcgtgcagggttggccgggggctaccacacatgcatattcttatcttttttcttccgtatttcaataaaagcattttcgatttcccaaggactgcgtctgtgcctttgtttccttttgaaaaatcttggcttgaattagcacgctcgtgctcgatcctgcccttggtggcccgggccggctaaaatcgccaaaaggggcccagaaccgagccgtgccccggggcgtggtgaactcccggggggggaatcggcaaaggcccacaatcgggtcatccataaccctcggtcaccacgttcccggcctggccagtctcgacacgtgaatctccccaggcactagccccgacccgcgccatttgaggctgggacctgggcacgagcccttgttcaagctaagacacagaaggaccgtggcacagaccatcctcgtctcatacacacaacaaaagaaattgacacagaaatttcctctttatttaattgcagattaagttagtctatacaagaagggggcccgaaggcctcggaaaaagaaggaaaaaactatttaaagattggcggaggcctgggggctcactccgacgcacccgggtcgccggcctcgtcaccgccgtcaccgccctcctcgtcggagtcgagggcgaacgcgagccgaggggccgtaccctcgaagttgtggacgatgtggtcggcggcgtcccggacctgcgcgcgcgcaccgtcctcggtcccgggagggaactcgtccagcgctgcccatggggagaagtcagggtccctggcctggtagctcgccagtacgagctccaccgctcctcgggcgaggtccctcgaggatgacttaattgtctcctcgagctcctcggggagccgctggagggtcccggccatctcggagaggcgctgggcgaggcccccctggttggcggcgtacttcacagtccgcccgccccagagacccacctaccgcccggcgcggtctagacgggagacgccgtcgcgaagcatgctgggccctatctcgcctgccaagcggagggcctcgacctcccccgtggacgagttcagcgcgccctgcagatccgcgatggtgtgttcagcagctgcgaggcgggctgctaagtccccgtcgcccgcggccgccccgccgctgcgtgccctcgcatccagctcccttgcccgcgcctcgagctcagcggtccgctgatccagtgcggccctctcggcgcgggcaccttccagattgcggcgcgcttgttcctcccgcgccgcctcgcggagggacaggctgtccgccagcctttgcgccgcggcctcggcctcctcgagagctctctcccgctcggtgagcgcatcctcgcggaggcggagtgtggactcctcttcggcacagccggcctcgtgcgccgccagtgttgtctcccggatggcgacggcggcctcgcggtccgccaggtccctctccttcgcgcgggcgcgctcttccagcaccatggcgcgggcctcaagggcttcttcgcgccgccgggacgccgcctcggtcttcgccgcccgccgttcccgggcagcggcggcgtcaaggaccccccgggcggcgtcgagcttctttcctagctccgccgcctagctcccgtattggaggcggagatcgtcccgcgcctcgttcagcacggcggtggcaatgagggcagcctctcgcttctcctccacctccctggcaatctccgccagctccttccgacgggcctcgagctctcaggtgtgccggcttctttcctagctccgccgcctagctcccgtattggaggcggagatcgtcccgcgcctcgttca

SEQ ID NO: 80194 - DNA, 11078 bp, Oryza sativa
gcctcccccggggtagatgggccgagagaaattcggcccatcgaccctgggggaggcaaaatagacttttgcggaggaatttgatttggaaggatttggattcggaaatgaactcgacgatagatcggggattgagatcttgagatggcacggacacaagacgacaagcgaagaaacaaatttcgcaattagggtttttaagagataattttcccgctaggcgccacgacggaacgggcgctacagtacagctattcgaatagtttcaaagatattctactgcagtagatgtacgctttacccgcagtccacgacttgctgataattatcggctttagtcatggcccagtattaagtcattgacaattatggcacctgttccatgaacttatatcctcatatgctctgaacgtaatgttaacagcagcaagaggagttctggcgttcccgaggtatttaaggggaactgatcatatgacaccacgtcatctcgatcagggtttagaaatataccatataatttatactcgagtatcataaaccatttacctgtacgtggtaatggttaaagttgcccttcgcggctatagttgcctcctgcgcgaggacttaaaaataagaaccactatacagaggcgccatattgccaattaacctaataactaggtctgtccccattctagaaactgcggtcgtactcgttcgttcgacataagtacctggtaaaacttatgtcgattgagacaatactagccacccggaaatcatccaaatcttacgtattgtcccaatctaagtatagggtgttttaaccagattgtaagcaaaataagcaatactaaattatctgggtttctatgattaatttatgcatagaaaatagaatattgaatagaatgctataaataaataatttataaaatataggcttaaatgatcaacaggtatatggtaacttgccttgctcgatgtcctgagattgattgatattatctaaagtgtcagaggaatccttaagacctagggttagacatataaaattcaaattcaaaaggaattcaaataaaatccaaaaatatgaaaaatagagaaaataaaataaaatgcaaaaatagcaaaaaggggcttaaaagatagagaatgattttagaagaatattggtccaagtttcactgggattggatctatattttaaaagatatgggcttctaaagtttgaaaatcaaataaatgtgaaatggcactgtgtgcgggtcccacctgtcagtctctctttctcttctcttcttctaccttcggccgttccccaaatcgggtcggcggtgctagggtttaggattgcggcggcgttagagggagaaagtggttgcggccgaggaggggagggagctagggatctccggcgacggcgagcggcggtggaggagttaatttgatgcgtggacggtctagcggctagggcggcgaaggcatggttaggccgagatggcgatcaaggtgataagagttagacatggctaggtgttgacagaaaacacgaggcctgggagatctgcttaactccagtgcaggtccaaagctcgccttcggatgtatgagcatgccagttgatttgatcttgcaattaacaagaaatagaacaaagaaaccacaattaatcctataaatgatagccgatcggctaggtgccgatgacatatcatttatttcaagccgatgtcgtgtgtacatcgatcggcaaatatcaataagcaaaccagaactaaatctactcgatcggctgtagatactaatgatatataatccttatatcgatatatacttaaataaaatgattgggatagatcggtcgccttgccgagacagtataaatcacttagatcgaaatatatattaatagtaggattatatacattcataacatagccgatcaggtagatctagcatgtatcggctaatactccgatactactctatactaagattttaaagcaagtagaatatactaaacataagcttaatatacttagatgcgacaagatcttaacataaagggtagatttaacatgtcaatcaaacatatagaataaaagtagttaaatcagataagatcggctgaaactccgatactaccctaatcagcaaccagaaagcaggctagagattgcaattctaagcgcgacttaatagatcaaactcaactgatgcagcattaagtatgaaaagaaaaacaatatctagacaatcaagccgctggaagtttcatagagtggtagatatatcacataatctaagttaacatcattgtctaacctaatcggctgccttccattaacagatgttagccgattataggttagatgaagatattatcaaagattatgtgagatatatgataactcgacgaattatatagacaagattagagtgtcataaagatggaagcactaatcttgagaacataagtcgtcatgacaaattttacctcttgttgaagatcgaaaccgatgcagctcaacccgagaacacgaactcgtcgaaataaaagtaaagcataaagggtggcgatgcgccgagattgtattggatgtgttcctttttttacatagggctcgggtctatttatacccgagaattacaagatacgcccataacggacactactattatctctaataaactctaagataccataagtctttacggcagacttttgcccaaacatatttctaaagaaattatatagaatatcctaattaatagatacaattgccttcccaggactctatccatgcgtggcaaatcatcttgaagcacatcaacttgaacccgatggcgtacaccgagtcatattatcggaatcggcaatatcggctaatcagctgtatcggctagcctcgtccgactcgaactctgtcgacctgaccttagccgatttggactacagccgattcttactttgtttccgcaacgatcttcatcttggattccacttcgatctgatcttcatctccgatgccaataatgatagaatttacgaaatttggtcgttaacactaggggaggggttctagagcatctacgaggtgtctagagggattccggcagcttgccaacctttggcaaggcgcggagcatagttgccgacgagcgcctccataggcagcggccgtgcacatgtcggcagctcagagggtggcaagatagtgcaaaccgattgcaaaaatggactctaggtagtatgtagatggttgaaacgaaaaaactcaccgagatcagttgaaacaacggattgtggccggaaaaacttcgcggcggggaagaacagagcaacgcgggggcggcggtttctgcttggtgcggcgaggtaaaactcgacgcagggctttggttagggcttattatgctagaacatggtaggatataggtgttctaagggttatttagggcggaagatggatggagaggggtggagtcgatcgcgcacaatgtgatcgaccgacgggcgagggtggttgatgagatggattggtgaagcagagcttcggggttgtggggctatggttgttgatgatcgatgatggacagggaagggattggggtcctatttatagggctaggaggagcggatgagctcgggcaccgtcatcgccatggatgagctcgggatttggatgaggtaaaggtggcagaggttgagagagggcgggtaagatcgatttgagtggcaggaggccacgttcgaatacttaccggcgaaggattttgacttgaccacggttggaatcggctggcgacgtgttggcgccaatccgggcatgacgcgcggcggcggcgagggtgaaaatggccggctcgggggtgaatggtttgaattgtgagaggggataccaccgtctatctccaatccaaccgtgcggcaagaattggcgcgattcaccccgggtagaagcgaaatcgcactcggcggcggcttggacgggagcgcacggcatcgagcggcgatttcgtgcggcggtcgtcgtcctggctttgtcgccgtcaagattggcgcggcggcggtgggctgagagcatcggacgggtgacggcgcgccaaggcagtcggccacgcgcgggcagcctcaaagccgacgcgcggcgacacgacgcacgacaaagtcggctgctagagagcgtgcgcaaaggggaggagaaggccaactaaaccacggtttttgagtgggatgtggtcccctaggagcaaatctaaactttgtgcaagattggaagggatcgggctgctctagttgggctaggcattctaccgaacaccttttgtgcaatgaacagtgaatttcataatttttgaatattttgctagaaaagatttgaattcaaactaggagtttgggagggtttcactagggtttagagtatagcaaaactccactaataatagagtaagctaaagaaataatctatggtttgaatttgagagaatttgctcaaattcactagggtttagaataaagggaataattagggtaaattagtaggactctaatacttgaacaagttttaaatcaaatagatttttaacccaaacaaatttaatcaaaagctagcatgatgcagtcaaatttttagttttaaaatttgaggatgttacagctatccatttgatttagcgagtcaaagtcgttgctcgcttcaacagcctctctatctaccctctccattacaattctatgacaaatgggacccatatgttatatctattaaccttcttcctccatttcctccctattttccccgctcatactactgcctcctcccccacaccctctcctttgatgcggcgacggcgggcgtgcgaggcgacgggctgcagcgagcggcggggcgatggactacaacaagcggcgaggcgggcggaggtggggcgacgggtggaggtgaggcggcagggcgatgggcggcatctcaatgggcggcgtgacgacggctacgacgagcggaggccggcaggctgcagcgagcggcggggtaggcggtggccgactgttgacaggaaacacgaggcctgggagatctgcttaactccagtgcaggttcaaaactcgccttcggatgtatgagcgtgccagttgatttgatcctgcaatcaacaagaaacaaagacaaagaaaccgtgatcaaatccataaatgatagccgatcagctaaataccgatgacacatcatttatctttgagccgatgtcatatgtaaatcgatcggcaagtgttaagtaaacaaatcaaaactaaatctattcgatcggctgtagatatcaataatatataatccttatatcgatatatacttgagtcaagtgattgggatagatcggtcaccttgccgagacagtataaatcacttagatcgaaatacatattaataatgagattatatatatattcatagcatagccgatcaagtagatctagcatgtatcggctaatactccgataccgcttcgtgttaagatattaaagcaaatagaatataccaaacataagcctaatatacttaaatgcaataagatcttaatataaagggcagatctaacatgtcaatcgatcatataggataaaagcagttagatcagataagatcggctgtaactccgatactaccctaatcggcaactagtaggcaggctagagattgaaattctaagcacgacttaatagatcaaactcaactgatacagcattaagtatgaaaagaagaacaatatctagacaatcaagccgctggatgtttcataaagtggtggatatctcatataatctaagccaacgtcgttatttaacctaatcggctgccttctagtaacagatgttagccgattgtaggttagatgacgatattgtcaagaattatgcaagatatatgataacttgacagattacataaacaagattagagtatcataaggatggaagcactaatcttgagaacacaaaccgccataacaagttttacctcttgttgaagatcgaaaccgatgcagctcaacccgaaagcaagaactcgtcgaaataaagcaaaaagggtggcgatgcgccgaaattgtattgaacatgtgtgtccttttttttacatagggctcggggtctatttatacccgagaattataagatatgtccatattggacacgactcttatccctaacaaactctaagataccataagtctttgcggcagacttttgcccacatttatctctaaggaatttacataaatatcctaattaatagatacaactgcctttccaggactctatccatgcatggcaatcatcttgaagcacatcaattcaaacccgatgtcgtacacaagtcatattatcggaatcggctgtatcacttaactcaacccgactcaaacctagccgatcccaatcgtagccgatccggactccagccgattcttactctgtttccgcaacaacccttatcttcgattccacttcgaccccatcttcatctccgatgctgatattaccaaatttggtcgttaacaccaacggctacagcgggctacggcgagcggcggggcgggcgccgtcttcacctcctgtagcaatgctcctccccatgtctcatcgcctagttgccatgctcgagctcgccgcctctcgtagcagtgtgccggcgtcgagattgggtgggaaagagacagatgcaagagagagagggggtggaggagattggtagtgtggggcccaccattggccagccaaatagactggccaaatttagctagcaaggaggaggatttggccagctaaatagcttgaccagtgagttggagaggctgttggaatatggtttttttagaataggtaaaatttaacttgaagagtcaattggagaggcagatggatatgctcttaatatactactactaaataggagcgagatgtagcggccatattgttttgctgccattgaccgtcaagttgaatgggtttacttttccctgcgacggttaattctcttctagtaacaaagaacaagttgatcgggttttcttttcgttgggatggtcagtggcagcaaaacaatttggcatatcttgggttggtgtacctggcctgatccatttggtctttggcttcaataaactaataggagcatttggcctagtgcttgcatacgacgcgtacatgccaacataaatcttctgaaatatttcaattaactagtcctaggtgcatgatggtggtccctggtcggtggtcaagctttagcttcatattgttgttttgatattgaaaaggaaagggactgtctactcctcatttgacagaaaactcctcctagtatcttgcaaatttcagaccattggattgatttaagatttgtgcgaagtccacaaaaccctaaccagtttttcttttttctctctgccgccgcacaacggcacaagtcactcgagcctcgagagctcccctcctctcagcaccgtacacctcctgcaccgccgccgtcgtcccacctggcctcgccggctggtcaaaaggtgttaacggcgctgacaagccccccaggctaaccccctccctctccctttccccctccctctcctctccagtggcggcgagctgtcccgtgccgccgtcttccccgttgccggtggtggggcgccaccaccggccgcctccacctaacactctttccgcttgcccccgccacttacaccggcccaccgcccgctcccgtccccgcagtttcagcggcggcgagctgtcccgtgccgccgtcttccccgttgccggcagcggggcgccaccaccggccgcctccacctaacactctttccgcttgcccccgccacttacaccggccccccgcccgctcccgaccccgcggtttcagcggcggcgagctgtgccgccgtcctccccgttgccggcggcggggcgccaccaccggccgcctcctcctaccactctttccgcttgcccccaccacttacaccggcccaccgcccgctcccgaccccacggtttcggcggcggcgccgccgcccaccgccggtctgccgcctcccacggccatcctctaaagcctgtgaactcccccctcttcctcccacccccaccccgggaccctaattcgtcgaccctctgccggattttgggttgtcgccggcgccgtaaaagaagaggtcgccggagttggagaagatgcaactggagcacgaatcgcgaagcatatccagtggtccaaaatatgcaagatttggggtcgtattttctatcgacagaagtatagccgattccgtttttacaagagtggagcacttattatggtcagcttgagtagcgagacataagcgagagagaaacagacatggattttctacacctaggtataatcacacctattatttgcatgtcgtctaaacatttataggaaaaaaaaaatatctggttagattgagtgtcgtgtaataatcgtacccacttgctgcttgatttgccccagaaccttcatatccttgatccttcccattaaagtgcagtgaagtacactgatagtgggcgtaagggcctatagcctaatggttataagagtctcaatagtaatttaggccctagattcgacttctcatggaaacgaatttttcagaaattaacgactttgtgctttcagtagtaggcgacgtacccatcgatagcgaaccactccaggatggatgtgtaattctcaaaaagtagactgatagtggaacggaaggaatttgtgggtgcgacgccgaaggccggagtccctccctccctcctatggccggcctgaccatgctggcgttccatgcatgatgacatggccctccccaacatctcccgccttctcattgaggatgacatccaaaatccacaccctgtaaccattcgacgatgaaccgcctagtgaagtcaggcattgtcaaacaccaccagagacatgggcaattctctaaaaatctatcgattgtgaaacttaaaatcttgaaataaacttaaaaagtgtacaagttggatgaatttcacgagacaagagctttagagatcgattatatattgtgtaaattaaagcaagagttgaggagctgcgtcttgatgctgtcgtcttcctggaacctgcctgcctgcctttcatgatccatccatccatccatgtctcatgtgattggtgtctccctcgtcccctccacgcaacacacagacacccatcatcgcctccactctcttcccctccatccaaagtacctggagagagtggaggcatcgggaggccatggctgccgcgccgaagccggaggaactcgtcgtcgccatcgagcagccattctccccgtcgctcttcctggacctgcccccgacgccgcaccacgatgacgaccccaacaatgtcaatgacgacctcctcctccccttcatctcacgcatcctcatggaggacgacatcgacgacaagttcttctaccagttccccgaccaccccgccctcctccaagcccagcagtcttacgcccaaatcctccatgcccctgccacatcttcttcctccgacgacaccaccatcaacaacaatacgaccaactccacctccgtccccgacacgctcgccatgcccgaccacgacgccgacacccagagcgcgccggacgacatggagatgctctacatggcgttcctcaagggcagggaggaggccaccaagttcctgcccacaaacaacaccctcttctctggcttcaaggcagagccggtgctggatattcaacccaccttcacgttcggaccaagcggcggcggcaggggccggaagaacaggcacgccgaggaggacgacctggagacggagaccagcaggagcagcaagctgatggcgccagaacatgacgacgccgccgccgccgacgagatattcgacgaaataattctcaatgggtaccagatgatcattaaggggatagatgagctgcgcgtcgccatgggcagccagagccaggccgacaagaacggccgaagagcgtcacgcgcgaagacggcggtggtcgacctacacaccctgctcatccactgcgcgcaggctgtggcgacgggagactggcggagcgccaccgagctgctgaagcagatcaagcagaactcgtcggcgagaggggacgcgacgcagaggatggcgtgctgcttcgctgaggggctagaggcgcgtctcgccggaacggggagccagatgtaccagtcgctcgtcgcgaagcgcacgtcgacggtggacttcctcaaggcgtacaagctgttcacggcggcctgctgcatcaagaaagtgagcgtcatcttctcgaacaagaccatctacaacgccgtcgccgggaggcgcaagctgcacatcgtcgactacggcctcagctacggattccagtggccagctttgttctttttgctgggagccagggaaggcggaccgccggaggtgaggatgaccggcatcgacgtcccgcagcctgggttccggccagccgaccagatcgaggagacaggccgccggctgagcatctgcgcgcgccagttcggcgtgccattcaagttccgcgccattgccgcaaagtgggagacggtccgccgcgaggacctccatctcgacccagaagaagaagaagaggaggtgctcgtcgtgaactgcctccatggattgaacaccctgcaagacgagagcgtggtcgtggacagcccgagccccagagacgtggtgctcgacaacatccgcgacatgaggcctcacgtgttcgtccagtgcgtcgtcaacggcgcgtacggtgcgcccttcttcgtgacgcgcttcagggaggctctcttcttctactcggcgcacttcgacatgtggacgccaccatcccgcgcgacaacgacgatcggctgctcatcgagcgggacatgttggggcgatgcgccctcaacgtcatcgcctgcgagggcgcagacagagttgatcggccggagacgtacaagcagtggcaggtgcgcaaccatcgcgccgggctgaggcagctgccat

SEQ ID NO: 80195 - DNA, 4908 bp, Oryza sativa
cctgcagccctattattattattattattattattattattattattattattattattattattattattattattattattattattattattattattatatagtatattatagttgctgctacgctatactatctctttctcatatcaactaatcgctttattatcagctttgcttgctaggaatataaataaaaatctgcccctcacattcaacagtctgtattagtccccacgctctctccgtattactctaatctcctctgccactgcacgctgccgcctccaccatctcgcccaaccatagaaaaaaaaaacataccaagccggcccccaacttgaatgtccattcctgtaatgtaacaaacccgtttgtgcacacaaaaggcctttgccatccaaagtctcagggatacctccataagcacccacataatcatattacaacacaacacaacagttacaatcctctaatgtttacatcactcaaatggggatgcacaccaagggattgcttccttatcaacaacaaaaaaaacctgctaaaacacttccacctcatctcatcaggtgtccagatagtttgcagccatcatcagctccagagttatctccggttcaatttgaaactcagatgtctccttcccactatcaaccaaccaaacaaaacaacaaccgagtcacttcagttgacgttaaacatgagcgccttaaatttgaatgaagtaaaatattaaaacaacatttgttaccctgagtaaaatatacaagacacatctagactatcgatagagaaatatgacagaatcagagtaataaacgactggttaggttctctgttctaccctacaaaaaaaaaatgtaagactcattttggtagcataccaaacactcagatcgaaacctacaagacacctccatctccaccaaaatttggcaatgccaaaacataaatctaaaatctggactggagagtataagctagaaaacactcaagatcgcattctacttgatatgcatatgtgctatttgagttatttcagaagcatatatgagttaaggaaactgccccaagttttaatagttttggatcacaaaggcctccacaaaatacatgaaccacaaagtcgatcacaaaaccagttgacaaattgggtagtgcagggattgagagatacaccaaagctaaatccctaccatgaaaccataaaactacctaaagaagacaacaaccttttggtgcaccattatttgaaaggtgtataatgccttccacaattttaaaatgtttgataaccttatacactgtacacaggctaaaaataatgtactgtatgtaagttatttattgtattctgaagtaacatttgcatgtttcataaattccaaacaaccaaacatgagagtgcaatatgcttatatatcttatagtagttgaaggttcctggtccaaaatatcacaggcaactatctctaccaaggcttagttctagattttgaaatgagatgtatcattataaattttgaagggactaaagtattgatgcagctgctgatgctaaaggtttatgcttcccttttcaaagcaggatatcttaatgcatagtccgatgggtcttagaggaaggcaggattcgagcagttgaaaaacaagataactggatggattttttttgaaggtgctcccaagttattttacaacatttatcctacataatccaatggctaatatgactattagccgcataggaggttgtcatcacttagcactgaggggcaataaaaacttttgacagcatacctacaaggaagtaattagatgctaaattagcatcccattatagaattccgggggatcatacttttcaaaaggatataatttgatcatttacttttattcccttatatcaagtataaacattagttaagggaaagaatagcatgaaatttatcaacatttgaacctatagatgttgaaaaaaaattagtatcataaattaaatgtagtggaacatagattaggtgaaattcaaacaatatcaaatatattgaatcaataaacttatacttgaaactggagaaataaaagtggatgaaatgcagacttaatctttcaacatcctcgaaattcagtccaataaatctcgtgtatacagtaaatcaaattcaataggtgaatgtgtataattgttcgctgcatgaatggtaaccaatccgatcatttattgtgttgacttgtctgcctctaaccatggatattaatgagtatcaagcataaacaaggttttgttggcatagtactgcccatagacattggaagggtaggattaatccaaactagatccaactgcataagagttaggactagtatgggattaggggtggtgtgaggactgaatgaggatgtcatgtggaaaaggtggaaagatttacctggagtagtggagcgaccagtagaagtactggcagatcttctcgaggatgggggtgctgatctcggggaacctaacctcgccctcgcgcgtctcggagaagccgcctgtgttggatttggatttggtggataattcaaggcaatctagggtttgagaaagcaaagcgaatcggatcgatagatggggaaggagacgaaccgggggaggtgagcatgttgcggagcgtgttggagaccatggcggccttcttgtcgacgacgaactcgaagccctcggcgctgatgagcttgacgaagccggacggtgcgtcgtcgtcgtcgtcgccgtcgtccttgtgcaggtggggtggggtttggtgccccggcgcctctcccttccgcagcatcctagcttgcccccttcttcctccgattcttcttcttcttcttcttcttgtcccaggcgagacgcagccacgcaggaggaggaggaggagatcggagaagaagaagatgacggccaggcctggtcaggccttgtgtgttgggcctcatccaggcatatgggcccgtctccatgtataggcccaacggcccaagcgtagcggaggctcggcaccaaaactaaggggggaaatagtaaatttgacaaaagaaatacttttatcaaattattattggaaaattatagattcaagatttaacactaagtttattaagaaatgaggtttaaaacttaagtatcacaaaattatagatttaataataaagttatcactgattacatattatggggttataattatttaggctttgtgattaaattggtattaaacatgtaattttgtgataaatttatggctaatatatttgtagttttacaataatctgtattaaattttattaaaatatagcgaaatttactctaataaaagatgcgagcacccatcatttggttctagttaggcatacccatttggtactacttacttgttgctactagttaggcatttgatattaatagtagttaggtatcgcatcgtattcctaattgatattcctattgtacatcaagactagagcatcgtatcccttacgaaatgaaaatcaggctaacatgttatatatacactagtagagggaaggtatatgagtcgaatccgagtcatttgcattaccactagtctagtgatgtgcatccgagtcatggaacaaagcaaaaaaagatgtccaaactagcagaagataattaacctgctcatttttgtatgtgcagaaaaatcaaaacaccgaccaaaagcaaaaaaaccaataaataagggtgtagggagttgttgagttgggtccgcgaatcgtggtttcccactagcaagcgcaagcgcaggcgcaaacgcaaacgccgccgccggtatgccggagcacgggtcgaagcccgacatctccttcgccggccgcttcaccgcaagcgccatcgctgcatgcttcgctgaggtatccaatcaatccccttcgatttctccgatttctcctctcctcctcctagagagagcattattataggtagatcgagaaggaaccagctgacggatcgatgatttggttccgatccgcaggtgtgcacgatccccctggatacggccaaggtgaggcttcagctgcagaagaacgtggccgccgatgccgcccccaagtaccgcggcctcctcggcaccgccgccaccatcgcgcgcgaggaaggcgccgccgctctctggaagggcatcgtcccgggactccaccgccagtgcatctacggcggcctccgcatcggcctctacgagcccgtccgtaccgtactcccccctccttcccctcatttccttttcatcctgtcgctattattcaaccccacgctttcgcaatcgcaacgcaggtgaaatccttctacgttggcaaagaccatgtcggggatgtgcctctcaccaagaagatcgctgccggcttcaccactggtactctaccaactctgctttgcttcccattcccaactagtactcactccgttatatgctgcttcttctcatctcaggtgccattgcgatcagtatcgccaaccccactgaccttgtcaaggttaggcttcaggcggagggcaagctggcgcccggcgccccgcgccgatatgctggggccatggatgcctatgccaagattgttaggcaggttgaccttctgcttctttcttcgcatgcgcttgcctgttccataccaacacatcattgcttgcttcacatctttattatattatcctcaggaagggtttgctgctttgtggactggcattggacccaatgttgcgcgcaatgccatcatcaatgctgccgagttggccagctatgatcaagtcaagcaggttccgtccttgtttctcgcagtgactgtaccatcaatttcacagttcgcacgcgtcacaggaaagatgacactgttatcctcgccttgcagactattttg

SEQ ID NO: 80196 - DNA, 21652 bp, Oryza sativa
cttcttcccactcctgcaccgccgtctcccgccgtctctcgcatctcccgcggcgacaagctcggcgccatcgtctccggtggtgcacggcggtgactcccccgccccatcctctccctccccacacccatctcgtccccaaccggcggctccctccccctctccccttcccccaccaaccccccttcaagtcctcaactcactggcggtgttgaactcagtcgccttcgacatttccccagtccccctacctcagcggcgaacttcgccgccattggtttctctactcctgtcacgagatccaccgctgccagcacctctcccatcccagaaacaacaaaaagctcacggtggcagccgtccggcgcctcaccacaccgctcgagcccaacacgaggaaaccatccatgcccggaactggcctcaagctcggcggccatggatggatctagctataggaggcgagggccggtgagattagttatcggggatggccaaggtcgctaccgatagggagctcggcgtcgagctcgacagcatcttgtggggggcgtccgtggcgacggaggcagttgacggtcgaggatgcttgcgacggttgcatggtcctcgacggcagtgagcaagccgagtggggcttccccaacccctccgccagctttccctcccccttcggcgacaaccgccgaaacaagttccgtttcctccatctctcttctctcctccgtcccccttctctctctctctcccttcgcaggcgatgcgggtgtgtgggccggccctgacaaatattgacgaggaacccatggctcaagtatgctccgcggtcctcactttgtaacgagagatgtttgatgtggtgcggaatctcctacgtagaagggaccacctatacatttgtcgacaaattttctcctaaaaatttgactgatgtaattacagtacaatcgtagtgtaattactgtaacttgcatgtagagatggcaacggggaattccccgtcggaggttactccaccatacccgcctccgcggtggggaattttccccatcaccatcaccgtgaaatgcaacggggcaacatctttccccatcaccgcctccgtgcgggtaatttatccccgtggagcctccatccccgctatcaacttactcaacagtcaacatgtatgcatttctcatatcaaacaataaaagattaacactcaaaatagcaattccagccatcaatttcagcacatgaacaacaactacaagaacacaagttcacagattcagatcacaaattcgcaaatgcacatcatcagttcacaaatgcacatcatcaattcatcacttacaacagcagtgcagcaacaagcagtgcaacaaaagtgtgcccaagaatacaatatccatcatattcccagattaagcaacaacacaataatacatgatcattcatcattcatcagtcatcactcattagttatcaccacattgcagcaacaacacatgttgtccaggcatacgtaaaaccatagttcggagtaggtcttttgtgccaaatatccaaaagcattgccatggtttacaagtttatcatgacacataacaggggttacaaacatccaaaatcattgcaagaacagtgcatgtccatacattcatgtcttcaaacaagagcaagtccctaaattaaagaagtagcaaaagatattcaattagtcaagtattttataaggatataacaaataatggcaataggagtttgattgctaatttcaagttgttgaaagaatacctcaatccgatcttggatatcttgaaggcaactccaaaagcttgctgcttcttcattatcagctacaagataacaattataacaattattttgcatccattgcattgtaaaatctatgctaagcatgatgtatgaataaaacatcatatgtacctcgatacttgtttcgcagccaatcttgtgagcacattaaggcctccaagagttctggagtaagccggctacgatgctcactaagaacccttccacttgtgctaaatgcagattcagatgcaacagtgctaacaggaatagcaaatatatctcgtgctaccttcctcaatgtaggaaagcttgtcccagccactttccaccaatcaagaatcttaaagttttctgtattaattgaaaccaactcatcctctaagtacctgtctagctctgatttaacacgtattgctgctggtctcctactagtaacacgtgctgtgattgaagacaataaatcagaattgacaagtggaggagctgaagattccgtgttatcctcatcatcttccacttcatactccttcatcaaatcatatagagtgtctttcacctcagcaactttcgttgcacactcttcacttgactgaccagtgatggtttcaatgaacccaaggaggtagtcaatcttaaacctaggatcaagaatggtggccaaccccattggcccttgaatatctttccagtacttatcaaacttttgaatcatttcaactgacatttcctctatagtagaatcaccacaaacagcccacttcctaatttgctctttagcctcacagattttaagtagttgaatattggaagtcacataatttgtgccagaaaatactgcagtgatgtcattaaacaacttgagcctatcaactacctcactagcaaaagcccattcttcttcactaggagcacaatcaaatagcttctcaacccgtattgcacggtcaaaagcacgtgcacaaggtaaagcaatactgagcatcctataggtagaattccacctagttttgcaatcaaggcctaacttgttttccatcttaactttcacatgctttgcaatttcctcaaacttttctactcttttaggtgtggctgtccaaaaggcaacactttcacgaacctttgcaattgaatcttttatcacatctaaaccatccctcacaatcaagttaagaatatgggcagcacaacgcatatgcaaaagtttcccctctagcataagcttacgcttgccgatctttttgatgagttcagaaatcaccttatcatttgtggtgcagttatcaagagtcaaagttgatatcttctcatcaagattccattcaaccaacgcttcataaagatgttcacaaataacttctgctgtgtgtggagcgggcacatatatgaatctacaaatggaatattgcagcaagattaaaatgttgaatttaagatggtgacaagaggataatcatttgtgaatcatgtacctcatgataatgcttctaagtgtccatgaatcatcgatgaaatgggctgtgatagccatgtagcctcttttttgattatcagaggtccacaagtcagtagtaatacccactctagacttagctccagccatatatgctaatgcccttttcttttcttcctcatatgtatccataatgtccttcctatattcaaacattaatcaataaactcactaactaatcaaatttcagaaatgcaaaaccagcaaataaataatagatgaactgaaattacctaatagtgttccgagtcaccatcttgaataatggctgaagtgcactaacaaatcttcgaaagccaatatggtcaacaatagataaaggatactcatgtaatattatcatggcagcaagctctctcctagccactgctggatcaaatgtgtatgtgtccacagaaactttccctccctctatggaattgaacctcaatgaagattgtgcaagtgtctttggccccatcttgatctttctcaatgtgcaaattttcaaatggtcatgtagatgtgaagtcccattgctgctcttccctccaagccgcttgtggcaatgaaggcattcagccttgacatcaccacagactttgactttcttgaaatccttccaaacaacagaagtaagcttcctctttgtgccaaaattctcagaatcatcttctggctcatcatcttcaacttgtattggctcagaatcattaacagactctgcttgtggtggaagtgactgcgattcttgctggctgctactcccacaaccagtaccagcagttgaattcgtggtaaatctgacaaatgacaaataaatatagatcaatatatctttcagcctatagaataatcttggcaaacttgaaatgaagaatctctacacataaatcatactgaaatctgctacagcctatagaataataaatttcttatgatctacactacacagaatcggattcctttaatttcaaaaacttaagttcataacatatttataacttaacaacattcaatgtacaaccatacaatatacatgtaaagatatctaattttctacagatactctaaatacaacattcaatatctaagaaaatcaagcaagctgcaaattaataaattgcacatgctaaattgttaggaacttaggattacgaaagtgaagctacaatgtataaagggttagcgtgaaatcgaaccccatggatttgaataagcgcaggccgttggcggaagatgaagcttctggagttcttggagcagaaggagctcctgccttagtcgaagcagaaggtgctcctgcaatcgcaagacggctttttgacctagtggtggtcctttttataggtggttgcggcggccgacagcaggcctttgcaccggagttggaggaaccagatctgcccacatgaacaatggcagatccagcaacaggcacgacagcgggtgtggctgcagctgcagctgcagcgcttatagcatgcgatggctggtccaactccgcattggcgtcccttattgtggaccgccgaacgtgagttagtgactcaacgagacaatgatgcagccatggaagaggaatttagtggagggggagggggatatggtactataggtaggcgtctagggaggggtactgagttgggagtaggacagctagatgtgctcaccttgcatcgtcgtcggagcttagcggtggtgaaggcgaagccatggcggactcgagcggctggtcgtcgtgtggactcgtcgttttcccctttcttgccaccgaagccttcacctgcatccaccatgagcaaaacaaataagcctacatgacggatcagatattgacggagggtggacgaggaggccgacgtccggtggccggtgccgagtccacggcgtcctcggacctgggaggctgggagtgaagggaacgggacggcgctggggcggacgccggcacggcgggcgcggcggcccggcactggcgcggacgccggcacggcgggcgcggcggccctgagcgcacggacgcctgcacgcgcgggcgcggcggccctgagcgcacggacgcctgcacgcgcgggcgcggacgccgacacggcgggcgcggcggccctgagcgcacggacgcctgcacgcgcgggcgcgggcgcgagatcgggagccggcgccgctcagtcactgtggccgacggacggcggcgtggactagggaatggggacggaggggataaggattggaatgggtagggttacacaattgctttatatactctatgctttgggcctggtttttatgggccatatgggtcaaatacacaggatattactacacacatacttttatatcgggccctccacagagggcggggacgggggacggggaaccaaacccgcccccgccagacccgacggagaatactttctctccatttgattccccatggagacacaattaataccatcaccatcacctaatgggagaattctccacgggggaccggggaccggggaccgggtacccattgccatctctacttgcatgtaactacagtgtaacttgtatgtaagtttcacgtaattttaaattattagatctattataaagatttgttttggtgagaaagaaaaaaaatcacagtacacacatatctgaaaaaaaattgttcccacaacctttattttaccaaaataatatattatggagagatttttgaaagttacatacaagttatattatagttacagtgtaattacatgcaagttacagtgtaattacattacggttgtactgtaattacatctgtcaaatttttaggggaaaatttatcgacaaatatatagcaaaattgacgtagaattatatggctaaatgacacgtaagtgcactatgaaagccccaaggtagggtcatgagcatgcaggcccacaaacgactcaaccttggtgcacacggagtataactgaacgtaattgctatacatttgtcgaaagattttttgggtgtggatttgtcgtttttcctgccgttggattagcttttgcgattcgtgcggatggatggatagtcttgcttgtggtcaacgtgggccccaccttttgtttttttctcaaattttggattccgcgcctgtccttacctgctttttctctctctcattctttcccctcttctcgtttcttctcggtttctctggcgagagagagaacgagagaactcgccgacgatttcgttgtcgcggtgagatttcttcatttttcttcggtgaaattgatctctcttgcttgtagatttaggtggaggtggaggtctctctctcattctttcccctcttctcgttttttctcagtttctccggcgagagagagggagagctcgtcgacgattttgtcgttgcgttgagatttcttcatttttctccggtgaaattgatctctcttgcttgtagatttaggtggaggtggaggtttcttaaatcgttggcttgtgtgtgtaatttttttggtttttggttcataggttgctcttttgctgttgatttttctgttgtttctgaagtgttcgaactagatctcttacattttgtttgttctcgtttgggatttttggtgtatggatgtgtttgttgatccgattcggtgtagttgttctctcgtcaagcatgagctctttttgaaacctattttgattgagttttctcttggtggtcttcgaatctgttaggaagttaggtattatgtgatgttcgtgaactagatctgtgtgaagtagatctcggtagttttctctcgttagattagcaagttagtgtatatatgtgagctatttgaacaaaatttggtgtgcttgtgttttattatgctttagatctggggatgtttgtgaggtgttcgaattagttgcagttgtgtactgttcagggtagtattttgatggctggcgcgcatgtgttctattatgctttagatcttgggatgtttgtgaggtgttcgaattagttgtagttgtgtacttttcagggtagtattgatggcttgtgaggtagaattgataacttgacagctagttagtttctaaaattttgtgatgtctgaacttagtttgttgtatttttgtttttgttattattattactgtaattatttttgaattttgtatattgtagtagattaaactttttacagatttttagttgtaagcatgattctactttccatgtcccttggatagttgtaagcatttcctaattttttacttccaagttattcttgtgtaattgacagctactagtgcttcaaaatctactgattgttgtttgtcagtttttttttaattcctatcaactgtaccctgttttcttcatcttcattaacttgctgtgcctgttgattccattcagcttgttgttatgttatttttctgccaccttctccttggtatagcttgtgtgcagctgctatacttctttagtgaaatcttctgcttgttcttttgtttccatcagctgtgtcatgttgttggagtcttgtttccttgtgcactctccatgataaagcatctttagctgtgcactcctatttttttttgtttttcttctaattatagttgtaaagccaagttcatggtctgcatgatttgcctttttcattgttgtttgtcttattaagaaagtgatttagatatttgttttatattttttgtttagatggctcctgctgctaagagaaatttgggtaaagcacctattgtagatgattctgatgaatctgattgtgtaagttatagtcttttattaatgttttttttatgaaatactatgttatatgaatttagtttgtagtttactaatatctatttcgaaatatatgaattataggatggagagctttctcgtcgtgaacttgatgatattatatatgaaatttttagaaaggaggtagtattactttcttgactgtatttataatttgttattgttttttatttttttaatgtatattttttctatttttattataggttgttaaagatgttaagaaagaaatattgaatcgaaaatcttgttctcatgcttttcgttatgcgaaggtatgttgttatttactaagttcttttactgttatttttatatttgtaagtacattcctgaattttataggcagtaatttatttttctgatttaggtgaactacacatttgattttaatttttatattgcttgttgttatgtaagttacccatttcttttcctacatatgttctattttattgtactttagatattttttctgtttacttgtctcagattgtcttaagatcttgcatttgtttagaaattgttctttacttagagtttaagcagtattgttcttctactttacttagtgtttatttttttctactgttttctttcaattttgttttctgatgattctctatttagtagttgtttgtttacttgtctaagagcaccaatagtgaagaaactcttctcaccatcatatgcgaaatttttttttgcctgatcacttgaattagtttgctcacttgaaaagagctttttcattattgttgctcttccacaacatgaacattggtacctgttttatgttcgctgcgtattgcaaatggtttgccaatacacataataggtatatatcttacattttgttgtgctttacatatttgttctgtttacttttgtattatatatctattttttatttattttgcaatttttttgttatttaataaggataataagctaaaggaggctgcaaagattgattcatcatttacaaggttttccaccaagtatttctgtcgagttatatctgcactttctccacatcagaaaactattattcagggtgctggttttcagaatttgcttgagttcaacagcaattatgttccaaataaatttgctacttggattgcaaaacatgtggattttaagacctcacaaataattttaagagacaaagtaatttcagttacaaagcagactgtttgtgacatttttggtttaccttctggtggcttggagtttggaaaggattttgaagctggaaaggaatacattctttcgatgtatgggcttagttgtttgccttcagtgaggttctttggagaccagttcattaaaaaggaacctttgacaaatgagaaagtgattacttcatttcttattgttgctttggcttgttttctttgcccgaattcttctatattgccaagcaccaagtacctcaccatttttcaagatgttaataatctgaggaattatgattggtccaaattcatatatgattggtcaatgaactacatgaagaagtttgtgaagactaacagcttgggaggatgtttgtacatgtgggctgtaagtatttgacatatttgttatttttaatttttttctcttttcagtattaacttattattaatttgttctttttatatttttttggtaggtggtgtaccttgacaatgttgaatttggtgataacaatgtttcaaatgaaattccacgtatttgtgtttggaaaagtgacatgatccatgcttattctgagtttgataaaattgatgatgacacttttggtcttaggcctctaagggattttaaatctacttgctatttccaggttaatactatttttaaaaataaaaatgaatttctttattatttttccttataatgcatattgtattaatgttcttttttttcattgtagcctcaaccttgtgatgaaagaaggatttcttttcagcagaaacttgactgtgctcttcagaatatgttgccagtttacatgaaagagaaaatatgttctatgtttgatagtcattgcacttcacttcatactattgatgattcatcttgtggagatcttttgatttctgttcttgctatgattggtgaagctagctgtaatgaatcagatcaaaatgttgtaattgaggaaaatgtaattgagaatgttggcacttctaaagctgatgatgacattggtatttcttctgctggtattagtgctcgtaagtcatatttttataatacttttggtgttttgagtttttcctcttgctgtttctatttttttattttgtattcagtttattttgttaatgcgttcgttttatatgcagaagttcatgtgcctaatgataatgtgttacctcattctcctattcataatgcttttcatgtaagttttttttgtcatatattgcataatttatttgcaagttttatttatattatttgttttttgagttcttgaattgaaaattttatagggaaatgaagatgcttttgtttctaaatctgctgttgaacttaatgattcaagacaatgtgatgatggtaattttgtaccaaatttgttatgttaaattatactgttaattgttttaatcatgcattaatatttttttaatttcttcctgttagatctgaattttgttacccctcaagttggtaatgctaatcattccaaacagtctgttgatgatcttttggatggtcagttaccttaagctttttttcttttcggttactgatttttttacttgtgaaaagttttttcaaatttatctgtttcaacttattcacttcggaatgttttctcaaatttagctttctataaatttttgtaggttctggaattgctgctgcagctgctgctattcatcgtgttgcaaaaaaatttagatcaagatttaatgattatgggaatgtggaaaatatctttaatcagtcaaggcccttatttagtttgctagattctgaagatgatgttagtgattatgaacatgttttctcagttcagaatgaagatgaaggctctgaaaatgtttccccttcttcaacccaagtaagaatttttatgttctttttttgcattgtactgttttgtgaagcaagttttatataaacatatatgttttcaggcagcatttgtattttcattggatatttttacattatttaatctttcttctctgttatatttgaaattgcagccttttatttcttttcaatcactccctgaaactccagacaatgatacttgcaacactgtcattaatgaaaaccctggaactagtgcagcacataattctcagaattcgaacaagaggctttttaaagatgttacagtaagttatacttttttttaatgttcttacttatgtttctcgtaacttcaaaattttctttattatgttttttgatctgatttttttttcaatttttcatttctttcacagaattctcctgatgttgtttgtttgggtgaaaataaaatttgtgattcatcaaaaagaatgtgtgttaaagctgaacagttatataattcaacaaatcaactgaacaagtacattcgtggaatgagttcttctggcggaaagcttcctatacatggtccaagaagggttttagttcctgctaggcatgcttctgatccttttgtcttttctccaaggcgtcgttttacagtttctgatcaagagaatagatattatattgcaatttgtcgtctttcagatagttcaaagtggcagaggtactaaatggctaatcttttaactgtttatttttatttgatttgattttagctttttatgctttatattttatttttgtagttactatgcagttgatattgacaatgtcaaagcaaagttctacagttttggtcattccctcaagaagaattgtattgtgtcaccttatgtcatttcagtcttctgccgtgttttgtttcaagatagtcatccatcaaagtctaaaagaaactacttttttctatcaattggtgtaagtatatatttttatatcttcagttttattttttttgccaaaatattatgcatatgttgattagctgtattgcatttgataggctgaattgattaatgatataagtgataaaggactggaaaaggttaagaagtcattcgaaggagctaccaatgctagaaaattgcatctttgtgacatggtattttgttagtagtattttttttcctcttattatttcaaccatcttttttttacttatatgtacttttgtcatatgtatttttgcagttatattttcctattctacatcttcagcattggtttctattcattgtggatttaaaggatagaatgcttgtcatactagattgtgtatatcatgaaggagatgatttctatgaacctattatgactcaattggtaagttgcacttttatgattttagttttattattttgatttgcatttttttattttatatttaattgttattttgatctgttttattttcagataaataatctccagactttttgggacaaatttgaatgctctccaatgaattttagcaatttcaaattgaagtttccatctgttctagcccatatttctaggttagcttattttattttctctgatttgtttgtagttttttgttctgttttgatgttagcttatttttttcttttttgtttcatagtgcggattctgggatttttgttatgaaaagcatggaattgtggtctccaagagttattctgcaaaatgaattctcaaatgacaatatcagtaacattcgagttcagtatgcaaatagaattttcttccatcctagcaacaagcttttaagtactgaagttgaagatgtagttctcaattggtttgaccctgtaagttaaagttttctatcttctatatatttttttcattttaattaataattttctttgtaggctaagtttccacgtgttgatactcctggtgctgcttgataattgtttcagtctaaaagctatttggtttgaccttgtaagttaagttttaatacctgttctatattttatttactttgttttgttttgacttttttaaaaaaatttcctttgtaggtaaagtttcttcacgttgatcgtactgctgctgctttgaccagtgtttcagtatacatttcacagtttttcttgaaatgagttgtgtgacaaaaatttgtatgacgaggatatttgttctactggcagtacattagatacatataatgtagcactctagcagtatattacatacttgtaatgtagtatgagaaaaacaattatacaacatttgtagtgtttacagtctgaatgctattacatagaagaaagatctcttttttttttcttccattactgatggtattcaatttgtcctttcatttccaatgtctttggtcagcttgtctttgcatgcaacttctctttaggagtttcctcttgagtattgtttttctttcctgcaaaaaagaagtatgcattaggttttcattatatatagtttcatttttgtatatgtattataattgatttgtttattacttctttttgtagtttttgatgttttcatctcttcttgcttgttccctatattggttatctcacttgttcctgcaaaaaaaacttgttatttctacaatttatagttatatgtggattcttgatcttgctacacttacttgtttctgttgtgtgttgctcatctttacttttcctttttgaagtttctatcatcttctccactattcttctatatctttttggttttcttcctttagtattggccaaatctgggtcttctatttccacttcttctattatctcttcttctgcatgctgcacagtatcattttgtactgtgttgctttcatcttgtgacaggtgtgtttcggcctcctgttcaatcatcaattgcacattcatttctaatttctcaagttcctccatcatgaactgatatgttctttttctttttgatgcttttgatgctatgtcagcacctttccttgatagaacattaaacatcagaacagagttgtctgttgcatctgtatgtatgctgcctttcactttctccttcttttctttttttctccatctatcaataatgtatttttctggaatttttctcacattgagttccaacatcactttcaggatatgtgaacatagcattccatccttagagaacttcccacaaatgcaaccgaagttttcatttggtaagtcaatgatcactatatgtttcctttgtctatattcttgctggatgctattaggtgacacaaacacttcatacactttgccctgttgtatcacagatacttgcaaccttaaagtatcctttaattcattttggaattttctgaatatgtctagattatatagttccgatgcctgctcttcaatgagatagttgaaccatagtgtttttggcatttttgtccttgattggaaatctttgctgtactcagtatcaaagatagtatcatttatgttctcatattccttcataaaactcatcacactgtgttgtggtccaactcctcttttgaatctgctatttgttccctcactcagcgctgtgctttgtataaaagggcagaaatcatatttgaagtagacaggcacaaactgagctctattcttccacattagttgcaagtattttatattttgcaaactgaacttttcaatcatctgaggccaaagcacttcaaattcttcttctgttaggcaattgtttagtatgtcatcatattcctcatacaggtttctatttgcttttgcagagaacatgcttcctatcttttctctgcaatttttcttgatgtgaaatagacagtttctgtgctttgtgttttgaaaaacctgtgcaattgctgatctcatggcattatcttgatctgtaattatagtcttgggatgtttccctcccattgctgttataaatgtttcaaaaacccacttgaatgtctctgccgtttcatctcctaaaaatgcacaaccaaacaagcaagttgacccatgtcctgtaacaccaacaaacggtgcaaatggcatattgtatctgtttgttctatacgttgtgtcaaaactgatacagtcaccatattcctcatatagctgagtcgatctaccatcagtccaaaacatgcttgtcaccttgttttcttcatctagcttgaatttgtagtacattccagggtcatcttgttcctttttcttgagataattcaacacttgcttcatgtcattgtttcttgtctctgaatttattgctgtcccaacattacttacatccttcttggtgtagggtagtgctgccaagccacctcggagaaatgataatatcacaatcatgctcctagttggtatgttgcactcttttaatgtccttattagtctcttttcttcctctgtcatatccttatgagacctcagaaatttagcttctcttcttgggcaaagtgcatggttatgattcagatcaagccttgatatttgccaaaactgtccaacttcttttgctaccattgtacatttgcaatttgttttgactaggactactgtttccctctgctgttcagtaacttgttcattgctcttcttcttgtttgctggttcatttttgccttgcaagttgcatttgtatgtgtactttgtaatttcaccttgtcttttcttgcttgttgtcttgtagtggtgcgcaatcacaacagaaaaaccggctaggtatgcatagaagttgaagaagcctctagcttctgtatgtgatttgaacttcattcctagcttaggtatgtgtttatcatctattggtaaactgctctcctcttcattttgtaagaaattgtcaatgtcttcctcacttaattcctccccgttgttagtagctgaatttaaattatcattcatttcagcctctgtttgctgctgttgtatccctgaaatttctgttgcttcaggtcttgtttgttgctcttcaatatcttgctcatgaaagttttcattgtatggctgaaaacaaggattaatagtagtaaatcaaatttttttgcaaagctaatttacaattctagttaaagaaaacagaaataactttggaatcttcttagtgatctatatgtttattttttacaaacctaatcactttcaaagtcctcttgatctctgttctgagtggcccagcttgtaggaattccctgcagatatctcttacaataaatttttgatatgtagcctatatcattttaacatgattaaattattaattaatgaaagtacctgtgatttcaaatgtgtgttttgtaatttgtacaattcctccatagttttgtcaactggaatctgtatattttgatgaaatgttagcatactactcatacaaatttaaaaatgattataatttatttttgtaattgcaatttttacctctggtgtgatccttgcactgttgtagatttcatcaaattcttggtaactgtaatgtttgcttgggattaataggtcattgtttctgtcttccagcagcatgtcttgttcacaaactctgctcgtagttagtatcattgaattctgcagtgtggaaattttaaaaaatattacatacaattaacaagagtatttctgcaaaatcgattagtagctgtgtatataaattaagtttaaaataaacttacattatatgctgatggtgtttgaagcatacttgtgaaactttctagtcctcttcctccctgcatcatttttatattttgttagtgaagcatatgctgttgtacaataatattaatattacgaatctatatccttaccatatttggttctatgttaatccttggactatttattacttggtgcattagacttgtgtacgacaactgtgctacctgcatttcaatttgttagtatcaaataaagtgttgtgacatgcatttttctatgttacttgtttattcaaattaccggtgtagtatgtgacttaagcatggttaactcatcatgtagtaatgctgggctttgtggcgattgggttgtgccgattcctgtgaattgaaaagcatgatggatcagctagttgaattttcaaattgaattcatttggcgtaaattacatatggttaaagagtatcatttttttctgacctgtaatttgtgtgatactagaacttgtttcttcagtatgctttgtatctattttgtttctctctgattcttttaaacttctttctccatcttgtagttgatgaatatttgtacctgcaagaagtgtcaattttattggtaagtttgatatgtttcttttcttttttgtacaagtattggcatgtcagatttttatgatctagcacagtggatttgtatgtttactaacctgactgtattgttttgttgttaccctctttgcttccttgggttatactcttgctattctcatttggttcagcatatggcattatccttattcctacaaaatataacacaaaatagtgataccataataattcatgtttatacagatcatctaagaataatactaagttacataacaaattaaatgtatgtatatatgtaatttttgcttctgattcactgtacaaatcctggtgttttaattattttgatgcttgcttaatgcttgttaagtctattttctgctttatgcttatatctcatacctgcattttgtttcatatggttttgtttatttccctgtgtctcgaagctaactttctgtttatgttctgaaattgagttcaattctgcacaaaagaaaatcaaacagttaaatgaaagaatcctagaatatatgaagttatactctaattatattgcaaatcaactatacttacatgtgtaactttagttatttgtacatgtaaatatagatgaaatttaatttgaatgacacaaattttccatgttttatgagtattaaaaattatataagatcatgcatatttatatattttttttgctattttgcatcttggtctcgaatagtctacttttttttttaccttttttctccaggggtccaatgcgaactggttcggtaaatttcattcctgcaaaattcatagaataaattagtatatttgactgctgaaaccatcttacaagaatgctaagtagtagatatttattttcaaagcatatgcagcaaaattaaaatgaacttatatgcaagacaaattgtttttataaatgttaatttatctaattactaatgtaatttatcaaatatatgaagtgatgtaaatctgaaactttattgggtttcgatatagttatatagtcaagtataactgaaatcaagttagttacaatatgatttgactgtttttacactgcagttacatgtcagtataactaaagttacaactgtaacttcacatatttcataatgtaactttctatagttctttttatactgctgtttttcttgcaaaatttgccaaagttttgcttgttagtgttggatgtgtgtaatacctatgaactatactagaaatggacaaatatatttgctgtgtgcctttatggtggacattttgtattaatttcatgaatgattcttgctacttaacataaattggatttggagagaatgcttaatgtaggtgtttattttatatctgattgcatatttatttgttaattagagatatttttcatatttatctgatggcaaggactgtaactttatattatcagatttatttcatgtcatattttttctctgaattttctgactttttgcggattggcagtgtgcttgccatgtcctgtttactattttattgtttctccctgttctttccagtgaagttgctgcttgtttggaatgatatcctagagccattgagtgattaactcattgcatgtagctttattaactcattgatagctaactttgacctttaattgctgcacaaattccacttgactgattaactcattgcttgtagctttattacaaaattggttttttattttggacttctgatttggcatttgttacatatgttttcaaaagtggttaatttgcactgctgattattctacgtgcacatttgctgattgtgactgtcttgttctattgcaatactccagttggactagcatgtcaatccctcatatttgtccaactgatcccatgtgcatattaaattgaaatgtacatttttagtgatcaagtatttttgtttaaagaagtttgtccaacttgttttaatgtggtttgttgtatagtcagtggttaatgaaatgatattatctaatggagttcatgatctgatcagatttatatcttcagatgatatgtcagtttctaaacattattgtatatgaagtttttgaatgttggtttttttttaccaaattgatgtttttgttctctgaaaaattagtgttagctttcatttcatttgtatggcgctacaaatagatttgtatgaagttacaggataaaataatggaaattacagttgtagttacattggaaatatatatgaattacaaatgtaattttaggtctgtggtgatgtaagttgttcttcaagtcaagtataattaaagtcaagttagttacaatatgatttgactgtttttacactgcagttacatgtcagtataactgaagttacaattgtaacttcacatatttcataatgtaactttctatagttctttttatactactgtttttcttgcaaaaatttccaaagttttgcttcttagtgttgcatgtgtgcactagctatgaactgtactagaaatgggcaaatatatttgctgtgtgcctttatggtggacctttttgtagtaatttcatgaatgattcttgctacttaacagaaattggatttggagagaatgcttattgtaggaatatgtgataacttagtgtgttttttttatatatggcatgtgcattttgtatggcaatagatttgtatgaagttgcaggataaaacaatggaaattacagttgtagttacattggaaatatatatgaattacaaatgtaatttaaggtctgtggtgatgtaagttttgatattgttccaattgttcttcaagtcaagtataactgaagtcaagttagttacattatgatttgactgtttttacactgcagttacatgtcagtataactgaagttacatctgtaactttacatatttcataatgtaactttttataattctttttatactgttgtttttcttgcaaaaatttgcaaagttctgcttcttagtgttgcatgtgtgcactagctatgaactgtactagaaatgtgtaaatatattgttgtgtgcttgtatggtgcaaatttttcagttcaacatgtgtatgtacagtgtaattttctgtatttactatatgattgtttcttgttaattaactgaccttgtttggatcttgatgttttgattttttcttcagatttgatcttggattttggttcttcttcttctcttttcttctttgcctttttcttttcgctctccatgtctatcttcttcgatctgactttggatctgttttggatgggagaagcgttgattcgctggatgtgtgctttgatcacgtgatgtatgtgctgtccttttctccagctttcttgattgccaagttgattgattttgggctataatcataaaattatttgttgtgtttttggcccaatatgattttatcggcccattattatatttacacgttgcaattttggcccaatttaggccttttattttttttctatttgtttccttctttatttttgctgccgttggatgctaatccaagggatcagaaatctgacaaatttggggcctgaaaatttgtcgaatgatgtgtagagagaccctaactgaaataaaaataggacggagatgttgtaagttgtaaccgaacgcaacaaataccatatcaaatttacagcccaatgggctaaaagtgcataagacaacggcctcctatatgaccacacaagctagatatagatagatgacggcaattcgacatggcaacatgtaccagcagttgaacatagtcgaaccctccagcccatgaatgccactactatagtctatagtagctcactcatcgccatcgtcggaccaggtgatgtgctccatcccgacgctcttgtcgaggccgagggcgtcccacaccgccggcgacgcgtccacgatgttgttgtcgcacggcggctcgtagttgtgctcgccgtcgcaaccgtgcacggagtcgcactcgtccaccactttgccaccaccgacctcccgctgccgccgctcgccgtgatcctgacccggtgcccgcaccgcgccatgccggcgaaccaccccgtcgacagcactccgcgggcccgccgccgtccttccccttctcgaagctgttcagcgtcagcacggcgccggcggccgccgtcaccggcggggagcaccggtactgcgggtacgccttgccgtcctcgcagcagtccgggtcgttgctctttcgcagttg

SEQ ID NO: 80197 - DNA, 14918 bp, Oryza sativa
cctgcagccctatgcattgtacctcagatttgttgatggtgatcacatgcccggtgtaaggtagctgctgcatatccaagcaagatgtgtagaacagtacactgcttgctgatgctgactgttcatcacacatgatcaaatagagaagagtcagtcattgacaatggcatcaaattgtctctcctagtatctggctatccatccaaccggaataccagataagggacgcaccatgtatgccatgatacagtcttcacaaacatttgcaatggagaaggccattggtagcagctgatcttggagctaggttgatcatgaatgtatcagcagctagcattcaccagtgtatacatgtgtggccaatcatgcagcaagaattattgtagggacttgtcccttgtcgccggcaaggctcaccggcatgcagctttgtcgcggaagccgaggagcggtgacaaggcgctacacgtcgcggcccctgcttagctggcagcatcacctcggcccctgcaagggaggtgaagctcaaggctgctgccagccagccattgctgtccctgaggacagcaccagcaccaccatgttagcaccctctctcagcttcagtggtggggaatccacctgactccagtgtgtagacaacctacaaaatgacacaggggtgagcactatgcagatgcagataatgcatgcatacattgcttacccagtggctggatgcatttgcattgccatttctgcaaattgcccagaggggggagcaacactcagatcttgcagcccatcatggagcagcagatgtccagccaacagatgaaaacattcaacaaggaaccatgcagtatcatctaaagcagtagtgccaaacaacaacgtggtgtatatggtaagccacagtgctctagtctgctgtgaaatgtagtatatgggggagaaaagattccttcagacactgtaactgaatcacaaccagattgttgctcacatttacatatctcaatggtacaatccatgagtcatgcacaatggcagtgtgttgtgtttgtggactcaatctcagatacagagaggcatatgaactgtgtatgacaatgctcggagagtttgcgcaatacgattacttctttgaaactgttacagttcaagcgctagaagcgcctcttctcaaaacagaactttgtatgaggagctatttctcacctatctcattctagtgcaaacaactacttgctggattacatgtgtatttatactactttttggttgatctcatttgtgatttcttggaagacccagaggcggttctgaggcctccatggtctcgcattcttaggccaacgattggtggcctcaaagtgactggaaccttgaaaatgttcattgtcaccaaatggcacataaccatgtccatatctttcacacttggatttccagtcaggaaaaagcgaacgctgagctgtgctgcttctccaaggtggttgctctgtgccttcagctctatcactgagatggcttgtgtcgagcctttgggagactcggttactgtaatcttgcaccttctgctgtctccattgtggagcagtcctgacaaacttcatgttcacgttctcatctgtggatattttggagtcactgtgtctccatgaatccgctgaagaactctgtgggtgatcatccacgcttgatctttttaaggcgctgctttcttgagagaatgagggtgttctatacatctcctcatttgcatgcttgcagcttacatttcgcttagtagtgtccataccgatcgttgagctgacatcacccaattgacgttcatcttcttccaccatatcagcccatgtttttctaacaccattgacaagagcctttccctctggcctagtattctcaccagcatctgtggagccaccagagtttggcaagcattcaacaaaactaggaatctgaacttggtgctgtatgctgatatttagtgtgtcctctttcaccagccgttttcgtagtttctcaagcaacgactggggtgtagcagcatcattgaacagtcgagaaagatcttggtattcattcaggcatttctcattattctccccactggtagcaatcaaactttctggttcttcacgtttcatctgagtaatgggagatggaaatacttgtgaattgcaatcctcctgcttctctgcatcagcagcaactgaaatatgtggttcttcagatttcagttgagtcaaagcagttgaggatacctgtggctgtaaatgcccaaggttctccgcatcaatagcaagccagattaatgattctttagatttcatctgagttatgggagaatggagtgttggtgactcaagttccataagcatttctctggcccgagcaagagacctcacatggctttcatcactgcagttgtcaggtatagattggagaaggtatttagcttcggctacctttccggtctttatcaggcagatagctaagttgcactctttgttataatcagcttctatagcaagagcttgcctgtgtcaaatgacatacggctagtcagtagtcagtaccagctggattagttgaataacgtaaaccagatatcactcctactagtatcagcattcattagagctgattgttgcttgcagtttcaataaatggtttttattatataattacttctaggattcataagtgctgactgctgagtatagtcatttcaagcccacctagatgattttaactgtgcggccacatgttttgttttcctttttgaatgaaaagggtatgagctctgcctatacatgttttgttttcagttttcacactatggaactattgaaggaatatagtagcgcctattttttcctcttaattttctcaaatgaacaccaaatgtgagcatttctaataaactagaaatcaggataaataaatactgccactttgggagatacaagccatctgatgttgatgaaaactggactcaaaagtatacctgtagagcatttcggcctcatcataattttcagactgcatatgggcccaggcaaggttacccaacaaccttcaagacaaataagagcatcagaatgatgtttactggttgaatagcaatgtacgaaagattttaaataccttgctttttcatccctgagagacaaataaactactcttccatgagatttagacaacttggttttccacctgccagaagctagctcctcatcaacaattctcaacttcaatgtcagcatttcaatctgctcttttgtcctgccgcatttctggttttacataaaaatgactagtatcagaacagaaatggtcgcatcttcatctaaaattaacatgtcatcagtgcagcaatttagatgtctttaggatctactgctataggcctaccaaatcacagaattactttacaacagaaagatttagcttgtaggttcttggtttacaggccaagataccttgtacaggtcaagaagaatattgtcaagagattcctgagcttcatttgggcaacgatcacggaaggatcttattgcctcaatagcctcttcggctcgatttgcttgcttcagtacagtagccatatccttcagtgcgctctcaattcgatcaccactgtttatagccgcccagaacaatggaactgccttgtttgggtccttttcaatcacctgcagaaaacaagacaagaaaacaaaaacctcagatctagcttatgaaaatttctagattcaggttattacatgcatttttgttcacaaaactgaaagagctgtagaaaaagaaacgctgtcactttgcaaaaaagcaagtaacatgtactgaatgatttagcatgaatatgttgaagcaacaattaagggaaaaattagtacccactacagttactagttagaatagcatgcgttagtggcaacacaccatcaaaacttgcccaggtggtgtggctggtgtctattcaatcttttttgagatggtctatcagtcttttagtataatagatttctggtaacaagggagcctagtcatgagaacacaatttctatatcgctttacgattttactctaatactggttttgttaaagaaacatagaagtagttttatctatatcatggaaattaccttcatattctctcttctggttcaattaaaagtgttttttttttttgtgggttgaggggggacagagaagcagagcttcccctttccattactggaaacaaattcagattacagagttctagaaagcagaaactatgaaaaaaagctaatcagcaagaaaagcttcacaccaaaacgatgccatcccattgctttttgtgaagtttttgcccccaggatatcctaaattcaattcaaacatatcatgaaacaatggaaaatactgtaactaaaacaaccacaaaatgcttttgcccttccttctccctcacaaactactcattattgaaattaatatagtacacacagtcaccatattgagcatacttcagcaacctaatttgcaacctctctccagagtaaacgaaattgcatcgcacatgatggtttccgaattccaattacctgagcctgcttcgcccgcacgtagggcgaatccaccgacgacagcggcgccctaggaggccgggaacacccgccgctcgtcggcggcgtgacacggtaaccgtaacacccgccaccaccgctcgccgggggcgtcacgtgcgaggagcacccgccgctcgccggcggcgtggcgtgggcggcgcggcccgaaccgtccgcgcccgcaggcgtgcaggggctccacctcggcgccgcccccctcggcgacgtccacggcggcagccgcctccctccgctcggcattgcggaattccgtcgaacacctggcgcgcagacaccaaaatccccccatcaaaatccatccaccaaaacaaccagatcaaacacaaccaaattaaccaccgcatgcaaaagcgtcccccaacctcgatcgagaagtcgagaacccgccgccttcgccgccgcgccgtgctcgggctcgacgcggatcacgccgccgcggagttgaaagcgagtggagggagacgcgaggacgaagcggcggcgcgttatatatatacccccgcgcgcgcgcggggaaggggatttcaaacggcgctgacgtggacgggggaggtggggcccacggatgcgtacgtggacgtcgcgtcacgggtttccgatgagacggcagcagtaagtgcagctcatgcggctcctgtgaattgtgatgcgagattgcgtgaaccacgcatacaatgtgctcttcctggcttattattgaataactttagtgtgaattttgtgtgtgaaaaaccataaaaatggaactgaatttaccctacttaacttactgcgtgcattttcaaattcgaatttgtttttgtttgaatttgctgtgtacatggtgactgatttgggtgataaaaaggctgacagatgaggcacgatgaaaagaatctgcttttctgttatctaaaaatatactgtggctgtagcttctgttaaaacaaaggctgtttttttggataacaggtagcgctcggcctctgcatccgaaggtagatgcacaccgccaaacaaaatgcaaaggctgggtttaatatccattatctaacaaaaaatctgaaaatatatggttgactaattacattttggggtcgttatgtcatgatgagaaattgagaatcacatattcattagtcatgatgtagatgaatcatctattgctggcatcaggttgcaaaaatgagcatcagctttagctaggggtgaaaatgggtggatactgtcggattatggcatttccatatcctaacccatattttcctttaaattcggagtcggatacgggtagtgccggataagatattactcatcccgtatcttattccatattattttcttcgaattggatttggaaacggacatctatttgtatctctaattatagatattaaatataaaaaggtgattaaagtattaaatgagatacatcaagagaaaaattatacaatattacatgtgagctcgtaaaataatgattaaccattttttatcatgtttgtaggtggatttataatagattttcatacatattttataatatgggacatatgggcggatacatgacttcctgtatccttatccatattttctaacgaattcggattcgaactcggatagtatcgggtatcccattttttgtcccatatttctcccatgagcctcgggtcgggtgggcggtcgggaaatacccgccccattttcaccgctagctttagctgatgaaataatcggatacttgaactcaaattcagtaaataacaagtaggatagcattctgcctgtaaaaatgaaaaagagagaccaaaattgggatattgctgtgatgtgcatgtaccaccagctgaagatgaagaacataatgtgcttttttgtgctgccatggtcactaacaatagcctaagactataaattgctgtgtagtttcatgcttgctaatatctcagcctttaactgttctcttctaattttccctgttgttgtcactggaaatggtttactccactgataatatatccttggcaccttgaatctgtttcagaaaaaaaaaatagtggagtactgatcatttgataagtaaggtaaaaagaaaaaagaactactacctgattacctagagagggtcatttaattctaagattttagagctgagtccatttaaagtttttccatcatgatatcagtggattagctaacactgtactagctgaaaaaattcagttgtaaaagataacatttgcttgttagttgctgcatcattgatccaaagaatcagtggcacaggtagattttctgaatatagtgacacctgatagagcatcaggaagcaaactttccgtcttatctctcatttatttccattgtttaaggactgatctgaaacagttgataatttgactaatgaaacgctatgttgagacagaatacctgctcaatttgtttgtacggcaatggtcttgaagcatctgtgcagagacttctctgccttcccccttgtgcacagctcttgcatcaacccagttccagccatccctgatgctaacacaggcaacaattttctccccgagacgactatccggcatgccaatcaccacggctttagctagacctgggtgctgagacagtacagattctacctgaaaattttgagatgaaaatcacctaaacatggtttcacatttctacatatgcataagcataatgtcaccctatgaacattgcactacagcactaatagtagaatcagtacctcctctgggtacacattttcacctccagttttgattcttcccttttgtcgccccatgacccacagattaccagttttatccacccatccaatgtcgccggtgtcgagccatccattcctgacagaatctgatgtgtctatgctgttgttcacccagtatccggacatcgtatgtaagcctcttgtcaagatattcccaattggtgaagaagaactactgttacttccatttctgttgatctgtatctcaatatgaggcgctggtttgccaacacacacaccttcagaagagctgcctaactggtccttaggttcttgaatttttggcctggtgagaaccatgaatgtcagagatgaacaggcctcagtcatccctgatgaaaattttaagccagttagtgaactttgcagtaggtagccaataacatgattcagagctcatagtaacagtaacagtgatgtctcagttcagttttttgagatatgttacaacttgcaagaatcaaaatgactcctaatggtacctaactttagggaatttttgcaggaaaaatgaacttgaaatcagtggtaagtagttataccataagctgagaagatagtggcattaggaaataagtgagaagctccagttatcaattcactcgacaacccgccaccgccattgagaatctttgtcacggtcatcccgtggttcaatatcttctgtttcctgatgtaccaaaacttttaatcagtcaccaacaaattgttcattcctaggcttccagaatcatattgtatcgccgttgtcataccgagcataggatagtaggtcagccatgattgcaggaacagtgatgaacgaagtcactctgtgttctaggatggcgtcgaaagccgatttcacgtcaaatttaggtatcaggacatgacagcctccagccatcaggattgccaagcatgaagagatccctccaatatggcacaaaggagctgtatgcaggtagatctgcaggccagacaaatgtatgatgaaattccatttatatcacatctagatggttgctaaggaaaataatgtcaacattaagtgaactatatattcaagaaaatcatgtgacaatatttggatcctgaaagcatacatcatcctcaccatagccaacaatggcaatttttgcaagggattgaatgatcaaagatgtatggcttatcgctacaccctttggtcgtcccgtagtgcctaaatccaaatagcttatggttatttagaatcaaactgatcccaattcaacctgtctataacatgcataaaaggccgcagactgaaattccccaaagtgcagataattcagtgcagaatgagggaagaatcagctcagtgccaggaagagcaatcgcttaccagatgtgaagcatatcagagcaacatcatttggagcagacacaggctctactgctctagtagttcctcctgagctcctcttgatctgctcaactgatacaactgatacaactgaaacaaattttcatgtgtaaatacgagttgcactgagccataattcacagggcaacaatattctcatataaatatacccagcttgttcacaataataaaataacaatctgaagaacttacagtttgcagcttggctgatgctgcagagattccccaggaagaggtaaagattaaccgatgtcaagctgttgctctccttcagccgaagcgcccatgagctgtagctgccatcgaagatgaacactgttggctgcacaagctccagtgcctgtgaggcctcctcaaagctctgaccacccacatggaagatgacacagttcaatgttcagtataaagtatcaacacaggctagaacagcacatggaaattcagacaaaatgtttgaattgcagctcttttttttcccttgaatttgtgatacatgaggtgaaggaattgaattattacccagcggtagttgagaggagcgatgatccctccgatgtaagtgacggctaagaacagctcgatgtactcgatgctgcaaagcagaagggaagccatggatgaacacatgagtgcatcaatcagaagccacaattacgggtttcatttctcaaatcagagaggcaagctgaagagaatgcaaagctagctcccaagtcccaacctgttgaaggcgacgacggcgacgacgtgaccacggcggacgccgaggttggagagggcggcggccagcctacgcgccccgtcggcgaggccagcgccggtcaggcggcgattgccggagacggcgacggtgtctcggccggcgagggcgccgccgaggcagtgggcaatgtggccgcggccgtgctgctgcgacattgcgcatgcaacgcaacagcgtgagcgagcgaggaaggagaagtgtcaacgtgattgcgtgacatctgaatctttttttctttcgattcgagataagaagttcagagcagcagagatggttgtggtcaggataggaggccactgattgctacatatccagacagataacctattttatcgagatgtagaatctgaccatgtgactgacttaaggacttcttgcctggaaaaacctattttaccaagtagtagtattatctgaccaagtgactttagacttcttgccttgctgcaagaaaatagagctgaaatgtacagaaatttctgtgaaaattttgcagcaatttacagaaacatgggaaagttactttctgtgaaaatctgcataaattttccagtaacaagggcaaacttacggcggttaaacgcacggcattagttctttcttcatgatctgatcgctgcgcaattctaggatacatgcattcgaataaagaaaaagatgaaatgcacaggaggatgaagtcgataaccatcgcacaggcacaccaaaaacagcagggggatacgggcacaaccaaaatgcataattaacgataccattgttggatacattcttgtctagtagaaaattaatatgctaaagattaaaaacaaacttcgatgttcagaacttgaaacaaaactttcaactttgcagcgatatggcaagaggcttagtcgaagaggctcatgcccaggtcaccatcggactcctcctcgggctcttccttcttctcttcctccttggcagccgatggagcagcagcaccactgtcggcggcaactggggcagcaacagcgaacttgctggggtcctgagaaatataagccagataaatatgtaagaaaccatgatgcaaccgcttccaaagcagcattaacttattttctagtgtggtaaacagcattttgctaccatggatgaaccaataaaggcacaaacagcctaagtgaaatactccttgctaccataaaaattcaattgctcactagactatgtaataatgctcaacgactaaatcaattatgtagataagtaaaaatgaccagttcaccagctagctgcatgctgctaggcagccgctgcagcagcgctgcaccaagcagccaaacaagatgttaatgtaccgacatggacatgctacattttagtatggtaatctactatctattgattatcttagttagaccaattatcaagcattaagaaaacatcatcataaagtgaaatagaaacaagattactttcaaatactccttgatcttatcagcatgtgggtacgagtattcggtctccacagcaacagcaagcacattcttgtacccattgaggaacatgtgtggtgcagcagcaatagttgggtacgagattgccagggagactgaggcaaccatagaaacaccagaagcaaacttctccatcaggtcatcctcagtgaggtcaagcacctcagggctgaagactgacccactgtcatagacattggtaataaccagcccatatgagaaggggcggataccaagcttggcaagcagagcagactcggaggagcccaccttgtcacccttcttaatgagctccacaggggtgataatttccacagtacccttgttaatcttggtggggatgttaagcacctgtaacaagataggaacagtgagaacatgtagttgactacttgactaagcagacaagatagtatttattaacaaatcaacaaatgatcacctggaagaaagaggtctgggatggatccagaccagtgttgccagggggaaccaccacatcaacaggagcaacaagaccaacacgagcaggagctccaacctgttttataacaaaaacaaatcagggttattcattcatcagataacatcacaagtatgcactgagatttcgcaatgaaaagagaagcacaagtcaagcaacaagtcacactgtaaaaacataaattactggctatttaaagaaatctctaaattaaactccaatatgtagtgggatctacaacatgacattgcaatataaccaaagaacttgagacatacactaaaaggtgacgaggtcaaatattgtgatatcacatctaacataacacttaattccatacaaacagatcatctactttgcatatggataaacttaacatgcataagcctagcgataaattgagcatgacattgactataatgtcctaaagttgtacatgcttgcaaaaactagcaatactcatcaggcatcaaactgtcacaacctactaacaattgagattcttcccatgatcactgtaagataacacactaaaacatcaaccaatttcacttaaagaacaagttactattataaaaccaatgcaatatttcagagacaaatcgcattggaaaagttacatgatgatgaatatgtcctttaaaatctaacagaagatctagcatcatacaacaaaaatatcgacatagcatatggataaactgctccacagaaagtttcataataacactaatacagttacaaactagcaaacggatcaagcatcagatttgcaatttttttacataacacgctactaatatcttccacatataatcaactgcgagcgtgcaacccaatgaatcacattcaacaaaaactacagaatcaccacaatacaatctactatccatgcagtctagaacacagattgaatgccagttataccttgtacttggcaacctcctcgcggacctccttgaggtcacccttggtgaagatgaggccaacgtttccctacaaaaaaaaaacagcaagaacatcacatcgatttccagaaacacgcgtaggcaaaaacaaccgcaagaacacggtgagtcggacttacgacgaggaggggcatgagctcgaggaactccttgttgccggtgttgtcggcgtgcaccttgatgcagcggcggatgagggtgttcttccccatgaggacgatggagtcgcccctgaggcccttgcggatctcctgcagctggttggacccgacgttgtcggcgacggcgatgagcaccttggtgtactcgtcgagaagctggcagagcttcttgtcgtacgccaccttcttctccgccttggtcctcttgatcgccatcgctgcgagctacacaaaccctaaccctaggcttagatctgcgcgtggggagaggagacggcgaggaccaagctctcggcgaggaggagcaaggcggacggcttgcggcggcggcgtcgctttaacctagggtttccagggtggggggtgcgggtatttatagtgggagagggatgggtgtggcttcgggttggtgggcctgatgggcttggttttagggtttcgtggcggttgcggtctcaggagatgggccttattgggctctccggcgtatgggccttgccagagtctgcagagggcacggttgcccaaggaaccaaatttctttttcttttacttattggtagagtaattcggatcaggtggagttttatgaaatttaatctaattctggagataaattgtagataaaataaaacaagtcctggtataataataataaattaattaaaggactgtatgtaaaatatgtatgggtctttttatgggtcttacggatagtaacttacattgcggattgtggagagaatattttggctaaaacatagtaacaattttggtagaaaaccattggaaaaaaaaagggaggccaaaatccaaacggacaactctaccaaaattatggcaatgataactcttactgttgcaaaaataagataatgttaggattggcaaagaaccaaacgtgccgatttatctactgtcgacgcacagaagaaacaatccaatgagatgtgatccaaattccaacagatatgctaacaacactttggcaatttttactatgatgatgaaaatgtcaaaaacttagcaccagaaaatgaacaggtaacagctctttcactagattctcctcctgctggatggatggatggatgtaaaacactctaacaacaactcactaagttcgcagttacgacaccaacacggcaacacatctactgagctgatggcactcgattatcaagaattcagagaagaagaaaagtgaaaaggattggtagtgtgagtgatcagcggatcatcatcatcatgcttctatggacagcttcttcttgtgcctgctgagcttcagccgtggcgtggtgtcacccttcaccacggccatcttctcctcgctcgccgtcgccgttgtcgtcgctgtcgtcggaatagcctccttggtgctgcaaatctgtggtttcatgttgagggagaatctgcccttgccggtgctccggctgcggcccagccgctcgatctcatccctcatggtggagcactccttctccaggtcggcgacgcgctgcttcatgttgtccatgccctcccggagggcctggttctcccgggaggccaggggccagccggggcggtattgctcgccggagatggtggggatgagctgcctcgagccgccttcgaggttctcggagaccatgaggcactcggcgatggagctccgtagctggagctgctcgaagaagaggacctgcacgatgacgcgcagcgggagccgctcgttctgagccgcgtgagtgcaggcctcgagagagagcttctggcagtccatcacccggcaaagttcttccttctctgattcagacaggtgaggatgcgcctatggagaaaaaatccagacaaattattaagcatctacaagatcaacatgatacagcaagatgcatgatcaaaactttaatagatataggtattgtttttaagataatagtttttttttaggaaaaggcaatagctattggcaattagcatgacaacttcattgatggaagagaatagccaagctgttctgtacagtttaggcattgtttggatggcctgaaattccatcccatccacatggataggccaggatttcaggagcaggtattgctgcaagcctacctgaatagtaggcttctgaatccattcttcagtttcatcaggaaatcggcttacgcagttaccagtgaaacaatacaaggctaaatccctaattaaactgaaagagaggctttccacaaatcacttgacatacaaacttgattataaattacaatttgaaaggatatatg

SEQ ID NO: 80198 - DNA, 12300 bp, Oryza sativa
agtaaccacatggtatacaccaactaagatggagtaagaatcctcgacgtatcgttattttgagctgtgggtagttaacatgaaaaagaagggcctaaaaagataaatcggtgtgggatccaaatacaacagtacttaagttatataacaagattacaccagacaaacgtagaagcagtgaaggagaagaacttactcatcaaaaccattgtcagcatcctggcattcattatattcaggagtataggatctgcgcatatcatcatgtccttttgtctgtcctgatgattttgtttggtgctccttcctctgcggggaagcatactggtcatcttgccttcctggggcaggagagcatgacctacagtgtgaataagatcgttaaggacaaaggtactgcacggaatatcatgaagatacactggcataccgtgttctagcatggtcatggagatgaagagaatgggaacgtgagtatgagcgagaatgagattgccctgaaggaaacatagcaacttgtcaatattcaaagatgaggaaacccatacactggattagtggccgctcacctggaggggatggcctgggtgacctgcacagagcccagggtcgctcactatcaggtgcaggcggcgtcctgtcagcacaatatacaatgttataatcacggattgtattcatgaaatgttgttgttattatttacgcacgtacaacaagtgaacattcgaaacgtgaccagcatgccagtagttctaaactaaacacgcgcacatgctaccatctgttacaagtaacaagtcaacaaccagcatgcacgcagcacactatttcaagaaaaaaaaggaatcatatgcaactacttacctcaactctggggagatcaacaattgaagacatttttttctcaccaaaaaaaaagaatatactaacaccagtgatttttacactggtccaagagataataaactgtacaaaaggctacagtattgatatatcactgacagtatagtacattctcgcttggaatgagcctgcacctaatatgacatgtagtcctatcggcagtgaaggaattatttatgtacaaaccatgttgatatattttgacagatgataaaatgggctactgcaatagaacagggctaaatttaggttgcatgaatgcacagacagtttaagatagggtcctggaattcataagtacaccattggttaaaaatatattaagttcgcatatgtcctggatttccatctgaaacaatctgccattgtgtgtgaggaatcagctactgtgcacacaagacttatgttatagacatgttatatagtactccctctgtcccaaaatatagaactacctttggactttttttggagggactaaggttgcggtaaaatttaaataaaggatggttgtgattgtttgagatgaggaagtaggtggagaaaataaatgaagattgttgtgattggttgggatgaggaagtaggtggagaaattaaatgagagatggctgtgattggttgagatgagagaataggtcgagaggtagctatattttgggacaaaattgaatgctaaaggtagctatattttggaacggaaggagtaactaagatgtacaaactctcgatgtcttgtgattttgagctgtgactgagtgactgactggtggactggtgaataggatttgtgacttatggagtgatgaataagtatttaacccaaacaaaacaatatatataaaaatattgcatgtgacgtgtagcaggcagcgcacaagcagaacttactcatcacgaccaatgtcagcatactgccgatccttatatttgggagtataggatctgcgcttccgcttctcatcatgtcctttaggctgtcctggagagtttgttcggcactcttcctttctctgtggggaattatgcctgtagagcagccacgagggtcatctcaaatgaaaggattttcaaaacctttgggggtgtggtgttctgttgtacccttggagggcaggtgtcggagtcttcctctaataccgtacaccttttcttctctatcttaatgaaatgatacgcagatctcctgcgtgttctaaaaaaaacagtactgggtacagtatacctggctccaattattcttcgcatttcctcgggccttttccgtgtctgcacagcaaaagcaacactgatctcacgtccagaaagcatcttacggttcatgtgatatcgcgctttagaagcatcagaagagtgagcaaactccacaaatgcaaatcctcttggctccctacatatatggtgttataaaatgttggataagtaatactatatatatttacgttcaacagagaagagggtgcatattcatggtatgtgctcaactagttaccaccaaagttccatgattcagtgaacgttccatgattcctcatgaagcatagccaataactaacattttcatcaaaacatgtagcatgcttcaaaaaaaagcagctaggagaccaagttcttctagtagcatcttcataaaatggtcacttgaaattcctcaaatgtttcagaaaatcatgaaagtacttgaaatcaacttctcttcaataaatcttctcatggaagacaccagtaaaatccaatcctcttcgggaaataaatttgtgaacaaaccaaacctcctctccaaagaacaactttatttgcacaatactctacctcaccaagacaccaaacaagtgaacagttaggactgtgaaagagatcttcaacaagtctagtgcttgtagttacttcaacacaacacaacccgggtaatcatgccagaacaataattttgccagaagaagccacataactagtacgtacaatattaacaccaatgtatgctgtacagagtacagtagtacagactacagggtgctatattttttacaaaaaaagtagagtgaaaggaaagtggggtctttgtgggggtttgtccagacatgacagaagttagacatctcaaaagaagattacagttgtagattcttcgctattaaaggcacaccagcgagagaagatttaaagcttctcagagtctttgagccgtggctggctcaacatgtgttaacatctaaccatatactccatagtatcaaatgagaaggataaaccaatttcttacccagtgttgtagtcttttggcagataaacatcccgaacaggaccaaacttttgaaatggaacttggacatcctcaggtctggaagagaacccaagtgaacaaccaggagcaagtgaaatgatgcagaaattggtattgtattgtattgtatacctgcagcttcgcggaaggttgctgacgaagaggcttacagcagcaccttccttatccttggcacagccatgtcgtgagcttggagggcttcttcccctgctgccatgccttctcctcttgctggggctgcggctcctcatcgctcttctgtgcctgcacaatacagtacatagccactgaccacgattatcatttatcaaaggcacagatggcgaaatctttcgtccagattgagattgtgagatacgcagatgaatcagcgcaagatttctttactgaaaactgaaaagggattggcggcgctgggcaatgagaaattagggctcggagtttaggggaaacacgaaccgtatcttggtattctacttgctaggcagcgccgccgccgccgccgccgccggcggtgccggaggaggagcggagacaggtagggcaggcgagacacgcgacgtgggaagaggaggagacgacagatggtggcctgcctgttatgggccttatcaatcgaggcccaccaagcctacttgaaacaaatggactttgcttcacaaactagcaaattattaaagctacttcatctatcccaaattataaggcatatatttttttacacgcccttaatagcatgctttgatcagtattttattatattcaatgatcctaacaaatatgaaattagcatcacatgaaagtacttcaaaatatgaatctagtgatataacatgcataatacttaatatagatatagttaatataattattagttaaaaacttccgagtttaattttacttaaaaaggagcgccctataatttgggacgaagggagtacttctcatctatactcctctctgtgtttatgtcgctagcgtgtggttcttggatatgcagtttggtacctcgacagtttctatattttttatataaaaaaaatctctttcttataatatatttgatggtctccttcggtcttcccggcgaataaagcaacttctcctacagtctacagagaaggaacatcacttatactccaggacaattcagaacccacaaagaagaagattatataaatggcactctgcatagattcaatcggtgtagtattcttttcttcatatgtacagcaaattcttttctattctctgtctgtcaaacatgatgtattcatgtacacgaagaatgaaaaatgtatatactactagtagtagtatttttacaagcagatcaactcagggagggaaccaagattctgctaactgcaaagttggttgcagagttggttgatcttatcttgcgtggcatccgctataaggtagctccggtgtacgtttgtgccttcacatgtcaagtttaatgtattcgcttgttgcattacctgcaaaggggaacaatttggtcataccatgaactgtcaagagatatgtccttcatagccattttcagaatctagccaaagcaatttcgatgcaattaaatgcttcagatttcaacaattcagattccaacaatttagttgagcttcgattagataccaaaaactgtagtattatgcaggagcaatagtctattactcagcaagaacaacacatttcttgtctacattatacttcaaatttctttagcttgtttctattcattctttgctgatggcactatcacttaaaaaggtaaacaaataatgatatttgaactgtcttaccgtgcaatatgttggtgatgagttgcatttccatcttttcgtaggaacacagctgagatagtgacaccaagagcagtggtcgtttgcattatatcctcggagaagcagtactatagccactgtaaatctgtcaagttcaaaattgggagatttcatcaagggaggaaacatgggtaaaatacattgccactattcattagagcccaaagaggaaggtcagtggactaacccgacaattagcataatggcagcagctaaccacagtatatattggtatgtcttgtgcttgcgtttcacaggagcaggttgttgtccaggtgctactcttctctgattaatccatgcaaactgtggacgaataaacataacaaatccaagaaggaacccggatataaggcccccaatgtgcgcaaagttatctaccctgggaagtatcccaagagccaaattcaccacaattacaaacactagtgttagtagtgctgccacctgacaaatgagaaaaaaatcacacaatataattcaataggaatttagaatggaaagaaaagctaatgaattggtgatgtagcagtagttgtttctacaatcaaaaaacagaccttgtttgcatagagcgaccaattcgttatgagttcagaaagcatggacccaatcaatccaaacaaagcaccagaggcaccaacagagatacttgatcggatgaagagggcagacatcaagctcccaccaagaccagagatgagataaaccagaccaatcctcactgcataacatagagaaaatcagacttcagaaagttgtctacgctgtgaaactacatattccgtattcattttaccactacaccattacttcaatgaacattgattcatattcacagaagttattgcacataattaacatgtattgtacctacattcctattacagttcaaggcatcgactcctcttgtattctaccaatgcaagcaagacagtaaaaggtatgatattatactcccaatccttacttgaacaggaagtcgtcttactcattaaatgtctgaggatttatatacaatgtattagtgtgcatccatcaaatagaattacatttataacaaattgtacaaaagaagctaattagccattatccaagcaaggtcatggctgaatagttggcttgtctgggacgtaaagttcagatgaaatatgcaaagttaacttaccaaacccaaactcttgttcaagtcgaatgccgataaatagaaggcatagcatattgatgagcaaatgaacaactccagcatgaagccagatgcatgtaattagacgccatccttggtgaccatggacaaccttagttacatctagagctcccatcttcagtaacctggtagtaagatgaaagcatttttatcatcttgaattcaatatgcatagtaaaatagtactattgtcttagctccttttgcccccatctccctttttttccctcaagttttgtgttggaaaaataacactgactcagttcattgtacctctaagcaaacatctgcttcttaccaacaaaaataaaagtaccggctcgtcctacaatccttaatctttttttttgcggggactacaatccttaatctaaacaagacaaaactctaagtttgaagtggtaaccctttccagcttaataataataaaaatggagccacggatcatgttcaccgaacaaggtacttccaattccaatagttgactttgcaaatccaaaatattatcgtaaaatatccaccgtgcagtaagatgagcaatcagagatttgaaaagaagaagttttcaatctttcttcggggttcaacaactctccaactgccaccatgagtacaaagaatagactgaatcaatacagtagtaatcaaagaaaaaccaaaccaagtctaattaatggtttcgtttagacaatcctacatttgaattgggaaaccagttggcagcttgcatattttttatgttcttttaataaagcaaatttttatttttgagctgtcagtttcatattgtgatatcacccaaagtcaagttgcaaggagcttaactctctagttaaagaaataaaaacgtatgttacaaatctcacctagagtagttgctaacctttatggatgaagtaattacagaaatgtaatgaatgttttgtaaacaaaagacagtaggttgttcatggtgcaaataaaaaaaggaattgaaagaacagttgcagactcttcattgcattgcacagtagacacgaagtacgttgagaccaaccctattgaagtggagtacataaacagaaggctttcttaaatgcaatgcattgcattggtaactgacgagagaatggatgagcagagttgagaaatggctcattttttatccattgttcgttgtctatagccaattgaagcattggttgacccttacaaacaaattatttagataatgagatgcataacagaatactactaccatgtttggagtcaggttcctaattgcaaccagccaaccaaccaaatgaagtggatgtattgaaattagcaggcagatatgaaaagcagaagaaaaataaaatcttggttggagtagataagagtttgctctgcatctgtaattggtgattgtatctactctagaaagtaaagaatggatggtgtacgtagctaggtacattaacattaagcagctatacgtcgtttattgaacaagaaagatcattatctaaaaattaagcaagaaagaaagaaaggggggcggagggattgaaggcgatcgacgtacgtggcggaggaagggccgaggaggggattctccttgagcggctggaaggcgaagcggccgaggaagccggcggcgcagtccccggagttgcggcgggggcaatcgttgacatacatggagacgaggaagacgacgacgcaggagagggcgatggcggcgacgatccagggcgtccatcggcggtagtaggggcgcgccctgagacttcccggccggtgagggtgcaccggcggtggcctaggcctctccacgcggacgtccaggttggcggcgggagacggcttcatgggacttggagacagacagacggaatatggaaatggaatgaggattggagttgagaatggaagagacggcggttgatgaatgaattggagtttgcttgccagcgagagaggagaagaagaaagaatcagcagccaccgcgtttaatttctactactccagtactacaagttgtagtatattgtagtagtattggtttggtaagcaaggagaagaaacaagtaggtgtattactccatgtcagaggaaattcgcagaagaagaaaagaaaacctctgacggaaaggccggcgcgagggttcagattactcctttttacttgtgtgcggtgcacccaatcagaatcagccaacaacaacttgcttaccgcctactacgtgttgaggaaggaaggaaggaacgcgcaaaattaaccaaatgaagaaacgcgtttcgtttcttgttggtgttgttggccaacctcgatctcttctatacgcctccatcgcgccttgtataattctactaccgccaattaaattcgaagccacctaccgtgatgagaacgagagagcgactttattttttaacggaattgctagaaaacttgctactgtcaaattttcagcccttagatccgcttcaagattcgtgcgtgcaacaagataaaaaacagcatataatgtgtcgtggacaggaatcgatccttggccttgctcatacatatggcagcattcaaaccactaagccagcacaacttcatgtttcttaatctacttatatagcatttacactctagttacatagtgtcacgccccgaactagtaccgaccggaactagcccgtgacgctccaaattaacctgttaatcgataccagtatcaggaaacagtgctggtatcacaggaagacagaatatcacagcaacagaggtctctttattatagagtaggagtacagtcatgttgggctgcggacagatcccgagctcacaactgcattacaaaagggaagcggaagccaagacttgggccaaacaacacaggcgcgacttgggaactaggccgaaaccctaaatctcatcgtagccggcttgctcctggaaaaactcctcatcagcaggatccgcttcatcttcttcagcaactggggggggattatttatatagagcaagggtgagtacgggagtactcagcaagccatgggaaataagtgtttaatgcaggcttcaaggaaaggctgttgtttttgcaattgattttatttgaactcttttctgaaaacaactaagtgagtgcttttcaaacgacacggttgagatagtgcgtctcgtccggtcggagtatgtgcaatgtatcagtctttaaaattgatcaagattggcacccggccaacagctttcaaacggccacccgggccaacaactttcaaacggccacccgggccaacaactttcaaacggccacctgggcctagctgatcccatcagctgcagattttccaaacatcgatcccctttccacaacagcaatttcacaaacagtaggcaaacaaaactacgctaggaatcacctcacatccacccatgaccgtgggcacggctgttcgaacagtttgttaacctctgcagagggggtacactttacctacacgacattactaacccggatcacccagcccgtggggatcagccacgtcgggagacctccaagctttcatgtcaaggcatttcgaaagccgacacaggtttaccatatgccgacgagaggggtcccagaccaacaacaggttaggtcccagactatactgtgccaggaagcccaagggtcctccccgacaccaccccggcgaatccacatgtctctcggcatcaaggctcccctgataagctagttactcagccaggggtgtcccattccacccatgtggtcatacttgtcttatattcggatgaaattccaaggaaacggtccttaagtgcaagagcgggaaaccgtacacccggtacgttcctcggtccgcggttttggaaaattcatttagttcgtaagcaccgacccaggtgtcgggttttccaagtcttttgtaaaacccaagttttacccaagatgttttttagattttaagtttgaaggcgaccgtcgatactcgtgtagagtgcacgatttccgaggcgcaactgggtggttacaaggaaacatggtataacaattaacagaggaaggatcaaatgcaacaagctaggtaggtccgccaatctgccttgcagacgggacaaacagattaagtgcgatcctatcaatgcataatatttttcaagcaacataattaaattcaaatataggctcaagatgtttaaaggtggcttgccttgctcgagatttggagcttgatcctcgaaatcctcgcactgcgggtcttcgggctccgaaactacgcgcaaaacgggacaactcaacaaacggcgaaaataaggccctattaatgacctctaagcgtgccattagatagatctcgagatttgaggaattttggaagttgaacggagtcaaacggatttacggttgggaagatattgaatttctaagattattggatttttggtctaaaggaaaaaggatttatttaaatcctttttgaaaaagaaaagaaaagaaaagaaggagagggaaaattagacttccctcgggcggcgagggcgcggcccgagagaaaagaggcggctcggccgagctaaatgggccggccggcccaaaaggcggcccaaagcgcgcgcgctggcggggaggggagagagagccggtgggccgggtccatcctgcgtggtcccgggtgggacccgcttgtcggcgactcggctcaccgtgcggagcgaacacgcggcgcgcgctagggttcggggagggagacgcggtgcacgcgcgcggttcgcggaggatgcggtgcggcgggcccacgcgcagcctcacggctcaccgcggaccatgcgcacgggggggaaaagggagggagcggctggccgggtcagccgatccggtcgcggccgaggtggcgctgacgtggcgcctacgtggcagccacgcgggccggcgggaggtagacgacgacgccggccggaacggacggcggacgacagcagcgagcggcggagcgaaccacggcgatacaggcgaaagcgagcacaccgggtggttgcacgagacgaggggagatgagccaacggctcggattcgccggagggagtgcgtcggcggcggattgcggcggcggcaaccggcggggagggaagagggaaacggcgacgaggtcacgaggggccgattcctggcggcgagagcatctacgcggctacgggaatccgtcccttgtgccggattaggaggaaacgcatcgagggaggccggcgacgagaggcgcttccgagctcgggcggcgacggcggcgagcacacggcgagcgacggcagcagtcggggcggcgccggctagctacggggaggctactcgtgctactacccgagtctaaggggaggagatggaacgaggagggagaacggggagatgcgctaccgtgcgggacggggggcagtgacgatgggccgacggcacgggagtgatctcttcggcctcgggccggggaagaggaagaagagggcacgcccagagtccccttccgcgtccttgctcgtgccggctcctctgacacgcgcaacgatgaacggcgacggcaaacagagcacgggaggcggtggcaatggagtggaggcgagagacgaaaacgagggagattggaggagggaggagcttgggtttataggggcgacagtgtcggtttgggagaggggaaccgacattggacggtcaagccggcgagctggcgcccggctagcggccaacacgacgacaggaggtgacgccggcgagagggaaacgggaggaaaggaagggagaaagggagcttgtcccttgccactttgggaaaaggaggagggagcgggggtgacgtggcagagggaggaggggctctgcctccgtcccttggaagctagcgcgcggagtggcggggtcgggttgatgacgacggcgatgacggtggggcggtttggagcggggcgacgacacgggcggcaggcgcgggcaggcgtggcagaggctgacggcggcggcgaccaggcggtcggccaccacggcgcgcgcgcgcggaaagcaacggggctgcaggaa

SEQ ID NO: 80199 - DNA, 19297 bp, Oryza sativa
atgcaagttttttttaaagagatttcttatatggctcatgtatttccaaaagcgaacgaacttaagaccccactcaaatgcggatatgtattttcaaaagtgaatgcacttaaaaactgactcatacacggatgacgtaccaaaataccgacaaaaacatcttcaatttttttaatagtagagatattaatttttccgtcatgctagatttttctcccaagccaaaaagtgtgttttttttttaattctgatccgccaatataacccccctctatttcacaatataaggtgaggtgctttagttttatcctcaacttaacttctttttaggtttaactaagtttaatttataggaaaaacattataatattctaaaagccaaataaatatattcgatagtggatcttaatagaattgatttgatgttacgaatgttgttatatttttctatgtaattaatcgaacttaaaaaaagtgactttaagactaaattaaaacactttacattctcaaatgtagctggatatatatatatatacacacacacacacacacacacacacacacacacacacacacacacatatatgacactatatatatatatatatatatatatatatatatatatatatatatatatatatatatgagggttgaaaatatatattacgggcgatgaacagtactgtggactcttttctctgttaaatagagtatatattgtcatgttctacattaggacatacagttatatctgtccatccatactgtgaaagattgcaaagggagcaaacgcatgatcaatggatgtatgagccaacatgcatgcatctacacatttgtggctgggcggctatagcgcccatataatattcagtcggtcgcggccggttgatttgtagatgtgtgctgtgcatgcacggatgggtgccttaatcaatttggatgtgaatgcatgaatttaattaaatttctacctaacgaaagatgcaacatatatatactacgtactgttacatgtataaatatattagtagtagtatatacttgcatgcatgaggaggagttatgttggagtggtccatggcaacactgtgtgcattcaattcgatcattcgtactcatacgtatatgcgtatgtactaacgccccagacacatacagtacaaacatacatatacatagctagtactatctccgtttcctaatatataaaaacgttaattttttcacaaatatttaaacattcatcttattcaaaattcttgtgtcaatataaaaaaaaataagttatgcttaaatatcatttgatgataaactacatcacaataaaatataaataataaccacgccataataaaatataaatgataatcatataatttttttaataagataaatagtcaaatatattttaaaaagtcaacaacggtgtatatatatatatatatatatatatatatatagagagagagagagagagacacacacgtacagagtactgggtactatatccatccatggatgcatccatcacacggccggccagttgtaccccatgcacatgaccactgtaatgacacgatgacacttaattagatactctatttattaatttacttaaaaaagtacctttagctaattgtaaggcatcatcagtagtctctctaaacataccccaactagtggtatatatcgatatagtagtatatatactatcttggttttatatgacaccgttgttttttaatatgttaatttgattatctatcttatttaaaaaattaatataaatatattaaagtataaattattatttttcttaataataaaatatgttgtaacaaaataaataatatttatatatttttaataggatgaatgattaaacatcatgttagaatttaatgacgttatctatatctatatctatatctatactattataaaaattgaaaatatttttgtcggtattttgatatgtcatctatgtttgattggtttttaagtacgttcgtttttagaaatacatatccgtatttgagttggattttatgtttgtttgtttttaaaaatacaaaaggagtcgtataagaaatctctttaaaaaaacttgcgtgctaacttgagatgaaagtcaggctcctaattgcagctcaagattttctaaaataaaaatccaagtaaattcctacagtgaatttcatcctagctaaaccgtataacaatgataagattaaaatagcactcatccattgtaacgtacgagtattttttcaagtctattgaaaaggaagtaggagaactgacttgctcagttagttacgctaaattattttttcatcatcgtgcggattattggagattaattgaagaacgcgcggcattaattcgtagagtagtattcatagggtacgtacaacgccattgaataatctgacagtagcagagacaagttcagtctgtacagtgaagtgcaaagcttctcttagaccctgaattccaacctttttctttaaatttttaactttttcattacatcgaacttttttacgtacacaaacttctaatttttctattacatcgtttcaatctcttcaaacatttaattttagtgtggaactaaacacatccccttatagtagtagccgtatgttgattagagagacagcccaggccggctcctcatgattgaggaataagtctactttgtctctctcaaatttacgccatccaatctaatttgtatctctcaatcataataccatatatcttaagcactcaattattaaaaccgatgcaaaataactccctcgataattttgaggatggttttcgctgacgtagccggttgacctaggccaaccattgaggaagtaagtagggacccacatatcatactatttctccttcccttcctcatccctcctctctccccttctgttcctcctctccacaacgatggtggctggcggcaagttcccattgggacgaagcggaaaccgggggcagttgttggcagctagcacaacagagccaaggaggacggcggcttgacctcacggaggcttacagaaaggttgaggggaaggtggaggggcgatagcaaggtgatggcggcggaggagtgtagcgcccgttccgtcgtggcgcctagcgggaaaattatctcttaaaaaccctatctgcgaaatttgtttctttgattgttgtctagtgtccgtgccatctcaagatctcaatccccgatctatcgtcgagttcaaatccgaatccaaatccttccaaatcgattccctccgcaaagtttagtttgcctcccccggggttcgatgggccgaattccgctcggcccatctctctctctctctcccgggctctctttttctctctctcttcccccccccggcgcgctccttcccccctgctcagcctcgcccgcgcgctgctcgcgcgtgcgagagccgccccgagcgtctctctccctcgctgccgctccccgcgtgccgttgctcacgcgcgcccgcgctgccgcccggtcccgccagcccgcgcctgtcgcccgagccgcgccgttcaaaccaccgcgcctcccgctgttttcccacgcgcgcggccgaccgctcggtcgccgccgtcgtcagcgcctgcccgcgcctgtcgccaatgtcgccgctccgctccaaaccgccgtcgtcatcgccgtcgtcatcgcccggcccccgccactccgcgcgcaagccgccaagggacggaggcagcgccccccctccctctgccgcgtcgcccccgctcccctcctcctctttcccaaatcgacaaaggggcaagccccttttccccttttcctccccgccggcgtcatcctccctgtcgccaatttggccgctagccggagcgccagctcgcgccttgaccgcgcaagtcggttctcaaaccgacattgccgtcccctttaaacccccggcctccccttacccctcctcttccattcgtctccgcgccatagccgccgccccgtgctctgtctcacctccgccgtccttcgccgagcgccgggagagccggtgcattcgaggacgcggaaggggacttcggccgcgccctctccttccccttccccggcccgaggccggagagattactcacgcgtcgtcggcctctcgtcacagcgcccctcctcttctcggtgatgtctctctccgttccccctcctcgctccgtctcctccccctagctttcggtagtagctcgagtagaccccccgtagctagccggcgccgccccaaccgttgccttcgctcgccgtgtgctcgccgccgtcgccgcccgagctccgtagcacccgctcgtcgccggcctcgctcggcgtagttccgcccaatccgacgctagcgtcgagttcccgaagccgcgtagatgctctcaccgccgggaatcgacccctcgtggcctcgtcgccgtttccctcttcttccgccgccggttgccgcctccgcaatccgccgccgtcgagcgacctccggcgaatccgagccgttggctcgcctccccctgtcacgaacaactgcccggtgtgctcgcttttgcccgtatctccgtggttcgctccgccgctcgccgccgccgcccgccgtccattcgcggccgggtcgtcgtctacctcccgccgtcctgcgtggcagccacgtaggtgccacgtcggcgccagctcagcttagaccgggtcgagccgaccccggtcggtccctccccgtgcgcgcgttccaccgcaagccgtgaggctgcgcgtgggcccgtcgcatctgcgtccgccgcggaccgcgcgcatgcaccgcgttcctccccgcccgcgtctaaatttcctccctccttccttttctttctcttttccaaaaaggatttaattaaataatcttagaaattcaataatcttagaaattctatatcttcccaaccgtaaatccgtttgactccgttcaacttccaaaattcatcaaatctcgagatctatctagtggcacgctcagaggtcattaatagggctttattttcgctgtttgttgagttgccccgtttcgcgtgtagtttcggagcccgaagacccgcagtgcgaggatttcgaggatcaagctccagatctcgagcaaggcaagccacctttgaacaccttgagcctatatttgaaatttaattatgttgcttgcaaaatattatgcattgataggatcacacttaatctgttgtcccgtctgcgaagcagattggcggacttacctaatttgtcgcatttgatccttccattgttaattgctataccatgtccccttgtaaccacccagttgcgcctcgatactcgcgcactctgtgcgagtaccgacggtcgccttcaaacttaaaatctgagtaacaacttgggtaaaactggagttttacaaaagacttggaaaacccgacacttgggtcggtgcttgcgaactaaatgaatttccaaaaccgcggaccggggaacgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctggggcctaacctgttgttggtctaggacccctctcgtcggcatatggtaaacctgcatcggctttcgaaatgccttgtcatgaaagcttggaggtctcccgacgtggctgatccccacgggctgggtgacccgggttagtaatgtcgtgtgggtaaagtgtaccccctctgcagaggtcattaaactgttcgaacagccgtgcccacggtcatgggcggatgtgaggtgattcctagcgtagttttgtttgacttctgcttgtgaaattgctgttgtgaaactgggttcgatgtttggaaaacctgcagctgatgggatcagctaggcccgggtggcagtttaaaagttgttggcccaggtggctgtttgaaaagagttggcccgggtggccgttcaaaaagcttttggccgggtgccaaccttgtttcaagatctaaagactgacacattgcacatactccgaccggacgagacgcactgtctcatccgtgtcgtttgagaagcactcacttagttgcttttagaaaagagttcaaataaaatcaattgcaaaaacaacagcctttccttgaagcctgcattaaatacttatttcccctggcttgctgagtactcccgtactcacccttgctctatataaatatttccccccctcagttgctgaagaagatgaagcagatcctgctgatgaggagttcttccaggagccagccggctacgatgagttttagggtttcggcctagttcccaagtcgcgcctgtgattgattggtccaagtcctggcttccgccttccttttgtaatgcagttgtgagctcgggatctgtccgcagcccaacatgactgtacttctactctataataaagagacttctgttgctgtgatattctgtctccctgtgataccagcactgtttcctgggactggtatcgattaacaggttaatttggagcgtcacgggttagttccggtcgggactaattcggggcgtgacaaggagctcgtgggggttgggacatgatggccctcacctagtccgcatatacacgggtagagagtggcatcgtgaaggaggacgcggttatattactccaagccgcagaccactgtcagtgggtcgagatggatgggccaataggctccttcatgacggccgcaaagtagaggccgacggctttgtcgaggctaccgtggcagaagttaaagtgattagcggcgacgtctcgaccgtccaagtcgtgggtcgctgcccccggttcagcttcgctttgctgggagctagccaccagccgatgctgctactatggagaaggggggtattttacttattgccacttttaagatgtggcgatgaaggatttgtcacttacaatctatgacgtgtggcccttgtatatttatgacatgtggatctagtggcaaatccttaattgccacttataagagtgacaaatagttaaatatcttggagagggggaatgtaatgggaaagagagagataatggagaaagagagaggaggaagaaggaaaggggagagagccagagagggagggggatgttatgtgggtctgcacatgttggctcaatgattggactaggctaacatgccacgtcagcgaaaatcaactcaaaactaccgagcgagttattttacacctgttttaatagttgagggtttaggatatctgatactgtaaccgagggatacgaattatattggacatatatatttaagggagtctaagtgtacatactctcacgtgattgaaacatgtggatgtgtgggccacgatcacagaaatatgggccacttaaatataggccaggggcctatgtgcatttacgttggccggcccagaaacgtggagctgggatagtgggcttaatggacctggcccagaatctatcggataccactccactacggagtcccctcctctcctcccctcacctcacgatatgatgatatccatccatcgctgcgattcgccgccgactccatccgatcctcctcaactccgatggcgatggccctgctgctgctgctgcttccgctcgccacccaccctcagccagcgtccaccgatctctttcgtgctgctgcttgcttcaccgatggtgatgcatgcttgatctgtgttcgtccaaatgcctcaaagggcgatcccatcttcaaccgcgattgcgatggcgattaggcgatggcgctgagccacctcctcctcctcctcctcctcctcctcctcctcctcctcagcgtcacctcttccaccgattcccctttctttctttcatgctggtgctgctaatgcttgctattccccttgtgtgttcgtcacaatgcttcacaaggaaggtgcgtcatcactcatcaaccctcgcacccctgccttcttcctacctgtttgattacattcatcggtactctctctctatctctcaattttgttccatgaatgtcacatgtgaattagcattccactctcccaagttttttttttgaaacgaaaagcggcaaaagacttgccgaataaattagaaggagtgcaaaccgtattgttcccattgcttaatttagcattttggctgacagtaaaccgtcttacagtattgttctaagaaaacactggatggacacagaaattgacaaatgatacccaaatgaaatatactcatgtatagtatagcccatatctttatattatattattattaacaaaaacttgtcatgcccagctatggcttgggcgcgatctgatacacagaacaaagagaaaacataaaaaggagaaataattaatagcaagcgtcaagccggcctgcttaaaaggtgtaaaggcagctgccgtcgtcgctcctcgccgttgggtcgaagttcttggcaacagggtcggtgcaaccttccggcacaggcaggttacctgcttgctgtgctccttgccctgatccaaattatcccaagtactaactttaatcagcaacctatcgatctatatagtacataacataggagtatagtattatatgtttgagaaaatgcagacaagatatagtagaatataatatatatatatatatatatatatatatatatatatatatatataaatatatatatatatatataaatatatatatatatatatataagggaaatatcctttgaaaacgagcttagtgttggaaactagtgaaaattatatctaaaaattttataaattcatgaaaaaattactagagaggtgtagatatgaaatacattgttaccaaatttaagtccaaacttaacttcatttgagagaaacaaaaattctcacaaataaagttgagtttgaacttgaaatttggtaagaatatatttcatatctgcactatatatctctagtagtattttcatgaatttacaaaacttttttgtatgattttcattggttcctaacacatagattgttttcaccggatatgtcttcatacatgcatgtatgctgaaggactgtatacaggaattacaaaatggaatagtgaagagttaaggggttaaatcacctcctcctcctatgcaggccgcctacgatgcatcgatgggatgcgaatagctagagatcttttattcagctggatggcgcagaacctatagacaggggcggaggtagaattttgtcatgcatagggctcaatcatttagtataacaaattgtaactagaaatttatgcttttccggccctaataattttcttgccacgtgtggagctcaagcctaattaagctgctcgacacgtggctccgcccctgcgctatagatagaataacatgtataacaaatcttaatttgtgcgttttagctggtcataattaatttagaggaagctatttttgtttctttcataatatatatatatatatatatacagtgatagagagagatgtatcatatatgatgatggtgtagagtagtgggagggtgttggatctaaccgtagaaggaaccagtcttcatggcgtcggagttagcgtcaccaagagcagcctcgctcaagtactgctcagccagctgcacacgcttgacgttctcctgctccttcacaagcatgtatccgtactccatgagcttttcgatcgtcatcttgggctgctcgaactccggtgggccctccctcgagttcaccagcctcttgccaatgttctccacacccgtgtccgacacccacttgcgcacctcgtcgtcgtaaacacgggcacgaagagcgccgaagaaatctgcatgcagcaattcgaccattcagtttcagtttcctttaattttaattaatttggtcattgatagcatttttggttgcagatggatgtaccgatggattggcctgggaagctgtcgacgatcttgacgatgtcctcgtcggggacgttgtcggtgcggaagatacccttgcagacgccgacacggtcgtcgcgggtgggagcccagtagaacttctccatacgcccgtcacggatgagcggcgcgtacagcgtggagaagtcgttgccggtgacgatgatggggacacgggggttgtcctccttgttgtacatcccggggagctgcacgttggttgggttgtcggcgatgttcatcagggtggcgttcaccatctggttgttcaccgtgtactgggtggtgcctcccatgcgacctgcacccgcgtccagatcgttgatgaagaggcagcacatcttccccttcttgatgatgtctgccgcctcacggtaccgctgcctgatcagcttcgccggctctccggcgttgccgctctccagctctccggcgctcatcatgatggggctgtaagtacgtacgtacgttgtaagtcaattagcaacaagcaagtacatacatactactaattaattcgaaagttcatactaacttgatccccatcttggcgaagacgagctcacactggaaggattttccctgacccttgcctccccagatacccaggatgagtgggaccttgatgttggggagggtcatgaagttcttggagatgtggacgacgagcttgtccatgaaagcaggggcgatgtagaagcctcccatggtgttgtcgaagtcgtacctggaggtatgtatgcatatatccagtcagtcaattcgattcaattcagcatatatatgaatatgatgaataaaatcgattggtgtggtgtacaaattagatttagtacgtacgttctgagaccctggctgaggtactcgtaggagctgaggacggcctcgtgggtgccatcacccgtgggagcctggaaaagggagtcgacgaaacccttccccctggtgatgtcctgctggtcatcggagatgtcgtaggcgagacccttccacctgtcctggtcggtctgcttgccctcgtccagctccttggccatcaccttgaacctgttgatgttggagctcttgccatggtagttcaccgccgatgtcacctgcttcttcagcttcttccccaggaagttggtcggagtggacgcctgcacatccattaatctcgcaagtaagtatcctcatttaatttgcagcaaaaacatgtacttatcaagctagctagctagctgcgtatgtatgtgtaccggagctccaacggtggaggagaaggcagcagccatcttaatttgctgaaagtcgatgattgtagaggatcactgatgatggccggccgctgctgctcaaagtgtagaggccgagctgcggtaggccttaaataatacaatagaattggacgtcgccatggaagttggaggctgtgagaggcacacactcgtccctgtggatcagcttccagatcctccacaggccacacgctgaagattgggttctgcacacgtggcgcaatctcggccggccgatccacagcatagcatgacttggacctggatcggagtctgtgagcgagttaggagtatattgtattagtgtaggtaggaaggatctcttggcttcagttccttgacctttcctcaccacagaattcacccatttctgatcaactctttctctctgttttttcttttctttccttgcctcacattcgtctcccggccggcagctagcgaccagttgcttcatcagctcagctactacataacctcttcattttgcatcaccacagaaaagccttttgctgcctctcgttgcccggcttcttggatgaggcatggcatgcaaattgtattctagttggactaccacaaatattttgctctgctacctgcacatattctgctttctcgataaccatcaggctaggactgtcatttggcaccacacaaacttctcttaacatacaacataagcattgtacgttttttcccctttgatggtttccgttaccacaaaaatacaaaaattctaattttgcactgctgttgatattgttttttggtgaagcatcaatcggaggcagctaaatctgcagcagtgccttaagatgaatttatttgtggttcatagctttcgttcctcctaagcctctatattgcttttcgtaacttttgaaaattaattgtttgctcatgtcatgtcagtagtaatcttttatgcaagtcatgtgaaatttctcctagctagcttgtccctactaagacgtttgagatggaggcaagtgattggtaacgacacttgtaaggtcgagtctccagtacattggaaaataacagtcatctcactaggcaagtactagcgcacatattggaattggataacattccccaacttgtgcatcattacagatttacagtgatacgctaattgttatcgtgcaacatgatgaatagcacaggaactttgatatagcatgcatctgtagtaacaaatgcaacccgcaagttgagaatacatccatatatagggaagtggatttggatccctcaaggaaatattccctcgttgattgcatgtcactcaagtggttatgaaaaaaattgagaagatatattaacatgtgatatatcactctacaaacatgcaaataaaaattcaacttcgacatctcgtaacgaaaaaaacaaatttaactctgaatatacattaactagctgttgtttaatttgtatttttcattacaatttgtagaagttgaacttgaacttgtatatttgtggagtgttatatcacatgttaatagaccttctcaattttttttcaaatttttttataatcatttgaatgacatgcaaataactaggggatatccccgtatatagtcagcatgtgtatatatcaatcagcgatatgatggcacatccacagtatccagagatcgtacgtatcgttgcatatgcatacagtactgctagtacactagtggataattaatgaactatgtgacaaacgattggattatgtgcaaaaatactaataatgtattagtatatgacaagtgtaatttcaccacatatcacatacttcgaggtattaaaatttgtagtgtaaaattttagtatgtactatactttaaaaattctcatacgattaatttaaataatactagttaatttgggtgcagtagtgacaaattaaacgttcctctttgttaagggtacaggctatatagggtgcgaagtacaaggaagcatatcgatggtgttcatatatatatatatatatatattcattaatcaagtgcaaaattaagaagctggtggtgaattggtgatggattgagttcagttgtagacgcagctgccgtcgtcgctcctggcggtagggtcgtagttggcggcgcgttggtcggtgcatcccgccggcacggggacgggcgactgctgctcggccttgccgtagaactcgccggagtcgtggttggcgtctccgagcgccgcctcgctgaggtacttatcggcgagccgcaccctcttgacgttctcctgctccctcaccagcatgtgccggcccgtactccatcagcttgtcgatcgtcatcttgggctgctccaactcgatccggcggagttcaccagcctcctgccgatgttctccaccccgatctccgccacccaccgccgcacctcgtcgccgtacacccgcgcccgcagcgccccgaagaagtcgatgggaacgcgtcggggaccttgtcgctgcggaagatgcccctgcacacgccaatgcggtcctcgcgggtgggagcccagtagaacttgtccatgcgcccgtcgcggatgagcgggagaagtcgttgccggtgacgatgatggggacgggggttgtacatccctgggagctgcacgttggtggggttgtccgcgatgttcatcagcgtcgcgttcaccatctggttgttcaccgtgtactgcgtcgtgccgccccgcgtccaggtcgttgatgaacagcacgcacatcttccccttgttgatcatgtccgccgcctcgcggtaccgctgccggatcagcttcgcgggctctccggcgctcatcatgatgaggctgcatgcatgcagttgtactactattacaacacacgcagcatgcaatgcagttgtacttcctactctcacttgatccccatcttggcgaagacgagatcacactggaacgacttgccctggatgttgggcagcttcatcaagttcttggagatgtgtccatggtgttgtccaggttgtacctgcagcaattaattaattaattaatcaaaatgtgcatgcaacgcagcattatatttcaagcattattgaatgtgcttaattacgtacgttctgagaccctggctgaggtactcgtgcctcgtgggtgccatcacccatgggagcctggaacagggagtcgacgaggcccttccccctggtgatgtcctgctggtcgtcggagatgtcgtacgcgagtcccttccaccgatcctgctctgtctgcttctcctcgtcaacctccttgctgctgccgcccgccatcgccatgatcttcctgcacctgcacctggacctgcctccatggtggctgtaccccgccgtcctcagccaattcttcaccaccaacccgcttccctgccaagccacaacatgtcagcttctgcatgcttttaaactttcaacaggacactcctctgtttcttactacagatctctcattgcaacgttaacgggtctcctctagtttttcctttctatctttaaatttcttgttgcttgcttcaaatcatgatatgcttttctatctttctgacaatacctaaaactttattatatgaatttaacaaaattgttattttctcaacaaatacaaatttttaaattgtaaagttggcgcgacaaaataaatggtaaaattggcgggagaattatataacttgcttaattgcaaaatattcagactcctacagaattatatagcagcaacaggtatctctcatccatttgccagcctcgttttcatttgccagtctcctacgagtactaatttatatcggccgattttgacaaatactactgtgcatacgtaggaaattaaccttgtcgtgtaggaatattattagaggctagctagctaacagcaggagacgagctagcgtacgtaccggggctccgacagtggaggagaaagcagaagccatcgtcgtcgatgtcgctgccatcgatcagctggtgggtatgtatgtatgtatgtatgcacaagatagtattttaattagcttcttgcagttgtactaactagctagctgcgttaccgatcttgcttgctagctaggtactaactgagtgagtgatcgacgaatgagctaggtgcaagaagaaattaaattgtgcaattaagctggctcagctcagctcagctcgatcagggacacccggttgatgagagctggcttgctgatggagcgagatttatagctactggcaatgcaaggcgaacgattgcagctttgctagtgtccaagcgatcgagtgtgtgcccgactcttccagaccgtgcctgcatattccctgcattgatttattacgagtactagttaaattgatcaccaattaggctgtgtttacttccaaccaaagtttagaatttggttgaaattggagacgatgtgactgaaaagtcgtgtgtaaatgaaaggtttgatgtgatggaaagttggaagtttgaaaaaaaactttggaactaaacacacccttagacacaaattctgtaagcccaagtagctatactatattcactaccagactttagagctatcctgtgggccgtgatattttctgtgcgttttgcagccaacccacagaacatcgctatagttctgtcggttgtgctaggactcatagaaaattaccactgacaggtgggcctaaatccatcgtatagaagtccagcagcccacacaagaaaacctagtttttcatccctcacgtcccaatccctcgagccgccgccgccacccctctcctccttctgcagtccccatcgccactcgcgagtagatccagcgccggcgccggtgctttgacgaatggagaccacgccgccgccttgtgccatcgatgagccatctcttccccggcggtgccagccaacccaagttcagggtcttcagatccatatgccccattctcaatggtcacggatccagccatcccgaggctgggtgttccagatccggtggctcccatctccggcggcgccaggtctagcctcgaggtgagtggatctgcggcagtttgtccccagcaagcctcctcgtctaacagctggtaggtttgctctccggattattttgcaaggatttgtagtatgtgattaccaagagtagatctggatatttgtcttgatttggagtaaatgatcaccgtatagttgatctggatatttgtcttgatctggatagtctagacaattagacttcaagaccgataattgacttgcaatatattattttgcttcgggtagcaaatcatctgtctactaatattgttgccaattactttacctttaggtgccaattacgaaatacagagatgttctgatgactttaggtgcccttttttgaattagttaatcaattaaaagtataagtagaatgatattttattcaccttactctttttttttcaaagccctgagacagccctgattcccggatattaagcaagaaaagttgattcccatattagtctacattatgtaacttagtccataatagaaacttaattttcttggattagtctagtgtataatgtccattttacatctaaataatttgtttcttgtttcaacttatatcaggaccatctaattttcctctctcaagccattttgtgaagacctaatacagtggcaccacaacaggtactcccacattagagtcccttgctactaaaaaaacttccctgttttatatttaaatgtcatgagacaaagcttcatcagttacagtaaagtgatctgcttgaatgtgttgctaaatataactaacaaatgtgcatgacctaaactgattctttgtatagctgatttgcatattcaatttgtccatcttgcagagtccattccaaaactacagaagaacgccaaatttcaacgaagtcttaggtacagattaagtgccacatcttagtgcatatcttgcaagttattatttttgttgcacatcattcaacacctgttgcctttttgcttgcagctgattgaaaggtgttgatcaatcagaattttcgtacaatgtttggtggataattttatcttgaaagataaaatatgaatctttataagtgtatctttataaattgtaacatagatggagacttgcagttcctttaccactgggtggctattttcttagtgtttgtaaacaggattgacacaaagttgaaactttgatatgtatatctcactgaagttgatgtatctgtgcacaattgtactatgaatatttgattgatgtaaataattatgtatggatctaatcatgagtgcaatatccaaatcaatttacttgtgtattaatctgaagtgcatgtgcatagcattctctcttctttttttttttccttggaaagccaatttttctgacggtgcactcgtcagaactatgttctctcaaacccggcgtctcagtttttttctgtgttccacccacaggaaaaggccgtcagaaattattattctgtcgggaaaccgacagaacaattgaatttttccatggtaatttttctgtcggcaatttctgacggggcacctacaggaatattttttctgacggtaaaaccaattttcctgacggtttttctcctacaggctagatgcaaagtctggtatgattggctgctagcttgccagctacatgcggccgattgggatggatcggatggatgaaccaattaagctgtccgtacgcacgtcgttggtgtggatgagattggaggtgcctcataaaccacacacactaaacacgctcaggaaataatccatccgattaataactatcgtcgttgcatatattttgtggcgcgtatgtatgtgtatatacgtggctactgctccacctcccgatggatgcgatccgacgatccacaaaaaagccggccaagggcccatatccatcaatccatggaagcttgcagctcctttacttttgtcgcgtgcccatgcataatttcatttgcaattttcttacatagtgctagattataataattggctgtaactcttttgaacaaaggccacgatgtaattttatttcattatctacaaaatatttgttgataaattttctcctaaaaatttaacatatgtaattacaatataatcatagtataattacactataacttaattgcatgcgtaattacactgtaacttgcatgtaagtacaatataacttgtatgtaactttcacataattttgaaccgctagatttgtttcaagatttgtgcaagtgaagaagatcaaaggatagctttcacataatcttgaattgaaaggtttctaagaacatcaaagaacaaaattatagaatcaaacatgcacatgttagcatccaagaacacaaatatggaaggacaacaatgaacacatccaccgccacttgccgtggtaaagtgcgtcgtcgatcgccttttctcgccaatgcgtcgatttgctgccattgtggccccctccccctaccccaccctaccatagatggatcttgccaccactgagacggtggtggccgaatctagccgatgccaaccttgtggtggcaggatctggaaggtagtgagctcccaaggaggaggcgaggcgactgatcgaagctaaccgccgaccgcacctttccccacgccagtgtgggccttataggctcgagccgcaactagatccgccaaacagagagaagagtcattggcggatgtggaagggcacaacggggattcggtggagaagcacgttggtggcattggtgcagatctggtggagaaagctcgttggtggcattggcgggatccgatggagaggggatagatggctgtgttggccaaaaagggttgatgtcttcgattccaattaatccttgtcgtttgagtaggggagagcagcaaagaggaggcggaagcagaggcgg

SEQ ID NO: 80200 - DNA, 24105 bp, Oryza sativa
cggcgcgcccgcgccccgatggtcaccgccggcgaccatcggcgcggcggagcggcgcccgagagagcggagagaagggggaaagcgaacggcggtcttcggctcaccccgggacaacgacgacgacgagaacggcggccggagcggaggaaagcggcggcgcggttcgggatgacgatgacgacggtgctccggcggtcggcgggcgaagcggagcggcggacggggtcggcaaccactcggcgaagccgatggaggtggcgccgagtcgggaggaggaccggagcgacgacggcggcgaaacggaggtcggcggcgacggcggagagagaggagcacggcgcgagcacggatccgacggcgagagcgagcggcgagcggcggaaacggaagagcggagctcggggagcaattatatagcaccgagagggggagaacgcggccggagaggaaggaaacgggcgcggggatctcgggctccatagatgtcgccggcgatgaatgcgggaaggaaatcggacgaatccgagggagagagagaggggaaaacgggggaaacgggagagggaatcgcggggaatgattcccccctcattaaggcgcgcggggaaggcgggatgcggcggaatccgcggcggcggcggcgctagggcacgggcgcggcggcgggcgcggcgggaggaaggcgatgacaggtgggccccacccgtcagcgagagtggcgggcgggcccgcctgtcagcggtgcgcgcgcgcggggaggccgatgggccgcgggggaggagagagagagagggagggagaagtgggccgagccggcccaagagggaaggggggggaaaaagaacttcttttagggttttctttttataaaacctttttaactttgtttattccttttcaattattatttgtgctctgaaaattccactaaaatttatttaagcattttaggcttttaggaaatatacaaaaatcctccaagcctcatttgacttttatctttgcccattttaattgttggaggctttcacatgaattttaattattctttgcacaatttcgaggatgaattttagagtcgatttgggacgcgacaaacctaccccccttaaacggaatctcgaccccgagattcggaagaactggcgaagagatcgggatgggctgccttcagttcgtcttcgcgctcccaagtagcttcttcttcggcgtggttgctccactggaccttgcaaaaacggattactcggttcctggtcctgcgctccatggtgtccaggattttcactggcctctccacataggtcaagtcttcgcgaacttcaatttgctctgagtcggcctgctcggatggcactcgaagacatttcttgagttgcgacacatggaacacatcatgcacgttgcccaaggaggcgggcaactccagctggtaagcaacttctccgcgtcgagcgatgatacggaagggacccacataccgaggtgcgagcttcccttttgtctgaaacctgtgcacacctcgcaatggcgtgacccgaagatacacaaagtcatccactgcgaattccagatcacggcgacggttatctgcataacttttctgccgagactgtgccacctttaggttatcccgaatgattctgactttagcttcagcttctctcaggatatcagtcccgaacacttggctttctccaacttggtcccacaatagcggtgtccggcatttgcgcccgtacaacgcttcatagggtgccatttgtatgctggcttggtagctgttattgtaggagaactcggcataggggagactcttatcccaagtcttcccgaagtccaggacacatgcgcgaagcatatcttctaagatctgatttagacgctcggtctgtccatctgtctgcgggtgatacgcggtgctgaaattcaatcgagtacccagctcttcctggagcttcttccaaaagtgagaggtgaattggcttcccctatcagatacgattttcttgggaataccatggagactcacgatcctagcgaagtagagctccgctagtttattccctccataggtggtcttcacaggaatgaatcgagctaccttggttaatcgatccacaattactcatatagaatcatatccaccttgggtttttggaagtccggtgatgaaatccatcccaatttcatcccacttccattctggcacttagagaggctggagaagtccggccggtcgttggtgttctgccttgacacgctggcacacatcacatagagccacaaactctgcaatttcccgcttcatgctaacccaccagtatttctccttcaagtctaagtacatctttgtactgccagggtgaatggaataaggactttcgtgagcttcctgaagtatcagctgtttaagttctctgttatcgggaacgcatacccgctttccgttccataaggttccgtgttcatcctctgtgaaaccagcggctttaccctgtttcatattcttgaggagtccatgcatgtccggatcattcttctgagcctcgcggatttgatcgagcaaggtgggcttggcttctaacgcagccaagaatccgcgaccaactatgcttaggttcagggcttccatctgttgattaagctcgggtggaatgcctcggacgttgagagtgttgcagtggctctttcgacttagagcgtcggcaaccacgttggccttaccaggatgatagtgtattcccacatcataatccttgatgagttctaaccatctcctttgccgaagattcagatccgactgggtgaagatgtatttcaagctcttgtgatcagtatatatttcacagcggttcccaatgagatagtgccgccagatttttagagcatgaaccaccgctgctaactccaagtcatgtgtagggtagttgccttcatgaggtcgtagctggcgtgaggcataggctaccacatgaccgtcctgcatgagcacgcaccccaatccttggcgcgaagcatcacagtacaccatgaaatccttgcgagtatccggcaagattaacactggtgaggaaaccagcttttctttgagagtttggaacgccttctcgcattgcgggctccacacaaatttctcttctttcttcaacaactgtgtcatgggtcgagcgattttggagaagttctcgatgaatctccggtaatatcctgccaaacccaagaaactgcgaatctgagtgactgtcttgggttgcttccaatcggtgacggcggtcactgtttcggggtccacagcaactcctttagcagatattacgtgccccaagaatttgacttcggacaaccagaactcacacttgctgagcttggcatacaattgatgttcccgcaactttcccaacaccagacggagatggtgctgatggtcttcctctgattgtgagtatatcagaatgtcatcgatgaaaaccacaacaaacttgtccaagtattccatgaacactttgttcattaagttcatgaagaaggcaggagcattggtcaagccgaacgacatcaccgtgaattcatacagcccgtatcgcgtggtgaatgcggtcttcggaatatcttcttcccgaatacgtaattggtgatatccggaacgaagatcaatcttggagaatacagtggcacctttaagctggtcgaacagatcatcgatccggggaagagggtacttgtttttgatggtgacttcattgagagctctgtagtcgacgcacatcctcttcgtcttgtctttcttctctacaaaaatcacaggagcaccccaaggggaagtactcggacgtatataccccttttctttcaactcttccaactgtttcttaacttcggccagttcatttgctgccatacggtagggtcgcttgtgcagaggagtggttcctggagcaagatctattcggaactcaatctctcgcttgggcggcataccaggtagttcttccggaaacacgtctccgaactctctgactatggggatttctgacagacctatctgatgcagttctgaacttctgacagaggttgggggtgcaaagaaaacaaccggttgttctggccctcggtacagagtgacagtgcgcctcgcgcaatccactactccttggaattgagccaaccaattcatcccaaggataacatccaaattcttggtgtctagcagaatcagatccgagggaaaaggaatcccctgaatttctataggaacggcagggctataatactttgctgtcataacccctccaggggtggtgatgagcagagggtttctaagcctttctacccccaactgatttttccccacgaatggcacagatataaacgagtgggaagctccagagtcgaacaaaattgtagcagggatggaatggacgaggaacgtaccgacgatgacgtctggagttgtcagcacgtcctcggccgtcacgtgattcacgtgaccccgaatgacatccttcccgccgttgttggagcggggaggcgcttggccttgctgacgccttggctttggacatttatccgcaaagtgtccgggctcgaagcagttgaagcacagacgctgctgaccttgagcgtccctgcggccttgaacgggctgcacagttggcgtaggaggacggggcgcacgagtcccttgctgattctgctgctgctgcggcggtgggacgcgcaccacgaattgaggtcgaggcgcggagcgaggttgctgctgctgctgctgctgctgcgaggaggatccccctgggtagggattggtgtagcggaccctctggttagcaccctgctgattgcggaagttcgccaagcggcgcttgtgcgattccagctccttgtgcttggcctccaagcggatgctcttgtccaccagacgttggaagtccgggtagtccccagagactagacgaacggacagctcagggtccattcctgccaagaacttctcttgcttctcctcatcttcccgcacatcctccggggcataacgggctagattgttgaactcatgcaaatactccatcacggagcggttgccttgcttcaactcccggaattcccttttcttaagagccacgactccagcgggcacatgggttctccggaaagcggcggtgaagcgggcccaagtaatcggctgcccctctggctgcgcagcctggaagtggtcccaccagagagatgcgggtccctgcagctgatgggcggcgaagacgactttctcctcatcactgcactgcaccgtgtctagcttcttccccacggcatgcaaccaatccaacgcatctacgggattgttggagctggagaaggtaggtgggcggatgcggaggaactcggcgagtttagagtgttggggaggtggtggtggagcattctgttgtggcggattttagaggtggtggaggaaagcattcatcatgttggcttgctgggcgaggatttgggtgagaatggcgttggtgtctggtggtggtggtggaggtggattgccttggtggttggggttgctgccctcgggttggttgccttcaccggtgttaacatttctcctggtcgtcaccatctgaaaaccccacacagaaccagcaaacagagaaggagagctgacgattaaaactaaccacccacgactactataattcttgaatttattactgctattaaattggttcattaatgttcaagttgcttaggcaaataaaataagacaggctccgacatagttacaccacacaccggtgtaaccatgccccacacaactcaaaaagacaaacgaggaaaaacacacgcgcaagcctactaactgctcgtctaccgctgcgacgggccagggcggaaggtgagcaacagcgcaccctccgagctaccaacgccggaggcttccccctcctggggaaccacgggcgcaggctcggcacgaggggtctcgacgaagcaagtccacgccagggactgacgaacaagctcgggcctggaggtgctcttgcgggcggtgatcttctggctgcggcagacgcggcgacgcttgaggcggctgtcctctccctgggcgatcttgagctgatgcagctgcgcctccactgcgtcgaggtccttcttgagctgcaggttctcctgacgcagctccaggatcttcaggttgttctccaccatgccacggcgcaccatctgatggaagtcgatacgagccgcgtcgtacgcctccaccatgcgtgccagatgcacgacggtggcgtcatcctccgagctggcgtctcggaaggtggcgtagtcgcgggctcctccgcgacgagggtgatagcggtagggcgagtgctgcaactcgtccgggtagcgctggtgaagggtgccgatggcgaggagagcggcgttctggcaagcggcggggaaggaatccccacccgcggtgactgccagcgaagtccgctcgggagagccggagaggatcactgcagtgacctcccaaccagcgtgaggctctgcatcctcaccctcctgctccgggagcggcctggcctggtaatccactccatgcggataccccaagaccacgcacatgccccgcagctccaagacgaagccagtcatgtccaaaccacgacgggtaacgctgccggccatctacaaacaaaaacaaaaagagaaacaacattttaaaggacagattttgatgataagtgaagcagcaagacaaagagagaatagcgggttttcacaaataataaaggatttttatttttgaaaatattgctaaggcttgggatctacggctcgtcctagggtcaagggaggctctgataccaacttgtcacgaccggaaatcacccaacaggcgttcctgacgtgcgtgtattattccttgtcccaggaggcaaggtacaccaaaagttgatacaattcagagtttaacaagcggaagcgtaaatataattattacacgggcaacaacggcccagcacacaaagacaacgaaaaacagcggaagactagggcgacgaccacaggcgcttgacggcaggcacgagctagacaccaaagccttcatcttcaaggaactcctcatctgggcttggggaaaattgagcaagactgagtacaaccaccgtactcaacaagacacacccacaaatgcagaataaatgcaagggagtacaagggaattataccataaaggggttagggttgcagtaaacagcatttaaagacatttagttgctcaaggctattttgtaaacacgaatctagaactatacaatattattaatcaaggccgtgaacccacacgaacctgccttaacccaaggcctatgatgattcagaccgaactggcaacccgaccctgggtcccagctcgtcccaagccaacccaggccaaccattccatattttagttgttaagcaagttttaagaattaaaacactaacttgggtacattgctcggcttgcccataaccgagggctcggctattcgaatagattatactctgatcagaggtgtacatctttacccacaagacacatcttcctcacgtgtaaccacgtgccacataccaccacggtatacagacgaaagacgtgacatagtttccaacccatcctagccttagacaagagtaccgacccaatcccgcctacggccggaacccccgggacaggcagacggaactgagcccctcgcagcagggcaccaaccctgtgctttttgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatatggccgaggtgctaccatcaaaaccatgcaccccgagcccagcctaaaagcaatttaggggattttgaatagagggggcggtgtgaagccaattccacaataaaccaacaattccagagtatccaggtgatatgaatatttcccaaagtctatagttgtaaaacctcctaaggttacctaattaaattgcgaagcatctacctagaattaaactagtggtgtcatgagtagagagtccactagttgaggttttgtttgcctagggtgaacaaggtaataataataacaataacaataataatatggtcataacaaaggtaagtaggcatggctaaataaaacagtgataacgcgggaatttaaataaagcgataatgcaataatttaaatcaacataattttataaactgggattcaatatgatcaagatgatgtgtcttgccttgctcgttttcccaatcgacggcttcgacttccacgaagagcggatcttccgaagctgcagcgtctacacgaccaacggaaaagaaaaggcttaaacactaaataactccacataacagcagaaacaaagcacaaaaatgggttctttacatcttaaggaaaaattagagacttgaacggtccaattccgagttcaaatggccaagatatggccatttgaagtttatatgctctttaaatggatatttacgaatttcttcatttaaattttaattaaaaatcggattattgcgtcagccgagggggcgggcgtgcggaccgggtccacgggaggtggggcccacgcgtcagccgctcggtccacggtggaccgggcgcacgcggctggcggcggtcggcgccgtgggtcccgcgcgtcagccgcacccgcgggcgcgggcggctgacggccgggcccacttggcagccacgagggcgcgcccgagggcggcctcgccggcacggccgacgggagcggcgcgcccgcgccccgatggtcaccgccggcgaccatcggcgcggcggagcggcgcccgagagagcggagagaagggggaaagcgaacggcggtcttcggctcaccccgggacaacgacgccgacgagaacggcggccggagcggaggaaagcggcggcgcggttcgggatgacgatgacgacggtgctccggcggtcggcgggcgaagcggagcggcggacggggtcggcaaccactcggcgaagccgatggaggtggcgccgagtcgggaggaggaccggagcgacgacggcggcgaaacggaggtcggcggcgacggcggagagagaggagcacggcgcgagcacggatccgacggcgagagcgagcggcgagcggcggaaacggaagagcggagctcggggagcaattatatagcaccgagagggggagaacgcggccggagaggaaggaaacgggcgcggggatctcgggctccatagatgtcgccggcgatgaatgcgggaaggaaatcggacgaatccgagggagagagaggggggaaaacgggggaaacgggagagggaatcgcggggaatgattcccccctcattaaggcgcgcggggaaggcgggatgcggcggaatccgcggcggcggcggcgctagggcacgggcgcggcggcgggcgcggcgggaggaaggcgatgacaggtgggccccacccgtcagcgagagtggcgggcgggcccgcctgtcagcggcgcgcgcgcgcggggaggccgatgggccgcgggggaggagagagagagagggagggagaagtgggccgagccggcccaagagggaagggggggggaaaagaacttcttttagggttttctttttataaaacctttttaactttgtttattccttttcaattattatttgtgctctgaaaattccactaaaatttatttaagcattttaggcttttaggaaatatacaaaaatcctccaagcctcatttgacttttatctttgcccattttaattgttggaggctttcacatgaattttaattattctttgcacaatttcgaggatgaattttagagtcgatttgggacgcgacatgaatggagtataaagtatcatgagcttctttcagaattgcatcctttaaatctttgttgtcggggacacagattctctcacccaaccatacagttccgtgctcatcctccaagaaaccaatagcttttcctcttctcatattcttcttgatctcttgaatatcaggatcattaatttgggcttctctaacttgatcaattagagtgggcttcgcttctaaggctgcaactgacggagctcgtggctcctcaccgggagaccgcacaggccccccctttgccggttcggccgggggcttagggtgagatctcaagctctcgctgtatgtggaaagatcgcgtgccaggaagaaacgcgagacacggacgatgtatacaggttcgggccgctgggaagcgtaataccctactcctgtgttttggtggatttgtgtgtggaggagctacaaagtgtgagccgatctatcccttgctctaggctctaaatctggaaaaaatccatcctcctctccctatgggcaaggtcctccttttatactttaaggggataccacatgcactcttccctttccaaactggacttttcttctttacataaatggacggagatttgcacggttgccctccgaacgtccttctgatgggacggcccatacctacctccacttctgccgggggcaggcgcgtcgtgggaacgtggctatgcgctgacgacatgagcagtgtcagaccggtcacaaatcggtcattcttgtccaccgcgtgtcagcttagcaacgtgcatgtttgcccttcttcacacaacatcttgcctgtaatggttaggatgaagcctggtattcatctaaccagggctaacgtgtcatctctaagaggtaacacgctagctccggctggagacgcgtgcctagaggctctcgtcttgacgggacggggcgaggcgtgcgccaggccgccagtcgccacctaaccgttgatctgaccggtctgtgactggtcacagaccggataaaagagtgcgctgcattgcgctgcatgctgcatgacacgcttgaccagatcgcaataaatgcggttaggtgagccctaccgtgttcacccaacctatgtacataatgcaaaccccacaaggggtcggggcacctcggccctcggagctggggcaggagcaacccgacccccccccctcggggaaatcaggaggagggcggacacctcaccctcgggcccgacgtccccgaaggtgccaggccacgtgggcgattccatctgcctcaagcctccgggcgcaatactcccggtcccatatcaccgacagcaacgaaacctctaccgacaattcccaaatttaatctttcaaattccttgcataattccaatggcaactgtcgtccttctgtagcattgcaatagccttttctgctaagagcgtctgctacaacattagccttccccggatgataatgaattcccatgtcataatccttaattaattccaaccatctccgttgtctcatgttcagatccggctgagtaaagatatactttaaactcttgtgatcggtgtacacttctgtacgagtaccgaaaagataatgacgccaaatcttcaatgcatgaacgactgcagctaactcaatatcatgagtagggtagttcttctcatgcggacgtaactgtcgagaggcataggcaaccaccttcccatcttgcatcagaacacaacctaacccaagtttggatgcatcacaatacacttggaaacccttctttggatcaggcaaaatcaaaataggagctgatattaagcgacttttcaattcttgaaaactctgttcacattcttccgaccacttgtacttcacatctttctgaagcagtcgtgtcatgggcttagcaatcttggaaaaattctatataaacctccgataatatcctgcaaggcctaggaaactgcgaatctctgaaactgtctttggttgcttccaattggttacggattccacgttactaggatcgacggcaactcctccggctgagatgacgtgaccaagaaatttcacttcggacaaccaaaattcacacttgctaaacttagcatacagttgatgttctcgtagcttctccaatgcaaggcgaagatgttcctcatgctcttctttggttcgagagtagataagaatatcatcaataaagaccaccacgaacttgtctaagtattccataaacaccttattcatcaagttcatgaagaaagcaggggcattggtaagtccaaaagacataacagtacattcgaacaacccatacctagtggtaaaagctgtcttaggtatatcttcctctttgattctcaactgatgataccctgatcgaagatctatcttggagaaaacagtggcacctttaagctgatcaaacaaatcatcaatcctgggtagtggatacttattcttgatagtcacatcgtttagtgcacgatagtccacacacattctctgagtatgatctttcttttccacaaaaataaccggagctccccatggtgatgaactcggtctgatgtatcctttctgtagcaaatcatctacttgcctcttaacttctgccaactcattggctgccattcgataaggtctcttatggatcggagttgttccaggtaccaaatctattctgaactctatatcccttttaggcggcataccaggtaaatcatctgggaacacatcaggatactcccggactataggaatctcttccaaagttatctggttcagtcttgaccttaaagactcagatgacaatgcatgaacagttacaactcgaccatcatagctgttgagagttacttttctgttggcacagtctatcacacctttatgtctggctaaccagtccatccctaggatgacatcaaggtctttggattttaacaagataagattggccagaaatggtactccttgaatttctattctgacagaggggctacgttgcaaagagagtgcttgattatttccttggtttgctgattctgaaattgctgcatcatcatgttcataagctgtgtctgttgagcaagaacttgggccagagtgggattctctccattgttgttgttattggggttgttgggaccattcccattgctacgagtgttcaccatctggcatggacagggcacaagaagagaaaccggggaaactacttaggacagagaattactttaacttttattgatcttaactgagtttcattattacaaactaaagactctcacaccactaaactcaccaacttcctaacactcaaaagcaaacaaacacatgcaattacatcccaccactgatgtaaatcacatgcgagccacacacaagcaaacttaaagcaaaccaactaacacaacgatctaagacaacgacttaacaagtcactctagttcttccaagcatcggaggtcgattgaaggctcgtttttatcatcttgagttgctacccactcaatcttggaattgttgtgcttagattcttcttcttcatcactacttatgatgatgaccgaaggatccgcttgagctggggcaacttccttctccaccacacgaacctttggcgccaattgatagcgagggacaaatagagctctcttccttgcggtaagacgaatcctggccttctgcggcggtgcttctcccttcaatgcggctaattccttctccaaacgatccaccttgtcttctaacttgcaaatcttaccacgattccggtcttcacgatcttgagctgctaatacagtctccgcacgactttcatccatagcccacaacatctcaaccaaatgtttcgtggtaacatcattctcaattccttcagtctcaaggtaactgccacggtcacttccctggggttggcgaggatggtagcgatactcaatgtcggccaactgatcactgtagcgatcacggagctctcctatggcgatccttgccacctcctgacatgcatggatgtagtttcttcctccagcttcaaacatcactgaggggacctcttcactattactgttcaaagtgactttgactcggcacttctcttcatgacgatcatgaggaatctgggcataaaaaggggcagtcccaaatccaatgacaaaggacatcgtgcgcaactcctggacaaaaccctcaacaccaaacaggtactcaggcttgtaacgcggcatctaaagacaagtgaaaggagggagttaagacctttatccaattaatagcacaagtttttggattaatttgaataaagttagaaaatcagagtaaaaaggtaagtaaataaagtaaaccaagctttgcgagataagttaaaatagttggaaacgaggtcacaaattttgtaattttgaataactggtttcaaaagaaatgaaagaaaatgataaaatcaacatgataaatttattttattgcagcaagattaaataaaacagtattataaaacttttgctggtaaaatgagccattagtacagtaatagatgtacagtactaataacactggaataaattttgaatgagaaccattaaaagagattatgaagtgcatgtgccattagtttggtttaattaaaagagaaagggaggagaacagttctacttttccaatatttttcagagggcttctatgggtaaccatttggcataacctagggtcaaagaggctctgataccaacttgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttgagaatttaacaaaacagttaagtaataattaaacaatattaatccaacgctatacaacataccctgttgtataggcccaaccattctgaacaaccaccccggctgcacagttctatctccaaaccaggaatgtcccattccaaaccaggagctaatcaaattattaccagtttaagcatcttttacaatgatgagaggtgtgagactaatcacgaaagacattgttagacccgcccataaccgcgggcacggctattcgaatagttttactctggccagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaactgaaactcgtgaaccggtccttaattgtcatgagcacgaccatcaaaaccatgtgcccacaacccaccattatcaggttttagttggcacattaattaattaactaatcacgattgaccatcgtgaactatcaataagccatcatgaaataatagtgagtcattagttatcccataaatgtactaatgtttctaagcagggctaagcaattatatctaatatctagttgaaccaatataaataaagctcaactagtcaaattaatataacccaaggtatcaaggaataaggtaatcaagtacgaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttccgcgaaaacggactctccagaaacgacggaatctaagcaaaaagaagcaaaatcaccaaaacagcacataaacaagcatgaacagtacatgtggatatttttaatgtgtaaatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaagaaggattattgcgtcagcggctagggtttcggtggaccggcgcacgggcggcggttcacgcgaacggacggccgagatctaaccgatccaagatggacggccgagattgatcgagtccacggcggttcacggcggacgaccccgatggcgtcagcgatgacgtcaccgacggcggcggcggctcggcggagcggacggctcgggcggcgcacgctcaccggcgaacggcggcgctacggcacgaacggaggacaccaacgggaagcggacgacacggcgaacacaccgacgaccaaaacgacggcggagaagcaacggacggcgacggcgacgagaaggaagcggcggctaccttcgggttgtcgacggcgacgaagctccggcgggttccaacggctgcgaaggggcggacgaggacggcggcgacttggcgatgacgacggcggtcttcccgagcggcggcgacagctggagcgacggcggagcatggctgaagcggcggcggcgacggcgaagctagggcacatggcgctaaggctcttccggcgacgagaggcgaaggcgagggctgcgacgggtagaggagacaccgggggtccttttaaaggggctcggaggcggcggcgaaggcccacggcgacggcaacggcgaaggaaaccttcggcttggagagagggaaaaccgatccgaatcgaactcgattccaaagctttccaaagcgatttaaccaaagattccaaaggagaaaatgtagaggagatcccggagatcatttcccctctattgattcggccggagaaggaaagaggcggccggatttggaaaggaaacggcggcggcgcgaactagggtttcggcggcgacggccgaaggtagacgacgactccgacaggcgggacccacctgtcagcgacagcgaggccgcgcgcgcgcggctgactgggccggctgggccgaggagagagagaagagaggttttgggccgactttcggcccaaagccaaaagaagactttttaaaaccttttcaatttaaattatttcttaaatgcaattccatttattacaaatactttcttagctcaaataaatcccagaaaaatctaggaattatagaattaagcaaagtatttaatgaaattttatctggcccaattttatattggaatttattaattaaacttagattttcttttcaagacttttaaaattatttctaaaaattccaattaaacaacaatttatatattttgaattttcagggtgtgacatctagcgatcccctaccccctccccctccgccccaagcttctcccttggatccggcggtggcgacgtcggcggcacccgcggacggatctaactgagaggatctgcccgacatcgccgccgtcccctcgcggccggatctgccggtgttgttggttgtgtatgggttgtttctatttttttttatgtgatgatgatgtcgttgccgtgattgattttggggtttttatgagaggagacctctcattgattacgatttggatttggattgaaattgagattttgtttttgggtaggattgtgatgatgtgggatttgaagaggaggtgcgcgacggaagaaaaatcgcggtatggacgaaaaatcgttgtgacgtcgtcatcttattttggatttttttttatgattccgatttagatttggattggaattttgaaaagtttttatttggattgggatggtttgagattttagagagaaggtgtgctcaatgtgggtctatttgtgtgatacggaatttcgactgggatttgggggggggggctgacgggacgaaaaatcaccgcatgcacgaggtgacgaaaggaaaaatacgaatatttatattagttaagatacagtagataggtagtgtggagattatgggtaccccatacccacacggcatggttatccgactagtaataggggataacatatatctatggaatatgtaaccgatcatgacttgggtattacgtttccttttatattatggagcggcctaaagtcctgattcgataatattgtaaaatagatttaggaaaccgataccgtattggttaaggtttctatcttgtaatcctgccccccatcctatataaggtgggcaggaggccctctagggggcatgagacaacctgatcgtcagatcaatacacactcggcggattcaaatccccaaacaggagtagggtattacctctcattgagagggcctgaacctgtctaaatcctttgtctctgcatccatccactttaggtctcgtccgctacccccttttattattgccgaattcatgtttcgacagttggcgcgccaggtaggggttgcgtcgagtttcctatcaacgagcgcgatggaatcaatttcatgagtcgccgacttcgctttcgctttgggagttttcacttcctttccgtcgaccacttcttcaagctcctcttctctgacttgatccaaatcagtcagggggaaactcaatctgatttttatcattatttatcatattgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgccggcctgcctccgtcgccgccgactggtgtcatcgcctatacggttggtcggtcacaccaccgttcatgggcgtccatgtcttcaccgaccggctggccttcgccgccgccgactggtgtttccgcctgcacggctggcctattatgccgccgctgttgggcgtctacgacttcaccaccggcctgcctccgtcgccgccgagtggtgcccccgcctatacggtcggttggtcacaccaccgttgatgggcatcgtcatctacaccgccggcctgcctccgtcgccgccgactggtgtccccgcctatacggtcggttggtcacaccaccgttgatgggcatcgtcatctacaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgttgttggatgtctacatcctcaccgccggcttgcctccgtcgccgccgagtggtgcctccgcctacacggctggcctattatgccgccgctgttgggcgtctacgacttcaccgccggcctgcctccgtcgccgccgagtggagcctccgcctacacggctggtctattatgccgccgctgttgggcgtctacgacttcaccgccggcctgcctccgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattactcggaagaaatcaaaagcatagagataatataatttattttctgctcttaataattgcaaaagtacctgagtagtaaattctgatccgtgaaactttgttccattaatgacgaactcatgtcactcatatgcatgtttgggaagtgcttaggccgactcccagtgcttggtggctatgactagttgggcagagcgtttaaacgtaatgagtcatctgctcggggaaatcaaaattgacaagaggagaaatacatgtttataaatattttaaaatacttgattttttctcgagtattatatttatatcagatactactcatcctatatgtttgttctgcaggatccagatccagatatgcataaaagggattcatggctttaggcttatctcttacgctccaggaatggatcagtcagaacatcaccgactggcttgccttcgccgctgccgactggtgtttccgcctgcacggctggcctttatgccgccattgttgggcgtctacgtcttcaccgaccggcttgccttcgacgccgccgactggtgtttccgcctgcacggctggcctttatgccgccgttgttgggcgtctacgtcttcaccgaccggccgcctcgtccgccgccgactggtgcttccgcctgcacggctagcctattatgccgccgttgttgggcgtctacgtcttcaccgaccggcttgccttcgccgccgccgactggtgcttccgcctgcacggctggcctttatgccgccgttgttgggcgtctacgtcttcaccgaccggcttgccttcgccgctgccgactggtgcttccgcctgcacggctggcctttatgccgccgttgttgggcgtctacgtcttcaccgaccggcttgccttcgccgctgccgactggtgcttccgcctgcacggctggcctttatgccgccgttgttgggcgtctacgtcttcaccgaccggccgccgcatccgccgctgactggtgtcaccgcctgcacggctggcctgttataacgccaactgatgctatcttcttcacggctggctacatcgctgtcactactaataggcatcagtatcttcaacacaagctgcctacgtttgccatggctgccgactggtgtttccgcctgcacgctggcctattatgccaccgttgatgggcgtctacgtcttcaccgaccggcttgccttcgccgccgccgactggtgtctccgtctgcacggctggcctattatgccgtcgttgttgggcgtctacgactccaccaccggcctgcctccatcgtcgccgactggtgtttccgcctgcacgctggcctattatgccatcgttgatgggcgtctacgtcttcaccgaccggcttgccttcgccgccgccgactggtgtctccgtctgcacggctggcctattatgctgtcgttgttgggcgtctacgactccaccaccggcctgcctccatcgccgccgactggtgtttccgtctgcacggctggcctattatgccgccgttgttgggcgtctacgtcttcatcggccggccgcctcgtccgtcaccgactgatgtttccgcctgcacggctggcctattatgccgccgttgttgggcatctacatcttaatcgccggtcgtctcgtctgttgctgactagtgcccttacctctacgtctggtttatacagctaccactactgatggacatcatcatcttccgtcgccgactgattatgccgccgccgactggtgcttttatcttcacaactgcgcgtcttcactaccagtttgcttctgttgccgacgactcgtgttcacttcatcacggcaatgcaactttgtcatcatggtagagcgacttcatctttattatcttcggcactggcaaactctattgctgctacttcgcaagttttgctacttcaccaaccacgacgtctttgtgagcctcgacatctcggcatgcgatgccatgttattttactacaacaagaggctctccaatattcaggatttctacttggacatcttcaacacatatcttcaatcaagcaatgactacttgacgacaagaagctataattctcgactctatgttcagttgtttcccaactaaccaaagagtcgggggctacacaaatacaaggctcaaaatttgacaaattttatgtcaagctgaagaaatcaattcatcaaccaacgagtcaacttcaggagtcattatcttcatctttgattcagagcagacattctacttcaacaacttcaaatatttcggtttagacgagttgggcaacaacatcaactctcctccaattatttgtcttcacggttggcctactacgcaaccgccgatagaggatctcatcgttatcatcggctgctacatcgctattgactggatcaccgacatcgccatcttcatcaacatcttgtcaagcctcatcaacatagcctactctgctgccgttgatgggaaacttcatcatcatagtcggctatctctattgccgctaatcatcattaccgtcggatgcgtttgtcgccgccgattattttcttcatcttcatgattggtggatttcgccatcaccgttgatgcgtgtctacgtcttcatcgtcggtttgcttttgtcactaccgactgttctttcgttgttgttgggcgcctacatcttcactgctagctgacctgactgttgccgactggtttcttcgcctccatggttatgcaacttcattacatttgattggtggcatctttactaccactgacatcttccgttacttctgatgagcaatttcgtcttcatgttggtcatttcatctccatgccgactgcgtcagctattgccaatagacaattttgactatgacagaaggacaagctatatgctcaggagctcatcaactcaagcgtgaggattatatctctaatttggacttgttccggatacatgcaacatgaatttatgatcatgggtctattttctatgctcaaagactggactatttattattccccgtaagggttatcaaccgaatacttgcgccagtcgggattcaatttttatatctattttggagtatcccataagggataatcactcagatcacatggtctatatcacccgggagcatgttacatgcgtcatcctttaaagggtatcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctgactttttaatatagtcatggtgctgtttgggtttttaagcaattgattggatacaatatcgttgctttttgccacgtaagtgtgcatttttattgaccaatattatggcttaggctgattatatattgtggtcatttttctaggcggttggtaaatcctttatgagtttatttactcggattttacaccacatatgccatatatttccaggtgtggtgaaaccatgtgtcttttagggactaaagcacgtctgttaaagcagtgtgcgcatggcgtatgcccaatactttggaaatt

SEQ ID NO: 80201 - DNA, 15224 bp, Oryza sativa
  unsure (1)..(15224): unsure at all n locations
cgaaaaaattccaaaaaatctcaaatttcgccctataaatagggcatgaaccccagccatttctcctcatcccacactcctcatcttgtgctctcaagtgttttaagtgctctctttgttctcaagtgtgcattttttttgattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaatggatccgaactttccataccagtcgccgtcgttcaccttgggtgatttcgaccccaactacatgtcggggtttgacggtacctccggatcggctccaactccaccatctgtggaggaggtaccggttcatacggctgtcgttgaggaggtaccggttcaggcggagacagcttcggaaggattttccggaaccgcgagcggaagtgtttcgacacacaccggctcgaagagatcgagaacctccggtgtgtggcaaagcttcgacgagataaaggaaacatgccccgatggaagggaggtatcgaaagcccgttgtagaatatgtaggcaaattttatctgctcgttcttctggtggtacaggtcacctcaagcgccatgcggagtcgtgtgccaagaagcaaggaatacaactccggcagcagcaacttatggtaaacccagacggtacggtacgcagttgggagtacgatcccatggttgctcgagaatctcttgtccggttaatcgccaggcaagatttacccctgaactttggggagtcccctgcttttgaacattacattcagcaatctcataaccctaggtttaaagctgtgagtaggcaaacatcaactagagatttagagaatgtttatcacaaggaagcaactgcacttaaggaactgtttagtacatgtactttctctgttagtgttacttcagatatatggagtagtagagctagagaggattatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgctgtcaccctagataatgcatctgctaattctagggctattgaaatattgcaacctttattttgtgtgtatgctcaatcttttctactccatcagcgctgtgcatgtcatataattaatttgattgttaagactggcatgaagagggtaggtgaccacatcgatgctgttcgtcaagcaatcgcgtggttaactgcttctaacccgcggattgctgcatggaagaggttttgcaatgcggccggtgtgaaagctcgtaagtttgccaccgatgcagagcatcggtggaatgcaacgtatttaatgttaaaagttgttttaccttatagtagtttactttctgattttgttcagtcacgtggtggcccaagaaacagtgacgggtcttcagtactgaacgagcatgtttgggcaattgtccaaaaattttaccaatttctagaaactttttatgattgtactctaactttgtcacaagtttattatccaactgctaatataattttgcacaaccttcttgaaattgctactttatttaaagaatacgaaaatgatgatgttctaactgaacctgtctttcacatgaaacaaaaatatttgaaatattggaaaaatatacctatgttgtatgctcttgcttttgttttaaatcctaggtgtaaattaaggggattgtctgctattttatcacttgttggagatactataggtgtagattatagttctttttatactgaggttagacgtaaattatatgaggtttttggaagatatgaagtaaagtttcaggaagttcgccagcagagaccccctcctatccccactacaggtaagaagaagatacagtggggtaggatttggggtggatcgtcttcaagttcaatccaaggtggtggcagttcgtcggctacaagtggagacgcctcttcgcatgttgtggccgaagagttgtccggttatttggacagcgacgccatccaccacgaagcacaagatttcaacgtcctcgggtggtggaatgaccacaagataacatatcctgtgcttttaaaactagcacgggatgtgttgacggtgcccgtgtcgacggtgtcctccgaatcggccttcagtctatgcggccgaatcatcgaagaccggaggacgactctgcgcagcgaccacgtcgaaatgctactaagcgttaaagactgggagcttgctcgacaacatgcccaatacactgcggacaaccaagaattggccgcccagttcgagcaactctacctggatccagaccaaccccagtagaattttgttagaagtagttctgacctttgagctgtactcttttctttgtcatggttttctcattttcccctatgagtttttacatgacaaagtttttaacgaggcagcatgtatcattgtatcctgtaatgatataaacatcaataaaggtcattactatttttaacaaattcttttgcaatattttcgcaagtgtggatttatctttaaattatttcaaaataatgaatcacaatctatatttttaaatttttcaacacaacaaaaaaaataccattttttcttttttttaacattagcaaatcattacttttttaaaaaacttttatttccattttttaaataccattttttcattttttaacattagtaaatcattactttttttaaacattttatttccatttttaatttttttttccttatacatttcctttgcttttttttttaaaaaaaacactgtgcactgcaggctggcgggctggcggcctgccttcacgggccgccgtgccccgaacggcccgtgggccgcgggcgtgccgtgccggcacgggcacggcccggccatccacgggccgtgcttgggccagcggctcggcacgtgggccggcacggcacgcccgtttcatcagccgtgcctaacgggccgtgccgaaacgggccgtgccggaaccgtgcccgtgccgggccgggccgtgccgcccgtttggacacctataatcggctcggttggcatcttcttcccccattgctgccctggttgccggcttcacctccgccgcgtctcctcccctctccgcctctccgctctctccttgctccgttgctctcgccaccacaaccaccatgggtccatggctacagccaaacctaggtcgtcgtcactcttgcctggccccgcctccggcatcgccgctcctccatcctgctcccggcaactaccaatagccgcgcagacagcagcgaaccaaccctagggtagtcacttcaaggaccggaggaagttggatggtatgtgatctgcttcttctctgtgttattgctgcttttgtcttggattatttcggttggatatcatccgatatatgcacacagagttttggaatcattccccaatttaacaaccaaacaggtatatttagtatttaatcctagattttatttccatatacatccatataggtacatttgaatttgaattatatttagaaaatcagaatcttcggggatgcgaattggattttgtgggaaatggggccaacaagtttatttttaccatgtcatggtgagaaatcattttatgatgataatcagaggttagggcaaacctgcacttaagcgcgccctgtgtaaattgcagcctaatatattcattcatcttatagcaagctacatttctcaacagccatttacacaacatcgacatttagatgacaggcccaaaacaaaatatggacattagattaaaaattatagactcaagaattttgaagcagttggtaagtggagacttcacaatcagaaatggatgacagaaaaataaacttcaaatcgttaatgaccacaccaaaacaccaaattccttgtcgcgagaattgcacgccgtccgagtggatggaaaaacaagaaagcaacggtgccccaaaacgccaggacgaatgaggcagcactgactgcatagagcactggatcatctgccatactgtctcttccttccgatggcaagtcacctgctcctgaatctggagagcatatgtttccctttgacatactccgaagattactgttgccttggtagctatccataccgtacgtgccgaactgaccagagtttggaatacatcctgataagttgttatatgccacagagaacaccgctaatgacgataatttggtcagctgccatggaatcaatccactcagttcattgtgggaaaggtccaagctttcaatctcgctcatgtttgcaaagcttgctgggatttgaccagtgaagaaattgttggacaggttgagggatttgatatggctcagattcccaagctcccatggaatttctcctgacagcatattcccggataagtcgataccagacatcagatcgaagaagttgtaaccatatgtatattgtcccccttttgtagcaaaggtgaagtctattgggtcatgaacaattatgtaagcctctattataacataaataagtagcaatggtgaataattttgagctgccgtatcactctcacaagagatgttgccaacacatggtggcagtgagcctgagagtttgttgtgtgagaagtcgattatccttgggcactttagtttacacaagtttggagtgatttggccttcaaagtcattccatcccaatgaaagtgtcttgattttatcaagatgccgtaaccaattgaggttaccagtcaacttattatgtctcatatccaaatacataagatttgatgtgttgaaaagatcatccgagatgtttcctgataatgaattcccatacagattaagcgaacttagagatgcactggcacatcttggtatagatcctgataagttgttgtttgaaagatctaaaatttcaatgcttgccaagctgcaaattttttgagggatactgccagttatatggttcccagaaagatctagtacctgcaatttagacagattccaaaatgaggtgtcaagttcaccggacaggctgttatcatgcaaatccatgattactagtgctcctgacagattacgaggcagtgttccttcaaatttgttgttctgtaggtgcattgcaaacccgatggacagttttttcatcccaccaaacaccagacctccaagctggttgtttgaggcactcaaggtccacagctcaagaaaatcagtgaacacacaagtcggcattttaccagaaaaattattgtttgataagctcaagtccttcatgtgtttgatgctgcacagtgacatcggaatttctccatgaaagttattgtctgacaaatccagagtggacaagcttggaaatattgcgctgaagttggcaggtagcttccctgtaatacggttggtagatataacaatagattgtagagctgtttgggggtgccatatgggacttagagatccagttagcgagttatttccaaggtttaggttaaccagagttgcttcttttgtaaaaagccaattcggcattcttcctgacaagttattgtttgacaagtcaagctcctgcaaatgatgttgtgtgcgtagaaagtgtggttctgcaattatgcctttgtcaagaccacaaccagagagagctaactgtttcagttggaatggaggtgcccatccaggaatattgacatcaactgctaaattaatattccctgacaagttgatttcttcaagtttagtgaggttcctcagccaaaaaaatgagagtttaccactcagattgttctgggaaaaccgaagacctttgagagacagagaaagatttgaagatggagttatagggataggtccttcaaaagtatttcccgagagatccaatcgttcaatatgtggaagtgaaagcaagaaagtagaaatgtttccagtgaagttattggaactcaaatgcaattctcgtaggttccttagatatccgaatgctgcgcaaagtatgaatacaatgaatcagttataatcagcatcatagaaaatcttgcccagatgttatgatcaagcatgaaatgtccattatttttacctcgttcggttggaagagctccactcatcctgttgttgttgagatttaatacttgtagtgaaactggctccaaagatgaattaattggagtacgtcctgctaacgaacttcctgagggatcaaggtgaggtagttcaagtaatgaccccggaaggcttccgctgaatccgttggcactcaaattcagctccttcagattcgtaagattttttaaaactgcaatagtgttacaaatataacagcacatgtacaagatgttacaaatataatcatcacatgtacaagatgctaattctttactgaactatgttcattctaaatatccatttctgtacctgcagtgggaacaactccactcatggcgttggagctggcatctaggacttcaagcgaaaccagttccccaagatctgcgaggatactctcttgcaaccagttataactgaggttgagatgctgtagcttgggcagcttcagccctaccaagctgatgatagtttgtctgaaaatattagtcattgcaaaagcaaggagcaatcttggttattcaggatggacactgtgcacataccatcgatatttagagaactgggatagatactggacagatccaggaactgaagctccgggaatgaggagaagaccgtcgtgttgaaacgccaaaacgagtcaccatgtgcatttagcacttccagagaatcatacaggtttgagaagtagagatgtgatactcgcccagtgatgttgctgcatttgacgcgctcccacaagcagcagtcgtcgtcaccgtcgccgcgcccccatgatggcggcaccgtgccgtttgagcgcgtcagagaggagccaatgtccatcagcgccgtcctctcctccacgaagcagccatgggacgtggagatattggaatctagcaagcatagcacaaccaagaagaagaagaagaagaatctcatcctgaaataaactccgtcttctcctgcgctcatctctagcaggctggagacacctgaggatgatcgatcagtggtggattactactagattgcgtggttttatcatgctgctgcatttgtcctgtttccatgaactttcatgggtacacacggctggtgaagcaacttttgattggaccaggttttcctggtcgtacccggtccgtgacttttgtgagttgacacgcgacgaccctgtagctagctttgtggttttaaagttttgcagtctgggattctggaaggacaagtgggagtgtgggacagcaggaacgcggagatctcatgatgagattatctgctttcgtcgataactgaaattttaaggccaagttgggagtcaccggagctgatccccctttcttctcccgtggtgtacgggctggtcgacgtcgttaatttcactttgggattttattgtcaaagtttcactttggactaggtaactttacctttgttgcacaatgaagcaccccaaaccacatcttcagttcttcgatgactttgagcgaattgttactgacgtgctagtaaattttcatgtctaaatgcttgctatacctttatcgaaagaacgctagacatcactagcgtaaagagttatggtggtttattgtgcaacaaagataaagttgtctagtccaaagtgaaaagattgtgtatagagtgatccaaagtgaaactttggcaataaaacatggctcaaagtgcaattcactcttttatttttttggttctgggtcaccttcgcgttgcgtgccctcagcatctgagtttagggtttgtttgaaaagcttctagcatctatacctttttctagaatcagaaactctcttaggctgcgttctttccacaagtttcccaacccctttccctcgttttccgcgtgcacacttttcaaactgctaaatggtgtgtttttttgcaaaaagtttctatacgaaagttgctttaaaaaaacaaattaatccatttttgaaaaaaaattaactaatacttaattaatcacatgctaatggaccgctccgttttccgtgcggtggagttgggttcccaaccccaagtatcaaacacagccttaaaccgttcaactttttcttcagtttttgagaagttgtagttataagaaatctagcttctctaaattctcagaaactgtttaccaaccaattgttttttagaattttaagcttcttaaattgagctttagagattgaatgtagcattgcattatacattctccgtcctaggaaaagatcatttatgtcttttttgtttatcccaaaataaatttattttaagtaattattatattagatttcgtgaaaaatagataaagtaataaataactgcattaagatttggtgaagtatgcggtattttagttttgttttctaaattcgtgttgatatgtgtaagacgagcgaaaaaataaacttacttcgatacggaggaagcaacttgagcagatgcaaagcccgatcgcatacagtcaagtcgcaactcgcacgtcgcgtccgtaacggcgcctggaagcagcttcgtcttggtgcattctgccaacaacttgacgataaccgggacctcatagttgaagccgggaacgtcgagctcgatggcgtccgcgacggagcctgcaagcaacttgtacagtcatctgtacatcccattcccaccaacaacttacctggcacggtcctgcaaaatctccaaaagaaatttttggcccaatcttctgtttcccccggccttttgggagcttcttctgtgattgacttggggccggttaccagtggcagcaatcaggctggacctgccacaacgcctcctcggcccatgaaagcttccttttccaagagcaaagttgtaacatcaaccggaccggacgaacaggtcctgccatgcgattccagcaaaggacgcaaagatgcaagcatctcaagtccgatggcgaaaacgacagcgaatagcgtgtgaaaataggttgagaggtttgatgagcattggtgaagccgattggtatggtttgcgttgcgctgacaccagactgatttatttgcatcaatgatatcaggtatgctctagtggtccttttaagattggtttgatgaagtggttgaagattatgacgatttttgtccgtcctcataccgtcgtacgtatgcttgcccattttctagtgtgagcaattgtttttcttgatgctgtatcttagacttattaaacaagctactgcagggagggtgcttggtgtgtttagttcacgtcaaaactggaagtttggttgaaattagaacgatgtgacggaaaagttggaagtttatgtgtgtgtaggaaagttttgatgtgatggaaaagttggaagtttaaaactaaggctgtgtttagttccttctaaaattaaaagtttgggttgaaattggtacaatgtgactgaaaaattgtatgtgtatgacatgttgatgtgatggaaaaaattgaaagtttggatccaaagtttggacctaaacacaccctaaattcggtctcaaccagtttggactttggagtggcacatcacctcaactagagccaactctgcacctcgaaatatcaggcgagaacttacctgtcaataatcaggcaggattcctatctgttgatttgttatccaggctatgtttagattgaggcaaagtttgaattttggttgaaattaaagatgatgtgactganaagttgtgtgtgtatgacaagttgatgtgatgaaaaaggactgaagtttggatccaaacacaaccccggtagccatgcgctcctctgaacttgcaaaaaaagaggagaaaatctgcaactgaggctgtgtttagatccaaagtttggacccaaacttcagtcttttttcatcaaattaacctgtcatacacacataatttttcagtcacattatctctaatttcaaccaaaatccaaacgatctcccaagtttcggatcgtgaacggagaacccgtgccgcatgctgacccttgactttgactgacagtgaccgatccactaattaggcaatttcccgctgtcaagtatgctacttatgattatctcctactatctcgtgtttatgaaacactgaccaatttgactgtaacatgtgaacaggggaaaaaaagagatgcgtcatgcgtatagggataagtagtctaagaggaattgtacaacggataatacgaacgacacgttgcgtgtgccggctctctggcttggagcacaacaccacaattactcgtgagcaagttactacttgtacctgttgtcgcgatccatggagactagtaaggcgtccatgtgatgtcattgttgatgggcaagtgcctgtgccaatcaggacacccaaattgcctgtcaatgcacatgcgtcccaactctcccaagtctccacttgagatggcgtcctcagttcgtcattattaggataagattgtccgggagtccctattcacacccagcaaatcggcgattacacgaactaatctatcattatctctagccgtcagggctttaatactctccatgattgtccgcgcggttcgccagcagcagcagcaacaacccccgcaaaattcccagattttgtgggacgcgcacgcgaaaaactccttccaatcgaagaggatagagagcagtgtggtggagacgtggagtggacaaggaaatgggcattgacttccacgcccaccttgttgcctccgctgcggcgtcgttgcctcgcctcccccaccaatcggatcggcgcgtcgcctataaaatttcctcccaactcctaactgcccactccgatttgacgccatctgctcgtctgcctcctccccgatttcctctcctctctctctctccctctctccatccctcccggcgtccaatctgttctgcttctcgctgcgcccccggaattgtggtgaggttttgtgagggtgtgggggaggaggaggatggcggaggaggtgtatgtcgcgtcgatcgaccagggcacgacgagcacgcggttcatcgtctacgaccgccacgccaagcccgtcgcgtcgcatcagctcgagttcaagcagcactacccggaggctgggtaagtgtgctgaactgctaattagtgatgctctttacaacgatgtgatatttcgggtggagattggcattagcatgggattattatgtgatctgtgtgatggattctggggctgaatgtactgctcgattggttgacctggatggaattgaggtgctgttagttttaaatatgctacctttttgtggtggttgtgattcattttgttttgtttgtggaggttcatagtagtagtactgttaattgcttgttgctgtatcaggttttccattgccgtttattttgatggcttaattgtcaaattaggattataatatgtgatgccagaaataggatattttgctctcctttatttattttttgcacatatctctataattttctagtgctagataataaccagaaatgcacacccttatggccttttatgtttcacaacaaagctcctttcctcctcctttgaacgattgagatttaagctatatagtgccaaacaaattcggaatatgataaggataggttcatatttttctacatgattatcatgttaagtgttgcttgctttcttactgagttaatggagtcgcaaaagtctagtcttcttgattttgagctatcatctggggacaggggtacttaaatctatggtgcgttaaggatcaagctctttatctgcttgagtaatttgtttccttgacaattgatctgtgaccatcataacttgtgctttgaaatttgacttctcaatgctgtattcatggagatgtctgattagcctgagttactttaaatctattaaaattttaataattaccttgatgcattttaaggggggcaacttctttattgtccacatgagtatacatttcttgcatgaatagtagaaaatttagaatcctgttctgttgttttgttgatttgtgcaaggagaaaccgaccaaactgaggcgtgccttatgctgtgacattctattgtctctgtttctggtcagtggtcagactcactgtagcatgttctctttagtgccacatatatgtgcgatgcactgaaaaattcgtcttgaatttttgttgatgtttgataccactttactttgccttttagagacaacttatgattttgctttacttatttgtgagttgtgactctgtctgctggtatgaattaacagatgggttgagcatgatcctatggagattatggagagtgtgaagatatgcatggcgaaggcacttgacaaagctgcagctgatggtcataatatggatgttggactgaaggccattggtattacaaatcagagggaaaccactgttatgtggagcaaatccacaggccttcctctatacaatgccattgtatggatggatgctcgcacaagccccatttgcaggtcttccctttgtccatcatgtttgacatatcagtgttatatagtgcagttttctcataatgtttgacctttcaggagattggaaagtgatctttctggtggtagaacccactttgtcgagacatgtggattgccaatcagtacctatttcagtgctttgaaggtgttatggttgatcgaaaatgtggatgccgtcaagaatgcagtccgagctggtgatgccttatttggcacaattgacacctggttaatctggaacctcacaggaggcattggcgggacagatcgtgatggaaataaagtatttgggcaccatgtcacagactgctccaatgcatctcgcacaatgcttatgaacctgaaggcacttgactgggacaaaccaacacttgagacgttaggaattcctgctgagatattgcccaaaattatcagtaactcggagagaattggtgtggttgccaatgggtttcccttggcgggcgtccctattgctgggtgcctaggagaccagcatgctgcaatgcttgggcagctgtgccagaaaggtgaagccaaaagcacctacggaactggtgccttcattcttctcaacacaggggaggagcctacccaatcctcccatggtcttcttagcacgattgcttataagcttggcccaagcgcacccactaattatgctctagaaggctccatcgcaattgctggtgccgcagttcagtggttgagagacagccttggaatcattagcacagcagctgatattgaaaagttggctgatactgtgcaggattcaggtggaatatactttgttccagcattcaatgggttgtttgcaccatggtggagggatgatgcaagaggcatatgtataggaatcacacggttcactaacaaggggcacattgctcgagcagtgctcgagagtatgtgctttcaggtgaatgatgtcctcagctccatgcacaaggatgctggggaggcaggagaagtgaagagtgcagaaggggagttcctgctgcgcgttgatggtggtgctactgtcaacaatcttctcatgcagatccaggtaataatccttctcacgagatttaaaaagaataataaatactctgctagcttttccattggaacagtggaacatttactatcacgcagatgcgaaatttctgggttgatgagcaactacgtttaagagtaaaataattcaaataggttatcaacgttgatgttaccaccacctgaaatgttcatgcttatagttgtgcttttgacttggtgaaaatgaatgaaatgcaagatgttggctctttgtgtccctctttctatttaaggttaaccaaagcaccaattgttaccttttgcacataatgacctcttacttctgtgagtcatacttgacatgattgcagccacatctgtacagcactatgctatcaatctcaaacaggaaaaaaatatataagtactgtcttcatctgtaaacaaaacagtagtgctatgaactgttatttcaaaattcactatcttattgataactgatctttggctaatttacttatatcctcctacagtacagcttactgaaattagaagcttgagctaattagttaaatcctcttatagtattgcttactgaaattgtcttgaaaaacaatctttttaaatgcactgggtgtaattgtagctgtagcttagtgaaacgtttctctttgcaattgtaaaatctctccaaattcccataagatcactgattttgcatgcacacctgcaggctgatttattgggtagccctgttgtcagacctgctgacatcgagacaactgcccttggagctgcgtatgcagctggattagctgttggagtctggtcgaaggaacaaattttcgctggtttgcacaaggagaacaccagagtcttccgcccgaaattggatgaggcccacaggaggaagagagcagactcctggtacaaggccgtttcaagatcatttgatttggctgacctttctctttagaatgacgagggatttgtgaattacttctggattgtataaggtgcttagcacttgttatgtccatgaataagttggtcaatggaacatccttcaaaagaattagttgattccccacgctttgctgctggaattattaagtaattttcaatatacttttttaacaattgagataggagtaaaaagaaaaaataatgaaatgtcagtgtttattcagtacttatcctgaaacaaacaaatgatgcctgcgctttaatgtggaacatgttgatgagtatatgttaaatattataaaaatgatagatagatttattaaaatattgtaaaaatgatgtaagagatgattggatatgtttgtatgttgatttgtaaaattaaatagattatagatgatattgcatattttcatgaggttaaatatttaattattgctagtgggtgatgatgtagaatggttgtatgtt

SEQ ID NO: 80202 - DNA, 27885 bp, Oryza sativa
ctctaccggtgatcacgcattcaggatcaacatagcctggtgtcccagagacggcggtcatcgtctgcatccccacggcatggtcgatgaaccttgcaagcccgaagtcgcctagcttggcattgaattactcatccagcatgacattgctcggcttgatgtcacggtgcacgacacactgttcccactcctcatggagatagaatagtgctgatccaagcccaagaacaatcttaaccctgtgacaagttaagaccaagttagctgagtttaacacgccaattaatttaacatcacaaaggaagtttagatgaagttaaagagaacaggtactaacctcatcggccatgttaggaaggtgccattgccatggaggtgaatgtcgaggctgcggttggggacgagttcatagatgagtaggagctcgtcgcggccatggcaccagccaatgagctgcaccagattgcggtggcgcaaccggcttatcaccttgatctccgacctatactctttcttcccttgcttggaggaatccttagcaaacctcttaatggcgacggcgaggccctgctctctcaggtatcccctgtacacggcaccgaagccgccttgcccaagcttctcctccgccgcaaagctgttcgtcgcctcgatgaggtcttggtatgggatttgccttggccccatgcccatctcgatctccacgatgggctcaccgtcatcgtcatcatcgtcatctctggccaaccctacgtgtctcgcctcctctgcctcttctacctcccttctcttcttgctccgacgtcgccgcacaaggacaactaccatggcaaagaggagcacgacgaacagtgctgcaccaacggtggctccagctataactccggcaagtccggaacctgaggtggtcggggaatgttgcaccgccggtggtggattctgctggaacgaggagttgaagtaccaagaatgcagctgatggagctcaagggataagcccgtcgccgccaagatgccgacggagaccttctccggcaaggcgctcttgagatcgacggtggtgctaaggttgtaaagtgtagtcgagccattcgtccatgtcttcaccagctgggccgacaggatgctcgagctgctgttgtagtcgacaatggcggtcatgttcccggtgaggctgaagctgggcagcgactcggtctgcaccgatctgatggagttgacgtcgatgccgatgtggtcgtaggttgcgttggggtcgaagtcgcggtttagataagtgtcgaattcgacggcgacgaaccggttctcgccgggctggacggtgtcaaagtaccggctggtgaggccgagggcgccaccgtcgcccttgtccggcatccttgacgggtagccgacgaggaagaaggccatcccgtcgcccttgttgtccaaattcgtcggagtgatgttgaaggagaagcgcgtggtgaagctggcaacctcgccggtggcggcgtcccagagctgcaccggcggcgtgtacgccacgcgtcccatggtgccgctgctcggcaggttgcttccggtggtgatctcgatgcaccccccgccggcgaacgccgcgctgccctggagggtgatgttcttcgcgttgctgaaggtggagtagttgaaagataccgtggtagcgacgacgctaggcaagcagcgcagcatgacgagcaagcaggctagagcagaagcggcagccatgaacggttttgtcatgaggacgccggcggccatggccggtctttgagcagaatcagcggccggacaatactgccaatacgaaaactactactcgaagaatcagcaggtcgccactcggagagaccagtcaagatcttaaggacatagcgagttagcgtagtgagaagaactctactaatttaacaagttggtgccttggtggttggcaaatcaattaggctccatgagaccatgactctgacaactctggttcctcggaaagtgctgtatcatattttgtatattttcctaataattttaaatgaagttaagagtaagtttcgtttcttgttggtatcttcaattttcttctgatacattttcaagaatgataaaacatcaagctggtttataaaaaaaaaggtgaagctttggacattggcataggccctgcagattgagtgcaaatttttcgtcttttttcaccaaattttataaaaaaaattataaaatttagctgctcctcttacttgatcaaatatccaaagatagatgatctgaaatcttgatggtatgttaactagggctacgttcgggaggttgaattccacggaaaatggggttgtccattagcacgtgattaattaagtattagtcttaaaaacttgaaaaataaattaatatgatttttttaatgtaacttttctatagaaaacttttataaaacacacaccgtttagcagtttggaaaacatgtgcataaaaaacgagagagtagaagttagagaaagttggtagcgtgggtaccagacttgctgtggtagtgtggtggcatcagttttttattattattattttcatgcaggtagtgtgggtaccagactactcccctcagtactaaaatttaagtattcttaaatacttttaaattggaaggttttgattggttaaaaatagaaaataggtgtataaattttagaagtttatgatttgttaaaaatagaaagtaggtatagaaattcaatgagagattgttattattcactgtaatgagaagataaagaagaaataactatattttttaagataaatttaaactctaaaagtaattatactactcatccggacaaataatactggtcgttttgaacacaaatgagaatataagatcaaactttaaaatctttatctataataatttctaaaatatttatcttagaaatatggagattatatgtatagagtagtcttaaaaagtattttaataatatcatttatttgttattgttttcatatatattataataaaaaataatgtttaaagttgttttctagatgttgtagtattgtctcgaattggagggacgagccaatatgttgatttgatatatgcgagtggcactggcacacattcgagttggaaatgcataaatgcatgtgcgtgaacagaagaagataccgccgtgcttctttggttctttgacgtaacttgtttttggcttacgcttacccccacttgccttactttctggatgtcagttttatcgaaagagatgcgggcaacttaactaaacccactggttagtactatacactgttgggtataccctctttgctcccggtttacaacctctttagtcccgggttacaaactgggactctgaaagcaggactaaagatatctatcttttgtctcggttgaaataactgggactaaagattcaccaaccaggactaaaggtcttctctttttctttttttcattgttttttattttgctaattgccgacattcccaaatccccacatcaaattgacgtcacagatcgaatgaacatactaaacaacaaaatcatccacaaattcacaaatcatctaaaaaaccacaaaatcacaaatcgtccgccgtcaatggcggcaacatctcctctggcgccgcccgctgttgacggtcgttatcgatcaatttcgcccgtcaatattaccggaataaaaggagaactagtcatgcttacaatgcatatagtgttagaataaaataaaatccactattacttggtttactaacctcttgtagagaataagcaataaatggagaagaataggcatcaaaacactcgatcgatcaatcagacgatgccgagaatcagacttaaaggaagatgggctgaaaatatcaatttcagaagacccaaaatgcccaaaattcataagtctgcggagagatgaagtcagggaggccgcaggataaaaggtgggctggttgggccggcctgaggtaaccctcctcatcgccgttggatgcagcgctttgggggaacaacttagattagcccccaatgatggttggagggtatttccgaccattccaaccatcacaatcgtcattgggaggctatataaacccctcaccctctcactttctccacacacttcaagcaacaaagctctcatattctctcaagttagtttagtgctctcaagctagtggagtcggaataaaattgtagtcaaagtccggaagtcttcggaagagttcgggtatggctctagtagctttactttcttcttttgtaagactagtatttaatttagaatatacttttgtatacgactctggtattgtaatactctccaattatatgaatacaagctttacaatgtctgagatattatgattatactgctagcttatctgggagatgcattggtacgggtataatgtttgcatatgaaattactctatgtcatgacgatgatactagagtagtatctggtagtttaggcatggtatctagattactcggtatcattatttggggttatatgctgcggatgagaggtgggccgctgatggcgacagctcagtatgggtattcctccgcgcgtgtatatagtcctaagttaattccctggggagggtactcctccgtatttagccctggttgaatggttatgacgggctgtcgtaaggaactcagctgtcaggggtggcttctcaaagtaccaggagggcatcggaaagggggtattagctagttaatcatatacctaggatgtatgtataatatgtatactagaagtatagaaatagattcttttctatactctttccacttagcttaggagatttaatataagaatgagtagcttatgcttgtgtgtcattctaccctgcaattatatttacccctgcttagacatgattaatacaagtaacatataaatattagtttggttctctctattataatcttcccatgggataaacaaatatgatacccttggaatactctcgggtgaaatgctacaatggtatatccatgcgcttgtggataaactctgtaaccataatataccatgactatttttggcgccattgctgggaattatatttctagtaatgtcgttaagaaataccaacaagcatttctagcgccgttcccggggaagatttgtaaaaagagattactaaaactaatatcttatatttacctctatataatcactgtgctttgcaggctaaccatgttgttttcaccttttgttgtgaaaacagggtagtgcatgacaggtttcgacttgccggaaaattttcaagaaaatccagaagtcttcttccgaagcgtaaagccgcgggttgttcccccgcagaagactcttccgacaaagaagccagccgtaccagcgccaccaactttcaagactatggctgacaagaccctccgcgagttcgctgctccctcctctgagaacgtggccactgggccgcaactcaacatgggagacgtggactttgacctgaaatccagcctcattacgatggcgcaggctagcccattctgcggcaagcctaacgaggatgctaatgcacatatgcaatggttcctggagatctgcagcacgtacaccgtaaagggcgtcagtcctgacgtcgtcaggctgcggctgtttccgttttccctcctcgggaaagcgaagcagtggttttatgccaatcgtgccgtgatcaatacctgggacaaatgctcgatagtattcttgtcgaagttctttccgatgggcaagacaaatgcccttcgtgggagaatttcgagcttccagcagacacgtgatgagtccattccagaggcatgggaacgtctgcaggagtacgtggccgcctgtcctcatcatgagatggacgactggctgatcctgtagaacttttataatggactcactcccacgtcccgtgaccacctagacgcggcagctggaggagcctttttctctaagacggtcagaggggccgtcgatctgatagagaaaatggtctctaatatggggtggagcgaggtacgactctagtcccatcagcaaggaatgcacaccgtcaaggagacggaaatgttcactgcaaaactcgacctcctcatgaagagattggacgaacacgagaagaagccccaaggcaccgtcaaggccttggactcacacgttacgtgtgaagtctgtggcaacacgggtcactctgggaacgactgcccgaaaacccatgaggaggtgatgtacatgggtaacaacaacaataacaacaatgggtatcacccacaaggaggtcaggggtgaaaccatccccgtccgtatttccaaggaggcaataaccaaggtagcttttctaatctgtcttccttaaaggatcttgtctttgcgcaagccaaaactaccgacgcactcaacaaaaagatggctgccaatgacaagatcttagaaaatataaatgtgaaactagatggctttgcttccgcatttcaaaaccagttgagtttcaataagatgattgaaacccagttggcgcaacttgccgctctagtacttgcaaatgaaactggaaggatcccggggcaacccaaaccctccattgaaaatgttaaggtgatcacgacgaggggaggtaagtccactcgcgatccgccatatcctaacactgcaggtacaagcaacacgcgggaagcaccatccaacacaacggctgaagaagaaattcagccagagaagaccgtgccgcaagactactgcaacgcgaggttgctgccattcccatagaggatcaggaaaccgtcagttgacgaatagttcgctcgattcgttgaggtgatctagaaaatccacatcaacatgccgttgttggatgctatgcaagtgccaacgtacgcacgttatctcaaggacatcctcaacaacaagcgaccactaccaacaaccgaggtggtcaagctgacggaggaatgcagcaacgtgatcctccacaaactcccggagaagaagaaggatccgaaggatccgaggtgtcccacaattacttgctcaattgggacatagaaattcgacctggcgctctgcgatcttggggcaagtgtaagtgtcatgcccaaggatgtctttgacaagctcaacttcacggtgttgacaccaacaccgatgcgccttcaattggctgactcatcggttcactacctagctgggatagcggaagacgtaccggtcaagatacgagattgctttatcccggtcgacttcgtggtgctagacatagacactggcaaggagacaccgctcatcctggggcgtccgttcctgagcactgcggaagcaaacattgatgtcggaacgggaagtatccgtttccgcatcaacgggaaggaggagaagttcgagttccagccaaggacggaacaatgctccatgttccgaataaagtacgggccagccccgtagaacattcagacggtcgaagtggagccacccaaaatggatagcctcatcgtgtttatgaagaaatctctagaaattcaaccatccaggatgaggtcccgttattggaaaacgccggtaaaacccaagacaccggccaagaaggaagaaaagctggctcagaagaagccgccgcccataccaagaacaaagaaggtatggcgtgcgaagcagaaaacgcccactccatcacctccggagacgggtgaaaaatccgtgaaatgaacgtcggaggtacggtcttgcacgtcggacttgaagcgacgccgccctcgccaataggtaaattggtatgtatcctcatatttgttttcatcaatttgatttctgcaacaaagcatgtttgaatttttttaaagaaattgcatttaggtttgaattttgtggcaattattcaaattgaatttttcagagcaaaatggaatcaaattttaaatcaaaattttcagtgtcacgaccacactgatcgatcttgtagattgttgaactctggagcaccatcatcctcccgtttgagtccttcagctttgacttccttaagtttatcatcattagcagagcttgactcaggcttctcatcaaccggtggcaaatccaccttgtgtctttgaattactgtacccgaacgagtcagaacaaatgaatgtaagtaccgattttgcagttgatttatcatcccttcaaacccttgcttctgttctgatgttagcatgtccatggttattggaatcacattgtctggatccacctcggtagacttgatgtccaccatgatggaagcttgtcacactcgtgtcccaccgggcgtgccaaaagcatgttgatgcgaaaaacacacactggcctgagagatctgcttaactctagtgcaggtccaaatcttggtttcgagttcaaaggcatgctagttggtttgatcctgcaaccaacaagaaacaaagaaagaaacacagttaaattcataaacgatagccgatcggccatgtgccgatgacgtatcgtttgtaatctagccgatgtaacgtgaattagatcggtaatgatatgtaaagaaaaaaggacggttagatctagtcgatcggctgtagatattaacaacatataatcagtatatcaaaatatgttgaaaccatgtgactgggatagatcggacaacttgtcgagacagtataaatcacttatgtctaaaagtacttcaatataaagattatatatgtttatagcatagccgatgttgcagatctgacatgtatcggctaatactccgataccactttatactgagatatcaatatagacaaaatatattaaacagagatcaatcaagtattaagatgacttaacagattaataacgtgcttaatatatttaattagagtgagatcttaatataaagggcagacttagcatattaagtaaacataaagtagacaaaataaccaaatcaggtaagatcggttgaaactccgatgaaaccctaatcggcaatcaataaacaggctagagattactattctaatcacaacttataagctcaaacttaactaatgcagcaatgagtatgaaaagaagaacaatatctagataatcaagtcattgattgattcctaggatggtggatatactatataatctaagtcaacgttggtatttaaccctatcggttgccttccaacaagagatgtttgccaattctaggttagatagcaatattgatctagattatataggaaatatgataaattgacaacttacataaacaagattaaagtatcattgagatgaaagcactaatcccgagaacacaagccgccataacaagttttaccttatcatcggagatcgaaccgatgcagcccaactcgaaagcaagaactcgtcgaaagtaaacgaaagtgaaaggttggcgaagcagcccaacacgggttgggctacttttatacccaacccaaagtacataatatgcccttgtcagacacgactcctaactctattacaacttaggatacgaacaagtccctaaggcagactcttaccaactcaaactgtaagtaaattacataaaatatctaattaatagatacaattgcttttttcagactcaatacgcacgtggcaatcctcatgaagcatatcaacccgatccgacaatgattgcaatgccatcttgtcggaatcgacttcatcggctaccttgtccgactcgaactctgccgatgcataccttagccgattcgatctccagccgatgcgcactctgtttccgaaaccatcaacctccttcgattccgcttcggttttaatctctatctccgatccatgatttaccaaatttggtccttaacaccgacaccgacctcgacattgttggtgatcgggagctacaagcctaccacatgctgaaggaccgggagttcggccacaccagggcgtatgatccagaacttctaagaaaaacaggtatggatgttgattttcacgctgttagcagagatttgtagtagtagatgagccaggttctcgtttgcttactatacaatttctgtgcactttgaaagaaacagaagatagcatatccttttgttttttccataaggagtatacactttcatggaaaggattaagcacacttcttggttttcacgataactgtaaaatcgatcttcggaaaggaatttccgggttcgagaaaaacagattttgggaagacatttctggtgctccaacttgcagaaaacctaggacaaatgacatccataatcctacacttaggcttatgcacaaatggattgctatgactttgtttccttgaggtgatcttagacccattcggggagatgagttgattatcatgtttgccaaggttaggaagactaaagttgctcctgttaaatatatgattaggcaatggttagaaagtattaagtataatgcccctgttgagtgcacttccttgatcacccgcatagcgaacggacatggagttatcaccactgatcaaatcgagtatatcttcactgtccatccctatgtggatgaaacatatttaatgcaagggcatatacttaagcatggagccgatggctctttgatatactttttcccctgtacaaatgaaatcccgttacccaatgcggggtatcatttgtacaactgtcaggaactaaccattcccctgcagaccatagaagaatctcgtgcaggtacatcctacagggaaacacgcaacaaaccaaggcaaaaacacgaggagtcatcatcatcaacacccatgcagatgtacgaggcggactgggaaccaacgggggatgcacccggttggacccaagcaccacgacacaacacaggaggttcgtcctagcacagtgccagtgagaaccgctggcaagcaccgcgtgaagtacactgggggaacgcgcacacctgttcctctggatcaagcgggatgcctcccgcctccaactgttggcgctcaagttcctcccaggacttgggtgaaatcacgaggaggctagacacccttgatatgcagacaggagagatccagtactacctcgatggacacatcgttcagacgcaagaatggtaggaaaatgctaatgctcagttcgttaacatcaacaatctgatgcaacaacagcaggctgatcttcaagcgtaccttcgcttccaagggttcaatccctaccagggaccctgagcgaaagataagcttggggggagacatctccccccactgaggtaacttgtatcacattgcatattttccttttccattgcatatttacatttccacattgcatcctataaaccaaaaaaaatgacataaaaatttgcaaaatagaaaataccaaaaatataggttagattttattatgctaggtaagacaagtagttctcttgattgaaatgatgaatagttgcactgttttatatctcttatatatggattcacggttaagtaatatctcaaagattaaataaaagtggccacatattatccgggaacctgaggtaagtgggctgcacttgctgaactaagtctaggttgttgtgagatatgagatagtgataagagctgctatgatcctgttctaagtttgacttaaattttggatgttttattttctaaaatgataaacttagaagttcatcatttgatataaattcctaccagagccaaaaatattcatattgacaaaccatatatatttttggcacttgtacttccattgaactttgtcaaatttttgagacttgtgtagatacttttcatgctctatgatcaagatcatacacccacatatatgcacatgcgaacttttgcactagaagttagcatccatccattccatttatatctatcatgttaccacccaaataaagctctctaattatatgctttctcctcccaaaataatatcctttccaaaaagaaagaaaagagggaaagacatggttatgaaaataaattcttgctcctcaaaatattgagcatgataaaaaaaatatagccatgccccctcctaaaaagaaatgaaggattttttagagaagaaagaaagcacaaagtagaagtattttctttattttttcacattccatttccaccatatatcacacactttatgtacgatcttgatcttgagtatgtctagtcatatgctctagtctaagtttttgacttaataataaatgtgaatacaggtatgccatgtttgatccctaccaagctccacatactaaaccttagagtaggaatcaacaaggttactttggtgaggaattcatatttatacactttgagtgatcgagaggatcatttgaggaacttagatttcttttgaaaaatcatttgaaaactttcggaataaaaagttgaataaagattgggtgactagtgctcatcattgctgttctgtctttcaaccgctcagggcaaggtaaagcaatgtctcgcgggaatcaggtgtaagggtaagccacgtgataaaattatttgatttgagagagagtacatataccttgcacttgtacatttgagaatatacagcatagtagcaactcctgatcaataaccaagttttgtttcctttcgtcctttactcgggacgagcaaaggttcaagcttggggtgttttgttgatggtcgttatcgatcagtttcgcccgtcaatattaccggaataaaaggagagctagtcatgcttgcaatgcatatagtgttagaataaaataaaatccactagtacttggtttactaacctcttgcagagaataagcaataaatggagaagaatcggcatcaaaacactcgatcgatcaatcagacgatgccgagaatcagacttaaaggaagatgggctgaaaatatcaatttcagaagacccaaaaagcccaaaattcacaaatctgcagagagaagaagtcagggaagccgccaggcaaaaagtgggctggttgggctagcccgaggttcggccgaaccctcctcatcgtcgttggatgcagggcttttggggaacggcttagattagcccccaatgacggttggagggtatttccgaccattccaaccgtcacaaccgtcattggttggctatataaactcctcaccctctcacacacttcaagcaacaaagatctcatattctctcaagttagtttagtgctctcaagctagtggagtaggaatagaatagtagtcggaatccaaaagtcttcggaagagttcgggtatggctctagcagctttactttctcttttgtaagactagtatttaatttagaatatacttttgtatacgactctagtattgtaatactctcctattatatgactaccagctttacaatatgtccgagatattatgattatactgctagcttatctgggagatgcattggtacgggtataatgtttgcatatgcaattattctatgtcatgacgatgatattagagtagtatctggaagtttaggcgtggtgtctagattactgggtatcattatttggggttatatgctgcggatgagaggtgggccgctgatggcgacagctcagtatgggtattcgtccgcacgtgtatatagtcctaagttaattccttggggagggtactcctccgtatttagccccagttgtatagtcatgacgagctgtcgtaaggaactcggcagtcaagggtggcttctcaaagtaccacgagggcatcggaaaggaggtattagctagttaatcatatacctaggatgtatactagaagtataggaatatattcttttctatattctttccacttagcttaggaggtttaatataaaaatgagtagcttatgcttgtgtgtcattctaccctgcaattatatttatccctgcttagacatcattaatacaagtaacatataaatattagtttggttctctctattataatcttcccacgggataaacaaatacgatacccttggaatactctcgggtgaaaatgctacaatggtatatccgtgcgcttgcggataaactctgtaatcataatataccatgactatttctggcaccattgctgggaattatatttctagtaatgtcgttaagaaataccaacacgtactgtcggccggcgacggcggcgacacgaggagaatctccacgctcggcttggcgatgaggtgggaaggagggggaacttgatctacgccggcagcgatgaccagtcgaggcagagagccaagacgcagcagctgaggtccgcggatgaagctgctcggtgggaaatcccgaggtgcgggaggaagaagcagcggctggcgacagggtcgcagacacagaggtcggagggcgccgcctgccgccggccaccgctgtcgtcgtcgctcacccgcgcgtgacggaggacgatgaggccaccgcgcaacgtcacgggctcatagccatctccgtcttcaccacctccgactccatgctccgatctccacgcctcgcctaggtgagaggggaggaggggggtggaggagaggataggaggatgcgacggagataagacgcgacacggggtaggagaagaagaagataaggacgagggagagaaagagagacatcagagataattaagacgcgatgcggctctctccctccccgtgcgcttttttcaattttagtctcggttgtaccaactaggattaaagtgctgtgttactaaccaggattaaagatcctgggcggcctgacaaaagacaaaccgggaataaaaataatctttagtcccggttggtgttacctaccgggaataaagataaaaaagtttcgctgggcttctgatatgtatgttctgcataagtgtgtgtattttgcttttaagtgctcaataatgaaaccgatagtttcgaatttttgaaattggtaattacaatatcataggtatatagaataaaatataatactttttatcccttactttctatttccttatgttaatacacacttcgaaattacggaatataaatgttttttattaaataatatgaagctttaaattaataatactgagttgtacttgttatggtgtcttacttttagtatttttcttgataaaggatttctgaatttaggattgataaaaataaaatattgtacatggatcggggtccagattttaagttttcatggtgttgtctaagaagacaacagtgcatttataagtgtacacaaagaaagtaaatatatttattaatccttaaaaactctcacttacatatattttctcttggaggtgtctatttatagccttagattagctttgaacattttatatttgtcagttaaaccagccatctatgctgccaaaaaacctaatttaacccggctttgcacgttggatgtccatatttattggaaagatgagaacatcaagtggacttatttccattgggggtaggcatgtagatcaggcttttcctagcggttgtggcccagcccaacttcattctgtaggccatggcccatgaagaggatggcggccacctcttcaattgtaatgggccgatcgtttaattcgcttccagtaatcctcttggccgaacgttcagggtctgtttggttgcctgcaccaaggttggcccgcaccggtccatgcaaattcgtggtgttttggttgcctgctcgggcctcccagcctgtccatgcggatgcaaaaataccccctcagccaggcacggcagaaacggtcaattcccacttcgctgcttggcctggctcgaccgatgtgcaccgcttcacccgcgcctgcacccacgcgtgcaactcgcgggatggggtcaccactgcttccccagaatcgctccctccctgcctcacttctccctctcgtgaaaaaaaactagggttcaacctaggctttggcagcggcgcggcgctgctcttctcgtcactccggccataagcggcagccctctcccccgattctggctctccttcatctgttccgaggtcgtctcacttcctgcccccgcgtcggtccttcccctcgtttgccagttctctccgtcgtgcctgttgttccactgtcactctctgtcgagcagcagggtaagtgcattgatggctatccatcgcccattgcaaggttgggcatcctcttccctgtccctccttccccagttttttcttctctatttggttgatttgctgttatttgagtggatgagagtatggggccttcataaatctgctagatctagtaaaagcttatacattttcctagttgactttggtagatttaaatattgaaaccgtgtcaatggctagatgaatattagttcaatgtcaacgtgtattgttggtatcctttttagctgttcattttctttcagatctactgttttttcagtttcatacagattaatattagttcaatgtcagagcaaactttgggtgcttatttgttttttatggtgtgctgttgtgttacacttttggctgtgcaccttattttgccgattgtgttttgtctgagtaaatatccatggtcgatgatggtatgccactggatgtatacatacatactcaggttgtgctccttaggatgttgtgtttatgtttcttggtccaattatcttttatatgaattacggagtacaaggtccatggattggctatgctgttaagcatatacttctaaatctctgcataagttacatttcagtctttgtaatataatcagatgttgacatccactgactaatttagtcaagcttggaagaacaaaggtaagtacatggaactgaaaatggccacttggagatgacagctccatactcagtcgttgtggctgccatttgatttcccagttccatctggaagaaacaaccagcaaaaaaggaggctagcaggaagcagcagaaaatactaagcatgatcaattttcccatcatagcatttctgtttagagcatgtatatctttttttttttgggttcataggacaaatttcagaaagcagagcattgcaatatcagaaattaggcttattccttttgtttgacctcctgtgttgtttgatatttaattttctaggcaataccattctagtagtactgagctgtgatgcataagaacatacttatatacacttgtcattttaccagattgcagatatataaggctgttgagtttaaagatgtctgtaaaaggattgtaataagtatgtacttgtataacaattggttcagttttgtataacatcgatgtaattttatatactcaaataccaaaatgtttgatctgttccttgtgaacaacttcctgtatgcacgtttgtttcctcaatgctgcttaccgattcttacaaaaattaccaaccgaagaaaatagacgtgtatgccaatattctaagtaatttagctcacaaataatagtagccaaagaccaaataaaattttaacacaacctcacggagtaacctcactacacagatgtaaactttatgagggtaacctcaccactcacaagagagggtatttacacctaagatgtatccatccaaccaaacaacatctcctgcatgcaaccattccaccaatcctttgctgcaaccaaccaaacatcatctcagcatatccaggttcatcggatgcgggtaatcaaacagctgcatatgtatccttttagccagaccaaactcagcctggatagaagagatgagccagactaagagaatacgagcaaccaaacgcacccttaatgctgctgcagccactatctctgcccgtctccctcactcgacttccgctgctgctggaacagaaaatggctggacaattctttgtagacaaattataacggcagtaaagttcaaatccctgccgtatcaatcagtatatataaggcaatcttcttgccttcattatctatctattatattattaagacagctcaaaaaaaagacaccacgttcgctgtggaggctagaaattatcacattaatcgaagaaaaagaaaaaatctacaccgctagatcatgatagatttatattttaaccgttgagattgatcagaatagtataagtaagaaaggatacatgacaaatcctactcaaactatgtaaaaaaaaaatactatacagcaaaacaaaaattctattcggactgtaatggcccaaccggacagagggctgagtcaacgtttcttttgtttccagaaacttataaaaaaaaaggaaaatcaatatgtttccttggcacttaccgcatagacgtgtcagctaacaatcaaactcactctgccaaccaatgcaccctttccttgcacagcagcagcgggtgatttagtcagccacgcgcacgcacacgatgtcatttaaaggcaagtttagtatgatcaaaattttgttaagtaagaagtttaattgttttgttggtcgtagattgaaagacaaaaatatattcccaatttttctttttttgagataattttgtggttaaagaatactataaatttcaaatattacataatgaggtatagaaattatcaagacatcaagatcaaggtcagtatttggcagcctgccaatgttcgatcatcaattcttgaccatattctatctaagaattaattcacatttgcaggactaaaaatgccacatttaatcaaaagaaaacaaacatattgccaagggacggcaaataaggcggcatgcaacgacggcttacaggaattctaaaaaaattataaaaaatgaaatcatatcaataatatggattgattttttagtcttaccggtgtagtgagagatgacaaagaagagaagcaatgggcaggcgagcgtacgcaaataaatgagataggaggcaattgccataggagggcatgccgagggtggtaaagtaaataaaaataataattataagagttcaagtaggaatacaatttataaatgaaagaaatatcacaatgagaaatattgatttttgaaaaaatagtccacacagaacacaacaatgacaaattataataaagatgagagaattaatagacccacaaaaaaatagagtggtgtaggtagatgggatatctaaaaactataaacaaaacctcacatagaatttcaatgataattaagaggagggacgatgagcaggtcgttaagcagcactgtctcgacgattggcgggatttctagaaagtaaaaaaaacttcaatcataatcatgttcgatttttaaatctcaacgataataaaaatgggaagcagcgggcgaaccatagaggagtacagtggcggcgtttggcgagacttctaaaaattataaaaacgaaacccaacgatacaatgaactctaaaaccacaaggtcaaatttgtaaaggttccaaaaagaatgaatgaaaacagtggtagattgagcaagcaaataaagcgatgacaaagaaataaggcgtagtgattggcgtgactattaaaaacaccggcatgataaagtcagtctttcaaagttctaacataacgagatagttatttaacaaatttaagtaaaaccatacgtaaaaaatagataattttatatgggtgctagccgcgcaattgcgcgggccaccagctagtttttttgaaaaaggaagttcaaaccatcgcgtaaatacacatacattactcacatcggcaattaggcaacactaaagaccaaatcaacggaccattcaaccgtaaactctaaactaagaacaaacaaattaaaaaaaacaaaaactaaacgctaggactgatgcttgagcaatgaagacgagtccttcaaaccggttgaatcggacggaaccgacgaacacgaggtgtgagtagcatggccactcgtcgtcgatgtggacgaggactgcgtcacacctgaggacgacgacaaccctgtagatgacgcaaagagcccatccaatgagatcaccggcggcgcgtacgtcggcacgggcatcttggccggtagcaccggcagctagcctccactcgattggagtatggccatggcgtctctaatagaaggtcgcgcgctcggatcagggtgcgcgcaccagagcccgagaacgatgacacgctccatctctgtaacatcgtagtcatcgttgagacgcacgtcgacaaccttgagaacatctcccttgccatacagatcccaagcccactcgaccagccgaaagacgccatccgtttggctgtctagtaggctcatcggtttcctcccgcatgccacctctagcaggacgatgccaaagctataaacgtcagactttacgcttgctctgccggtgatcaagcattcagggtcaacatagcctggtgtcccggacactgcagtcattgtccgcatccccacagtgtggtcaatgaaccttgcgagcccaaagtcgcctagcttggcattgaagaactcgtcaagcatgacattgctcggcttgatatcacggtgcacaacacattgcccccactcctcatgaaggtagaagagggctgatccaatcccaagaacaatcttgaccctgtaaaaaataagttagctaatctattaagtttaatttaacaatatatgttaattaatacggtcacaaagattgagatagaactagcgagggttgataacctcattggccatgtgaggaaggtgccattgccgtggagatggatgtcaagactacggttggggacaagctcgtaaataagcaggagttcatcgcggccatggcaccagcctatgagctgcacgagattgcggtggcgtagtcggcttatcaccttgatctccgacttatactccttcctcccttgcttggaggaatctttggcgaagcgtttaatggcgacggcgaggccctgttctctcaggtagcctcggtacaccgcgccaaagccgccttgcccgagcttctcttccgccgcgaagctcttggtggcctcaacgagctcatagtatgggaaccgtcttggcccagtccccatctcgatctccacgatgggctcgccgtcgtcgtctaagctgtccgagcttatgtcctgctcatcctctgcctctttcctgtttttgattcgacgtcgccgtatgaggatagctgcaacagtgaagagcagcacaacgaacaacgtcgccccgacggttgctcccgcttcaactacggcacgtacatgcttatgctcgaacgacgggctcgagttgaagtaccaagaagtcagctggtgtagctcaactgatgcgcccgttgccgccgagaagccgatggtgaccttctctggcaaggcgctcttgagatcaaccttgtcgcttaggttgtaaggcggcttcgttgtgtcatttatccacagctttactgacaggatgctcgaactgctgttgtagtcgacggtggcggtcatgctcccgttgaggctgaagtctggtagggactcgttcgtcacagatacgacggagttgacgtcgatgccgatgtggtcgttggttgcgttggggtcgaaggggttgacgaaggtgtcgaactcgacggcaacgaaccggttctcgccggtcgagacgccgaccgtctggttcgttaggccgaggttttggccaccggcgtcgccctctggtaacctcgatgggtagctggtgaggaagaaggtcatcccatcgccctttttgcttctatttcccgggatgatgttgaaggagaagcgcgtggtgaagctggccacctcgccggtggcggcgtcccagagctgcactggcggtttgtggaacacccgtccgacgttgttgcccacactgttcgcactgatgtcgatatacccgacgctgacagaggcattgccttcaatttcgatgtactggttgtgtgaggaggcgaaggtggggtagttgaaggacaaggcggcgaaatgagccggaggctgaatgtagcagacggagaagaagatgacgaggtcggcagcacaagtgatcaacgaaaagacggccatcccgccggcgagccagcgtcgatcgatcgtgtgcaaggtgatactgatacagtactgtgatactagtactgtgtactgatcggcttctccagctggaggagcaacgacacaacttcctatactgccagtctgagtctgtatttgaggtatcctccattggacccgttctcggcctggcgcgtgacgacgaaacaagagtaagtcaaaccagtattcgtttcgtccttagggtacaatgtcactgaactcttcaaatgattgatactccctccctcccaaaatataaatatttttagagtaatgtgatgtcaaaccttttaaattttgactattaatagcaaaagaaaaaagattgatcatgtcaatttgatgttactagactgatcattaaacaaattatcataatatacaactctttttagttaaaacatagatattatttgtcaaagtagtatctcgaagaccgtgtcgaagtttaaaaatatttatattttgggacggagggagtagcatatattaggctgtatttagttccacgttaaaattagaagtttaaagaaattagaacgatgtgacggaaaagttgaaagtttatgtgtgtaggaaagttgaatgtgacaaaaaagttaaaagtttgaagtaaaaaagttagaatctaaacagggccttactatatgtgtcttctctagcactaaaataaatatagagactgtaacttttgtgctccccgccggccgtggcccgtgttaacaccgtaccgtacacgctcaccctctagttactgattttaaaattagattttttttctccactgtccatctagaaactacaaacaacataatctttagctgaccttaggcgcattttgtttggtgttactgattttaaaattagaatttttttctccactgtccatctagaaactacaaaccacatattctttagctgtcctttggcgcattttgtttggtgtttctgtggagatgtacataatttttagctgccctttggcgcattttgtttggtgtttctgtagagatgtacataatctttagctgccctttggcgtattttgttcggtgtttatgtagagatgtgctgaactggttgtttggtgtttatgtagagatgtgctcaactgggattatgttcctcttaactttgatgacttctttatccgtgctgacattagagcttttgatgacttctttatccttgctgacattagagctgaatttaaccatttgctggactctatatatgaacaacgagaaacaacatcgtatctacctttccaaattgtctctttcttattgccgtggagttctttgcgtaggatcgtaaatagtctttcccatcacaaaagctagccttgaggtgaggggctcttccacttatatcttatgtcatttgtccttccacaatcaatataaagactattcaacactttgcatcggctggagatgaataagagtgatctagaaaagctggccggtaaagaggttgaaggagggaggacctgctttaagacaaaataaaataggagttggttgatcttgccagcccaatccaatgtttttggcgttcggtctgtttcaaaggtttaatatatcacttgtctgttggtaggtaatcatctccgagtgctttctgtgctcctttttgtaaagctggtaaccccagcaaaaactctgctcgaggttggctttcaatataggccgggtccttgtgaccttttctctaaaaaaaatctatatggataggtaggagtatatagcaaatctaactgggaattcaatcataatttttacggtcggtttttttgtgtgtgtagatgaatttggctatagatgtataagagcaggtacaatagcagcctataagctaactataaacacatttcgaggagataaaagataagagagaagagtagcgggctacagatttgtagccagctgcagcacggactccaaaatgcatgtgtgtatgacaggtgggactagatattaattgtgtagtatatgtttataggtaactattgtataattgactattaagttgactatagatgatttagagtcagcagttggctccactattaaacttgctctaaatgaaacataatctgcgattccagatccatagcattcccaaaaaataaagagcgatgctccggtactctatatcgtagtattatacaactagtaaaattgatttaaaccgttgattcataaagacattttagtactttactaacttagtgattaaaggtaaggttggtatttaggatattatccactcttcattaaaaaaaaagtttttgtacatttagatctatcgcttggctactcgacggcacatccttccgttgccggtcggcaaatcgtcctgccgggcgccggcggctccggtggccgcgttcacaaggccgttatgttcccttttcttttcaattcattgtccggtttcaaatatgaacagagaagtagaagataaaaactgttgcactgcagactgtagtatagtcgctgattaacatgtaaatcataaagcacattctctgaattataacagtgtagactctattagaggtcccatagtttagagtgggattcaattgaagcagatgagcaagagaacagaagcttcgctctgatatgctgattaaaaaacagtagcagtttagcacgtcaagttcagacttttatctttatctcttgtagtaaattttataatgtttagtcctaattctttccgcaggcaggagacggccaaccaaagaaataaactactcgcatctatcgctgctgatcagctgccggcagcacaccagccacctccactcctcgctctgtaacgctaccccgcatgctcagcccagcaagacccaaaaatccgagcgtttccaactaacatgcaaatttacaaaattatcctcccatgcacgtttctactaccattaaatatggtggtagtacgaataggtctgatcccttgaatagaaaagaatctacggtttagctagatttatttttactaccattagaaagcaccgttgtgagattcaaaaataattcgtcaagtactttgttttgagatagatagatggtcaagaactgtcgtaaagtaaaaaggagaaaataggtaacaatccaatgattttagagaaactcttacctttttatcattgacaaggagccagttctatagattaccattgacgatctcaaatctatctatctatcgattatattattaaaacaactttaaaaggcgacgccacgttcgctgtggggggctataaattcccacattaatcgaaaaaaataaaagaagagtctaagtagaaatacaatttggaataaaaataagcaatattgaaagaagaatccatataagcacccaatacaagattaatcaaaattcggaataaaaataaaataaaatccgaaattagaaaaaaaaagagaagagtccaagtagtaatacaatttaaaaataactgaaattcggaattaaaaataaggaatatcgaaaaaagagtacatataagaactcaatacgagattaattaaaattcagaataaaaataaaataaaatccgaaattagaaaaaaaaataaaagaagagttcacgtaggaataaaatttaaaattaactgaaattcgaaattaaaaataagcaatattgaaagaagagtccatataataaaccaatacgatattaattaaaaatcaaaataaaaaagagagttcaagtaggaatataattttgaaacaattgaaattggaaaataaaactattaaaaagatagtctatatataacacaatacaagaataattaaaattcgaaataaaaaataaaataaattcagaaaaatagaaaaagaaaaataagatctcaactataatacaatttataaatactaaaatttgtaataaaaataaatactattgaaataagacacaatctagaatacatgacgagattaattaaagttcaaaataacaaataaaataaatttcaaaagtagaaaaataattataagagttcaagtaggaatataatttatgaataaaaattatcagaatgaaaaatatgcaatttaaaaaaaaagtccatctagaacacaacgatgacaaatgacaataaaaaggggagaagcaataggtagagtactagcggttgatgggatatctaaaaactataaacaaaatcccaaacagaatcacaatgatgattaagaggagtgacgatgggcatgccgttaagcagcatggtcacgacggttgacaggacttaaggagagtgaaaatataccccaataataatcatatccgatttttaagatctcaatgacaataaggatgggagggagcaggtgagctgtagaggagtatagtggcgaagtcactaatgatttggcgagacttataaaatgtaaaaaaagaacacaaacaataattatgttcgatttttaaaatcccaataacaataaagagaggtggtagcggacgggccgtagagtagtaaactggcgatgttggaagatacttctaaaaattatgaaaacgaaacccaacaaaacaatgaactctaaaaactataaggactaattttaaaagttctaaagaagatgagtaaaggtagtggtagatcaagtaagcaaataaaaaggtgacaaggaagtaatggataaagactggtgtggcttttaaaaactataaaattattagaatcacgggaatgataactttaaataaaatcatgtgtaaaaaatagataattttaaattgatgctagccacgcaattgcgcgggccgcctaactagttatattattaaaacagtcttgaaaagaggcaccaagttcgctgtgggtgctagaaattcccacattaatcgaaaaaaagaaaaagagagtccatgtaggaatacaatttagagatatctaaaattcggaattaaaaataagcaatatagaaatattgaaaggagttcgtacaagaacacaatacgatattaattaaaatttggaataaaacataaaataaatttcgaaattagaaaaataaaaaagagagttcaagtaagaatataattttaaaacaactaaaattagaaataaaaaataagaaatattaaaaaaataatccatatagaacgcaatacaagattaattaaaatttaaaataaaaaataaaatgacttctaaaattagaaaaagaaaagaataagagttcaactaggaatacaatttataaataactaaaattcataatagaacataaagactaatgaaagaaacgaccatctagaacgcatggcgatattaattaaaattctaaataaaaaataaaagaaattcccaaaaatagaaatatagttataagagttcaagtaggaatataatttataaaaaaaatagtggaatgaaaaatatggaattttcaaacaaaaaattttatatagaacacaaatgataaatgatagtaaaaatgagagaagcaacatgcgtataaaggagtagattggtgatggttgatgggaaatccaaaaactattaagaaaaccccaaatagaatcctaatagcgacaatgaacatgcagttaagcaatacgggcacagcggttggcaggacttctaaaaagtaaaaagtaaaccccaataataattatgtttgattaaatcttaatgacagtaacaggtgaggcagcgggcgagctgtagagaagtacaatggaaaagccgctgatggtttagcaggacttctagatagtaaaaaaaatgaacccaaacgataattatgttcgagttttaaaatcccaatgacaataaagagatgagacagcggacgagtcgtagaggagtataatgacagcgtttgatgggacttctaaaaattataaacga

SEQ ID NO: 80203 - DNA, 24416 bp, Oryza sativa
ctctgatgctgatgagatctccagccgctgtagacacaatggggaaagttgattgagttgtaaaaaaatatatataataaaggtaatactttttcgccgggctcataaaagtattacccccaaaaaaaccagacaaaataaaaaaaaagacagataacagaaacagagtgaatgggtaataaaaaaaattgtagcactactaaatggtaataaatttatatcacgtcctattcaacttgactcaaaattaaagaaacaaaaaacatattaagcaagactgactgctctttatttgagcttgcctgcaatttgtattacaagaacaaaagcaatgctatatattacagacaggattatcatcggtggagcaaattacttgcagatacaaagcacaaatatgtaacacattctccaaatgaaatacctaatacattgcaaagtacaaaggcaagttccagaataacaaactaacaaagtcaagaagtaaaataatgtggatcttaccatctgtacatgctgatcttcattcctagaaacacattttggaccttctttagcagggaaactgtttagaaataactgcattaggcataatactatgaaggctaaatgatgaaaaataaataactgaaagaattaccgttctagctgaagcttggattcaagagaagacactccgtgttgattgcccttgtttatgtcagagttggatggtttcccaagttcattgattgtggattcaccatcgacaccatgtgccatcatttttcctgtttctttcaatgcattaagctctgctcgcaggcttgaagcttttccttctgattcctcacatttagagactggtattttattcctgaaaatttctgagtcatcatcagctttatatccaatatccattaagcttgatacagatactatcgccatctgcatcttgttaggcgtcctgggttcacacatgccatctgttgtttggattccggtgtgcttaattactggaacaacttctagtccggaactgctatttatctccaagttctttatgatagtctccctcatgtctgatacatcttggagtgaaaagcagtggctgattatccagtctagtgtgatattgatttcaagcacaaatctttcaacatctgtactcccatacaaaagctcgttacacccaaggacgaaattttgtagtacagaagtaagttcagacgttttccacaggaatgcacgtgcaacgtagccagtcaatgtgttagagcggtcgccctcactgccaccagagagcacaacagtgctactataatcttttgatgatctctggacaacaccctcaataagttctatcaacttcaggactgccttctcaatcttgtgctgacggagttggtcagatgtttcaataggaccatcaactgttactagctctttccctgatgattctctagactccctccttgaatcatacgattctgtaggtttcgcatcacatgccaatgctaacttttctatctcttcaaagtcgtccatgaaactcaagtctgatactccggtactcttacaagagggtgtagtcagcttccccttcttgaagtgttccagttcagaaatcaaggcagacgcccatgagcttgaacagctgacattatcttcattgcaaccgtcctcggagattgatgatagagggttctcgaccactgtaggactgcattttactaaatctgttgcaacccgacctcttgataactcctcaagctgagcttcaacttgggaaagtttagaggttgtgcgagcaagcatggtccgcgaatactggagctcaccatccttactagaaagagattccttcatagtcttattttcgtcttccatcgcatgcagccttgcaagcaatgaagaactttcatgtgatgcatcataggagttctgcactagattgcctgagttgaatgatgttgtagaattgaaccttctcgtccttgttattactgcattgttacccagtgtttcaacttcatttctcattttagcaatggcagcagggcctggtagccttttacgtaccattgaacgcaatctctggcattctgcttcaagttttgtaatcttttttacattctcaagatgttgtttatgtgcagcatcagcagatttcaggttaaatttcctttcctcacttcgaatatcaagttgcttctgcagcatgcaaacctcatatctaagagaagaattcaatttgtccgctgactctagttttacctcaaggttcttgaaatttgactctatcacaccctttgcttcagttaactctgagatcattttctctttcattgagagcatttcagaaagtttcctattctcggcatccaagctagcaattatgtttattttctctactacatctccttccagcctctcaactttaacttgctcatgagaaatcagtttagcagtgtcctttatcaataactccctctctaccatggcaacatttagagcctcatcaagatggcaaatcctttgctcaattgcggctttctgatctagagtatcatcaagttgtgtcttaatagctattgcttcaccttcagctttctcccaacctagaatagttgtaaaccaataacatgaattgcagaaaaaaagaattgcagaactttaattgccattgtatctgcatacttgcagctgtccatttctcttctaggatggaaaaatcatgtgcttaactagttttgaaacaagaacatgtatcagttagcgaaaagtgaatggagttttacctaatattgcttcttctgccacttttgcttgcttagctaaaatagcatccttctccacgcattcagcttgagcaaatgaaatctgttcatttaagcattgcaaggatctctctaaccgtgcaatcttctctttctgcagggaaggaaaagttgaaaatccagataggaacatatcataattcataaggcttcttaataatgttaaagagataagtgatgtacctcctgttccctctctgatatattggctttgttcttcgttgaaattgtcctttctgaggatttttttctccaaagccatgttttattatccattagtgagatgctaaatatctatcaatattcaacgccgttctaaactccctagaaattaataagaaatataaatgttagtaagatatattcccaccaaattgtacaaaaggtggatacagacagaacatttccttgggtgctattctattaagaaactgaaattgtgtgtatcaagtcatctttgcaaaactatcccaagctaacataatctgaaagcaagttgtattttatcccagttaaattcatataattatatcgtatacacgttagttttttattccatgagacaaggttgaaaaatacaagaatttggactcgtggactaaaacaaagaaatccctttgaacactttctaagcttaataaaaactttggctggcgtatgccagctcagcaagtattttgttaaccaatgattgttcagaagtaaagtactgttaattatctgccatgttaatagaaattgaccactatctaatctactattcatgattaataagtttcttcatcagctaaccataatatcattttcctttcaatgcagaaagcgatgctcagctcagaaaagaaagtaaaggatatagtgaagcttgttctgttccactctctttgtacctaccacttcaaaaggtaaagtttttggcaaaatacagctatagagtttcttaaaacaaattttaacagaattgcccgtcaacttttagcttctgtgtcagctccaatagtggaagcccattgacattgaacctatcactttgatccagaagcgtcaccaaccgatgcaattaaaaccagccggtacaaaggcatttatgtgactcaggtacgtcctctcagaagtcaaaagaactgaagtacttaaacacctctaaaaacgaaatgcttcttctttgtctcgacaatctttagggcgtactattttgatggcatttactattttggacaactcgaatatagtagtaaaccttaaaacctctgaacgaagttttattgctaactggagtgaggcccaacctcacaatatctatttagacagtatttatgcaaattgattgcatctaaatctagacaaatatacaattcacaaggagggcaagagaagaagatgagagaaaagaaagatgcagaaacaagcagtcagagctcagaagtctaactctaaacccactagaaatattaactcaaaataagcttccttctgcgcagcaggaagtgaaaatggtacatcagctagaactgatggcgaaaaccccaaaagggctccacggtgaaacaagaagacaggatccctaagagcaccagcagtttagcaagagcggcttctgcaatcggcatgcatgttagtgtagttaagcaattaagccaaaaacatcaccatctaactagctccaaacccattaggtccttagcccaagctctagatttccccatcgttttcccagccagcaaacaaagaagaagatggagtgtgctcacaccgcgcattgacaaaggatccaaaagggcaagagtaaaatagaaggaagcaagattttcaagaactcaagaaaaggcactagtagccagtagccagtgaggtgaggtgagtgagctgaactgaactgacctccagtgacaacaggtggtggctctgctgcagctcaccaagaatgaactgccgctgcctcactgtgagcctgtgacggcatcctatggaggagggagatgaagacaaggacacaaaggtggatggaagggagaaaaaggtgacacgggtataagaacaaagcgatcgttcagcttttcccgtggggcaaccgctggggtctcactccgtaatttttttcttagtagatccttgcaatgacacatgtaccagcggatactgatgctgcgtattggctcactggcctgtggacccggggctcaaatttagccctttctcggattttagctatccgtatgcgcggtgaatcctgtgatgctgtgatgaaaagtcgatttagctcgagagtgtttgcctaagtttggggcttttaagtgtcggcggtgccgttggacaagagtagaatggagtgcaatagcagcattgcactccccattaaattactgctcctgttgtccccataagtacaggagtatcttgtgattccagcaagttatgacaataattacctgttttttgtccaggagagttcattgccagcttgccacagtacaaaatgattttcgtgagcacattcatcaatagtgtagagaagggatcagtgatgacagaagaatactagttgttggcacatatagtactaccgctactacaatggtttacttagtgattaattacatggatattggataactaacctgagagtggataggacctgcagcagtggcccataaggagggcgtgcatcagtggcatcgaccaccgtcagcttagaacgtttgtgaggtttacccacctaaatgattggcacttatcacatgtattaatggtttgatgcatgaatcaagggacagcggattgaaagtacggacaacttgtttgtgctacttacgttggaagtgtacacctcaagctagtgtgacatcggttcatcaatccatctgtcgggctgtcttgcgcaccaccaggaggaaagattgccagctatgttcctaaagcgacacatatatttgctgcacgataaatttagcgtcatataccagtcagtggcatcaatcttaattcacagtccacaagccaacagatctgtgaaatggatcggtcagtgtctcagtggctgattacttcaacgattagctccacgcagatgcagtcaaacgctaatttgacaatctgctgtaacggtcgttggacagatcgcagaggtgacaagtggggttccatgcagcgcagtgcagtaccacggacaagccttttctctgaagcaaaatatgaagaaaagtaacccgttgagaagagaagaagaatttacttcgagtaaaaggctgagctgaacatccaggtccagtccatgcaggctggcccggtgccaatctgctggaccaccagcccatagccaaaccaagctaagtagacttttgggtccaccggtccatcccgccgcatccgtggagtcacgtgtcctcatcgctcgccccatgctgcaattgcggccctgtcccgggtttgatgggccaatcgcgcgggcgcgcatgggcaaaacagcctcgccgaccgccgcgtcgcgcgttgcgggtgggctccgtgcccgtgccgccgcgacgacgatctcctcggtggcggcgtctccgcctgtcgtacgcgtgatgccgcgcgcgccgagccgaacaagtaaacaaccgatcggtccgcatcacccgccgtcgatcggtgagacggtgagtacgtaatccaagtgatgcacgggccgtatgcacgcgtgctgtgccggtcatatgtatacgccccagaaaaatgatttcatccgtaaagcggcggcggcggcggcggcttggaacgacacacgtcccattcttgcgtcattacaatcggtgtgttgattatgccgtcggcttcacagctcacacaagtcgcccatgtacgcctcagggtcatctcacgcgcacttgtgcccgtgctaaagacaagttcttcgatcgtcggtggtgccaaagtctaagcttgcacgacggttctacaggagattagtgccgcccggccggcctggaaccacaatttcaagggggcttgctcggacaattatacttggcattattgattatggctcaagagtactatacatcatatagatacggcgtcataacaggtcattggatggaaacgaattaggcatgcgggtacagcgtgtgtacttcctccactatccgtgaagtggaagtcaatttctgcaagatttccatttacctatagctaggtagcactactaactactccagtacagcaagccgtcctaaactcgtatcaaaacgtccaaacttcagctgattttcgtggaaattctgcttcatcagcagttccgttttaacccctgctcgtcgactgcctgccgggccaagcaagcaacaccaattcgatcgaggcaacacacaacacgacacgagacggtggcgcgtggcgggcgatgggcgatagacggatgggaagagcatcggagcgcatgctaggtcgtagccagtgagacaacgcgacgcgcgagagaggtggtggtggtggcgtccgtgcggagccagtctcacgtcgccatcgcgcactggcgccagatctggaccggacgggcgggggcgcggcagaaaaaaaagaatacgatatacaatgcgaccaatcgatcgatcgggagcggcttttgctggtgaatagctgcgcgtcggtgcccactttccctttggggaaggtcggggcaggccgtgaacaggaccgacgacgcgagccaccgaccgaccggccgtccttccttcccttccttcctcctctctccttccctccagggaaatccaccactactactcccgactattctaccggcaaaaagtgaatctagctagtagtggtacctaagctaccggccgtggctgcatgtattggcctagatagctagctgcaatgtagcgatgagccgatgcgtgtaacgctgccctgtgcgtgcgtgcgtgcgtgcgtgcttcccggtctccgcacctttgtgcttacctttttccttcgtccatgtagcacgcacgtcgacccgtcgttgcatgctggtctcgtgcgtgtgcttcagcagctgacgtacgagtcgatcgatcagctccgcgctcgcttgatatttccggtggccggcacgctggggccctacgttgcacagttccacgcagcaggggatgccgagagcgcccgggccgtcgagtggaagcatcgatcatgcggcccgaggggggcatttttgccggggagaggagggcctgcagccgcgcgcgcacagtgcgcgcactcgcagctgctcatgtctcgctactcgctagcgacgccccgcgcgcgcgtcgtggggtctcacgctcgtacgtacgcgctcgcgcgcgcgcgccatcgggtggtttcagctagtttcgtcccgtgaaaccgagtacggccgcccgcgccgagaccccacgcggccacgccttgccggccgagacgtatccattgtggcacttatccatttactcgatcgaccgtgcaaggaaaccacttgcaacggccattgatgaagagagatttagttgcctgtatggtatgcatgccgttttttgtcatgagcttagtgaggataagctcatggatcatgtgggcctaaatgtgatatagtacaggagtttcttcgcgggtatatcaagagttcaataccatttgcgcagattatttcttgtagccacacatattaattgagagcctgcatgatgcatatgccatcgatcgttttctagctgcatgcagacccaggtccgcgagtcgcaaggggacaagaggaaaattttctttccccctgctattgcacaacagttatagtggctagtagaaatgcatagaacgcatgtgcatggcaccctcgcgagctggcccctagcaaagcttacacaagaaaagctacaagacacttgcgaacaagtcacgacgactagtcctgattgttgcttcggttagacgtactacgtccctacttactaagaatgatgctgaacacgcagccaattaatcctgccttgtccttgtcatatatctgatgctagcaaccggctgaaccaccgctcgatcgcattgcattttttttcatagattgccacaaacatgcacacggcacggaaactcaagggatccatcaggaggcacccctgttcatcaatacacacaagcgaaatctagaacgaacaccaaaacgatttctgacaagctctttccctgcccatccactgcgaacgataaaaaccaggaccaagtcctgaacgaggaacaggtggacgaagtgaggtgaaagtgaccaagcgtctgatgactgatgagatctggtgctagcaataagagcaagttcaatagtatagccaactactagctccaattcatctatagctaatttaatagctcattcatataatagttacatactacactattaatacctagtcccacctatcatagacacactgtgtcttggagtccgtgctacagctggctacaaatctgtagcccgctgctcttctctctcctaatttatctccttaaaatatgtttgcagctggcttatagtctgctattgtacctgctctaatggccacagggagactgaaaacggccaatgcgctcgcctggttggttgccggtgagaggcagctaaggtaaagcttagctccagggggcgaactgattcggagagccgaggagagcgacacggcatcggatgagaccacattaacttgttttttaccgcgagaggttggctctcatggtcatggcccagccagtggctggcccagctcgcttttgtgaaccagtcgcatacatacacatgcttgccttgcttgatgcccggttgctgctgatgctaccctgcactgcactgcacttcacttcactctctctcatctcgccccacacacattcaattattgcaatgcccaaattagaaacaaggaatcccctttctctagcaaaatgttacgcccacttgcatctatgccccggcactattctcttctcttctttttcagggaggtgcataggcaacacattttaaagcatctccaaggatataaaaaagcgagcggaaaagagatacatgcatctgcttattcctctttttctcttttctattcgggaaatctcatgataacatttttgttttcgcaacaagcaacagcaacctaaagatccgtaccttatcaaatgatcaagcacaaccgtacgtggtgggtctatatacattgattcatttttttttctttttggaagattgctatttaatcacgctttgaattcaattccaacaagtccagatgactgttggttgtctacttgtcttcgagatgttagatatgtgtgcaagtaacccaacactatgaaattaagagattattaggaagattctgcaaggaacagttcgatttttcttttcttgcattgcagatagggcccacatatctgattcctgttggtataggataccaaacgcagtcgtatgtcttttttaatttagaagaccaagcaccataaaacatctcttcttagagggagaaaagaaagaacattactttagtaccaacatctagaaggacgaatacttctatatgctccacatctcggcagttacgtttcttggaaagcaaagagccaaagcttaaatagttgacatatatgttaatctgatcgtctcttttgatgatgatagattacatgacagtagtagtagcgtaaagctagcactccgtaggatttataaagcgatgaatagtagtagaaaccgtgggtgtttaaggatgcttactagagggcaagtgttgtcggccaagcggaggtgcatggagcaaattttcccgaatcatggtcatcatgcagtgaatgatgcaacatgagaccgaacaaaatgagctgtgatgttgacacccagagtcatcgttgttggccatggtgaaagaaaagaaggaaagaaagcgagcgaaacggcaaaagatagatactcctacactgcttgaggcgacgcttggccaatctctctcgccttctagggagctcctcatttacatgcccacttgtgtcccattcatgatcagatccatctccatctcgctcgcccaatcaagaaacagagaagaagaaagagagaagaaaaaaggtagagcaaaagaatagcatccagctcttgttcttgctggtaaatctgcattgagtttttccctgcgtcagtgacacacacctctctctctccatcgatctttgccatgatcgatcgacgaggagacgatgaatgcagcgatcttgaattttaaatctttgatcatcttaggtgggccgggtcagggaatggaacccgttcttctgcagccaggttgaggcttgcgtcgcaatgtagggagggaatcgtgatgatgctgcagctgctgtagcggttgcggcggccgcggcgttggtcggcggcggcggcgggtgcggcgggtgcggccagctcatgccgccggcgttgccccacccctgctgctgctggggaggccagtgcccggccatgcctgcgccgatcgtcagtgacaggcctcccgctgtccccggatcaccattgctcaagaactagcagcacagacatcaagaattcatcagctcacggataccggtgaaaccaaacgcgagaaattcagcagcaaatggagcgaagtggagtggagttgtatagtgagctacccacttggtgatgatgcctgggactgaatggcaggtgggtgacctgcaggaccggaggcatctggggatggttcgagttctggtcgaactagacaagaaaacgaggaatttttaagcctttttattacgtgatgagaagacaatcggctgatgcggaaagcaaagtccccattctttttttaccttagctttggtgctcctcgccgccgccgtttgccagtcaaggtcgaacgccatagggacgcgctggtcggagcccgcgccaccgccaccgccgccggtgatctcgtcgtccccgccaccgtcaacgttgcccctcttggagcccgccgagctcccaagcgagaggtccaggttgtgctcggcggcatcacccgtggccgctgctgcaaaacagtgacagattttgtccggatgagcagtcacaactcacaaacgaacagcctagccatgagcagtaagcgcacacatgacacacccacccggcggctcgaactccccggcgtaaatgcttggatcgaagttcgtcaccgcatccttgccattgcacttgatggcagcgcggtcgtacgccctgtggccaagagacaagaaacatcaatcaccatcaccgctcgcccatctaacccagaagcgtaaactcgcaaacggcgcagcagccacactcgacattcaacaacaatggccgcgcgcgcgcacagtgcggcccaataattttacctggcagcttcctcctcggtgtcgaacagccccaagtagacgtacctgcagtgcaccaaaaacccacaagatgatttacgggagattgcccaagaacgaacgatcgaacgaaagaggaagaaacggtgatcgattaggacatacttcttgccgaggaattggcccatccgagcctcccatctcccgcacttgtggagcgtcacgcccctgtacttggagcttccccgggggaaccccgtgctctgccgccggagcacgtggacgaactcctccttggtcaggttgctcatctgcaatgatcccgttaatcttgcagctacagtaatagtagtatgatctaacgaaaccgtggcgactcatgaaaagaaaggaaagttcaggtaataataatcgatcgcgctctcacctgcttcaggtcatcctcgtaatcctccaagctgaaattgatgtcggcctccacgccgcggaacttgatcgccgcccgatcgtacgccctgcgattgggaaatgaacataacaaaaaagattagaattttgacagcgccggattcgattgggcgagcagggaatagaagtcagcgattggaagacgaggaattgagtccaacttaccgagccgccgcatgagcagtgtcaaatccgcctgcaaattcagtcgtcacaaaggcagccattgtgaggaatcgaaaccgcgcccatagagaaaaaacggctccaattggcgagccaatcgtggaggccgcttgtagcagttcccaagtatggggggtatggacaagatggacatgaatgaaacttacccaaatagacctgcttgccacaatccctgcattgcacaaaaggatgagaggagagagagaagacaagaagatggtgagtgatgagagaagagaagagagagagagagagagagagagagaggagagagtatggcaagaataacttgataagatgttgctatgaaaggtaaaaggagcagaagcaagaaatgcccaaaacaagacgaatccaataccaaacccgtccatgctgctcttcttttgctcccctttgcctctctctctctccttcttcctccgttgagctctcgaaaatggaaagaacgagcaggaggagacgaggatgcttaccatatgtgcgattcccatcgcccggtgcggcggtagaacgtgacgccgcggtactgcgagctgcgcgaccgcggcccgcgccggctcttcttggacaccgccgccgacgccgccggccccgttgcagcgaccggcggggcggctccggccaggcggagccacccggcgcgcgcgttcccgggggcggggtcgccgccgccgcccgggacggccggagggaagaactggcgcgtgacgacaaccacagcggccgagtcgtcgtcggcgtcgtcgggtatctcgacgacggcggcggccgaggacgaggaggcgccggagtcgtcggcggacggcgacagcggcggcggcgcggcctcggccgccggcgagtcattgaggtcccacatggcgtcgcccttcccccttcggtgagatgcctctgcctcgcctcctccgtcctcccccttgttgggtcttggactcttggcactgcaggagatagaaagaaagaaaggaagagaagagagagcaaggagaagcagagaaaagaaagagagggtagcagcagctgttgccttgttgggctatgcaagtactttctcttttgcctatctatctcgttggcaaagccgctgctaacctaggaggagagcagaggacgcgaaaagcaggggaggttgtgggtgtggccttgctgctgctgctgcgcattgcgcccgagcgattggggggagatggaatggagagaacgtagtaaagggggaatcgtggtggacgcgcggttataaaagcgcggcgtcatcgcgtgtttctccgtaagcagaggggcaaaaaattacacatgtttttagtagcaaaccttagccgaccgaacgggggaccctgatcgggggaggggggcggccgtgggttttcgcgcttggattcgattcgattgcttgtcttctcgcgtcttctccttttggtggcggcacgagggggggaggggccgcccttgcccttatcttggtctgcactgcactacactacactgcagccagggagggacggggcctttgctttgcttcttcgctttaccgttcgtccgtcctagctttgggtctgtgggcgcccgggctccgcctcagcaccgcccggatggactgtcacgtgtactcttgctattcgggatgcaccatcgtagtagtataaacggtagctcaacctcggtaccacgtacccaggttttaacgagcaagtctatataattagatagagtaattgagaaacatgagtttaaatagttactatctctgtcataaaatttagtaatctgagacccaacctaggacatgtctagatacattgtattaggataaggtcttatcccatactagattgttacattataggatggaggaagtacaaaaacagaacagacttactacgtgtagggaaagacgtggaaaacgactccatttttacagtagcagagatatgatttacgaatcggtttctttagtctgtatcatcttgataaatatggtagctacaatgattaagccgttactattatccactctatcttaaaatagaactgatttaaaattttaaaaatgtttttaaaaaaaggtagctaccttttacttgctcctacatcactattataatttctcccatataagaaattggtttcccacagcctagattggcatcattttcaacgttggatatatgtttttagacaagagcatttgatatatcaggtgtttatttccacctgtaaaagtagtaaatgttatacctaaaactttgaacaaaacttgaacaactacgagtggcactatttaccacagtagtcccagcatctttgctagactagagtacgtagtagtacgtgcatagctaggacctctttccatctttctctcatttcttgttaccgggatgccctctcgatctctcagtcaagaactcctagtcactacgctgccgcggtacttgacattctgacatctactgctctgcgaccaacaagccaacaacctatctagtcggagtacctcagtatcaatgcatgaagcaaacggcttgacaaaccggacaggtccctatataacgtcgtattactactccttactaggaactactaacaataaacaaaattggtccggaagaatatgaattcaatttttaaatccaaattaaaattatttgtttctggttaccgatttgcttaataatctggcttggatcacaacaatccgaacgtccttttgctctacacgagaaattatgatccttacatgctccttctgtctccaaatatactacctacatcccaaaataaattcagcatttttcacacatcccacacatgccaatacaaaagaaaaaaaatagaatatccatactctattaaatcctaatacaactattcatttttttatctactccaatacaattattcactgctttttataaactccaatgcaataattactctaaaaataaaattattttaggacaaataaaatgaactaaaaaaaacttaatatgagacggaggaaatataacacgtactttacagattcgcaatagtaagatatatcctattcaatataagattgctactcctatacatattttaagaatgagttattagtgctatgatcctagcaccagcagtcacagctgcttgcatctacaaacaccatagcctatggcatgaaccatcaaaggcatcacccataattccaaaagcttccgaaagaacgacgagacaacttggaaggtgagcagtcagcgatcaaggaatgcctcttagctaacactagcagccatctcctatcggcaaaaattgtttgggcttatttatatacgatcgcttaattaacctgtggaaattaaacaagaaaattacagctactacacgggtcaaccaagtgcacgtctgtgccctgcatatcatatctggctttattaatccaaactctaatataatgttggtacctggacggtagtacttggttctagttttctcgcctgtcgactttggagaaggacgtacaaagacggtaacttgtaatctatccaacggtgtgttagactttggatcttgttggttttagtcggtatctgaatatctgatagcgagagtcatcgatgtaaaactgtgtctgattctgattgattggctcgcgtacaggtgaattgagtcagcatctactattcattgcgacatcgctctctccccaactatgtgaaatagtgaaattaaggacacatatatgaattctttttgtcgaattgttacatctataaaccaagaagtatattttgtactcctctcgtttctaaatatataaatatttctagattatttatcgaagattagtaagaggaaatattcattttcagtaacctcgttggccacatttaaatcatatatatatagaaacggagggagtatcacataagtttttctttttatttctttgcaaaacttctaaaacatttataaagagtacattattcctagcaacaagttataaatcacccatatatcgactttttgttgtcgtacaagatatatctgagatgttaaatcaacctcggactgaacggtgaagtcagaatcctcccaatcacaatttgatagtatattcttcacaataacactactggaaaaataatctttgctgggtcgacccaaaaccacaatagtcccggttccaaaaagaaccgggactaaaatgatctttacccccggctgaaaaccccacagccattatatgatctttagtaccgtttgttgttaccaacagggactaaagatggtctttagtctcggttcattccctgtcagaggcatgtcagggccgaggatctttactcccggttggtgacaccaactaggactaaagatcgccactttagattaaagatcatctagatctttactctcggttggtattaccaaccggtagtaaaattcaacacattgtatataatccatatcccttatcctctcctccacaattgcaaccactcagatcctccccttcctcctccccttccctcctactgtcccctggagacagacgccctcctcctcttcctcctccccttcctcctccctcccctggagacggaggccctcctccccttcctccttcctgccctggagacggaggccgcgccgcgcggacgcgtggtcccctccccttcctccccttcctcctccctgccctggagacggaggccgcgccgcgcagacgcgtggtgtatggacgaacgcgtgacgtgcggttgcagggtgcgcgcggtagtagtggcgccgtgattggagcttgttttctcttatgtgtgtgtgtatatatatatatatatatatatatatatatatatatatatatatatatatatatatatatatatatatatatattgtgattcactaatatgtataatctgtgatgtatttgatttgtgtatattagtaactttaagatttgtgatgtggattgggatgttactttgatttggggatttgggatgtgcatgccacttgattcgggagaaaataaaaaagaaacaaacaaagaaaagggaccatctagactgccgctatcctctatttagtaacaccaaccgggactaaaaatctttgactaaagatgggcatctttagtcccggattcctactcccggttggaaacccgggaccaaaggatcgttaccaaccgggagtaaaaaatgtttctccactagtgtaatttggagaaattgaagaggtcagctatctagatatccatctcaaagtcattttcgaaaggggaagtgataacatggtcccccgccattgtcttggcacaatcctgagggggaggactggtacgccgtgaggattggttttccccctttttttcgatttagtggtgaattgtgtcgtacgtgtactatactgcaaatagcacgttcaagtaaaagtttaggatacgcttctgatcgatgcttgtcaattcttcctactgttggctccattttcttgcaacatccatccttttatgtgccgtgtcatctttttttgcgttcgagagatatagaaaattattccatttgtacaataatttggttcactcatcgtgtgaactgcgcatatcggtatttcaacatccctttttgtttgcgtatgtaatttttctaggattaatgtaacctgtcatgaacgatgctgctttgcgttccctttcacataaccgtgaaaccgacaagggggaacaacttaattgccgctcttttcatgacatatactactttctctcttttatttctagctacgaaccgcacaacaacgaccgtcatatatagctgtgctaactgcctaagcttgataatttttttggtagaatatattgacaattcttaaacttgaggatattattaacaactataaaatatgaaaattacaatttgatcctttaaacttctaaaaccatgatccgtcatagccgttgtttagtcccattcaaatatctccattgtccctgtcgccacaaagtgagacccgcaccggtatattttactcttttacataagacaacagtaaacaacaaaccaaaatttctgcactcttgaaggaagccttatacaaaattaaagatgaacttctcttcatcagccatgcatatatgcagaggtgttgactctctaataaggcccttaaacagcgtgatcgatcgagattggcatatgcatatactccgctgtgcacgccgtaccaagaacgatatgttcagtacgaatattctcccctatccaagtttaaaaggcctgctacaacgcagctgtgtgcgtttcaggagttcagacgtttaaaagacgagattttacatatgcagcacagggctgaacaacagtgtccatcacctttctgttgttgaccaggagtacgtgctactagtatctatctatctatatagggccagaaagaaaaaggatggagtgatctgcattctgatcagtacaagtatactacattatcgtttgattgtacttcacttcgttgatcactttgcgaagtacttgtcttccacatggtcattctgagatcactttgacgcagaaacacgtctcaatgaacaaacaagttccgtacagccactaacatgcaatgcaaacttgttaactatttactccctgcacgttcacgttgttcgacgtgacccagctgggagagataaacagtgcttgtgcacatttgcatgcagtgtttacttgggagaagggaacgagaacaacaacagtaagacagtgtagttgtaaagtaaagtagtcgtcctagtgagagtagaagtacacgcgaataaggaaaccatagtttatgcctgcatgtcgagttggtccattggaccttagtagagcacggggtagagtagtctcacgctacagtgacgtctccccgactacaactacgagtccgtggctggctggctactgcctccatcgtgtataggttcgccccagattgggatcggtttccaagcccaaccgatgcttttacatgcatgcatgtggcacagccgcccctaccctagggacgtagtatcactgtagcacaagtagcaggacagctgggttagatcctatagcaagggttaaaaaaaattgtgtggttactctactgctcggctataagtaaaaaactcataaaattcaaacaagttttgtcgtaagtttttattgggtagtttctcgatttgtacgtaccagcttgaaaaactcgataaccaaatgtatattgttatatttattaacctttgatctcagcatatatattgatgtgttatttatgtacatgaaaaaaaatcaaacagctaagactattgtaaccaccaccgagtctacctcctctccttccttgatcacctaccaccgccactgatggaatacttctttttttatcttcctgatatgttgtctctctcctttcatgcatcgcacgcatccctcccgcctcatcgacgccagaagccatcaatggtgtcaaggagacccacccaaatcggtcccttccccacctcatgtctgaaccaagcagcggcgggtgttaatgccccgttgtcttcctcgtctccggtggctcacaccgtcggagacgcctccatcttcctcccaaatcagatgtgatcccaccaactatccttctctagcctcgcgtccactgcctccccgactatctctcttgacggagcgtggggctcctcaccgggagaccgcgtaggcccccctttgccggttcggccggggactcagggagagattctaagctctctgtatgtggaaggctcgcgagacaggaaacacacaagacacgggcgatgtatacaggttcgggccgctgagaagcgtaataccctactcctgtgtttttgggagatctgtgtatgaaggagctacaaagtatgagccagcctctcccttgttctgggtttctaatctggaaaagtccagtcccccctctaagtgggcaaggtcctccttttatatcttaaggggataccacatgcaccatttctctcttttttgtggggacttaccccaccttttcataaacagacggagacttgtatggttgccgtccgaatgaccttctgatgggacgacccatacctacctccacttccgccggaagcaggcgcgacgtgggaacatggctgtttgctgacgacatggccagtgtcagaccggtcacaaatcggtcattcttgtccaccacgcgtcagtttatcaatctgcatgttcgcccttcttcatacaatatcttgcctgtaatggttaggatgaagcctggcatatatctgaccaggactaacgtgccatctctgggaggtaacacgttagctccagctggggacgagcgcctagaagccctcgtcctgacgggatggggcgaggcgtgtgtcagatcgcctgtcgccacctaacccgcgatctgaccggtctgtgactggtcacagaccggataaacgagtgcactgcactgcgttacatgcggcgtgacacgctcagccaaaccgcaataaatgtggttaggtgagccccactgtgctcacctaacccatacacgcggagcaaaaacccacgaggggtcggggcgcctcggccctcggggctgaggggggtgcggcccgaccccctcggggggactaagaggagggcgaacacatcaccctcgggcccgacgtccctcgggggtaccaggccacgtgtgcgattgtgtctgcctcaaacctctagtcatgatactcctgatcccatgtcaccgacacctctaaagcccaacgtaactccaccatctctcaaccccaagacgctaatacatgtcttctgcgccctagcaacaaggaagatgaaccaatcattgaggggctcgcatagtcactgttggtaagtcctagctatcacgaggaagaggctcaggatggttgtatattcaaaatgtgaagaggcaaaaacttattttaccagctatagggtattgtgcgaattgtcgaattgggctattagacttgtacgaattagattgtcaaactggactactaggatatgatattcttttcattcctaggttaaatatggcattttaaaaatgttttcgtaatatatgtatgtaatactgttcatacctatttttccctaaaatagttaggtatgcatctaaatatccttcaatttaattgggtctgccccccctagctatcacctctcaccccgtctcctctctacgtgtgtcaccacccttgctatctatgtttagcgttgtttttatgttagcattgaaaaagatatactccgtagaaaattcgagaaatttgactaaaaattagcatacccatcgattttcatgagattttataggatcctacggcagggtggtttgatgcgaattgggaaggacagcgactttgaccgagcgccgatcagcggggtcgttggattaggtaatccagtacagtacaggcctctggttcgggaaacatttcccgttccgtgcgttggcgtccgaggcgaaatcccacgctgccactgcagccgtcggatgcatccgacgcacgtagtgacaccgaagcagaaccaatcacggctgggcagctacaccttccccaatttggatgcttcccacacacggctgtcttcgcatcaattaatcgctgacaaaggcatctctgtagcctagtgcttactaactgacggcgatattggatatatagctttgctgatgcggcaccaaagataatactagtataaaaacggcgccgatgttcgcacagtttctatgctgcacattagtattagatttgtgcgtaccattaggggaagcaaagcaccaaagctgcattaaacaacgagatggtccactgagagttttgggcaagttgcaagcattgttaagtccggagctcgcttggggccctcgtggccatcttcctccccacaccaagtgttcgaccactacctacgttggatgaacaaaatacaatatctcctgcccaccatgtagtattatagtgttattatatttatacttttcattagtagttatactaattaagtactcctactaatactaattgattgggggggggggggggggttggtcactggtcagtacttcattatgacagtgcagaggattgtgtgggaggcatcgattcttgatgatggctgcaggcgaggcaagggtgtttgtttgttcgttgtgcttgtgcacatggatgctttatttggcacgagactatcctattggaattaaggccctatttagatttcaactttttttaagagaggttttacggtgtttgcattccaaaaagggtaaagattcaacactcctcaatcacaggtaccatgttaaaagtatttaagtattgatataggtacttaggtactaagggtaaaaacataattttgctagtagagagaaaatggtagaattgtctctcaaattataaaaggtaccgcataggtataacggtacgtattaacaccgtaaaacctctttgcactgtttaatttcctgttttgcgtggtttattgtagatttacgttgtattggagttaagtcgtttactgcgtcactaaggtttaattttctgatttgcgtggtttcttgtagatttacgttggatttgagtctagatttacattgtgttcttataacacattattggcccaattatgttattttttttctacatttacattttattccaacgaatacgtaaaaactcctaccttaattatgttgaaaattatattttatttctagcaaaagatttatatcgtcgaccatacaatctagtctcctattcaaccctcaaccatacctacacttttccctctgtctctttccggtgaaacgttcaaaccctagaacaagaacaaagcagggaaagaagacgatgcgatctggaaaagaagacgatgcgatctggtatagatcgattggatatccgtgattttctttttttttctgatggcataccgatcgatggatattagatttactcttttttctgatggcataccgatcgatggatgttagtattcaattaaagtataatggccatgttttataagttaattacaccactgccatcatgttacaataaatttgttccgtaccttacccctctcttgatcaacggtgcacgttgttccacctccaggtacctctaggtacctcgcaaacaccgtaaaacatctctttttttaaacttctaatttttctgtcacatcaaacttttttacacacactttcaactttttcatcacattgttctaaattctttaaacttctaattttagcgtgtaactaaactcagcctaaggaggcaataggagttgcattgtcaacatttaagtccttgccttttcgtgtcactctcgtcagtctaccgtaacgtacgtacgtagtcctacccccatggaaaattcttcagtttcatactgctgcagaaacgcctgaaggtgatctgattgtataaaaattactacttacttgggttttggacttttagtggctaaactaagcataagcagccacaagaacgttgggctgcaggaa

SEQ ID NO: 80204 - DNA, 35972 bp, Oryza sativa
gccccctccccccgaaattttttatttttgttttatttgtttgatatttttttcacgcttaaggacacacaagaaccaaccatagaaaaattgaactcaaatggacgtaatatgtgacctgtaaaatttttcctctcctctcctctctctccgaactagtgcagaggagagagatgtgcaacttttttatttttattttatttttttgatatttttttcacacttaggaactcacaggaaccaaccatataaaaaataaactcaaacagacgaaatatgtggcatgtggaattttccaaagctctaccgaaaaacttctctcgaaaacacaatcttgcaagcggaatttggaggttttaatatcgccgaacccgacaaagcggggaagaatcggatgtaactttttctgtagatgtccgtgtatatattatttgcctgattccgagtccgtatgagaaagttacgcctattttaatagatgacatattttgtccgtttcggtagagttttggaaaattctacatgtcacatattttgtccgtttgagtttattttttatatggttggttcctatgttctcctaagtgtgaaaaaaaatatcaaaaaaatgaaataaaaataaaaaaaatgcatctctatggactgtttaacttatatatgtcatttcatgtggttatattttgaattagattaagtaatttcatatagtggtagagtgcattatgtttaacatgctgatcaaagggttttactaaaggagttatggtctaattttagtgaaggtgcaaagtagactaagtgatatgctagctattttcaaacttagctaagtggtagttcgagtttaatttttttttgtggttggttgtatcgtgatcctgagtgtgaaaaaacatccgaaaaaataaaataaaaatgacaccgttgcaactccatacaaagaaacaagaatggaggcgccggcgccagcatagctggcgccctcctcctgccacgtcggttcgcgtgcgccacggtggcagaaggacggcgccagccaccctggcgccccaaaaaggaccatttctgggataagttttttcagagatctatttgcgaaataagttttttaaaaggagcaaaatatgaaaaatccagtaatgaaggatgcacagtgacacaacacaagtggcctccctcaattatttgttggaacgctcttagctggctggtcaatttagatgtgaatgctttccttatttggcagtgcacatcgaatcatgttgctttcgcagcacacaaaaggccactgcgtttggaccaatggattcccgcgaaattaactgccgggccagctaattgagacgtaacgtagtactgctacagttatggagaaagtgttgcgttctgttggctgttgcgagcctaactcgcaagtggaaccaaaaaaaaaccaagagatgtttcatactagtactaatctggaacaatttgacagaaccataactttttcgtagctttgtgtttaaattgtcaaagacatctcttttctcaaactccctatactactacagtttggagaaagagttgccttttgttggctgttactccagcttgcatgttaatccaagaaatgtttcatgcagctaagcatgagccatctcacaaaacaaattgccaaagacaacttcaactctttactcgaatttcacaaaactacaactgcgagaggatacctctcaaaacaacatatttggccacatgattcttcctcctcaaaacacctccatcccatgaaatgtagtactgcttgagagcaatggcgtgtggagaccaaccttttcttttctaggttatcttgtcttccccaagagatacccacgcatgttgccggttgccattaaggcattaacaacagattactactactgatcacagaattttcagatgatgatactactgcttgatgcatactacgtggttcctgacttcacaacgaagtcatgctcctggcgtagtatcatgtcagatagtggtggttgagaccttgaaacttgaaagaccacaaaaaaaattgcagcttcagacttcagagtcgacagaccgccaacgagaacaagaataacacaggtgacaagtatggccgtatgggcatttccttctccttttcagtttgtaattactccaagattcaggctttcaataaccatgtgcccagcttgatccattttactgctagctgctggcctgctgccactcgatgcaaatgaaaagagaagatgtcagcagaaagtagcaacaccaaaccaccctgcagaaacagtcgttcacaggttcagaagcgtggagacactataacattttcctttccggtgaaagttgtccttctgtgttaagcagaagtggttagtaatgcagtgatacagcactgtactttcctgcagaagaaattgatgacactgtcaaaattgaccagtaaagaaaatggtgttgatattggcttcggctggccattcatcaagaacaaaggacctctggttcatctactcttcgggtctctgtttaatttaatgccaaaaaaaaccttatcaaattttggtatagttgctaaaattttaatgaacttgtcaaaattttggcaggatttcttatataattaccaaaatttgatagcaaactaaatatagccacttttttttggtaaatttgaaaatgacatcaaattaaacaaccccttcaagtacacatcagagcatcgagtgacccaccaaccgattttcatctcctcttcaagctgattgctcaattccccatcttttcctttcacttcttgcctatattcaggctgtacaagacgactagcctggcctgttccttcttttcacctctactagtaggagtactaatttactgcctcgccaggcagttttccccgcatgcagcatgcttcactgaaatgccttgaaagcaaaagccttttttgggaggcagtctccctgctcgggactctgtttcctccatctcgacagggatttttttactgggctatggcttgtgatgcctgcatttctcatgcaacgcgacaaatggtgcctgtacttgtgcaaaaaaaaaacagcaagtttcagacatggtacacgtcatgtgcagacgatatgtggaaacgaggcaagctgctctgctgtaaaagggggattggttgctgctgtaaaaagaggatttggtccagacacatggaatcaatgcaggccgtagactgaaaagctgcctcgtctcacaacagaggaaaacgaaacatgcaaaccatatgctcaccgtaaggaaaggaaccattttcatttgagagaactgcaaatatgcaatgcattggtccttggaggtgtacggtgtgctcacacggcagttcagggaaaaaaaaaagaacttgatgccttgcacattgcacaagcacaaaggtcaaaggacctgtttggactttggggcttggaacggaaagtttttggtcaggatcaagctttctccttgaatttcccgatctgagcgattgttttgtactagtactacaaaaaaagtacggttcatacggactacgaactgcattcgtctgcaccgtttcacccttatcagagagtgcaaatgaagtaccccacttaacggcaatcaaatccatgtacaatcatctttcagtacaaagactgaatttcggagagcttctgtgtgtggtttactggagggacaaaactgaacagtgccaaataatcaaagataagataataacgttgcttaggacagatcccgtggttcatcatctgtttgatattttcatgggtagtttatgtggatcagttttgctcaacatcaccatgtacgttccagtgatccagtctacgtactatacagtactgcactgctgaaatacagttaaatgctttcgatgtcaaatactcctgttgaaacacgatgcctcacacgtatgctgaccacacttatcaaaatttcaaaacatatgaaattggaacctgtagcaacttgcacccgacaaaccagggtagtttttcctttttcgttcatacggtccgatttatgataagttaatttgattactagtttttttttcctactagtactatatatgttcaaaagtttttccgatatcaaaattattatttttctcgctagattggcgttgttcctactagtactatatatctgttcctatgttccctcaacctgatgcttgcgttgttgttagcagctggcacatggcgcccacacatagaaacatcgtactgcaactcctcggaaccatcaacctttcggtgcgttgttactccaaaccttaaccactagtgtaatcgatggggtgttagctcacggatcacacattttggcatccgaaaacaggagcggcaaaaataaactaatgaatggcagcatggcacatcgtcataaccaactctgatatacttatcttgtgaattgataataccctatacataaacaagatgctcagtaatcttaggaaaccaccacacacgcatgcaactgatgctttgctgcgttaatactatactagatactcttacttagatcttgccgtttctttaagggtctttaatggaaatgggagagggctttgcctatctgttattagtacttctacatactcgttctgtaccaaaataaacttaatctatgataagatatgatatattccgaaataacgaatctagataagtagttgtgcagatttgttgttttatgcatgatagattacattctaacttgatttttttataacggagagaatatgaaagaagaagtctactactctgtcctacctaatgtatagtaacttactactgaattggatattttataatattatgaatatgaacatactcttatctatctaattcatagtagtatgaaatgtcaaatctggttctaaattgttatatatttttttacgaatggagtactactaaattatgagtatcaagcaatattagttcaaccacattgtcgtttctcataattacttatcaatcatgtcttttttcccctcgtgatgttatcttatcagtcctttgcttgggcacaatgatagtatatgctcagcttggtaccggtagtaccgaaggaaggccacatgggaagaggcccatctacggtcgattttcaatcatatcgttttgatgggagcgtgcaatgcagtgagtagaatcgattttccttggaatggcaccacccctaaacccttttccggtagaatctctcgtggtgagttgaatgtagtgacactgctactgcgagttgctagaagtgatagatgttactcgctgtgggctgccccctgcctgtctcgtgcggtctagtctggtgtggtcgctgtcgtctccactagagaccactactactactcgcttgcatcacctgaacagtagggttgctggcctggcacgggcggctggggatttttttcgggacgcttcacaactgtgtgtcagtcattgtgtatcaatgtacaaatgtttgctcggcgaccagcactgccgagtgatacttacagctggttagcttcacggctaatttatagtagtagtagcagcatgtatgtacggttcgccacagtttcttagcaccgtgtctcacgtatcatggactcaaaatctgtagcctgtgacactcgtttctttgcacactttttatgacccgtcgaattttcgccatagctagacgtgaaccaaacaggcacttaactgcggcagaccgctgtttgcatctcagcatcctcagtggagtgtgttaacattggtggtttaaatggtgatgatcggtttctgccaattgttttataggaaaaatgaaaaggaactgtagcatgggctccgttttgggctgacctttgctatatccggccatctgggcctcagtccacctaataacagacccagagcacaacaaagttggagtaacctccatatataggaataagttcattataggtccctcatctcttgacgttgagtatgaaattcgtccctaaaccacaataacaggtataacaccccctctcacttttcaaaaccgatatacgcgacatcccaaggcagtatagcagttggtttcggttgacttgacaattgagttagtatgggacccatatcagggcaaccaatccaaatctaaataataaagattggtcaaccacacatgttagtgacacattctcttctccctctctacattttttctcggtggccgacgatgagactgtatggtcgtccaggtgttggaagagggcattgacattggcatcggtgagaggaggtcggcagcggcatgtgagcaggcaccgcatttaatgcatgagccatatagcgcgaacaacggcatggaggaggacattggtatcggcagagaaggacgaatgggatcctacggaggctgttgcagcctcgtgagcagtcggaccatctctggtcaacctctccacttatgcactggtaggcatcggcagaggagttagagggacgaggatcctggcagcacggccatcacgacgaggtgcgcaaccaacagcagtaatgccctatctcggatggcgctcactgtcaccacatcgtgggttgcctcatcagatcctgtcgctgccaccacaatgagaggagaggagaagagaacctatcgtaacctcgcaagtagtcgatctgcctctaagcgacctctccgcttgggcgctgtcgcccggcacggagtcggcccttctccccgccgcttgccaaattccggcccctacccctgtccacgccgcctgtggcctacatcttggcttggtgaagatggggatgagaggagaaaagagttaactgctaacgtgtaggacccatgtgagccccacgctgactcaacaaagctgaccgaagttaaagcgccacatcagatgaaaccgggagccatattgcctcgagacaaaaagttgatatggtttcgcgagttcgtggatggactatacttggtatagcggttgagagatgaattttaaacttggcgtcaagatgaggaatctaaagtgaactcattttccatatatatgcagatcatggtccatcttatgggctttcactgggctggaagcctggaaagggccatcgctcttcataggctacgacgcataaagtggcacaaccacggcccacaggcatacgagcccgtccgtgcttcttgatgatgcatgctttgtcgaagtacgtagaaacaaagaacatcggggatgccaggatatggacatcactcagttcatctcctacacattggcagattgctgcatctacaagaaaaaaaaaacgcatcaacctgccatgcagtgggtacgttacgttacgtagctgccgaagctggctgggaataaaggggaaaagggagtgagacgatgtatggttggcgtcgttgccgtggtcctcgaccggtgctcctttccaacgttggtgaatcatgatcggtcaatttgcaacgagagagtgatggaggccagtagctagccgcccacgcattcttcctcttctctctctgtgtttggaggccggccaagcggctaactagcgtcgtccaccgtagtgggtttcctccttttgaagcaaatgaacaatgatcggctccgaaaagaagagcaacttgtcaggtgtggtcgactatcacaccataagacctggcccatttgagtatgttccgggaattaagccctcaatcggcacaggcgaggagttctcatcaccgtcgcaaacacacaagtgtttgaaaccgggcaccggcaactagttgggctcgacatcaacacgagacttcgctttctctctttcttttttttccccttttcttttctgacagccactgtctgccccgagcagagcacgcatatatgatgatcatcatctaggactgtagtcttcccaagtgtacacgcccctccctttttacctttccgaacctccgacacccacgacatgttcgttagtagtactggtgctggccatgcctggcggcaaagctactactagcccccatcgtatcagtatagattcatgcacgctagtgggagcacgacgcacccagcgagccagccatcacgtaagctgataagccctttgccaaatcatatccccaccacgcaacacgggcaattcggcgcgcgtgccgagccggccgttccgatcctccgacgcgagtgggcgacgcgtcgcttgactcgcgcggcccatatccgggtggaaaagggggtccaaaaggggggagtgaattccgagttcgcggcgggttggtgcgcgccgcgccgcgcgctcctgcttgtcggcgcgcccgcctggcagcgaccgaacgaacgagcacacatgacacagcggagccggcaaagcagtacacgcgcgaggcgcggggggccacctcgcgcgcaccaggggccaggtacgctcgtccgctcgcgtcgctagtttaatcggtgggcatcaaacgctggctggaaccgtccaactgccggcgggcggggcggagtcggcagtggaattccagagcacgagcattatccactctgtccctcctctcatcgccccggtcgctctcaccgctactcccccaccacgcccccaattccacccctatctcgctcgcttattatatagcggcaccagatgaggaatcaatcaactcatgccgctgcacttgtttgtttatctttaaagctactagtatgtgtagctaggaacggatccatccatccatcgttgcattcctcgttactccaccccgtccttttgtttattgggagccacagataagatagcaacgccctccatccacctccctccccacttcgctctctcgtctccggccgcgcgcgcaagtccctgtcaactgctagccccgcctgcttcgctcacctcacccaactaacccctccctcccctcgtccggataacaaccaatgcccaccatcaacacatcatgattatgatatggccatgattgattgcagcagagcatctgcttaacaccactactaatactagagtatccatctctactgtgtctctgcgactatcacaagggcaggtagccgggcgggcggctggctggctggcccgttttggctgtaagagcatgtacaataggaggctataaaccagttataatcatatatcgagaagaaaagagaagagagagaagaaagcgggctacagatttgtagccggctgtaacacaaacttcaaaatgttatatgtgtatgagaggtgagaccgggtattaatggtgtagtatatttttatagttaactattgtatgaataagatattagattggctatagatgttttggagctagtagttggctatactattgatcttgctctaagggatctggatttggtgcacgctattcctggttagttattggacggacaagtacaattagaatatacagctcggcacgcgcatgtactgattagggcacatcgtccctgttggataaaaataaccaagccgtcccctagaggggatccaaacagatcgatcgagctgatatatactactcctcgaacacttaaaccatccacaagtaggtgtttttttcctgaacaatataatcgatccgaccaagcaataaccaacgctgccagaccaagcgaggtgttttactcctcgctttggctctctcagcttgtcttttgtgccttgcttgaacgaatacggtatcctatcctgtcatgccctggcctccccgtacgtcggcggtccagcaggaagccataaacgcgggccgcgacgtataaatgacccgtcaccgacaacatctgtgaactggaagtcgttgcgcgattcctaacagaagcagagaccgaaatcggtgcgcgcgcacccacacctacctacacggcggcaacacaacacacacgagcgcgcgcgtccaccccccgtgaaggccgtgacgtgacgtctcaaaactcggaactcgccgcggttggacggattcctcctcctcgcgctcacccaaaccctatcccgcgtctacacgtcgcgttcctagctaagccgcaccgacctccacccggaccgatccacgccgtccacatagtcgcacgcatcgcggccgtccgttccaactccgccgaccccgaccaaggtgggcggcgaggggggatggacgtatgtggcggggacgggatgacgatgcgctcaaccaaaaaaaaagtggaatggacatgacacgatgcgatgtgattagcccgagcttgcgctgctaatcttgcgggaaatctacgtcattagggtggagacgatgagtagtagtagtagtatgattgggattaggagagggaggggccggggatagtgggcgggcgttgccgtcgctggcaagcgaaaattgacgtcgcttgtccggatcagcacgagcgacacgtacgtgtgttggcatgggcgggcggatggaattagctagtgctctgtgcgctgcggtgcggtgccgtggacggggagggaaacgtccacgtcggagcgacgccacctagccgcctcctcatgtcgacatgtcggtgcctgcctgccggcgcgcgctacgctagcgagagctagccggaggagcggttgggggctggcccgaaattagtggtgctctcgctcgcgtcgcgtccaccgaacgttgtaccacccgatgccggtgcggatggatcatggatgggatggccgtttgtgtttatcccagccgcgacgcaaaagcagccgggctttgcaaccgtacggccgcaggctggaaaggggggggggggggggggcgctgcatgcggcatggagtaactgcgaacgtgcgcgtgtcagtttttaattgtgccggtggtgcaactactactccagtcaagagcagcatcaacaccgaaatttgtcgcgcgccgtacgtacttaaccccgcgctatcggttttctgctttgtcaacgcgtgcataacctgcgaggtgaaagtacagttaatcatatattggtactgttttgtcttgtgcgagagagagctctaccctcctatatatacgatcgatgtttccaagcacaaaagggaaccggatatactacagatttgggcgaaaacaacgttgacgacgtaaaaacgaggccgaacagttcttccgcgtgtggttgcgtcccagcaccggaactgaaagcgtgcacctttttcctggtttccgcatgcatatgcgtcccggcttttcttcgcctacaccagctttaggcctttagctactagtagtacattgaaatcctaccgtaccagcgcgacacgcgcatgcaacgcgaaccatcaagccgagctgctccgttagctagagccagccatcatagataatcagattcattcgtggtacgacgttattgcccacctatctcgccctcccgctccgacatgtggtggtccaatggcttccttttcacgcgcgcgcgcgggcgcgcgcaagcgacaaagccagcgatccgagccgagcccccggcctgcgtgcactactagaaaattcaccacgaaaaaaatcgtggcatcaatactaaaattatggcaatagatatatattatcataattttaaaatcgttgctagccgtggtaataaatagtggatttttatttagtggtaataaatttaaatgttgccacggaatagatgtggcaaaaagtcatattgcaacccactccatatgtggcattagttttacgtaccaaaataaaagttcaaatattaatctaacatcctatctatttatctatttgtttttttatatcgtgtcttggctaggattcaaatccaagacctatccttcacgcgtgctctactttaccaactcacctacacatcagttctgttggaaaatgcatatcgttccatttgagcctatctaactgagatttgaatcataaatttgaatatctaaaagatttcaaatgaaaaagttatcacctataaaattgtagatctcatcaagagctataatttccatataaaatttgtctcaatctgtgtccatatgaaaaaattaagttaaattataagacgacaatttttttattgcaatgaatttgttgatcgtgacaacaaaaaatagtgaaaagtaccatgtactgtgtaaattgccacaaaaattaaaattatagcgatagaacatgtttttttgcaacaatacgattttttttagcgatatctcattttctattgcaacaaaagtactaaataaaacaacgattgtatatcgttccattaaaatataattatttgctacagaaaaattatcgttgcaatagtacaatatattgctatgaattattttttgttgtaataatttggtgataatagcttaattatctggtattggtgtcgctccccgcttcgcgcgcgccacgtacgcgtacgctggcttgcttgcatatgcacgtccctgcgcctacccacgctacgtacgcatgcaggtcggtcctaacctaatgatgcgtggggggctcatctcatttgctcctggccggcgtgagtcgcgcgtcgacaaccttgaatctgcccagcccagccgggggccacggtgtactgttgtaatagtactatctatctaatctagctagttagatttgcatgatttagacccggagttctggacagggaagccggccgccggccacacggccagctattcccgcccaattatgcatgggggcggctagctgacgattgactccacctaaaaggagccaattatcaagggacaaattagcataattaaagtgtgtatattggctttggactacaatacatactgtataacttcgctgtaaagtttctttacggagaaaatgccatacgttagtaacggcccagaaatgtcgtcgtctcaagcttttggcgcaaagacagttaacggttttactttagtgaatgttaccgattgtgcttctaattaattaatggcattgacctgtgtacgtggcttgctgtctggtgtaaacaggcagttcgatcaagtacatatatacatatacatatttctgaaatgtgtaacgaattttcgacagctagaacttgaagtgaaagtacatgcatgcatggctacacggaggctcacccaaggtcaacacgatcacaaatgtggcgacaaagtgtgtatgagggttggtggagaagagaaaaaaaaagatggatgtgacgtaattagagatagtcataattttattttattttcttcgagctgcacacaatgtacggtgatgtggttgaggatggaatttataatcaacaaaacaattaccataacaatggcatgcatgatcactaaattgattcagcttgtgcagaaaccttgtaatattttagtgccaaaacaagcagcgcgacaaaccattttagtcattaaaatcgaatagggtcatatgtatacccacatgtacataggccaaaatgacgaaataccactattagtttttccctgacttaatgttatttcatttgccagtttgcggtatatgcgattttaatcataataagttaatacggtaacatgatatatacaattccttgtggtttctacgcaactaattgctgaccctaccatatgtttattgaacctggtttcaccatgcaaagcaatatcatctctctcatatctaagatgaatggtaaacaccataagtttttgtggctagaatagaaaggcaggcgcatggtgttgtctagtccaattgtggaataacacaagttatctcaatgtgttgtgtaggtgttggtgttgtaagatatgaatgatagcaataacaccaacaattaaacgacaattagtaacaaaatttgatctcaaattacatatttgtgtcgacgggagatacccgtagaccggataaataaaatattggggtacgttggtacgaggatctacacgatatgacgataaacatataaaaaacaaggattatactagtttagacttctcgtgaggtaatagccataattcagtttatatgagattgatatggaaaaccacagagtacaaagagaacagatgaatccgacgataccggcgagatcattgttgagatcgttcgatgagatctcccggcggcttcggcttgtgtccttcggcttcgtaagctatggcgggtgtgttggcgctgtgattcgatgatcctgaactccttcgggggtgtgccttttataccatgagtttccttagtctccaagtagaactcggagacaatgaaccttgccgatatagaataatccctatcccctcctagtgggactctgttaatcgccggcccgtgaggatatttttcataatatcttgtatacttcgttattgcatacggaaatatatcgtatgaaagatggtataccaatcttgcatattcggtaaatcgtaggatagaatgtatgccttatccgtaaccttaacactttgaaactctggttattaattagttttccaattgcctaattaacatattagattagtcctggaaagaaacatattctcatcgcctcaaaatataacaatttttagggatggcatatatatgcacgagaggagttgaatttgtttttaccttatcgggatgggtgaagtagttccgaactataagagcaagtttaatagtatagccaagtattgacctcaaatcatttatagtcaatttaatagacaattcatataattgttatctataaacctataccacacaaataatatttggttccacttgtcatacacacatgtatcttggagtctgtgctgcagctgactataaatctgtagcccactgtttttctcttttcttttttatcttttgaaaatgtttttataactggcttatagtctgctattgtgtatgctctgatagttccaagggatgataggtgcagtgcaacggagttatggagctaattctgatgatgtatttaaccgatttcgtctgtaggacccagcaaaggggcactagctaatcctgcagtatcatgtgtttattgatcataatttcatcatgtgacacaccataagtcactatgactggaatggaaatggaaagcgcatggctcgttgtccaattgtgacggagcgtggggctccttaccgggagaccgcgctggcccccctttgccggttcggccggggactctgggtgagactctaagctcccaatctgtggaaggttcgcgagacaggaagcacacaagacgccggcgatgtatacaggttcgggccgctcagaagcgtaataccctactcctgtgttttggtggatttgtgtatgaaggaactacaaagtatgagccagcctctccctcgttctaggttcccaatctggaaaagtccaatccccctctaagtgggcaaggtcctccttttatatcttaaggggataccacatgcaccatttccctctttttttgtgtggggacttaccccccttttcataaatggacggagatttgtatagttgccgtccgagtcaccttctgatgggacggcccacaactacctccactttcgccgggagcagatgcgacgtggaatcgtggctgtctgctgacgacatgaccggtgtcagaccagtcacgtcggtcattcttgtccaccacgtgtcagcttagcaatctacatgttcgcccttcttcacacaacatcttgcctgtaatggttaggatgaagcctggcatatatctgaccaggactaacgtgccatctctgggaggtaacacgctagctccagctggggacgagcgcctagaagccctcgtcctgacgggacggggcgaggcgtgcttcaaatcgcctgtcgccacctaacccgcgatctgaccggtctgtgactggtcacagaccggataaacgagcgtgctgtactgcgatacaggcggcgtgacgcgctcgtcaaaactgcaataaatgtggttaggtgagccctgccatgctcacctaccccatatacgtggcgcaaagcccacaaggggtcggggcgcttccgccctcggggcctagacgggagcggcccgaccccttggggagacaaagagaagggcggccgtatcaccctcgggcccgaccccccccaagggagttaggccacgtgggtgatcgtgtctgcctcaagtctctaagtcatgatactcccggtaaagaggagggcgaacacatcaccctcgggcctgacgccccctgacggtgccaggccacgtgggcgattgtgtctgcctcaagcctctagtcatgatactcccggtcccatgtcaccgacagtagcccccggcgttatgccagggcgatcgccctcctcgagggaagcggtcgggcgtaacgccacttcctaaggcctggtgacaggtggggaccggtctccacacttgggcagaaacccaacggccacaaatcacgcatatcggcaatggtaactcggctgtcaataatgagcggtctcttcaagactgccacattactcgagtagcacacgaatctggacatggcgattcgtttcgtctagagatatggtaacgtcgcttcggtcggcgagcgtaattaacgcgcgcacgatatgatctatctcgactgccacaaccgcatatccacctcatgcgccgcaagcgggcgaatgggattagtggaagcgtgggcgcgagaaacgagggggcgaaatagtgggcgcgagaagcgaggagccaggcacagcgttggcaagagtataaaggcactgaggaagggatctgtttccttcctttcgccattattccccttgtcttcgccgcttgcgccctaactccttctttcctgtgccctaccttcgccacacgtgctcgctcttaatcttctcttcctccggcgccatggcacggggctccgctctgctcgatggtagcgtgctgccgccttcccgcattgtgagcgagaggcaggctgggctggcgcgccgtttcatgccgggatctgccaccggccgggagatagtcacgctgggcgagggacgcccggcgccagactacccggggcggtccgtcttctttctcccctttgcaatggcagggctggttccgccattttcttctttcttcatggatgttctggagttctacgatctccagatggcgcacctcacccccaatgcggtgatgactttggccatcttcgcgcatctgtgcgagatgttcattggggtgcgcccatctcttcggctgttccggtggttcttcaccgtacagtcggtgtcgccgccatcggtagttggtggctgctacttccagccacgggggccggtgctgaaccgctacatcccctgcgccctccgcaagaagtgggacgactggaagagcgactggttctacaccccccttgccgacgaagcgcgcctccgacttccgagccagcccccggcgcaggcctctagctggcgggcgtcggtagatctgggggatggctatgacgccgtcctcgaccgcctggcgggcctgcgatcccaggggctcacaggggccatggtgtacggcgactacctccgtcgtcggattgcgccgctccagcggcgcgctcggggcgcctgggagtacaccgggtccgaagactttatgaggacccaccagggagtgagatgggactgggctcctgaggacttcaagatattggtccaacgggtgctgaatctcaactccgtggaggcgtccctcattcctcaaggaatcctccccctctgcagcgatccagaccgcgcctccatcctgaccattatgatggcggtcggggcctcagaggagcgagctccaaagggccacgacggcgcaggcgggagccgcaggggggaacaatctaccccgggagggggtcgtgcttctgggtcccgcgacaggggcccggggagtagccgccttgccgacgcccgggggaagagcaagcagggaggaacacctcccccatctcctccccgagggggcggggcggtgcgtgccagcagcaggcgcccggagggggccgcgccgacatcgcagcccgagagggagcgcaagaagaagcggctccgcaagacgggggagacagaaccatctcggggaaacctcatttcccctccaaagtggtcgtttaaccgaccccctcgcaggttcgtctctcacccatcgtggctgtattcattctctcaacgcgagttttcactcacccatcttgttcgtcttctggtcttttcttttgtttcagcgagatcccgttgcgtccctcccgccattccaagtccggccagtctgaggccgaggatccggcggccgcagaggcccggaggcgggaatctgaccggcgagaggccgcggatcgcctacgggaagccgaggaggccgcccaggaggccgcccgggctcgccaggccgaggaaaccgctcgggaggaggccgcccgggcccgccaggccgaggaagccgctcgggaggaagccgcccgggcccaccaggccgaggaagccgctcgggagaaaaccggatttcgccaggacgaggcgatggcgacttccgaggcagctcgcgacgaggccgcgggcgcgtcgcttgggcccactccctcgggcgacgctcaggcgacaacttccggggcagctggcgacgaggctgcgggcgcgtcgcttgggcccactccctcgggcgacgctcaggaccaaacgggtccgggggacatccccgagtccggcacttccatcggcggcccgagccgcgtggcctcctctccaaggcggctcttccccacgccttctatcgctccactgaacgcagagccccttctgcaggccttggccgccgcaaacaccacggtgttggatgggttaagtgcccaggtggaggccctacaggcagagcgggcggagctcgacgccgcgtgggcgcgtgtcgaagaggggcgacgctcggtggaggccatggtggaggtgggccgtaaggctcaccgccggcacgtctcggagcttgaaacccgtaagaaggtgctggcggagatcgccaaggaagtggaggaggagcggggggctgccctcattgccaccaccgtgatgaacgaggcgcaggacaccctccgccttcaatacgggagctgggaggcggagctagggaagaagctcgacgctgcccagggggtgcttgacgctgccgctgcccgagaacagcgggcggcggagaccgaagcggcgtcccgggggcgcgaagaggcccttgaggcgcgcgccatggcgctggaagagcgcgcttgcgtcgtggagagggatctggcggaccgcgaggccgccgtcaccatccgggaagcaacgctagcggcgcacgaggctgcctgcgccgaagaagagctcgcgctccgcctccgcgaggacgcgcacaccgagcgggagcgagctctcgagggggccgaggccgcggcgcaacagctggcggacaatctgtccctccgcgaggcagcgcaggaggagcaggcgcgccgtaatctggaaggtgcccgcgccgagagggccgcactgaaccaacgggccgctgaactcgaggcgcgggcgaaggagctggacgcgagggcgcgcagcggcggggcggccgcgggcgaaagcgacttagccgcccgcctcgcagctgccgaacacaccatcgccgatctgcagggcgcgctggactcatccgccggggaagtcgaagccctccgcttggcaggcgaggttgggcccggcatgctttgggacgccgtctcccgcctagattgcgccggtcggcaagtgggcctctggagagggcggaccgtaaagtacgccgccaaccacggaggtcttacccagcgcctctcgaagatggccggggctctccaacggctccccgaggagctcgagaagacaaataagtcatcctcgagggacctcgcccaaggagcggtggagctcgtcctggcgagttaccaggccagggaccccaatttctctccatggatggcgctggatgagttccctcctgggaccgaggaccgcgcgcgcgcgcaggtccgggatgccgccgaccatatcgtcgacagcttcgagggctcggcccctcggctcgcgttccccccaactccgacgaggagggcaatgccggtggtgcagacgacagtgacgacgaggccggcgacccgggcgcatcggattgagcccccagaccccgccattcttcagttttttcttcttttctttcttctaaggccttcgggcctcttttttgtatagatcaacttaatctgtaatcaaaaatgaagaaatttttgtatcaatttcatcttgctgtgtgtatgagatgaggatgatctgtgccgtggtccttttgtgtcttagcttgattaagggttcgtgcccaggtcccagtcctcaaaaggcgcgggtcggggctagtgcctggggagatccacatgtcgagactggccaggccgggaacgtggtgaccgagggttatgggtgacccgattgtgggtttttgccgattcccccccggagttcaccacgccccggggcacggctcggttctgggccccgtttggcgattttagccgacccgagcccccgagggcaggattgagcatgagtgacctatttcaagtcaagattcttcaaaaggaaaaaacagcacagatacagcctttaggaaattgaaactgcttttattgaaatactgaaataagagaaataagaatgtgcatgtgtggcagcccccggccaaccctgcacgcccgagggggtgcggggttggcccgagcccgaaacctgacacccgaccccccctcaggggtagaagcgacgaaggtgttcgatgttccacgggttaggcagctcagtgccgtcgcccgtggccagccgtatggagcccggccgggggacgccgaccactcgatacggaccctcccacattggtgaaagcttgctcaatccagcacgcgtttggacgcggcgtaggacgaggtcgtcgacgcagagtgatcgggcccggacgtgacgctgatggtagcgccgcaggctctgctggtagcgcgcggctcggagggccgcgcgccgccttcgctcttccaagtagtcgaggtcatctctgcgaagctgatcttgatcagcctcgcagtacatggtggcccgaggagacttcagggtgagctcggatgggagaaccgcttccgcgccgtagacgaggaagaaaggcgtttccccggtttctcggcttggtgtagttcggtttgcccagagcaccgctggcaactcctcgatccatgaatcgccgtgcttcttgagtatgttgaaggtcttggttttaaggcctttgaggatttccgcattggcgcgctccacttggccattgcttctggggtggtcaggtgaggcgaagcagagcttgatgcccatgtcttcgcagtagtcgacgaagagttcactagtgaattgggtgccattatccgtaataatacggttaggcactccaaaccgggccgtgatgcccttaatgaatttaagagcggagtgcttatcgatcttgacgaccggataagcctcgggccacttagtgaacttgtcgatcgcgacatacagatactcaaacccgcccggggcccgcctaaacggtcccaggatatcgagtccccagacagcaaatggccacgaaagtggtatggtctgcagggcctgggccggctgatggatttgcttggcgtggaattgacacgctctacatcgccggaccaggtcgaccgcatcattgagagctgtcggccaatagaaaccctggcgaaaagctttaccaaccaaggtgcgcgaggcggagtgggctccgcattcgccttcatggatatcggcaagaagcacaacgccttgttcccgaggaatgcacttcaggaggattccattagccgcgcgccgatagagggtcccttctaccagcacgtagcgtttggagatgcgatggacgcgttcactcccttcgcggtcctcgggtagagtcttatctgtgaggtatgcttggatctcggcgatccaagcaatcaatctaagggagctgggagcactcccctcgggtcccgaggcctggactccgacgggcctcgggggccggtcaggcgcatccgtctcccctaaggggtcgggtcgcgccgacggctgggcaagcctttcttcaaaggcgcccagtggggtctgggctcgcgaggacgcgagccgtgagagttcgtcgaccatcatgttatcccgtctgggcacgtgccgaagctctatcccgtcaaaatggcgctccatacgccgtacttggcgcacgaatgcgtccatctgcgggtcagagcaccggtactccttacagacttggttaacgaccagttgggagtcgcctaacaccaggaggcggcggatccccagtccagctgccactctgagtccggcaaggagtccctcgtactctgccatattattggttgctcgaaagtcgaggcggaccaagtatctgaggacgtctccgctcggagaggtcaacgtgacccccgcaccggcgccctgaagagacagggagccgtcgaactgcattacccagtgggcggtgtgaggcagctgcgaggggtccgtgctggcctcggggattgagacgggctcgggagccggggtccactctgccacaaaatcggcgagggcctggctcttgatagcgtggcgtggttcaaagtgcaaatcgaactcagaaagttcgattgcccatttcaccacccgtcctgtaccctctcgattatgcaagatttgaccgagggggtaagacgtaaccacagtgacccgatgcgcctggaaataatggcgcagtttcctcgaggccatcagaatagcgtaaagcatcttctgggcctgagggtatcgggttttggcgtcccggagggcctcactaacaaagtagacgggccgctgcacctttcggtgggtccgaccctcttcgctaggggccgcatccctggggcactcttcgtccaagcagcctcgcggggcgcacttgtcttccgtgctgatgacctcggggtcggaggataacaggtgcggccttcccacagtggcctcggggccttcctgggggtcgggggctcctggcgtcgtcggacaagcgggcaaagggccaactccagtcgtcaggggccttaggcctccgttcggttcgggggcctcttctccctgctttttcccgggtcgagtcagcacagggttagcctcggggtcaaagggcgataggtgcggccttcccacagtgacctcagggccttcctgggggtcgggggctcctagcaccgtctgacaagcgggcagagggccaactccggtcgtcgggggccttgggccaccgttcggcttgggggcctctcctccctgctctctcccgggccaagtctgcacaaggtggggtgcgcggaatgaggattgtcctcatcgcgctccacgaccaacgccgcactaaccacttgcggggtcgccgctaagtagagtagtaagggttcatttggctccggggcgaccagaaccgggggagagctgagataggccttcaactgagtgagggcacgctcagcttcctccgtccaagtaaacggcccggagcgtttgaggagcttaaataagggtagcgccttctcccccagcctcgatatgaaccgctctatacttgctgggggggcgcatccgctctatagctcgtatcttctcggggttggcttcgatgcctcgggcagagaccaagaacccgagaagcttgcccgcaggtacaccgaacacgcacttatcggggttcagttttatgcgggcggagcggaggctttcaaaggtttccgctagatctgagagtaacgtttcctggttgcgcgtctttacaaccaagtcatcgacataagcctcaacattacgtcctaattggctacccaaagaaattcgagtagtacgccgaaaagtaggacctgcattctttaacccgaagggcattgtcgtataacaataggttcctatgggggtaatgaacgcagttttttcctcatcctccctagccatgcgaatctgatggtaaccagagtatgcatctagaaaacacaaaaggtcgcaccccgcagtggagtcgacaatctgatctatgcgaggcagggggtaaggatccttaggacatgccttgttaaggtcggtgtagtcgatgcacatccgaagcttgccgttcgccttgggaacgaccaccgggttcgccagccattccggatggatgacctcgcggatgaatccggcctccagaagtcgcgccacctcctcgcggataaaggcttgacgttccggggcctgccgccgcactttctgccggaccggccttgcgcccggccgtacggcgagacggtgctcaatcacctccctggggaccccgggcatatccgccggtctccatgcgaagacgtcagcgtttgcccacaggaaagagacgagcgcgtcttcctatttgccgtccagaagaccactgatccgtgtggtcttggacgggccgtcgcccagggcaacctccttgaccgggacctcatcgcacgtgactatccgctgcctcggggcggcgggggcggatgtgccaagcctctcgtcgccaccctcgggcttggacacgacggcgaggcggtccgcgcgctgctccatacaagcgagcgcgactttgaggtcgccatggacagagatggggccaccggggcccggcatcttcatctgtaggtaggcgtagtggaccgccgccatgaacttcaccaacgcgggcctccccaggaccgcattgtagggcagactgaggtccgccacatcgaagttcacccgctccgtgcggaagttggcgggtccaccgaaggtgaccgggaggtcgatgtgacctaacggccacgtgtgccccggcgtcacaccgataatcggctgggacggccggagcatcatccccggggccttgatagcgtcaaaggctgcgggggaaaggatgttgagggccgctcctccatcaatgaggacacgccccagcttcacgatgcaaacagtgggggaaaccaccattgcgatctgtcctccccgggcaacgcacggtgggtggtcggtctggtcgaaggtgagggcaacctccgaccaccgcgcccggcgcgtcgcctcatgagtaggggccgcggccagaagctctcgcttcatggccttgaggctccggcgagaaacgtgagcacacgctcccccatcgacagtggcaatggtggccccaggctcttggaaacctaggtcatcatcgccgtcatcgatgtcctcggcgggggccttctgcttggcctcacttcgccgattgccggaaggaaccgccggggacttgccctctcggcgctcctgcctcctctcctcctcccacttcctcgtccgctcagccaaacttttgaccgcacggcagtccatgaggtcgtggagggaggtgttgtggacggtgcaccacttgccggctgggcgctccctgctgggagcgccggcctttttctttttgtcgctcgcaggcctccccttttgggtggcccgcgaagcgccctcgacggcgaggacatgaccctcgtcgtcggaatggactgacctcttcttcctcctcctgtcacgccgccctatctgagcggcggatccgggggcggccgaagctgccacaccggaaccggaggggttccaagtccaggcctcctccttgcgagccactcggtccgcgagctgaaaaagctccgcggtagtctggggctccttggaggcgatcttttcgagcatgcggttgtgccgcacgcccccccctgaacgcgtagattaccgcatgtgcagggatgcatggtatggtgttgcggacttgacagaaccgctgaatgtacgagcgaagtgactcatcatcccttcgctgtactgcgtgtaagtccgcttcttcacctgggcgcggatatgtgccctgaaagttcatggtgaactgttggcacaaatcctcccaggagtggactgacgcgggtggcaagttcattagccaaccccgcgcctgccccttcagggccatgggaaagaaattcgccatgaccctgtcgtcacccccggcggcctcaatcccgatcgtgtagacctggagaaactcggcggggttgacgctgccatcatatttttcggcgatggtgggccggaaccttgggggccaacggacattccgaagactcgccacaaaggctctacagccgacaccaccaaccgggggcacggagggctgattcccgcgtccgtgttgaggtgacactctggacgaggaagcgccctccgttgcgtgggtagcacgtcggtcattacgccgccgctcgatgctggtgcgggcgtccggccccccacgcagatcttcccgggtcgaaggagtcgacgaaggagtggtggccgaatggcgaacggcagctgccgctcgccgcgcccttcgtcttgacgacgcggagccggtggtagcagcaccagaggccttggtggcggaggaccgcccaccagcatctagacgctgtcgtgcagtcatgaccaatttggccacatcgtccagccaacgttgggctggagactccgggtcatgggcgacgggcgggtgacgtaggagcgcgcccgcagcttggagcgcgccctggggcgtgctgccgtcaccgtagacgaggaggcgacgctccccatctcgccgtttttctccatcgcccgcaatcggtgaagtcgcggatctttcgaccctctcgagtgcctccccccgcttaggactttggcgtggagggggcggtggagtacgagctcgacggcgtgggttcggctccccgtcgtcgccactcacactcggagagaggtcgtgcgcctttgcttgctcagccatgaggctgaacaggaaaagcttggcgcacacgaaagagtgcgagagctcagaagatcactcgcagagccccctacctggcgcgccagatgacggagcgtggggctcctcaccgggagaccgcgctggcccccctttgccggttcggccggggactctgggtgagactctaagctcccaatctgtggaaggttcgcgagacaggaagcacacaagacgccggcgatgtatacaggttcgggccgctcagaagcgtaataccctactcctgtgttttggtggatttgtgtatgaaggaactacaaagtatgagccagcctctccctcgttctaggttcccaatctggaaaagtccaatccccctctaagtgggcaaggtcctccttttatatcttaaggggataccacttgcaccatttccctctttttttgtgtggggacttacccccccttttcataaatggacggagatttgtatagttgccgtccgagtcaccttctgatgggacggcccacaactacctccactttcgccgggagcagatgcgacgtggaatcgtggctgtctgctgacgacatgaccggtgtcagaccagtcacgtcggtcattcttgtccaccacgtgtcagcttagcaatctacatgttcgcccttcttcacacaacatcttgcctgtaatggttaggatgaagcctggcatatatctgaccaggactaacgtgccatctctgggaggtaacacgctagctccagctggggacgagcgcctagaagccctcgtcctgacgggacggggcgaggcgtgcgtcaaatcgcctgtcgccacctaacccgcgatctgaccggtctgtgactggtcacagaccggataaacgagcgtgctgtactgcgatacaggcggcgtgacgcgctcgtcaaaactgcaataaatgtggttaggtgagccctgccatgctcacctaccccatatacgtggcgcaaagcccacaaggggtcggggcgcttcggccctcggggccgagacgggagcggcccgaccccttggggagacaaagagaagggcggccgtatcaccctcgggcccgacccccccccccccccaagggagttaggccacgtgggtgatcgtgtctgcctcaagtctctaagtcatgatactcccggtaaagaggagggcgaacacatcaccctcgggcccgacgccccctgacggtgccaggccacgtgggcgattgtgtctgcctcaagcctctagtcatgatactcccggtcccatgtcaccgacaaattgcaaaataacataactaatatcttatcttttttttacggaaagaaataaattagtatctcaaacctccgtgtgttgagtagttatatatatagatactgtgatatgaatgatgacaacatcataaagaaataaacaccatgatatttgatgacagagttcgatcatactcccaccttttatagatgttagatttattctatattttgattttctttttcaaataagttaatcttatttgttgttttcatgtatttaaaatttaaataaagagacaaattaaatatttaatcagaatctgatgagttttcttaatactcattgattctatgcatgaacatactccttgatattttttacatgtaagataatataacttctcttttctcttgatgataaaagtaatatgtataactcttatagatacttatagatagaaggaagaagttccatatatacatctttgaaactctaatatcattattccaccctaattaacttagttttacattgattttaatctatattgttattaccgtttgaaatccaactataattttaatttctttcagaaacttttcaaattaaactttttttaagtatatgttaagtgaggcatcgagaaggaagtacattagtagtacatagagaggccggggactcggcgaaaggcagattcataggttgatcgatgccgcctgcagtatactgttccgaaatgctgctttttgcacgggtggttgtactccaagacggtggtcgtcgacctatacgatgtccggatgcaagttagccggtggacctaacaaattacgctgccgctcgctcagctcaggctcccctccaaacagcacagtacagtgctgccgtcgacgtcttcctcccgagctattttatcattatcgcaaccaaactctaatcataccaccccccacccacaaaatcccaatacaaataccacccatcaaatagatagcgagaaagaaaagagaagagaagaagaagccgcccaaccaacgccaaaagctactgctgcttgcacaggagagggcagagagagagagagagagagagagagaagagggcggctgcggcggcggcgcgcttcgctcatgcagggcgagtaccaccgctcctccagcgaggactcggctgcttctgctgctgctgctgcggcggcggcggctgcggctatggctcctctcgccgcggctgcggcggcggttgctgccaaggaggagcaggcggcggcggcggcggtgctgccgctgcagcagcagcagccgaggcggcagtaccgtggcgtgcggatgcggaagtggggcaagtgggtggcggagatccgggagccgcacaagcggacgcgcatctggctggggtcgtacgcgacgcccgtggcggcggcgcgcgcctacgacacggcggtgttctacctccgcgggcggtcggcgcggctcaacttccccgaggagatctcctcgctggcgtcgctgtccgagggcggcggcgcgagcgagccccgcgagcccgacggcggcacgctgtccgcggcctcgatccggaagaaggccatcgaggtcggctcccgcgtcgacgcgctccagaccggcatgatggtcgcgccgacgacccaccaccgcgagcggcagaagcaccaccaccaccaccaccaccaccacccgcacctgcagccgcacggcgaggagcaacaccaccaccacgagcagaagcaccagcggacggcgtggagcggccgcgccaagaacccggatctcaaccaggcgccaagcccggagaactccgacgccgagtagaagccaacaaaaccgcctccgcgcggcaagatcgatcaacggcttcgtcaacatgcagccagcgtatgatcacctccaccacgtacgctcgctgcatccatccacctaccacctattcgtccacccctcatctccacctcggcggcggcggcggcggcttcgtggcgagatttttcgatgcggttttggataagaacaagggaagggcagcgtcgggaggagggcggtggagacgggggaggaggacgccacaagtggcggtctttccaaatgtcaaaaaagacagctgtaacagtgataaaacaagtcatcctctctgtttttttttcctctctctcttctccgtgttattatcgactagataagcagcgattaattaatccgtccttccccctttaattcttctttggttgcgtcgtcgcacacacagtacagggagtatatacaatttgccaagcttgatccagttgctcatctgcctcaccccttaatccagttgtctgttggtgagcaaaccccggccggcgcgcgttaggttaggcagccagccacccacatcgttaatcactctcacagttaagcatctgcctgtaatgcgtgtgtgtgaacgtgcaaaaacgcaatcatgcatgggatcagtggacggcgtagtggtggtgagccatgtcttttggctaatctaatcaccaattatgagcttaccacattaccactagtactatcatgggggaggtagcaatcaggtcggtgtccaatggcaggagcccgtagtacaactaactcggcaggagtgtccgccttcctgcctgtgcctgccattgaaagtatgcgtcgcgtactcgcgttgcatatttgcatggggatcgatggttgttagcctggccggccaccacattggaaaaacgtcgtcgtgattggtcatgattgcagtggcgtgtactacgttttctcatattttgcatgagcttcaagtactcctacaaccgaccttctattgcgaaacaatggctgttcgtgccggaaatcgaatggattgattcggactcggcgtggcaggttatgaatcctctgggctgcatcatatcaacgatgggtgaacaagaacaacccatgtagtatgtacttacgccgcggcagtaaattttgctggaccatcagcacatgatggtagtaatgcaaaacacgggctagctgcagacgcatgcagaggcgacagcagtgcaattttttttcgtacgtacagacagtgcgtgccggccgcccccacccctccactgttctacctccccaattgttgtggaactaacttttgcatcaaactcgtcctctctcgcccgttaattccctcaaaactcgattaaattttcgaatggacaaaacactgttttctccttaagagagtactacattttgttactatttgtaccacaatctgacccttttccagcgatccattcatcaattgtcatcaactagctctccaggatgttgttactgttctttgagatttgttgtagccagactcagccagaccgaagctcgcctgtactacaaaggccaaagggaggggcctcggcggtgtagtttgcgattgctgaaagggaaggcgacgttgcctgccgactcgctaccttttctggcctttttgggcgccctaccgatcggacccaacaagccacccacgaaaccagcacgccatgacacatccgcttgtgtgctgctcctcccacgaaaaaagggccccccgtttgggggcgcgcacccgaccagccgcaccccaaatcatctggctgcatccgcatcgtctgtagccgatcacacggctcccacggctcccccctcccctccaaactgggcccgtttcgatcgatcaacctctgccaaccgcagcccagcctcgaatcaacaaggcccataacacgttgtaatgagcgcgcgaaaaactttcttgtgaaagtacaggagtcggaggaaggaatccgtatctaacgatgattgtgtccgtgttgtgcttgtgcacaaatcgtgatggggcatggaatcgagttctaacgtgtccggccgctgctagcgtccaattcgctgagcttgacggcgaatctaaacatgcagttccaaatcagggccctatctagctagctactactactagtagcattagcagcaagtgagggctagcacaaagcagtcgagtcgcgagcagtagatgagtggagcggagacgataccctgccggtgggaataccagctacagcgaccggtggccgcgccgcgacgtgcgtgtttttttgccgctttctgtggcgtcgcgcgcgtgccaccaacaccaagtcaccaacccctgcgtttgccggtcgcgatgccgcggcggggacgtcggcgtgtgggcggatgagagggaaaaggctccaaaagaggccgggggggagtttggccggcgacggcgacgtcggcaattgcgtgccggcttttcgcgccgcgggcgtctgtggccgacaagaaacagatacaaggtgcaacgaacaaaaacgcattggatcgatcaggcagagaggaaacatgaattactgcaaaacagtagtaccaggttggttggcacatggtagtagcatgcgtagcagataaggcaggattaacagggcacagacagtgaaaaaaatattgagccatcatccaatataccagccataaatattcagttgaatgcagagcgacagattccagggattatttactgcaggagggggcagtttgcagggaccagttcttttacctttttttttaatcaaatttgtaggtcaatggcaaaaaaaatttctaatcaaaaaacggcacggtaatatgaatcactaaacgatcttgcgatcgaacaagcacacagtgtttactgccctgtgctttttctaagacttcagagcagtatttttgcatatgggacaggtgttcttcacaaccagccattgcctgacgcatccaacatggaagtcatgtccacagtccagtgtcccgagatcatccccatcaacatactcttcctggataaacagcgagaacgaacatagttagaagacatcaatatgaattattagtttgcagaattgccaaaacttttcattgatttaagaagacaatgaagaaaaaggaagatattgagcaaagacaattcctcaagtgtatcccaaggtaagatatttgcttgggtaggtcagtatatgcagcactaggaatcttgaacaaaatcatattcaactttcagctacaagttttaaaagttgagcattgttgtccaactggtagtggttcacaggcctgaccgacttaattgataattacagctacattattgatagatgagtgtttttcaagttaaaatggacatactcacaggcttatgtcacctattaggtatggcgtacaattaacaaagctaaatgcacaaagcactgaacctgctagatttcaagttaactaaacaaaggaaactatgtcacaagcttctgataggcctgagttatacctggcagatacagcatggctcttcttccacagatgcttccaacctccatgatgagaatttcctttgctttaggagctttgtcacttcttcctcactgaggccagtgctaacattgcctattctttcttccagtgccaatagctcctggaagacaacagcaattatcagagttttgctggagaaagatccagataatattgtgctaaggaaaaccaacctcataagacatgttgtctatgtcaaggcgcatatccctgtgtctgtcatgaatgtcgactccaccatagaaaatggactgtagcaagaacagatatacgtggaagcaagagtaaatacctcaagaaataagcaaagattttagaaaacaaaaaagggttcagtgcaagttgttgcctatttgtttctctctgttgaaatgatgactatatttttctgaattatagatatactatggtctttcatgcattcactatatactatttccatattacaagaaacttctgttttcagaaacaaaacaacaccttatgcgatctctcttttataaaatggattagaatccagcctctacatccaaactgaatggacagagcaaaccttatgtaatcctagcatcaactagtattagtcagccagtcttgctgtgagtttttaggacataatatagtttcatcaatctctacaagtccgtgcagataaaaataggcaactgtaggtaactccgaaaccacagttgttactgacctcaaatcttacattttcccctctgtgaatcatttcaagcgcgttccggatctggtgacaagcaaaaaggtaagaaacatattgtcttgcatagacttcatggttacacaagtaaataaatgaacgacgcatccaacatggatggctcactagttattgcctgtccaagccacatagttctagagaataacatgcggctagaaacaaaacgtagcatgcataaggtaaacggtccattgaattttataactattaatccactgtgtcatttaaaaccaaaacaagatatgtgctctctctctctctctctctctctctctctgttgagttaataaaattaagtgtcactactaggtacaagatgatggtgcgtaagggggggggggaatttagcaactgccgtaacattttcagattggtgagaaactaaagtttatctttccaccgcagaattaggtggatggctgcagacatgcgaagaagcatgtgagatcaaaggggaaatgagatttagaagatcgtcagaatattattcctaatgatgcttctgtatgtccactaaacggatgtaaacataacattattctgatttctgacctagttcagaaacaaggcaggcaagagaagggaaaaaaagagagcagaattgatacctcaattaatcttcttccttccctgctcctagttgacaacggaacaccccaaacaccatcaccttgtcgttctaacagaaaaccggaccttaggcgtgggtgctgatggccacgaagagctccagataaacgacttatctcctataaaagaaaaaaacgcaagaagattactaaaagataaatcgatttgaaaatggaacatattgaactgagcaggcgaaaagctacctctgacaaattacgaggattacgtctatgcaagttttgatgggcaataaatggagagcctgctggtggattaaccatcgaattggtattagctctcgatgaagaaggaacatttcctggaatggtagtagctctgccatctacattccaactagatggttctggtatcaaatgcctcatgtctagtgcggccggaggaactgcatcagggaagctggtagccactacattcctcgcgctaaattcctcactaccaataattctgttctccaaattgcctgttcttgatgatgaggcccctggaccagtgaaccggtgtgacatctgtggaatgccaggaacgacattcattggatgctggtattgaaagttcaggctactgaccactggaattacctccggtggttcatcaaatgaactctgaaagggaggtggctgatgattccatgaattggaatgtctgatagtacttgaagatggccacacaccataggggccaatatgttgagccaggctagttcttggccgaaaacttctttgtgagcctcctgaattgttattgcctccactaggatcatagctactagatgacaatccagctgtagtagctccataacgcgggagttgttcatcaagagtgcttggaaccaacagacaattaggagagggtaaatttgtactaggagagggattatgactcgaagaagcaatgttatggaaaatactatcgttcctgtgggaaaaactagtgctagcacctgccgagcactgcccattaactccttctatatttttcctcttgcatgccagccggcggcc

SEQ ID NO: 80205 - DNA, 20228 bp, Oryza sativa
tcgctcgccatggcgctctccttcgcagtgatggtcacgcggcgtccgcatcactatccgtaagtccgccgcgaagcgcaagccatccacctctggcagcccgtggtacggacccgaccgcgtcttccgctccaccgatccggctaggcacgtgcggagcccggcaaggaggagagaggaagatgggggcggcctccgccactagctctctccccgccagccaccgtcgaccgccgggctctccaccgacctgccatcactccggccctcgaccgcccgccatctcctctactgctgcctcctcctcctcagcctccatccgcgccgactccagcccgaagcgccgccaccactctagcccccgcccatcgccatcactgtaaagaagggaaagagagggaggaagaagagagaggatgacatgtggggcccacacattagtgggccccatattttttttcgaatgacaaatgggtcccacatataactctaatgccacctaagcgtcacgtcaacgccatagactagtcaatattgtctcgtagacgccatgttagtgaaaccaccctccaaaaccaccgagggagttaaattgcaccggttttaatagttaggggtcgagatatccggtattgcgtttgaaggatacagataacattctgtcactagttaagggagaaaaattgaacttattccattttctgacgcacgcatgaaaggtcaagctcccactgaaaatgggccgcactaaatggaccggacggcccacaaaaagaggaggccacgtggccttgctactaggtaacatgtgggccatcgcgtgggcgtggtcggagtttaattctccgaaccctgtctaacatgtctctggcgatataccagcactccagcatacagcagctctagccttgctggttactgtagtctgtagttagtagttaatcgtaaaatttgccaaaatttgaagcagaatgttatgctgaattttcgaagttctcctgtgatgtctgggagatgaatgccaacaaacagataaacaagaacccaacaatcaaaaccttctgtagcataacctgattcagtatcatgtcatgtgcatgttttcaaaacaagaaaacatgttaagccatgcaaggtttgcttgttccactgcatgcgtataacaaaaacccgcagtcaggtaacataattaatctaaccaaggcggtgatgaattcttgagtacaattgctggaatgttttgtgttgcgtcaaacaatatatataatatgtgcggccatgaacgactccaaacctccaaaattaaggaggttactgccttactgatcacgttgcagtgtttcttggatttgcatggtagctgatctcagcagagccctaactgaaatataccataacatgatgtcaatgaggggtcggagttttaaactccgaactcctttgggatctctgacggccatttgatcacgcttgcgtttgcgcagattgaacagtgaaccgatcgagtagagagagccacggcggactcgtcgatcgaacacatgtgacatctcgaaccactttacactgcatctctgacatgccgcgcgccggacttgtggcaattcgtcagtaatcgccgtaataatgcttgtgccgcatgaacgaacgaacgtacggcgcctgatcgagatgccagatgaaccaacagtaaggccacccgttggtaagaaaggcatgtgcgcgcggcgagcatctcttcgccgctgatggcggccggaccttggtcagacgtcggtgcgcgcggcagcgatggcatggaatccggagtccactatgaggaaagaaagctgtagtctttgttcggtttagagaggattgaagaggattggaggagattgagggggaataatttcacaccacaataagtgtggaataaatcccctccaatccctccggattaaccgaacaaggccgcaaagggagaacaattgccatgtcatcggagatcagaattccgaccctcctcgggtctagctctgacggccttccaaagctaacaacatgtagtcagtcagatcacatggtcaatgtaaccaagacagtgctgaaataactaacattagcctagccacatctgaattattgagtgcaattatcgaaaccgtaattttgtggtgcataaaacaatgggaccatgaaattctactccagcaccctcttttcgaaaagaacaagatatcttccataccaagatcagaggcattcttctacttcgcccttagattactttgccatgttgacgctctgcatagcttttctctatcgtccgtgagtgccacggtgttcgatcgatccgtgtggcgctcgagacggcggccggccgtcacagctctaagccagcatggcggttcaatcaagcccctgtgtggcccaaatgagactaaaacctgtgtcaatgcggttataatttgaaaatttttagtttttatcaatttgggaataatggagtaatatttttctagcaaaaggcaacatatatgttgacagcgttccttatgatagaacctaagtactcaggtttaagttgtagattttatatgtgtattcgcatttacgattggttatattttaagtggtaaataaatgaaatatacgttgagagtgagatgcttgtgattatctaattaatcttaaaatatactacttaatttttcggagatgcttgtgtgtgttttataaggataagtgtggacaagctgtattgctgttctaataattttgctgagaatgtaggatagaattactatgctcattcatacataagttctacgtgatgagtagttaaccaacgtaagtgtggggcatgtgggctccttcttctatatttttcttttacggggaggacataagactggagctcacccacgcccagccgctcgtctagttttttttatctttaagatgcttttgctatttaattacaccatcaagatatggtatatcctaatactatgaatttaaacagagcattatattttaagacggatagagtatctatcaagtgaatggtgacactggaccaacgataagccaacaagccggtgtttttttttcttactaaatgcttttactatttattatgtattagtataagtgaatgttgacacttggaccagtgatcagccaacgaacctgccggcttgagaaggatgaatcggatgtagtgaaatcggtcaagcctccaggatggaccaatggaaatacccacaattcgtgcaggtcccatcctggctccaacttggcatgtacagcaacaagcaataaatatagctaggctttttagattgtcaattagacagctgatttgctaaaatagaggaaagaaaaaaatcaaatgtaaagcttcacaacgccttaaaattaactatttgcatttacaaaaggaatattttctatacataagggtaaggaaaatgaaaaaaaaaaggtaataaatattattttgaagtattaatagctagaaccttcgttgtctcaattgttatgcgaggttagtctctacatagctggcaagtcgactagggtgtgctctttccctagtttttccaactctcccatgtcgttttttgtgcacacgtttttcaaactgctaaatggtatgtttttttttaaaaaaaataattatatactaaagttgttttttaaaaaaatcatattaatctatttttttaaaaaatatttaatacttaattaatcatgcaataataagtgtttcgttttacgtgccgagaactaacccctcctcgcgaacgcagcctaagaggctctaccatgcaacatatcatgtgtttgttttttgacgcatgtttcccaaactaataaacatggtatctcacacacacacacacacacacacacacacacacacacacacacacacacacacacacacacacacacacatatatatatatatatatatatatatatatatatatatatatattgtgtgtgtgtgtgtatatatatataattttactatacacacacatatatatatacatatatatatatatttatatatatacatatatatatacatatatatacatatatatatatgccttaaaaatcatattaacacatatttcttaagtttttttaagctaatacttaattagtcatgcgctaaatcttcgctctattttgcgtgttgtgggccgggggaggggttccaatccccacaaattgtacgggtaaaatcgaaccatgcttgaaaaaatcgactacaacacactgcagcaaccaattgttatatgttaaagtaaaatatcgaccacaaaagaagagtcgaacttagcgttaaaaagatggtttgcagctgttggttggctgcacaagatagggatgtacgcatgtgattagagattctttttctataagggtccaacgatccatgtcacatattgtagccaacaaatcaaaattttgttcgaccatactaatcgaactagaactgcaggtaccctaaagctgacaagttgtattccattcgaaagaacacccttacagttacatccactatccttggccatgggtggttgcttcatgtgaacatatatgtggactgtgggcctgtggcttgctagtgccaaattggttgttgaagaagggccgttgacccctagtcaatgacagtgaattgtactcccctgcctgtcctgcaggtgctataaattctgaacctcaagaactagaccaaagcaacaaagcgaggtgcagtttcagtgagggaggaaaaaaagagtgagaagaaagtcgagatcatgtccctttggaaggtgctcctgatggtaatcgcgctcatctgcgccctgcatactacttcaggtaaacgagttaataagttttttttactattgtaaatttataattaatgtctactaccttagttataaaataaatttagaatatcttaaattgatgtctaaaatataatttattctgagacggatatagtataatctctattattagagaatagagagaatagactgaggaatttaattgtataatttgatgcagggagacctcccgtcgtgggatatcctgctcctcgtcccaacggtagctcgggcacacgatgctacgaaggctgcaaccctccaggtagagatggcaacagggatccataacagagaccctctgctaccctccaggtagagatggcaacagagatccataaccagagactctataggtttttattttattaggagtcatatatgatctaattcttgtatctatggatttatcaacagaaaaaaaatccttacatgttggatagatgggtattagttctttagccactcgtaccccttacctatgggtaaaaaatacctatatgcttagcgtgatagtttacttactttgaacgttcatgtatggtttaatactagtatggtttatttacttgttatatatggtttaattcttgcatgatttgtttacttgtatttgaatgctaatactaaaaccaaggttacttaatatgatgtcgatagttgttatcgtaatcgtttagttatagataaaggggaagggagaagttcactttagttccctcaatttatcgtcgagtccgaaatttatctttgaaatgcaaaaccgggtacaacacatcccctagcttacaaaatcagtacaaatatggggtctctcggcaatattgtgcccagttttggttgacgtggcgtctacgtgggatcctttaactaggtgttcgttccacgtggtattgatgtgtcgcttacgtggaaattcgatccgagaaaaataataaaaaccgtaggacccacatgttagctacacacgaaacaaaaataatagagggtccgtgtggccccacacgtcatcctcactcctccctcctctctctatcccctctctctcctcccttcttccagcagcacgccgccgctgggggattggtcgccggcggtggaagtgttaggcggcgggcaggagcatcatgacagcttcggcgtcttcctgtacaaggtctcctgcggccggcgtccagcggtggtggtcatgaacggcggcgaggacgcgatccacctcgtgcagtgggtctgggacacgcacgggcggcgcgcggtggcgggggcgacatcctcgacgcggccgacacgcggctgaacggcgagttcgacggcgcagacatggagcgcgcgctgaccgcggcctgaggccgtcagcgtgctgcggttcgtggcgccgctgccgagcctcccggcgaagatgccggtggcgagtacgggccgccggtgtccacagcgccggcggccagcagcaacgatttccatggctgccggaccaggccggctcactgcttcagctactgtccaggtagctcgttcagattgatgaatgggtattgatgaaatggcaagccatggatgcaaatctcaatcgaattagcttattattcagttgtctcgaatctcgatgaatgcgtttgagtattagagattcagagttggtgcctgttcttggccgatgcgaaatttgaactcaaaggaatagttgaataaaaacgtctgaataggatgcactgaatatatgagtttattccaggtgattaataccatatcatgagttggcaatgccgaaaatcttgtcatgttctttggatattctgaattcagcatctgttcacctagttcgtgttacaaagcggcaaccatcgtgtaatcaacatgttttgtgtctgaatctgtcatcaagtttcgatcgagatggaacacgagctgctagtgtcgtcgttgccaccggtggactgaatcagccgccagcgccatacgtgcgtgggctcggaagacattcgcacggatcgggcgcacggtggcctctagcgccagctggatctcctccatccgccgccccttctccccgccggtcaccatccttctccctgccgccattggtcgttgcgcctggagagaggagatttgaaatgtgtgatgattttatgattttggtgagattggtgtgaaatcaatatgcaaagaataatgaaaaaaaaaaaggataggaaccagagacgtggcgctagcctcaccaaccgggaccaaagattttcctctttactcccggttggtgttactaaccgaggatctttaatcccaggtatttgaaccgggactaaagatagcgatctttagtcttggattcttagtactggttggttaccaaccgggagtaaaagacatttccccaccagtagaacacagccatattgatagagtagagctaatggttgggcctcagaaaaaatatgtataggacatgatcaaatagagccaatgtcggcaaaagaaagctccagaaaaatcactctcccaaaggttgcaaccccgcgaggtcttgggttcctgcccttcgccacgatacatcgtcttcgattatctagatgattattattggcatcgactaataaacatttaaacaacatatggtaagtggtaagacatagaacactctgattacacactgttctttggaagaatttctgcagagtactactactactaaacaagcaaaacatcaccagaattcaaggccagtacaagatcaggacacggccggaaccataataccagaaataacgagcaactaattaattgatcgactcgaacaatgaaagaaattaagcgctaactaagagcacccacaatagttatctatggctctctatgagagattcatgtcggtatatttttctacttagaagagattaaataaagagagagagtaaagctatctactaaactgaagatagtctatagagaaaaacgaggcaatggattagagagctatagatacccatgtagacatactattgatcaggtggtttactgttaatctagtctattgctgagatgtacatgttttataaagaataccttactttaccattgcaattactgcgtgattgatgggtgagctatctggtgcctttaattttgtatccatgacttgagatatctgcagctacagatacaactttcgagacgtacgcaaaggtacaacgtcgactcctcctcgatgccgtaggaggccagcgtgcggtcgtccgcaagctccataccggagaaaaccagccgttgcttgcacggcatggtcttcttcttcttcctgtagtacagcttcaccttcacgcttcccaccgtgtccgacggctgcaccttcagcgccgtcgccttcttccccccgagcactctcacgaagatctgcatctcatccgtagcagcaggtcgagtcgttagggtttgatgatgctcttggatcagtttctgcgcctccatgtgcgtgcggatgcagtcgcagctggcgaggcggccgcagaggttcaggtacgagtgcttgcggatgccgcaggaggccaccgtgtcgccgtcgtcgagctgcctcccctcgaagatcagccgctgctggcacggcggcagcccgtccttctcctggagctgtagcttgacgctctccaccgtgtccgacggctccacccacagcgtccaggtgttccccctgagcccgctcactaagatctgcatctccgtagcggggtcgcggatgccgtagtcggccagcgtgcgatgaccgtcggcctcatccatctgctttccgtcgtacgccaacccgaagtcctcagtgatccccgacatggccttgatcttcgccttcacgctctccaccgtgtccgacggctccacttccagcgtcaacgtggcccccgtgatcaggtccacggggatctgcatcctcttccccctggaattaatcgtcgccgccggccaccacagtttcgtccaggtcacgatcgagctggtgttgctctggttgttgcgcggctgcgtgacttgccggaacgacgtgtatataaataatataaagggcagggcaggcttaggtcagaacggttctggtgttggagttcgaaccagtcacgacggcaaaagtaggttcggatatgaatctcaaaatatatttgggatatattctgcggcgatgaatcccaacatacatatatacgagtccagaggcgctggacacgttggagttgccaagaaattttcttttcatattccctttttgtttatgtttttcttcccttttaaatatgtgatttgaattttgggttcacaatatatttggattatagtattctaatagaacctgactattagattagttttctagtataactcttagtctttattcacgacgactcctagttttctcctgtgtatatccctcgtaagccgcactaggagggtacgatagcccaatgtatctctgcgtttgtatccaactcctcaatagtaattattgttggttggcgcccgtggttttttcccaaaagggttttccacgtaaaaattcgtgtctccgctgcacatctatttccataacacactttattttgggttcgttactacctgcttagtgcttagtgctacgtgacaggtggtacaagccggatcgaagcaatgtggcttggtaggggtgggcaaaataagaccgaaccgaagaactggaccgaaaagaccgagaccgagaccgagaaattcggttagtgattcgatatcagccatcaaaagaccgaatttttttcgggtaattcggtcataggcttccgttaaccgaattaccccaaaaaactgaaatttggcctaacaggtgtacgaggcctaataagcccactaaatagaacaaaccctagagggagcaaccgagtaaagtcgctctcaggtctctcagcggctcagcccctcactgcctcgcatccatcgcgtcgcctccacgcctccgccttcgcctgcatcgcgccgcctccgccctccgcctccagcaccggcgccgcctccgcctcgacgtcgcctctgcccttcgcctccagcgccagcaccgccgccgccgcctccgccctccgcctccatcccacctctgcgcctccatcccgcctccgccttgtaccgtgggtctgtggctgttgtgacttgtgaggttcagacttgagatctatcctgtgataatttggtgcttgatgttgcctattgtttggtatttttgtgatatatatgtctgtgaaaaatttctaaaaagagggaagtgctgtcaaaatttttcattctcctgaaatttcggttagaccgagtccaagaccgaatttgccagtcctgagttttttttatgaaattcggtcctgactttccaaagactgaattacccgagaaaccaaagggaattttttagtctgaccgaacgcccacccctatggctcggtcgaatccagatttgtcctagcatctctgcaaccctctgttttgttttgtttttcttcacggcaactttagttgggaaaagctacgactttagcaaacgatttaactgtgacctttaactcaccatgcatgtgacatgtgggtccgacacgtaacgacgtgagttttgcgcgtgccagagttgactaacgggcctaaaattcatcaagtgtatgaagttgcacttttgtgataaaaaccatttactattgttgcggtttcatgaaatgtttcactaaagacatcaacttatggaatagtcacccgaccgatccaccgtgtccaacggctccattcttagcttcactctcagtgtcactgtactcctcatcaacacactttcacgtagatctgcatctcagtagcaggctgcgtggaatgtaattgagctagggtttgatgcttttgaattagtctttgtgtctcgatgtgtgcgcagatgcaatcacaactgtcagcgaagtgatagcagaggttcatgttcgagtatttccaaatgccgcaggaggccagcgtgtcaccgtccttcagctgccacccctggaagatcaaccgttgctagcacggcaacatcttttccttctcctagagcttcaccttcacgctcttaaccgtgtccgacggcttcacccacagcgtcctagtattccccatcagccccctcacgaagatctccatctctgtagcaggatcatggatgccgtaatcggccagcgtgcgactgccgacctcatccatctgcttcccatcgtatctcaaccagaagtcctccgtgatccccgacatatccttgatctttgctttcacgctctccaccgtgtccgacggctcctgatgtgaccatggctattatagatacaaccgttgctcacatcatgaattaacaagaagacatcaagatcaagtcctccatgtgttgcaatctgattcggccacgtgctacattgctgacttcaaacggccgccaaatctacatacgtgctccgttttgggcccgtgagtacttgatggaaagctctcgaagtcttctttccaacggatccaacctcatctcggaattccatctcgtttggccataatcacagaagcaaagtgttgcgtcacctgtaatgggcctatgggcttgtaacctcgtctgggatcccggcccaagtgaggcccatgtgggatgcatcccaatctggtgaagcacgacccttggacaatcttggtcgtcctcctacctctataaatagttaggtaccccttcagggtttttcgggttttgtttagatgaaagtttagctattgctacttccttgcagcgcgcatgtgggctagaccgtccgtctgcttgtaatcggaaccccaacttatcatttatgctcaattcctatttgtaattcagattgcttttatcttgttcttgcttgtttcttcgatttgcttgcaggaacaaggttgatctgcatcggcaagatcaacaaccaacggagaggtgtatcgatcgctaaggcgcaacacaacgtcttgtacggttgtagtcgggtcgtcaacgtttctctcaaatcgtagttatctcaactcactgaaagatcgggccaacaacagccttgagtgtcgagtggaactcagggttcatcagctccacttccagtgtcaacgtacccccctcccacctccccccctgatcagctccacgaggagctgcatcctcttcccctggaattggcggctgccaccgcagtttcgtcgagatcgaccgagttggtgttgcacggctgcgccgggaacgacgtataaaaagggtatgacacgacggcaaaagcacaacccggatacaaattcatacgaatcccaaaatagtttgggatacattctgtggcgattccggcgatgaatccaaaaatacatctacttgtttcaggaatgctttgactcgagcgttcgatacgcgataaaaaatcggacgccaccaccgagtgggtcccacctaaccactcttctacgtacctttttctcatcaaacttatccctatctcaaattctcagccacttgttctctctctcccccatcaacaccgtagcggcaaggtaggaggacaccaacgacaacgtgaaaagggaggaggatgacggtgaccacgctggcggtgatggggcggcgcaacatggagaaggaggcggacgctctgcacctcgttgacggcgcgacgtgtagaggggggaggacgccggcgaccttgctgacggtgcagcgtgaagagggaggaggacaccggcggaggcagagcaggccgacccgaaagggaggaccaaatgaggcaccactggtggagcagccacgagcccacgatgcgaaggaggcgttggaccggatgccgatgcgactggccttggcgaggtcgccctttcgacatggctgcttgcttgtcctcgtctacaccatcaccacacctcacttgtctcgccgtgttggccgcttgatttcggtgaccggaatagaagacagaggtgggttttgttaggaattttagtgatgttacagtttatttgtttttttggttgcactttgttctatcaagttgtttcattctattttgactcaattttgcgtacattgtattaaggtgttgcaatcagtatgttttactattgcatttggttgaaacaattttactcaagtgttgaaacatttttatctggtagtgaaacatctgagacaatttttatcgagaggtgaaacatgtgaaacattcttcaacaatacggtacaacaccgtccaataatttgcatcaaatcggacgtccgatccgtagcagtctccatttgtttcgggctagtgcgaacaagtccaaaagcgctggacacgctggagttgcgaagaaattttcttgttcttccctttttcttttcttttttttctttttaccttttttttctctggggtgattacaacttgctgctagtgctatgtgacaggtggtacaagcctgagcagtgtgttgctcggtcgaattcagagatttgcaccaacgtctctggaaccctctgttttcttgttttgtttttcataaatttcaataaaatgattcgaactattagtatactaaaagacaggtatttcacaaagctacaattttaataaacgattttatcaataagatgcaacctgtaagttatcatgtgtgtgcgatatatgggtctgacgcataactatgtaaattttgtacgtgtacctactagcgaacccaaaattcggtttgcttttatatttatttttattgcaatgtacgagcattatgctactaaaataaagctcttcattatctaaaagatttatatggtaaaccgatagtaaaatgttttccatgctatgaattcaaccatggcacatcctaattcttacttgcactgcagcagcacaacaacggtacgcaccttctgtacagtagacttggatatatgcatataattaactagatgatacctcgcactttgttgtgagatttatagatgagtatatattaaatattatcgaaatgatgaaagttaaaatgttaaaaaaataatatgaggaagatggtttgacacatacttgttgatgatgtgtcatgcttgtatggggatttaaaataggctataatagtaattactcgtgagtgaagatgtgacatgcttttatgggattttaaatgagctagaatagtaattgttagtgggtgatgatgtggtatgtttgcatgttgagctttggcttctaataattaataattgttagtggataccaactatatagaaagtatagatttattgtggtagtatttttatttcatatatatactcctcgtatgcgtcttaatctacgtatgtatactgttgtgtaaaatcttgtgttgaggatagtgctctctatccatttgcaggctgaaaacgtgtcctaggtaaactaggaataactggaatatctggaaacttgattagcgtaactaattaataagtatagtagtaagcacaccttaaagacggtaaaaagaataaaatgtcaatagtcagatattttcaaccaaaataattatatgtatagaagtatagaaattcaaatagccataacactaattcatgggagaattttccagtgcagtgctaagaccaacacagttcaagacaagcaaagatcaagacgcgaccaaattaaaatatcagcaactaattaaccaattcaaacgataaaagaaaacgttaaataatatccgtctctcacacgatcttttgaagtactaattttatttcatatcctctggctaaaattcaattaaattaaaattgaggatttatcatttctaggtatcaacttttaaaacatctcctctccacttttcagttcatcaggtaagtccacacttgccgcaggtgagtcagtcgtggtgcttcgccataagtgcgccaacgtctttgcactctgggttaggacacatcagtcgtagcctctccaccttccccatcacgtcatcgacacgatagtgacggagcaccgcaagctcttccttgcggtgctcatgctttcccttcttaggtgtcgcgtacgccttcttctttcgcttcttgttgccgccgccgccaccacagatgcgaccgaggaggtgcagcgtcgactcctcctgaataccatagtagattagcgtgtggccgtcgtccagctgatgcccctggaagatgagcggctgctggtctggcggaagcccctccttgtccacgagcttcaccttcacgctcttcaccgtatccgacggctccatcctcagagccgtcgtcttccctgtcagccctttcacaaatatctgcgtcatcaccgtcgacatcgccggccgccggggttccgcgagatcgtgtggcgtgtgccctaggttgtgttggtctcagctgcgtggcggactcgttgggaacgacaagtataggcgaggctcgtcgacgtgggaaggggtggtccgtccgatctgaataatcggacggtggtgatcgagtagagtccggttcgaaaccgacccggagaccacaaggcccggcccaatttggttcgagccttcgaggccgcacgcgtcgcggttgcgaacacgaggcgaggaggggagaggaggggagccggcgcggcggcgaggaggggagaggagaggaggcggcgatggcggcgatcggctcctccaacgtcgggttccaggtgcgcgaagctctccatcccacctgggcttccgtccgttcgaatcccatggccatgggagtgggtgggtgggtggggctagggtttgatgctttgttcgatttggtcctctgcatctcggtgcgtgcgtctcgtgtcgtgtcctgaatccggagctaatcttaagtgatcttgttgctgctgcagctgctgaagaaatcgggctggaaggagggcaccggcctcggcgcgcaagagcaggtttgcgcctctgttcttgcgtcaccggaaatcttttgtgtgtgtgtgtgtgtgtgtgtccatttaccccaattgtagttatattttggggttttgcactttgatgcttaattctgttcatcgtgcatgtgattttgttttccctcggcttgtttggtaactcgagggaaggggattgggagtttacacgagagaatttacgatgagattaagatgggaatttgatttttaatcccaatgtcttgtttggtagatgtgatggaaattgatagggagtttagttggagattagctcattaataaaaacggatggctgagatttgcttagaccaagtaaacgaggaattccctcccaattacctgcccctacccaggtattgaaaaggagggagtttcttcctcaattctccatcccaatcccaccaaaattcccatgtctcccaaccaaacaaaacacttaatagcctcatccctctaaactctcaatccctctttaaaactccctccaaccaaacgggccgtagttgttaatggtgcgtagagttaaatgttgagacaaggctactgcaagttgaactgttgaaagctcaaaaaaatgtgtagatcaacgtaagatatatgtttagtttctggataatggttagtggtctctggaggaatggtaaagccaaaatttgtttccgaaccaagtaggcaggtagcttaccttagttggctgttaactccaaatgtttagtaggatctgaaattatatatcattttgaccggaatgattatctcgcatgttcataggtattaattaagagctgatgtttagtagtcatatatgtgttacatactatgtttgcatgtcacttggatgaagccagtttatgggttagatttgccttttatgctgtgtttttgttttcatactcacttagcccaatttaatcctggaacagggaagattggagcctgtagaaagtcgtgtgaagaataacaagcgtggtttgggttccaaggaaccaaagctaaagccaaaggttgacgaggatggtgaaaaagaccctaaaaaacccaaggtgagcaaaggatatccagtttattcatgatacccgcatacaatacctaattactttctttggcttccttgtaattctcattccgagcattgtattaatagttcactattatcattagttctacttaatagccttttttattgaaaaatactgatgactgctctatagtgtagttcagtaaaaaggtttcagactttacagataaacgtggttacttgcatcgttactaattgtattggtaccagttattctttatgcattataatacttgtctcatttggtagctaatactgctgctttgatatgtatttgttcatcttcaacaagctacttttagtaaatcacacttactgatgggattctaactaactgattcaaacgtgttgcccttgtcagctggaagcaccgaagaagaaggccaagttggccgcgaagaggatacggaagatgcaagaagaagagaagcggttacaagagagggaatttgaaatggctttcttcagggaattttggcccgataatgtgtagaacaggaggttaaccttgctgggcggttcgacctgctggcttcagcttattaggctcccttgtacagaacaacagctttgactcccttgttgtatgtggctaaaatgtttacattgattcaatggatgtttctggagagaatgctggtcttgtatcatgattttgttgtatagaactgtttgcaatgctgttacatgctggccgaataccttttttttttgttaccaaactggcagagtacattcactttacagtcataaaaggaaaaattttcatccataatcgcccacccccaccccgttttttttttcccaaagtggccgcgtttatttttgaagtcataaaaggagaaagttccatccataacctgaggaattggaatttgaaatcccatcgcatagcatttggtgtgtggtgtacacactcagtttgataatgtaaactgaaagaaaaattgctgaaacatattggctacaatgacccatacaaagggacacatatcatatgctgcagttgagctacaacaaaatcggattttatgactgaggtagcagtggcgactgtgatacataatgaaaaggggaagaaaaaaaatacaaaaaaaaaagctctcgctatggtctgaaaatgaaaaatgcagcaaaagagatttgtcaccaaattcggtgccaatttctgtctatacaaacagttaacgcacgtcaggattatgcgttgcttctcaaaaccatatgccagcgcctagctacaatagcagcggttggcgccacagcaccaagtatggtaggtcctcaactctgctggctacctaacaaaaaaagaccttcacatctccctccctagaataccaattcatcctcctcttcagttgcaacggatagtgtgcctgccgatgcggcatcccgaatctggccggccttctcgtcgcttatgccaagcagatactgcaaccttgacagcttttcaggcttcggaatgctcttcatgtaaatgccgtacagatcatccagctctcctgatgtaggccatgataggggcttcgaagcaggcacagccgcgtcgcatgcaagcaagtcgttcaaggatgcgacctgcattggcaatatattccaagtaaaaattagaacgctgagtaattctaacagtgcagttattgtaactttcctatttatactctagttgaatttcttttgtcattatgacgtgccagttatcaagaataggttaatcctgatatacaccaagatcaaagtcaacgctaaatcagtactttgataactgtagtcagtgttttaatctttcagattcttggagaaactaagttccaacataaaacaaataagtaggagatatgcagggatattccttacgtaccacttcatctttcttcttctgccgaagcagagcaacagcttggacaagggcgttatccaacctaatcttcgcaatgtcctggacaatcgacttggccttctcagcattaatgatgagatcagctgggatctttacatacacttcctcttcatcaaattcacctgtgcctgacgaaaagatctcctcaacggattttttgtaaatgttttctcgaagtggttctgcaatcaagctgtccaattgaaaatttgcttctttcaatcctcggacctgctgtataccaatctgtcctcgagaaatagaggcttcaattgcagaagacaactttgttgttgtgatattcttgattattttctgtgcatactcagtaggaagaccaacttgcttctgtatctttgcaagctggtcagccttggcctctgttaacttcccatcagcaagaatcacttcagcctgttgcacaaatgccttttctgccatcttaatgtgaacattctgagcttccttgcgggttaaaccaagtatgtctcctaattgcttcagcattaaatactctgaattatctttctttgtggagattgctgttccaaatgaaacattggtcgtctccccagtgacacagaacaccaaatatgtttcatacagctcagctctgtctctcaatggaatgtcatctttgagggttatctctttctggcttgactttgccagtttctctctgagctctttatcaggcctagttttccttaatgtctccagctgttcccattcgtattcatcatccccctcagactcgctgacttcaggttctgaggttgcatctgatgtttgaggttcagcagttgttggttctcctttaatgtcagctaaaagctcactcacaactactgtgttgaaggatatcatctttttcagctcttttgcagtttcaatgcggttcccagctgcttttgctctctgaatgtagttcaggaataacttccgtacctggtcatggatttggtaatatagaagtgaatttcattcacagtaggaatatattgaaaaataatatcatctagcacttttttttggtaatggggattaacataccactttgctgaaaatggccatgacagactcgtttttcaaattcagaccttgtgctgccttcttaacagcctgtcgtctattagtgtcatatccatcaacagatgaaattgcttccacgacaacctgcaaagcactaacggttgtaagaacaccactaacacagaacaggccatcaactttgcctgaacaagggaaatatagaacaggcaacatagaatatttcatatcaccttttcaaacaacttgccacagatttctgaatggacagcatcaacagtttcttgtggaatgcagagacgcacttggaatgccatcaaagcttccacttcgtccttgttcagctctccatccgctacaaactgctg

SEQ ID NO: 80206 - DNA, 40756 bp, Oryza sativa
aattttcaccagatagatcattaccattgatgttaaggcctatatcaacattatccaaagaaaggttgcgctcagctaccaagcgcctttcaccaatccttaggccaccaccgatattacgttgctcagctttgatctcattagagcccccaaaatgtagtgaactgccacttgcacttgcttcgcctgattcccaaaaacctaaaaaagtgccattttgatgcacaccgtttccatagggaatagttccatcactacggttcacctgataaccttgaaggttatgtgactccactgaaccaagaatgttgttccaatatccttgttgatccatgacagggtttcctgaactggatgcatggtcaaatccaaacacatcagcaagctgctcaacagagttcttctgtccttgcattactgaagatgtgctctttatcaattgatgtctggcaatagcatctcaggtgctgttcatctctttcaacaattgaagcaagtggtctgcaaatgtaagaaagattgtaagatattagaattttgggtaaaaaatatgttcttagcattgcccgtacagaagaagcaaacaaacagtctcaaattgaaggaatgttgaatgctacggttcatcacacgctaggttctgctgaatttcagtcattatgttactgaacaacgcaagtctaatcctattgttatatactatctttaactaattaacatctatagaaatgtgaacagacaaatcttttgttcatgactcggctatcagaaagttattctttttgataaaagggttactatccagaagcaggaagactagtttgggttttacagaatagcaattcattctgtcattgatgagagcattaactaattttactgtagcaatcttggcatgaaccgcatttggtgaggtatatggatgcaccaaacttgatggtttgggctgttgtaagcaaaggttgtgctgatgcatgcaatttaatgagtgtgagacacggtgattgtacattgcatgcgacctaaacagatggactgcatgcaagatgggccccattgcctctgtggacaatccaaaaaatatactactactactctcattttatttgcatttaattcccttccttttcggtttgcaaaaaaaaaagaagttttaagtaaaaaagacaaacggaaagaaaaggtagaagcggcgatccacggtttcaagggacaggttgattttctcgtgacgaaattgaaaggcaaccaacacagggaggaatttaaccaaccaagaacaccaagtcatctctgtttctcaccgtaacaccaagcaaagagaaacgtaccgtttacaaagtttgaagaaatgtgtttatgaaaaagaaaaacacgaatttttcacggtttaatagcatttgacacattccggactgtagaaaacatctcgtgggatgaaccacgaaagaatcaacacaagaaaggacatgtattgcaaaggaaccatagatttccaaccaaagagtatggcaggccaccatgcagaatcaaaagaacaagagaaattaaacaaaaacatagacacagagagatgcagcaaaccgtaccagcaacaggtgcagagattttccaaacagcagctctcaagaaccacacgagccaaaccaaagaacagacttttctcgatttcccttctcctctcctctcctccctcccttcgtttcttgatcctctccaaggcagagagaggaagaaagaaagagagagagagggagagaaagaacgaagaatcagcacaacaaccggaggaaacgaccgattgctagaagagaggaggagagaaagatggtgcggaggaggcgaccgaattcagagagatcggcagggtgggtggagaagggaatgggtggaggaaattttgtcaaggaggagagagcgagaggaaggaggaggagaaggagaaagacagggagagaaggaggtggggtggtggtggtgatgagaggatgtaagaggaggaagagagagaagtttggctgaatttggatttatttatttctccatctcatctctccctctctctctcttcctgtgggtcttggttggaaggatccctttcttcctcccccactaaaacccagcctttaaatgctccccaattcacacagagaattaacatctcctttaacaagggccaaacaaagattagtagagagcagagagccactgttgtgttgtctttcacatgacctccctccccccatccacttttggatttttgcagcactctttctctgcatgctcatcctctccattgaatagtgtattatcctgctctcttttttttttcttccttggttgagcatccttgcattgattatttctaggtgtaatccaagtgtcatgcctgcttattgaaatggctgcgttgtttgtcacttcatgagtaattgtgaaagggagctgttcactgtccagataagttaccagaggtacaactgtaggagtactattaaattgtgagctggttcttttaggagcactaaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggcctaattgtgttactgtcattgaaagacagccggtttctcttcaaaaacattatcttttccctaagtttatgctaaaccaagaggcttttccttgcaaggaagccattgattgtggtgtggtgttttcaatattctctctatcatgttggctgacacgcatatattcggatgggaacgcttaaaaacgagggttcacatgaattttgccatatagtttgttcctcctgtgcatcaaagaccacctttctttttgctgcatttccgcttctttccagctcaaacgaaataaaaacgtataattaacacctccggaaaatctgcaaacgttcttccaagcacctcaatccaacacgtgttgagccgagagaaatcacatggttattaatcccccaattaaatcctctttgatttttttttgcattcacaatacaactaattatcacaaaatcgcctaaaattcatttgaaaatttttgccgtcacgaacctcacgtagccacaacatgcacgtctcggggcccaccgtgccaccatcatgtagatggagtgaagtcaaaagccgatacgtgtcctaagcggtgcacggcatgcatgcgccattccagcttacgtccatgcacaaatcatcatctgaaattatcaacaagagaaaaaaaatttctctgcacgaacaactccccttttcaccggcacttacctagaagaacaccacacaaatgttttttttcccatactaataattacgagcttgaaattttacattcggtcaactgattggaccagctgcacgcagagaaagatgaggctaattatcagtggctgtttcagaggcgattttttttctctccatgagaacaaattatttgtgtcatttgtgtgtttgtgtggccttttttataggtcgttgcgggtgcttggaatgctttgccgctttactgatggagctcgtgctatgtggagtacttggcaggagaatatacggctggaatgcgcttggcccggctagctatgccattttgctttactttccctcttcttcctccatctcagtttggattggattctctgatctttagcaaccctctttaccatggttgctttgggctaaattgcgtaaagaacctcggctgcagactacctcctcattgggttcagataaaaaaaaagtgggcgaatttccatccgggtcatcaaaagccaaagcacattttaaaaaagcatatcgtttgggggagttaaagttattacagagtgtatctaatgagaccgaggagcgggcggaacgggttagaggtgcgaatgcgacaggaatcgttcgcagtactgtgttagaaatacgcataatcctgttcttttgtatcctaggatttgcatttcattttttcgttcttgcatatacatgaccgtatgtcgcagcgcagtggtaaacccagaaaaaaattattggggttcaatacatattaattatctaattattagttaatatataattaatgtgttacaaattattaaaattaaataatttacccaaggtctgacttggaaaacaaaacactacaaattcccatgccgcagcgtgggtgttgtgttgtggtcatgtttgtgcctagagagagtctttatagcaattctaaaagcaagtttaatagtatagccaactattagctctaatttatctatagccaatctaatagcttatttatacaatagttacatactacactattagtacctggacccacctgtcatacacacactgtgtattggagtccgtgctacagctggctacaaatctgtagctcgcttcccttctctctcctcatttatatccttaaaatatgtttgtagctggtttatagcctgctattgtacctgctctaatagtacatcccactattagctctaatttatctatagccaatgtaatagccaattcatacaatagttgattactatactattaatatatggtctcacctatcatacacatagtgtgttttgaagtccgtgctgcagctagctgtagatctgtagccgctgctcttatctcttatcgtttatctcattaaaatatgtttatagttgactaatagcctggtattgtaactgctcttactcttactcttagtagtatagcatgtgaattgcttcaacatatgggatgtcaatttcacgtggtcgattgaagctagagctagttagttgaggggattctcggacttggttgacacactgcacctataatagtcgttgatgatatgtgggattgggtccacctgttaatcactatcaccgcaagggcagcactacaggtaatccaccatgtgcaaatgtacgtgtttcttaaattaaagctacatattttttaaaaaagttatttataaattttaattaaaatactaatgaaaatgattccatttgattaatattagcaaaattatccatgcgatctatattgtatatatcattactgtcaaaattttcaaattaatatatttcaaaaaataattaatagtaggtactatcttttttatcattgttcgaaacttttggaattcagaattaatacaagttgtactagattggagtctcaattataactattcatcattttaaattgaaaattttggagcaaacaattattatgttatagttatttcttctttagtcagtaatattataattatatctgactgctagatttattcacaaagtgtaattgatatgaactcttatttcaacatgtggagtccaatacacttttccaatggcgtgcttattttacaccaattcttgatatgaaccagatcatgctgatatgatcgatctaatcaataaacggattgtttttacatagtgcagttagagcaggtttaataaggtagattgagccggcgatatgagctacacgtcagattggatgatgacatggacgagagaaaggtggaaagagggtgcgagcggatggtaaattagtcgctagcgcacacgagctcctaggcgcctgtgcattgctttttgtcagtgttgcagcggagtgagagagggaagggtaaagaagaaagagattgaggtgattaaaaaattaataaagatattacttgtttaacgtgtcaacggcttactattgtactctctagctataagatgacatggtacacatttatagcctgtagccggcgatactattaaacctgctcttagggctcctttggaacacggaatgtgaaaaacgtgtgaatactgaataggaaaaaaaacaagatcggaatgttaagtatgtgcagattaggcaggagttcaaaacacgagagttttaggcatactatgtttggatggttaaaagaatataaccaaagaacttttatagaattaaaagagagataaagagaggaagtgcatttgccttctcaacgtaaaaacaatgaggttagagctcacggtaatatcttctatgaaatcggtgcataggatagcaattcactcaaatcctctgctccgaagaacacatatagaaaaaaagtatccaaatataatcctttaaaattccttttattttcgactgcgtgaattttacattataaatgacaaattcttttcaaaattgttgcttaaataatattgtcaaagtattcttttttagaagccaattagtgctactttttgtcgctctcttaatttatttttagccttggaccttttcaaatatggaggcatgtctctgtaattgttttttctatttgtcttctcaatggtgaagattgggaggaaaaaacaaactgtaaaggcgcatgccaacctcctagtactagtagcttaaacagctgtgaatgacaacggaaatagtttcttgaaagcaaaggatcacaaggcaagcacaaccagaggcatctgcatagattattctcacaagttcaattgtcactaggccggcataacaaacaaatgaaaagccgatatttggagagagttttcattgacccgtccaagcatctactagcatgtttaccggtcagccaaccagccaactaaccctgataaaaacatgcagacaaattatcacaaaacactactagctaggactatgagaaaaatgccatgtgacagccaggaaagaaagcacggttgctactgccatttcctaacggagacgtaaagaaggtgattagtcgtagtaggcgagagagcactctgatcttgatagctaggcagcaaatgtaaagttggcgccattgaaaggcaagcaaagcatacatgataaacattgtagaccagctcaatatactttttgtgcttttcagtttactagtcacagccgtttttaattgattagggttaactctagtactacatggcttcacacgatatttttggcttctttgttttgttcgaaagcatctttctaatggccatcattgcaaggttttgtttgcgttttctctctctttttctccatggctctctggtcatggacatggacgctgcttaaaagctggcaagcgcctaccatggacagcaaaaggtaggggccattttggtctctcttcaatctctggactgttaaagcctttgactaccgggcgttttaatgccctgtaaggtcgccgctgcaacaagattcgtacactacgctcctcaattcaagccgtatgatctgtgcctccgtacatggtagatcaagatgatatcttttttttcctttgacgttttgaccatctgtactagtttcatggatcggtcggtatatatgtgagtgaaatgggtttcatttggaatacatgtatggtccatggttgatcgatgatcaggtcaactgtacaattactgctgctgtaagctcagggaatccaagaccaaacctatggaggaaaggaaagaaaacaaccgtagcatacaaaagcaaagggaaactcagaaagggacccattttttatttgccattctgtgtgacctgaagtcaatcagctttatcaccacacctagcagcatccatcacttgtttgctcaagtagcagcagtcaatgcgtgcacacacatcagacggatcagcagtatatacatatttatttataaagaaaaaaacgatgagaaaactactccaactatctcctgcaaacggtgcttcttcaaagtgcctttattcccaggccacaatgctagtgctctcctggaagaaagaaaaaaacggccgagtcataagcatcaacagcagcactgctccttggaccatcgccaaccaaattgactagtaggatttctgggttccgatctctcatccacgcacagtgcgcgcacgatccatccatccatccaccggtgccggatgatgatgatgatggagcctgcgaatttgccgtggtttcctgctgatttctctctcttttccggcgcaaaaacgtcggacgcatcagctatagccatcgcgatggactcgtggggaatagaccggttttttctacgcctcggtggtggcatcggaaaccgcgattcgttggtgcaaagcagcatcataatttccggtgttgtctttgctgtgtcaaagcaggcatgtgctcgcgctcttgcaggcgagcgggcggctcgagctgctgatgctgctgcctgccgggcctggatgctgtgccgcgccgcgccgcgcctgtcccaacgcgggcgaagggctgcctggttacttcacgtcatgggctaatgggtaataaaattttaattgggaaccggcgttttcactgtacgtacttacgggctcatgtcccccgatgctgctgcctgttttcttctgtcctctgctctgctcccgtgtgctaacttaggctgtgtcggcaaatgtggttggaaactaatctctgtatattatgattaattaaatattggcttaaaaatttataaaataaattaatataatttttaaagtaactttagtatataattttttttagaaaacatatcatttaacccttcgagaaaattatgcgcgaaaaactataagttgaaaaattagtaccaaactttggttactgtgaacactttgccacttcccatttttagctgtcacagtttgctagacgtgtatttggtttatattatgacctgttacacatttttaatagatgtcccctatatcatatatttaattttaccccattttatgattaacaatttattcgtcacacttttataaatgccacagcttacttaattttggttgtggctttgtgggtgataactaaacacgtgattaatgtagacccccgaaaatgggtggtacttgcagcacggaacaggcgaagacagtgggggtgggattaatgggggtgctttggtacaaggcgtgcaccaaatctggctataaattacgtcacgagacttggtgcgccgcagatatcaccgcaatcatgccccgcgtttacgcctcctctcccccgcattcatcaaggcgctacgcaagttgcagcctctcctctcctctcactcgtgatcgcgctccgtcgtcgcgttggcgcacagcgtccgccccgccatccgtccaaccatcgtgcgggcggggacgcgatcgcgctgcgtttctcacgttcttttgcctcccgcgtcgcgcgcgcctcgcgaaatcgctcgcaccgctcggctttgcggtggaacaccgaagcagcagccagcagcggcgttttccccgtttttctctactactcctaggttggttgcaacgcggggacacgggcacacggcggtacgtactacgtagccgctgggagaggtaggataccacggcaattgatttgattcagactactactactactactagtggggaattgattacaaactgagtaatccagcgagctggaccatgtgaccaatcgactgggatctcgtcatcttaaacaaaatcttggggctggccgtgacggccccccctctccttgtcagcgggcgtgcgtgacagacaccgtgacatgctgggacgggcaccgcacgcatcggtgccatgacgttacgtcgccaacccaacagcagatgtttgttaattcatcttttgcattccatttcacctgtcatttagccggcagcgacccaactgaccccggcgacggccgtgacaatgaccaggaggaggagaggggacaccctggaaaactggcaccatatgccacaaatttcaaacctgtggacgtttgaaagaacatgtccataaatttgaaagctggtgtgtgcgatggcatttatcacagtcaaaacagcaatatatacaagtgccccctaccctttaacccagtggttgtatgcctctatcggagccagatagcatgggctcatgtaactttctccttcttttcttctgacaaatgcatggcaatgcggggctctctctcctctcgtcttctcctggtgaaagcaaaggcacatggacatgttaaagcctaagggccgtatagcctatagctgccacacaaatcttttaaaaccacgtaagcgaatactcgattgtatcggagtaggtatacggtcatacaactagtagcaaagcatgtgaaggtactactactagttgtgtgcgtgagtgactagtgtgacctgctgcctctgttgcccaagcatgatatggctacagggtcatgtgaaggtagtggccatgccttggggattcctttctttgggacgatgacttctcatcatcaagaatcacagatgagatgtggctatgtgccaaggattgcctgtaaagaatgttcaccggtcactaccatctaggcgtctacctgtgcatgatgccgtatccatgtgaatatattcaattctcgtaggatttgtttatcccctttagcttttacttttgccttgttgtgacatgcaaactatgtatgttcaaataagatgactttagctgtgttgttattcgcagaggcagggaagacaaaagcagaccaaactcgtatgatataatgtttttttaccgtggtatactaataaattgtgggtttactgcttttgaaggaaccttgagcacacagccagccaatcaagaaccaacaagcacccaacaagtaaagaaattgatatgggtgaagctaccttactataattaaggatggaccatgtctatcacaagctagagtgcttggataatgtaaacttctccccttgtgaaattgcatcatgacctcatcatagcaagcaaagaacgggtgtggctggggccccattttttgttggtccaccaaagggttgcctaagatactcgaattaataaaaaaaacacttgtcattgcgcttaagaaacataaaaccagcggtttcaacaatgccatgaatcttgcaaatgctgcatgtgatgataagtgggtttccgacaatcgcgtacaatctgcctatgggcatccttttgtgcatgttgaaacacagcgtcactgcccaaggcacatgtcggcttcaaatgcaaggcaccggcagcctaaagattaatataaccatctctatgaagagattagattgtatcctttctcactaggcaaaatgatgaaacgggtgaatcatcaggcttcatttggcattggcaatgtgctgatggggaagatcgtttgggttgcaacaggaccaggatttcatgaacagtcttgtgattcccacgcatcaattccatcctatcttctccattttttaagcgtttcttctgaagaattatccctctttcggctgaggtggtacgtttgcttgcacggtatagatccttgggtacattgcagaatcacgcctctgtggaaattcaggacagggcaatctgatcgactgcaacaaattctgcagaatagagtgaaacagctaccaactactaccatagatgaaatcgccaaaaagcatattctgaacgaaagttactggaaatctagctacctgtagttgtactctgatcaagatcggtagccacaagcagttgattaatgcgagtaatcgtacagtgcacggctgcgccttaaggtaccatacattacactgccgacacgcacaaatgcagtgccgttcaatatgttttttaggttccagtaccaacctatttacttgaacctttctcaatagtcacgaactttacaaaagttgcaaaattgctgggacctatcgtgttgctatcacacagaatagggtatcacagcctatcatccagatatctagcagaagttgtgtcatgtcttcagtttacgataatttcatttttatcgatgggtagagagcacattaaagtgccagccataacaagtaatggcttcagcaccaagaacatcacattaactaccttgaagcttcatctaaacaatatggacaaaagggccataaatacaaaatcgacctttcatgatttaggacgatgtgagcatggaaggctaagctaagctccacgcctatcaacttccacttctgccgctccattttgtgccatgagaattgtgtacacttttttagagcatgctggtccgagccttctcttaaaatcacccagaggaccttccaacctcaagtcttcaagcaaatgttctttttcatgaacctgtcaaagaacctgtcaagaaaaccgaaaagccaatgcctagcttttagtcttatttagaacctgtcaaaagggcagcactcacagatttactgtcatccatatacacattcagtagtgatctcatggacgggtacttcttctcaattgcaatagcttgtcctggactgactccgggaatagcaactaaagacttcagcctgttacagatgatttgaagaattagcatagtgacactctacaaatcattaactgtcaagaaaccaagaacactatattcgaatgcatagttgggagctagaactgtcaaaagtatgggggaccaaaattatcaagttgtcacaattaaaataggtagcacatagtcagaacatctctactataaaatcagaaaaaattaaaggccacacaatccgaaaatccaaaagtccatgcatggtctccatccacgggtccacagaagcatcacttaaccaccatgctaaaccgttaatgtaaatatagcttgcaaaccaacatcaaccaagcttggctgatatccgatgttggctgaatagatgatgtcatctacaaagaaaagaagtgccacaaaatatttatagacaaggttggattacaaacactgtcagttctgatttgaacaattcgatttgattgtaccaaagtaccaaaggaaagaattagatcaaatactaaatgtatctgaggtacctagacaggctaggctagatttcatagaggatcatcagtttagcaacaaccaaatagaaatattcagaaatgctggttcagaacttgaatcaacaccatactttgcaaactgcaagtaaaccttgtacacaagatgaaaactgtgaaatgtgcttcttctaatcatctaatgtactgtatatagagaaaggaacattatttcaattagtggacacaaaaaggcaaagcatacagcaacaaatggaaatttggttcagtatacagttctaagcacaacttaccaggcacttttcttaatccgatctttatcaacgcaacctttagaaatatttgaaccattagcatgcacagataaccatgtcaatggtttcctgcagaacagtcagcaggggacagtatcaaaacatggacttggttgttcattgagtgaaacaacaaaaatatttctgcaccaaatgtgcgtgaaaggcacaatattggccagaagaatgtgttaagtatttatattgtcaaacgtaacttgcctgaacttgcaattcgcaagactatatgtcaagccaacaatatgctctgtcacttcagcttcatctgtgcagtgccttgagcgcactctagcatagtgtgtcgctaatttgcataaggcctaaaagaatatgagacatttcaggatacagtagtagttcagaacagaaattgatagcgttgcaaacagacctcttccactggtggacgcttccaactattagaatttgatgtggtcttgttgtactgattctgctcactggcatgaaaagaaggtgattttagcaggacgataggcaaacacaaacaatacctcacataactatgttttccttccaaaccttgagagtcatgcatatttctccagtcttgtgcgtatgtgtttgtcatggtgtgaacagtgcaacatattacatattacttcctctgtttcacattataagacattttggattttgaatagattcatgcatggatccatgtatgtgcttcatatgtgtccaagttcatatatacattagtgaatctagatgatggattgagatgccaagacgtcttataatgtgaaacggagcgagtacaatgctttttctcagaaatgctgcttttcattagccataaagtaccagcagtccaaaactatgtgatcgtatagttcaagcaaaaatagactaatgacaattaagaaacattagcacacaaaactaatgttgactgccactgaacttacatgcactaagaaaaaccaacatgatttgaacacaaaatcagaatttaaagcagagttcagaccaaaagaacagtaaatataagataatccatacttccaggaactaaccgtctttttatgaagctcatcagtttattagtaacgtagcaaattgtgaattctggatactgtcttcgaactttctgaacatgatccagtaatgtaccaccacttacaagatcgcagaattcctcagcttgaagcacaaagagaatatatggcacttgtgatgttgaagcttggtcctgcacaaatgtatggcactttaggatatttttcctgtgtcgccagtatttacacagagaaaacaagaagataccagtcaaatgcgcagtcttccgtgactttttgtggaactgtatatatacatcaaataggagattttttttatctagatttatcggctggcaccccataaaaatggtttaatttcttcaaagcaaaacatgaaagcagcaaagggtgatgaattctataagagaaccttctacctgactacccattctttgatcaactctaactttctgtctagaatttatggttgataccacatcactgtgaatgcattttgcaaccattcatgttttgcaaccattcatgctcatctacagtaaaacgattttggtgttgatacttctgaaatttaaccctttcaattttcccataagctaacagaattataaatttactatgatgtgtaattgttcattctgagagtggcagatcgcctctgtatggtataatggtaatattctttgcacatactcagccaatttagcaaaatggacaaagtatcaagtttgactgaatgtgttagcagccattggcttgggaaaacactccacatctaactaggtacaacgaaaccactgattgaacatgattgattaactatcatgtgaataaaagtatcttctttaggagttgggcctgaggaagcagcattggctgttcaattacacaggcagctctctttaaaaacacccggaacgcatttgtgcgttggttataaggatgaaaccaaccgtttaagtagaaatatatcatttttttttcttttactttggaggcgcaagttttaccaacgtacgcatgccagaataaggttgaggccaacaaaacatttgaagaaccaataaagggatgcaatttctaatggaaaaaggtaaacaaaggaaacaagttatcctgtaagcggtacctgggtaaactcattaggaatttgcatcttccataaaattgaccccttgattgaattagatgttactcgaaaacaaaggcccttctcatgaaatccttgcacaagatgacctgtttggaaatccgagcagtggagaaaggtgagacaatgaacaaacattactagtattaattaacttacttttgtttaacacacctccaactgagccactttcaataacacttgagtcaatctcagcaacaatacattttgtagctaacttccctgattcccacttctttttttctttctccagcttcttcaattctgctagttcagctttcatagcttccttttgctttttggtttcctagaaataaacaatatgctctgttaatctctagatcatggcatgaataaataaatacacttctgttagatttcaaaccagtcgtttttgttttttttcttcgatttctctggctttcttttccttctttagtctcttctcttcctatatcatgcaagaacaagaatttcaaagctaaacctataatttgtgaaacttgaaacaagaagattttctttatgccacacctgttgtttcttcttcctttcttcaatcggtagggcattttcttccttcaaaaacaagacatctccttttttgttagtatacatatacagctattaaggtgtaacttttgtcttttggattgatcaatatctttgttgtataatcttaagtctcagctatttccactcacataacaattaattacacctaaaactacaatatgatctccaacagcgtaatcgtaatttaacatgcctaacggcatactaggtcatacattcttctgattcagtcaaatatcatttccatgacatttctgcctagaaaatataaaaatatgcttcaacgtttataacagatcaaattacaaaccacttaggttaacatacctgcggacaatggttattgataaaaggatcagcctccttcaaggtagaatcttcacaaggagaattagcacgagggggttgattgtagctggttgttcctaacaaaagcatacatagtcaatacactaaacaataatgtgttatctacattgtttacaaccagatatatactaaaaggattttacaacacatatgagtgtcaaatattttatttttactgtcctcactttaggtttttcttaccattatttttgcatgcagaattgtttgtttgatatccaacatttgattttgaataatccttcttatctgtactttttgtattctcaactttatcagtacaggaagtagtacaaggctgaattgcgtgttctggcttcgccatattgcttggcgtcctggttaaagactccctgtatacagtgtcatccaattcgtcatcactatccagagatattggacaagatactcctgtaaaatagaaagaaagagagttactccacataagaaccataataaatattaaacatgctgtcatctactaatcaatgtgatcgctcagttgcctcccacataagaaagcagggtggagataaatcttaacccaaaaaaaaagttacaagtggacatgctgtgtcgtcaacaaagcaatagttagtggagtttttttttaagaaaaaaaatctctgcctcctcctcttgataaaaatctgtgcactttctaaactttgacaggtgtcatttgggtccaacatgtaacttaaggtttaaggacccttcatatatcaagtagagtaaagaaacaaatgatgctcgaaagaatagtcagatacactttgtttattggtaattccaaactactattaaggacagattaatcatcgaaatgtttgcaatcattaggatttaggtctgattccacctgatgttaaaaccaaaatgacccaacaaatcgattcagaatgttgcaaacaagttttctcaaaactgtatagaaacccctgccataaatcaccaagaatagctatattgataaatgataaaggccaagaaaaagaacacagaaatgagctacaagctccaacgctccatgactagaactggacctaatccttgtctattttgccacacggcaaattcaatggatgaagccaaatgagcttaacctaggccggtagaattcatgaaaactcgaaaggaatgcatctaatagttaagaaacttcaccagaaaatttcctcgcggtcataggagacgtcaagccaggcacggccgggggacgagccaagcgtggggagttgaagcccggggtctcaggaacaatgtcgtcaagcccgacggagcacgggacatccgagccaggggtcgcggaatcgggagcgtcgaggtggaacgacgggctcgggagaacagaatcgggcgtatcaccagcaatggcgcggttgcggagcgagcacggcacgaacgaccggggcgtatctgccaccacggaggcggaccggtcggcagctaccggcggcggccgccgcttcggaggggtgggggtgtcgtcgagcacgatggttgacgccgcgagctgccgccgcttcgggtctggaggggaaggggagaaggcgtcgggggaatcgggggcggcggcggcgaccgcatgggagcgcttgtggagggcgggaggggtggaggcggcggcgacgtcgtcgtcgtcgtcgtcgtcgtcgtcgatgatctcgacgacggcggcgtgggacgccatcggtttggtggggcttcgccggtggatttggggatttcttcgccgagatggcgattttgattttgggttttggcgggttagggttccggcgaatggtggtcggctcggctggtcagcctcatggtccgcttcacagatatcgatgtggtgctcgggccatctgcgggggaatttactatttgccactctctcaaatgccagtgctcaaataccactctcccaaattttcattcccaaatgccatccgggcccacatgtcagtctcactctccattcaaacgaaagtgatgcgggacccgatgctgagtgaggctgacatgtgggtccggtggtatttgggaataaaaatttggaagagtggcatttgagcactggcattcagagagagtggcaaatagtaaattctcccggccatctgcgtggtagtaacattttgtatgggcctaatttggatagctaccattgatagcgagaaaaaaagttcaatatgagtccctcaaatataggttggatctgattcatatactcaatcgcaaaaccaggtaactaatgcctctaactattaaaactggtgtaaaataactcccttgatagtactgacgatgattttcccccctctctctctctttatctcatcgctacacaaacaatcttgagcaaacctcgatgatgtaagatgacaccagtggatcacccttgcgccgtcctcgaactgcaccatgacgtgtagagttcctccttgttcctccttcctcgagtactcctcgctgcttatacacacatctagattcctccttcctcaagtactccgtagtgctagtgtcattggctccgttagcacgaacatctcctcgtcctcacgtcgcacctcccatcctcgttatggcaaggtgcgggactcgaaggctccttctgagtgggaggaagagagacggaacaagcaacagctcccctcttttgtagcttccatcctaagactcacgagtcgttgcagagtcgagagagctcactagcaaccttacaccactaggcggcaaacagaaaaggaacataggggaaaaaaagagtgggtgctgacatagaggccctacaattttaaatttttcccattcggttacatttggatcccactctctatttttatttcccttggtgatttggctgccatatagacgtcatgttagccaaaacaccctcaaaaccagtcgagtgagtcattttgcatgattttaatagagtaattaaatacctaagttttacaattgaaggacacgtatcacatccaacctaaaaatagttgaggaactcaaattgtactattttttgagggtttttatataccagtatctcgttcaaaaatgggatgatactgggttggtatcaggtcctaatatctaaccagtatcatgcgattcttaccacatggtgggtgatgcttgcgatgtatcaggtcctgatacctagccagtatcggtgatacctaccaggtatcatacgattctaccacgtatcaggtgatacttgtgaggtattagataataactattaggtattatgcgattcttacaacatagaagatgatacctatcaggtatcatccgattcttaccacgtagaagatgattctaccacactctacagccagacatgaccaagttaacaagctctttgcacccatctttgtctctttgctcctccgaagcagcatatggatagaatgaaggtccggactcgggatcgacggccggcgatgaaggcggcgactgtagagggcccgtgacggagggggcgttggtggagggcgcaccagctgaccacgcgggtggagcagggggtgggcattaacggcggcgccgtcgatggcgagcggcggtgttggagctccaggcggcaattcggcgaccatgtcgccggcgacggagttggggcgccagcggaggacgcaccagccggccatgcggatggagccgtaggtgggcgttaacagcggtgccgtggatggcgcgtggcggtgctggagcaccaggcggcaatccggtgaccacgtcgccggcggccgcgccctcctcttgccgagcgggtcttcttccccagcccgcgccggaatcgccgacggccacctcctcctcacggctcaggcgctcaaccttgttcctctttggatgggaaaggtggacgaggggtatcccgtcccgacggtataccggtatatagcatttatgtattttcttagccgtgtctttcttcgtacaaggcagtaacgaaaaagggttgggccgtccatctcaatctggaccgtgtatttctaatctaacggttaacaagtatccaacgggtgcaccgcggccggaaggggcccctcttttcccctgtcggcggcgccggccgcctctcgccggaccgccggcctcctccgtccgtccacgggagacagaaaactggccgcgcgcacctgttccaactgggaatcacaacaattcacagctcatcgtgccgtgcgcctgggtgggttgtccaggacaacttgccctctctctatctccctctctcgcgcgtccgggaaattggcgcgtgacgccatggccatgagtcaaccccgccattgccggacacatgtgagaggagaggagaggagtacgcgacgctgtcgttacccaccaacgagcagaggcaggtactccacggcatcgagaaccagcacgcgtcgcaccgtttctcaactttgcgcgagcacagtgcctgcactgcactgacagggcgagcgagcgaacgagcaaaccaagcagaggagagaaagcgccaagccatgcaggcgcaggcgcgcacaggcacagcgcaaggacgcaggaggaggaacagcatgggagcaggcgccgcggggggaagctaagctagcgaccaaaactcaagctgccaaagccccaaaggcattgcacgttcactcgttcggccaggcttttttcatacgggtaaaataattacacgccacggcttttcagagcctcccaacgatgcggcaatggtcttcttcgcccccctccttttggagaacccgagatatgcattggcactcttcttcctcaagatccctctttttctgttgcgatcaaaaaattgtgttaattaggaaccgattgacagcgtgctttttgtggtttatatgtagtacaattcttcaggcaatagaaccttgttttgcaaagttaatgcagacttgtctgaggtctgaggacaatctctgaaactgaaacagcctcaatctgatcacttgacttgacccctctcctgtatcggtcttctgaaaaaggtagtactaagtttgaacgatgaaaaactgcaaatgcttatattattcatggcgtaagtgcgtggctaagacaaatgatttacgctcgatcatttctgtttgcaccacaaaaatattttttgagtaacactttcgatgattctatccatcaacatgacaaaccaaatgagcaaatgaggcaaacaaagttagttattgttagagaaaacctgctagattaaaccaacaaaacccagcaaatcgaaggaccggacatatcaaagagagaaaatcaatgaattcaatcgagctctagctaacaagcactgcactactgctaaatcaatactccatatggatactacaagtaatcctccaatctgtcacttgggtgaccaggaagagaagaagtgagcggtgagattggacgacgacgaggaggcccggttggtgtcggtgaccgtccccgaccacgccgtcagcgacggccggccatcggtgaagcccagagacggccggccgtcgatgaaacccatcgatggcgggggacacgccacgacgcccaatggcggcagcttcctcatcacggacaatggcggcgagaactcgccaccctcttcttccacctcctccgtgatcccaaatggcgacggcgaggcgtcgggcgtctcgaatggcgtgtccgtgtccccacgaacgtcggccgggggcgcggcgccccgctcgtacaccgggttggagatgcacacgaagcggtcgctgttggcggaggagctggaggacggcgacgagcgccgggccggcgaccacctccacacggcggactccagcttggggatggcgaggaggaggtccttggtgtccgccgccgcctgcatgacgccgtgcgcgtagtagaacggcggggtgctcgacagcgcctcgcgcgcggtggtggtggtcgccgtcgtcgccaccgacgccgcgtcgtcgtcgcccgcggcggcgcgcgacgtccccgccagcccgagcttcgcgcgccgccgggacaacgcctccccctcctccgcgcgcatccagcgcctgcggaggtgggagcagaagaggtcggcgaggaggagcaccgcgatggtgaggaacagcgcgaggctgagcgccagcatgaggctcacccccaccgccaacctcgacatgccgtcggtgaacattgccgcctcgccccgcgcgccgcgcctcgccgagctcaacgagagtgagaggactggagtggagagccgcgccgtggcgagcgcgtgcgcgagctaacaaagcaacaggtggcgcgcggttcgtgtcgcgtcaaaagggcaactactacgactcgcttggaccagagcaaggttaactcaactaacctctaacgcatttcagccataccaattttttaacaaagctgtcaaaattttggctacatttagttgttgtcaaattttagtaattacatataaaatcttgataaattttgttaaccttgtcaaaattttggtaactttactaaaatttggtaatgtcaaaacttggtaaggttgaaaatggtaacaaattgaaccaaccctaagcttcaattcatcttgcttggaagtagcttatacatataatagttacctataaacatatattacaccattaatatatggctttatctctcgtacgcacaaatttatagcccgcttcccttctctcttcttttctcttgtctatatgtgtttacagtttacttatagcatagtattatactcgctctaatcattttcttatctaatctaatccaccgtttgtctcgtcacgttttccgaggcaggttagtacttccaaaagctagtgggctagtgcaattagccgggggcagattatggtggagccgtgactgttgtctgcttaaacccaagcgtactcacgctttggccaaccattttcactgtcgagtgggtcccagccatgtggggcagggttgtcagtggtgattagggggatgatgtcaagtgtaactgtgtagcaaaagggagcaaaagcattgctctgttgctgatcattggaggcagggaaaggactatggaggagacgatgtgtgttttttggcgggaagtcgacgatctgcttacgagtgcgaatccaaagattcgggggtttctgatctaaccgcacgaccggttgcttgttcatcattttgaggtgatcagtcagagtcaggcgatgatgtttgagtagtttgacgaatctcctccgtgcagtgtagtagagcacttatctccgatgaccctacggcatgattggcgtttggcgaagtcgtagctccactttcacgggaacggtatcgggcttcatgattggcatttggatctaaggctaactttgccatgaacttaatttgcgatgagtatgaaaagacaacgactatgaaaaattttggctagaaaataaaagtataacatgtaatcaattcctaataaagtgggattcagtttaaatgtggctctcaatcaaacactagcttaagaaattataacgtgtccaagatttagtgtggtaatatttggtcatcaaccaaatagcctcaatatttattccaacattcatatgttgttcaacattttcatgtaactagttaaggaccacacatgttgcaatggaaatccaaaatttacacatagctatgagtagggcatgtccagttaacttatacttcttccgtttcataatgtaagtcattctagcatttcccacatttatattgatgtatatatatatctagattcattaacattaatataaatgtggaaaatgctagaatgatttatattgtgaaacggagggagtacatagaaatcgtttttgcttatgttgcaagcaagtcactctaaccaggttggttaagtaagattgtgatggtccgttttcacttttttagtcatctacaatttgatgtttcatggagcgttttttatacggtgataggtcgtcgttgcaagtagtgatggttttcatgtgggagaaaggttggctttttacaggatgtctttttatccttagtgagttgtttttaggtgtttttatgtgaggcgggttacctgttgcatggacgcagtgcagatgttttcttttaaaaatagtacagaaaataaaaaatgataggtagcacactgttagacatttgatcattcacattttgaactaggtcttaaaaatggctgaaattgcaccggaagacgaaaaaaaaatcaatcattaattcaccaaaagaaaaaaaagagaaaaataattaattaccaaagaaaaaaagaggaaaaaaaatcaagcagcgttactacagtatacagtctacagactaaaactacaaaaagaagagcaacggcccaaaaagcccaggaagcaaacatgttcagccttctgatccagtccgtcgacttcaccgacgacgcggccgcggccgcggccaccgccgtcgccgccggcgaaaccagcggcacctctcaccccctctccccgcgctccggcgaccctctccccaccaccacctccgcctccgtaacggcgcctctcgagctgcccggcgcgacctccgcctcgcccgcccgaaaccctaagatcaactacacccgcggcatcctacacctctaccgctcctcctcctcctcctcgtcgaccgcctcctacgcttccgccgtcgccgccactccatcctcctcctcctccggacccgccgccccgcagctcgcctccgactgcctactcccggtaacctctcttcttggtaccatcttatttactaatttgttcatttccgcgtgttctcatgcctcatcgcctgcgtatctcagccatggcgcggcacacggctcctggtgctcgccgtcccaacccacgtctcaccagacgacttcgtccgcttctgcggcccttacatcgagcacgcctccgatatccatgtcgtcaggtgaattatccttctcgttgaagcaatttgtgtccgactttgcccgggaagctatggttttacatatgtgttgtgtcggtagggatgatggggtggaggaccggtatagcgtgctcgtggagtttgaggatcagaagagtgccgatgggttctacttggacctcaacggttggaggttctcgtcatccgaggttactaacattgtcgattggatgtatgtctagtttgctgatcatgtgtaacattgctcctaaattgggaagctcgctcgcttcttgttccatggtgtaggtagaggtttgccatgttctgtttatagttgctgtccaatatacaccatcaaccaagcctgcggtgactccaccagttggatccactgagctcccaacatgtcctgtctgtattggtgagcttatttatatttttctccttgttttgtggtcattcaacaatgtcagatatgaattttgtccactacaattttgcttcgtatcacctccccataggctgggaagatatcaatttgcaatgccccctctgatcaaaagattagccacttctcttctgagaaactacacctgtgaagttgagacttgagaagctacatactcaccacatgtttgtggtgtcttaggggctgtttggttgagtgccaacatttgccaaagttgtggcacccaagtttgaccaattaagcctagtgtttggttcatgccacaagtgagttatgccacaattttttagcaagttggctcacttgtcactgagttatttttttgccataacttgccacaattgtggccaacaaattcttagccatacaatgtgtggcatgccacactttgccaaatattttgtggtaaactatggaagtcatccacactttgccaaatatttcaccatatatatgttaaccttatttttggaggtatacattgcctatcgatttcggtactgttttttttctttctttctaaaagctgactttggggtgctatttttccaagctactactataccagtaagctctgtcaaatctagggaccatgttatttctccttgggcaatatggattacataattatagttaagacctttgttttcaggtctatctattaacttatgttgtttaactatctttgtgcaagtatgcataggtacacacttcctctgtttattgggaagagtttttctgaacattttaatgtatcattttttttctcatcttttcaccatcttcttatgcatgttatgaaacagaaagattggatcaagacatcagcggaattatggcaacgacttgtgatcattcgttccagtgttcatgtgtttcaatgtgggtcaattcatcttgtccggtaatgatcattttgacaatcaccatttctcaattagggcaacaaacaaccatttgttatggctgtgattcttttcctgcttacatttttacatgatactgaatttgcctcaattttatataaatttatgagtcaatccattctatgccattgacaaagcgtgggttctacaatatgccaccgacaaggctcagttctacaatataccattgaacaacttgttttcttccttatctgccattagtcaaccattagtcagatgcagctaagggaggaaaaatgaccaatgccatgttgcattaaataatcttggaagataaaaacacaatggattcctatttttcatcaatgagaaaaaatagtggatcatgaccaacgaaatccatgagcacacatgataccctaggggtaaaatggatatattctcgcccttagagcaggtacaatagcagactataagccagctataaacaatagcagtgcggactctaagacgtaatgtgtgtatgacaggtggggatcaggtattaatagtgtagtaagcaactattgtatgaattagctattacattggctatagatgatttggagctagtagttggctatactattaaacttgctcttaacatagtttgactaatggttgactagcggctatggcatataaggaagaaaactaattgctcgatggtatataatagaactgagctttgtgacatattgcagaatctgtgctttgtcaatggcatagaaatatagaatggattatctctaaatttatattcttccaattttgaatttttgagtaatcttctatggcactgattaacgtagtagttcgaattccataccaatacccaatatgtggccatttatcaagtgtgatcgaattccataacaatatccaataaaatatgtggtcatttatcaagtatgatattgtacatttgctactcagtaggaactaaccagggacagaggtcagggtcatttgcagaatgttcaccttctgtatttttcttgaagatcactgaatgtttatggcacctgtttacccgtgtcggtgaatcttaagacatattgcgctaaccagatttatggagcgtagagttgtagatgtgccaatgtctgcctatggctataatacaaatatattattgccaccactcaccactataaccatatgccattgatttccttgtattaagatcctccactgccttttcacattaccaagctttcttgatcatgacttgtttttattcataatatttctgtttcaggtttgccagttttgtcagaagcagtctaagaatcctacatgttctgtttgtcaaacctctggaaacctatggatctgtataatatgtggttttgttggatgtgggaggtatgctactctgctaattgaatttttggagcattttgcgaatctctttgtatttaataatctgaaggaaagaaagttaatggcatgattactgtttgtgaatttctttgttattacaggtatgaagaaggccatgcaattaggcactggaaagaaactcagcactgctattcacttgatttggaaactcaacgtgtttgggattatgttggtgacagttacgtccaccgacttaatcactccaaaagtgatgtgaagcattccaagttcaagtcaaagtgtaaatattctggtgacaaatgtgcaaactgctcctgcaatgatgaggaagatatcggtggtgctattttcagcagcaaagcagaaacagtaattgctttaagattcattcatttcagttaatctttgacacctcattgccagtctggttcctcaaatcacatatgcttttctcataacagattgtggatgaatacaaccgtcttcttgctagccaacttgaaactcagagagaggttcatcccttattagtgcttatcttttgatgtcacaatctgtactaccagagcttgtcatataatttacattacagtttatatctgatatatttatctgcctatgtttccttatattcatagtattatgaggctcggctgtcagaagctaagaaagaaaaggaacaacacatttctgatgcagtggataaagctgtaaatgataagagtaaagaaatccaacaaaagattgagaatgcaatgttggagaaaaagaaacttgcagatgtgagcatctcaaatcatgcacctttcagttattatcaagcatagttgctgtggttctttgacatgacttggtactttgcctttcctgcagatgaatgaaaaactcacgaagaaccaggatatatggcgtcgaacactaaaagaaattgaggaaaggtatgtttgacccttccaccagaaaatggaagtagatggcacagcgaaaggtgttggatcgtgctaatttgtgtgtgttggttgctctttttttttcctttcctttttttttttggggggggggggggtatatctttttcatgtactactttgtaaagaatctgcttgagccttgtccttttctgttaggcaaaaattggttatgtagcacccaaaattctggtttttagatttctagttttgcgttcctatcataaagatacacaactttccctttttctttcctgataaatctacacttctacactcaacagggagagggctcaactgaagttgaaagatgatacaattcgtgatctagaagaacaggtgctaaactctctttcctcttgaaaacactggagcttgtacaaaggccattagttaacatgccttatacaatttctgcagataaaagatttcaaattttccatcaagttacagaaatcgatcgagaagaataaaaatgctgatgatctcaaaggaggtttgctggtgccactcccaatggtgccagattctggaaccaaaggtaaaagatcgtcaagaacaagcaagaggaggaaccagtagctgcatctgttgtacatgtaacaagcaattgcttggctaatctgtgccaaccaggataatatgatacattctgaaaaaaagagagagtgcaatattattctactacagatagctgccttttatggaacagaaaattgaaccaaaggatagcatagtttacaattttacattacatacaggggtagatgtttcagaaagctcttggctatattattgctcatacagtactacttttctgggtggactacattttgagtattgcagatcggccgtatgaatggcaaaatgagaatgcaacggtggcacagaacgccaacacgaacgaggcagcactgacaatgtagaggactggatcgtcgtatctctcctccacatcttcctttggcacatgaccactaggagagcaccagcttccctgtgatgtattatagaggttgttgttgcctacataactttccatgctgaacgaggccagctgaccatagttcggtatgcatcctgataagttgttgtatgccacggagaacgctcccagcgacgataactgagttaactgccaaggtatcggtccactcagatcattgtgagacagatccaggctttcaatctccttcataccagaaaatgttgctgggatttggccagtgaagaaattgtaggacagattgagggacttgatatggctgagatttcctagctgccaaggaatctctccatcaaacatgtttgcagataggtcgatgccggtcatcaaatcaaacaaattgacaccgtatatatacagactccctttagtagagaaggcgaagcctgataggtaatagtagtaagtactcatcaggtgagaatcgtacagctcgataaacggttcgacataaaagatctgcaggatatcatgatcatgcacatctccaaagaggatgttaccaatacatgctggtaccgagcccgataatttgttgtgtgagaagtcaattatcctcaagtattgaaggttacatatgtctggagagatttccccttcaaaatcatttccacccaaggaaagtatgtcaattcccaaattattctgtacccaattcaagttgcctgtgaatcgattatgtctgatatccataactataagctcggatgtattgaaaagggcatatgggatatctcctgacaaagagttgttagagaggttaaggaaattaacctgcagtgccatactacaatttggtaaagaccctgttaagttgttatttgatagatccaaaaggctaatgcttgtccagttgcataaatagggttgtatttcaccggttaaagtattgtcagcaagattcaggcccactaacataggcaaatcccaaaaagaaatatcaagtttcccggacagcttgttatcatgtaaatccatgacgaataagttcttagctgatagattttgaggtatgctcccctcgtatttgttgctatctaggtacaaatacgacaaagaatcggacatattatccattccaccaaatattagtccaccaagcttgttttttgaaaccttcaaggattccaacacagcatggtcagtgaataagcaagctggtacttctccagaaatgctgttattcgataggtctaaataccgcagctgacgtatctgacacaattctatcggtatatgcccgtaaatttcgttatttgaaaaatcaagaacaagcaagtttggaaatatcgaattgatattgtctggaagttgacctgcaacacggttcattgatacgttgatatatttgagaaaattttgagtataccatgttgactccaatgatccagttaacgagttatttccaagatctagcttataatgtcttgctccctcggtgaacaaccaatcgtgcatgctccctggcaagttattattggacaaatcaagtacctccagatgatgttgtgtgcgtagaaaatgtggttctgtaataatgctcttgtcaaggtcacagccagagagcgctagttctttcagttggaactgaggtacccatccaggaatatttacatcaacagctaaattagcattatctgacaggactaccgcctcaagtttcgtgaggttcttcagccaagagaaagaaaatttgccgctcaaattattatgagaaaatcgtaggctcttgataaacgcaggaaggtttgaagatgaacttataggaataggcccttctaagagatttcctgataggtccaatagttcaatatgtggaagtgagaataatgaccttggaatattcccagcgaatcgattgaggctcaaatgcaattctcgtaggttcccaagattttctattgctgcaaaaaaacatatgcatcaataagcagctccatggacaatcttacctaacattatttgcacttaagataatcagcaagtgctcatttttctgtaccttgttcagttggaagagttccattcatgttgttgttattgagatttaacacttcaagtgagactgggaatgaagatgaattaatgggaatgccaccctcaaaaaaattcccactgagatctaagaccttaaggtgaggaagtgaaaataatgacgctgggaggcctccatggaatttattgaaactccaatccattttactcaaattcagtgctctcaagtttctaagattctcgaaagctgtaaagcatgaactttcaaataccagcacatacaaggaatgttaattctttacttagcactaagagaggtaaaaaagaaattatgtacctgaagccgggagagtcccattcatggcggtgttgcagagattaacaacttctagcaaaactggttccggaggaacaggaaaccctcccttgatgaagtcatttccacagagatctaatactttaaggtgaggaagtgaaaacaatgactttgggatgctaccttcaaacttattcgagctcagattcagttcttgcaagtttgtaagattttcgaaagctgcaaagtataacagttgtttttttcaacgatcaattttatcatcgaggaggtacttagtgaaatctttagcttaacataaggaggtacaaaatacactaaaaacgtggtgcttctcggtacattctcaagaatggtaaaaaaatctctactatgagaagcaaaagatcatttatatacctgcaaccggaagagtccgttcatgttgttagagttgaaatcaatgacttctagataaaccaaattcccaatagatgacgggaaattccctccgaaccagttaccaccaaagtagagaaaccgaagcttggtgagtcctagtaatcctgtggattgagggaacagttcacgttagagagacacgatgaaagccaaaatccagcacgcatagactgatgctaattacttattaccatcaaaactcggtgaaatcagtttattctgtgataaatctaggaactgaaggtcgcgaaatgcagaaaaaactgtgatgtttaattcccaggagaaaaagtcatctgcaatcgacatgctggaaaggttgagctgatatactctccgtttgctactgtcacatcttacacgctcccacgagcagcagtcctcagtctgtccccatgaacggggcaccaacgtagagtttgcttgtatcagagaagccctaatatccatcagggcggccctttcctccacaaggcagccgcatgacatgtaaatcatgggctgcaatacacttagtatcataaccagtgacctccatggcaaccgccagctcatctcggaagaatgatctgccttcgccgcaagcttcaggtttgagacattgtaatcttctatgcactagtacaccactacgctggattgctatttgctggtagatgattgccctggtaaaccttttataatctcagatagccgtggagattacgatgcaaactgtccaaatcgattagttgaagattgatgacttgggcgacttaagcaactgcaaatctttatggaaaaagctgtgttgtttctccctctagatagcctcatagccatatgttgacagcaactcacgttgactttgacttctagagctctacttaacacctacaatgattaatatgatagtgaaggtaattgatagggacaagagtgtattagtacaattgtacaaaggtgagctatggtaatttgagtagcctgaaaactacgggctagttcagattgatgtcatttgaaaccatatcattttttagcagagttgtcaaatatgtgcatcaatttagtttcttgtcaaactttgataaatacataagaaatcctattaaaattttagcaatattaccaaattgctaaaaatttggtaaggtttatttttgctacaatttaagcaacccctactggatcaggcttggatgcatgcttcctcgctatacatttgaaggaaagcttgaccacctgcccgctgattcggtcgactgctgagcccattcgtcaagtccgcaagtcctgcacattgatgggtttaccgtgtgtctcaagtcatgacgtcctgaactggtaaacaggccgacagattcatcgtctccgctaggaataagtccacttgtcatctctcaactttacatcgaatttgatagctgtccgtaaaccacaataccaaaaatcttctcccccatctttacaaaaccatatacatcgggtctggtagtataggctcatatttctgcttacataacaagttgaccgggcccacctggccacctcgctaagtcaccaatgaccggacccattgttaacgccaaaatttagtaagcttcaaagttgtcatcggtctagagacaatatcagcttcagagtcccggaatggaccaatagaaattgtcagtcgacaacagttagattcttgatggattgggcaaggaaattcatatttaaatgaagtctatccagaagagatcgacttcaagtaggatatgacaatgtcaatttatttattaattatatagaattagttagtttctttttttatttttaggaaaatgtttttagtgtacgatcaagacttgcatatatttttttctctttaggaaagtttgagtagtgtccaattagaactctgatcggcctatgggtataaatatgtacactcgggatccctataatctatcttcacagaacaatatacatatattttcggcgcatctcatgaggttttatttcgacgagttcttgttttcgcgcatgggctgcatcgattgagttcgaccttcggcaagaagtgagttccatcatcttcgcttgcgctggcgtagctaggactttctcggttgggtccgatatactaattgggtcgacgcaagggttgcctatccggtatatcatttctatctttatttccattactgtttataatcacatcggcttagttaggacttcctcggtcatgtttgattatcataatactatctcgtgctgcatcggttacggttaggtccgacctactagattgttattaataatctaaatcttgttaagccgataggttcatactaatattttatcggagggttagccgatcttatctgttgtgttaattttctctttgatggttttattgtcttggttaatttaatgcatgaccagtttgatcggtgtcatatcagtttgcttaaggaaaaagtacgaattaccccccgaactatcgcggtcgtccgaattacccccctaaaccacaaaactggacattcttcaccctcaactatgcaaaccggacgaattaccccctcgacccaatccagggctgttttggtctacgtggcgtacgcgtggcagtccagtcagcactctatcaaaaaaatatttgtgggacccacatgtcatacacttcttcccctttttccccctctctctctgctccactctctctctctctctcttggcatgacatgacagcagcggacggcacagtaaggcgaccgaggggagccgacgactctagcggctggggcggaggagcgtggcagcagcggaggagcgcggaggagttcgggctcgccggagtgtggaggtacccgaagccggcgtcgcaggagatgtgccccgggtggacgcgccgcggtggtgcgcgtgcctcgggtacctacacccgaaacctgcgtcgcggcatggaggaaccgggcggagtatgctgggttggtgcggcggaacaccatggacgacgcggcgatggccgattcgtgtgtcgcctagccggccgccggcaccggcagatgaggatgaggtggaggcgatggccggctcatgcgtcggctagccggccgccggcaccggaggaggaggaggctaaggccaactcgtccgtcgcctagccggctgcctgcaccggaggaggaggattttggcactggccgttgtgccgccaagccgccaccgtcggcttgctgcccgtcacccaccatgcatccccgcacgccgccgcccccgcccgtccgcccccacgcgccgccgcacacctcccgtccccacgccccgcctcctggtggtgcgcgagggcgacggcgcccgctgcccgcagtgtatttccggccgccggccactggatgccaccggcctctcccccacgcccgtcgcgcccctgccgcacctagcgccggccaccaactcgccgccggacgccgcccgcctctccaccacgcccgcggcgcccccgccgcgcctagcgctggccaccaactcgccgctggacgtcgcccgcctctccaccatgcccgccgcgcctagcgtcggccacatctgagacatagagattgagaggaagaggggaagagagagagatattgagaggaaagtggggaagagagagaggtgggagagtatgacaggcgggtcccaccattttttaaaattaagaaacgctgactaggatgccacgtgtacgccacgtagaccaaaaccaccgcggattgggccgaggggggtaattcgtccagtttgcatagttggggtgaagaatgtccaattttgtggttcatgggggttaattcggacgcccgcgatagttcgggggggggggggggtaattcgtacgttttcctttgcttaaatctatcagacaattatcaaccttatgctgcatcggttgggttcgacctatgggtttatggttgtaaattagatttatttaagtaagtaggcatcaattattcttgcattgaggtttcagctgttgtgttgtctggatattgtttaagtgttgcattagcttataaggattatatataagttggttttagcttatgtagcaaatattttattgattaccagtcatttagatttaatgacatcagattttcagccgatatatactttaaccattagatcaatatttattctatcatactgttaatggtcgattggtttatattgttatgttattataatttttttatagggtcaaagtcctttgaaattcctcttgtttttcttttgttcgaaaaacccttaaacaggccgaattattcatcagctttgctgctaaaacagtaagtttaagggtttaagcttactgctaaaacctggacgctgttcttaagattaggccttctccatctgaccttgccgcgccgcgcccgagttggccgtcgattcagattaacctgggcttggcccagtttgcaaggcgatctgatgtgatacgtcttctcccctctccgcggctctccgctctctccttgctccgttgctctcgccaccacaaccaccatgggtccatggctacagccaaagctagaatttttttgagaattaatattatttttatggaaaatcgcaaaagtagtggtcaaccggggaaaatcgtgaaaataggtccctgtcgaacgggtgcagttcgatagggcgcctatcgaacggccagagcgcgactggcgacgacatcggaaggctgccgttcgacaggacctgtcgaacagcccccgttcgacaggcagggctgtcgaacagcccccgttcgacaggctgggccgcagttcgacaggatgtccgtcgaactgccgcagttcgacagggtcgcgttctccatttatttgtaataagttatttttttaataatatgtaatttattttagtgtgtaagaaaggaaaatatttttgtaatgttatatgtatgtgatttagggttttgataatgtttggtcagaaattgtagtatttatttgttggttaaaatatttgaattatttagtttcattatttgtatatttgaatgataatttgtcatgattcattcgaagggtatgctactgagtaattatccgaagaagtttatgaaatagtactgatagtactaagttaatcgtaaagtgtttctcaaatagtacggacagaacataaatgattaaaagtttaatacaaatagataagtcaaggacgatcagtgcccttcgcacgcttgctaggtcctcccttcttcctacgcctaatctgctcagtgggatatgtcaaattatcaggggggtgcctatctctagctgcctgctgtggtgtcacgtctggcccctgaccggcctccgtctcctgcgtcggctgtgtgacctgaggtgctgcgtgccagtaatccatccctacttccccctggggaggatcagtggaaaagaagtcctcaatgaatgctgtgcgaggggagtaagcaggcactccgtgatgcgtcgacgccgaaccgtactcatcgtctgtttgtacaagggggagaaaccaaaaaatatggcgtagttagtaacgatacatataattagaaactaaagcgtgttattgtttaaaatgacttacatgtgtgctgtgtgtggccctgctctggcgcacgcggagtgatatgaagtccccatgctggtgtgttcaacacgttgtccccgttggcatgtaagggaagtgtgccgacccagatgctccctgcgaggggtgaacataaggcggagtttggaatacctgcggacgtggtggtgccgtactcgacgtgggtacccctgatccggctgaccccctggtgtactccggtgctggggtgtgctgaaaggaaggacgaccgtgagatgtgtgggccgcttcgtacccgcgacgtgaagaggatggaccactccgatccacgctggaacgtcggggtagtggtggtgatggccgtcggcccgacgtctgcaccacatctgccgcgctccgacaggagacacgacgtagtagtgcggcagcacgtgcacggaagttgcgaaggacactcgccacgtcgtcagacctgacgactggaggtctcgcctctagtctttgcagcagggtgtcggactccacgtgaacgtgctcaacaaattccgcctgttccacaaataatcaaggcaattaaaattatttaaccagttgcacatttattaagagtatttaacaagatgcacatttgttagaaataatgaaccagttgcacatcatttataaatactgaactagttccacatttatgtaagaaaaggaactaggtgaaccaattgcacatttattagacatactgaactacttgctaactttttaaaaatattgaactagttgctcaaattccacaaataaacacgtaccattgagttgtaagctgatctaggctgaggggcaaacgtgtcagtaatcgctgcctggtgggggacggtgctatctccttgtggaggaaaacacctccatcgtgtaacactgcggtaccaacgaaggtaagctccataataactcccatcgtctggaggtgtctgaagttccaagttatcagctgcgtgctcccactcttgtaccgtcggctgaaccgtggtcacaataactagctcgtaggaaagcccgagcccctttctggagtacctgcacaacaacaaattcacacatcagaaaaaatgttgtgcagtgatttattttaaaaaatgtaggattaaacaactgtgatgtgaactaacctatgaagactatcagccaaaggacgaccatctctcggagggaagtcctgatacatgcccaactgtttgagaaccctgtggacattgtgtggctcgacgtgcacgtccaccacgaggtgacaagtcgtcctccagagttgcatatctcgcgtgcaaagatccgcgagaccgtgcggtgcacgatcattgacatcgtgctgagtgtagggagtccaccgaacacggtcaggcgtaagctgatcaaagtcagctacaaactgagtgtagacacgacgtgtcgtcccgctaacccactgcgactgtaacaagtagtagttttcattagtcatataaggaaagtttgtgaactagtattcataatgataacataaacgaatttaacaaaaattacctcacggtgtgtccacaaggatcccatagtgggacgatcgtcgatgtcatcaacaccagacctgtacatctctcgcaaaccgtagtttgcgtacgagtcaagctgaggcctcccaatgtcgaagcgctcgtgcgcccacaacataagtagcaacgggcatccagggagtgaactttgcttgctgttcctcacgcaagcatcacacagtccggcatatgtcgccgcaagtaccgccgacccccaactgtactgtggaatctccgcgataggtaactctgcaatctgctccgcaaagtggataagtgcttgtccacggagtcagcgtgagttcccgtgaacatcacccatccaaacaaccacaacaggtaagcgactaagtgccgctgcacgatccactcctcctggtcatcagggaagacatcctgtcgaaactgattcaaccaacttttcgtaggcccgtgcccatctgtgagatcctccagtgcaacaggcagcac

SEQ ID NO: 80207 - DNA, 9206 bp, Oryza sativa
gtcatctattaaaaaacggagatagtacatgaatagtgatcgctgactcactcctgtcaaacatgttacacaagtcctgggaataacattcaagatcttgttatgaattttggagggagagatcccctaacaacaaatcagatgtttttcaattgaaacctgaaaatgttgccacctgtccatttttattcaataaaaaggtactaatccaaagtgcctaatcaaagtttaaatgaagatggctccacaaatcaacaatcccaaaaaggacccatcatttataagctgcctaatctcagctactaccatttgactaaaatgctcaattaggcctaccagattgcatcttttttgtcttggccatagtctccaatcaagctggagaaacagagaggccatcatagataggagtagcaccatgaactctccaatgctcatgcttaaattctgccggttcatgcgtctctttgcaggttggtgagcagtgcgttttgcctcctctctctttcagtttttggcagcagatcagttaatatggtatgctggggtttgcatgaagtggtagttagcaacttgcaaggctgcagcaacaggtgaccaaacctaacgcacatgcacaagcaaccaggatttcttttggagagagagtgatggatttggatcatattggtgtatgcaagtgcccacaacatgtctctttttttagttgccacgccaagtctcccccattggtttacacaaaagaaattcctcccattttgttcggcatggtgaattttgaatagatatgatttctcggtttatcagcagcatccacaattttagtgttgattttaccttttttattatagtctattttttagtattggtttttaaattgtgaataatatagatataaaagttttattaataaattatgtttagcttttcgttcatatttctataagcttatcagtcgcatcttaaccaatgctattataaagacgcaaatgttaggaaaggatctaatatcaaataattagaaggggcgaggtttcgaacccaggtcatctagcccaccaccttatggagctagccggaagacccccgggtatttctcaccaatgctattatacatctcgatgcagaggctggactgatttctattataaaaagaaatagatatagttatcatgtagatggtgaatgtttatggtactaccacatagaacggctaaaattgtcacatgataaggatgagatgagagtgtgcttctggtaggatgaaccgggagcaaattaagctttgttggtcatcggttagctgacaacatttatgtgaatagtatccagagtactaaccaaagtatggtactccaaaaagtacagactatcataacttttagtagtacgtcactattattattatttgtctggaattttagtagtatgcgagacaaatacggagtactatgatacatgcatgattcaggctgtaaatctcagtgtaaatctcttccattatcttaaaacggcaatgcttccatttatctaaaaaaataactatcattagttataatataatattgtgctaacaatttgcatgatgaatttacccacagctttcttttcatcacagaaagatccttcttttcccacaactaatttggctttttgctaaaatttatacagcctatagtaagcctctgttcgctagttctggttgggaaccgatgccccatgcacggaaaacggagcggtcaattagcatgtgattaattaagtattagtatttttttcaaaaatagattaatttgattttttaaagcaattttcatatagaatatttttttttaaaaaaaacgcaccgtttagcagtttgaaaaacgtgcgcgcggaaaacgagagagaagagttggtaacctgggggaagaacttagcctaagctgtactctctccatatgcatagagagtttcagcagtgaattcaacatttcacattggaggcttggatagcaggtcatatttagatttaaattttatgttatcccttggttaattgttctaattttatttccaggtttactgatccaaattccacaacagagcctaaaattgctgtggtaatgtctaatacaactggcacatattaaaaaaaacatgactaataactctatacaaagtgcttatggtaataaaattttgaccaaattttattacaactttcttataatctaactaacttgaatttccatgcaaaccagaatcactccaaattttgacaggaaaaaaagggaagagtttatacttctcggggttttggcccaagttatcgcagcctaggcccaacaacacgggctgttctcactgggccaagacgggccgaagcggcccaagcccacgttcccgaagcctctccaccatcctagggtttgcttcccccgaagcacctatatataccaccacgcgccgcctctctcccacttcctccctttcccaccgccgccgccgccgccgaaaaagaagaagaagccgacgaggaggcgaccatgagggccaaggtaaccaacctccccgccgtctcctcctcctccctaggctgtctacgcccatgtgttgttgcgtcgtcgccgtgcttgttcttggttggtcgggggctgtgattacaaagagagaggctcgagtggtgaattttcacgggaaaccctagcgaggcggcggatctcgccgtgtgcccccctcctccccacgagcaccccgtgtgttcacggcggtggagtggatggaacccgaggtgccgccccatcgcgatgttggcttgggtatctcggtagttgcatccatggctcaccatgctagtactactccctccccgtccaaaatgttattgctacttcctccgtttcataaggttataagttcatttctgggggaggaatggatggcgcgtggtggtgggttgctgtctcgtgagggggtttcctgccacgatgaaggcttcgtttttaacgcatacacttgatatgagccccctttatgatggtattttttatgatggtatttggttggcgagctgaattcctgttcttgcaacatctgatggatggtgcgtgatatttgcttggattacccgtttgtcagttagcataggaaattaggtttatccattagatgctgaagatgctcattaattttgtggtgctcactgtttaaataatactccgtagtactgtctgtaggaaattataactattatatactaatagtagctgttaagttgatcagtaattatgtgatgctcactgtctatatgctattcctgctgtagtttcagtaggaaattatgaatgctttcaattccctgtgaacatgaaattcagttacataactgcattatcggtgattacctaagttaccatttcatagtagttatttttgtggtgcaaagcttatccagggaagtacatcttaatcattcattcatgatttgatagactttgtaatatgaaattgtcattctgtattttgtcaatctgtattgccattttgccatccatgatgcccctacttcagttggtttgttcaacaatgtctatgctggcattcttgaatcacccaagcaatgaatttaaatcaactaaatttgctgtgatgctatgttgcttcttgcttctgcgttccagtttctgttcacccttgtgttctttgagagaaggctactgtgttgtgatcttttgcagtttcttagctatgctaccatgcttatcggctaattttcatcagttaactttctgtgatctgatacttctgtttgtattgtattcagtggaagaagaagcgcatgaggaggctgaagaggaagcgccgaaagatgaggcagagatctaagtaggcgaaggagatgggcgatcatggtgatggcgtgtcgcagtgatccatgtcttcggctgccaagctcgttgatatgtcaagctgcttggcgtggtgccaccattcgactgttgaatggcttatttacctgtgctgttatcatcttatatccctagttttaccaagagttttgcaccaagacatgtcggttcagttatgtgaacttgttatggagccgtatttgctgctaatgtttacctaccgttgagtaattgctttgttggctctgtggtaacatctattgattgctgctttatctgttagcattggtgtgttgatctctgcgttattgcttgcttgatggtttcagtgtaggaatttccctggagacgctgatgctcagcctggacaggccttactttttctttagaagcttaacattgttttgcatgtctgcagttcttcggctggttcttgcttcctgtggtagcttgtttgttgttctacttagggcctgttttgcagggtttaacttccaaatttaactcaagagttggctttggagagcagcctgaaccctgctctctagtctatggctgtgtttagtttcatgctaaaattggaagcttgactaaaaattggaagtttgaagaaaaaagttggaagtttattagccctatcgtttggcctaaacagctaaagaataaaccaaaatttgattttgaaatgcttttaacataatttttttttaatgttggcttttaagttttgaaatgcttatgtgtgcatgtgatggaaaagtaaagttaggaactaaacaaagcatatgatttgagagcataccagtctgttctgatcccttttaaggcgaagctgaaacatcttggttctctagtttattttctgagaggtgcagctcaaaacagtttgatttaaataagccctaggagtatgtagtttggagatattttgcaaattttgaatttgctgttcattgcggttaagtaattttgcgtttatttcatatcgtgagcaatggtgtgacattggataggttgtttaaatctgttttagatgtagcgtggaaagattagatggaagccgtctaaatcatgttcatgaacgtatatttttcgtttatttcgctgctttcacggtgtttcgacctctgtgttctggtagcttttcttggtacgctgcgttggaaggatcagttctagctactcattgcatactgttcaatgttaacgatgcatattattgtggttgattgatgaattttaaactcagcgataatttgagggatataaagtgaacttattcatagactgaattaggcccaaatataaccgcacagcccatttcacatccaaatgtgggcccattacatggaggcccatcaccgtctcgcactttctcgcttctagtccccaatctgaagcccccctcgatggcatcgccgctccaatggacggctccgatccacccgccgccgcctccccatccgccgcagctgccgccggcgacgacgacgacgagcgagccgccgcgcccgcggcccagccggagcggtgcgaggctctggccggggccatcgcgggggtgctgggcggcgcgctgcaggaacacgaggcgtgcgcggcggccaccgctcggagccagggcgagctcgccgccgccgtcgaccggctcaacggaggtgagtgcgtgcctgtctctccgagccttccccccgcgacttccgttgctttgcttcctactgctgctgtgtaggctcgtcgactcctagggttttgtgtgccttttatggtgtaggaatcgtcgttcgagttgcgttgacgattttctgctatgtgattgattcgtagaaatgttctgatgcactaaggcgttagcttgcggcatacgtgaaccaataattaacgaattatgcttatagttcacgcattttgtgaattgtgctagtatcgagtacaatcttctttacaagctatgcaatatggacaagtacgtctctaattgtctggatattttgatactgaattactgatatagtcttcttgtttccagcattaggtagatattttcgtgtccgttcccgctgaacttttatctgtttgctacatggatgattggatattcatgttagttcaagaggatttcttttttggtttagagttgtattcaagtggtttggatgagttgaaattagttctatatttatttcaaaatcgtaacattgctaaagatcgtctccatttttttccttattgcaaaacttgttatgattggcttattgaaatagctgttaaactgatgcagacatgcagtacgatttcttgtgtggagttgaactagttcacggaacatgccattcatcttttgttattaaaccttgtagtatactgtacaataaattagcgaaccaggagatttactgactgtacttgtatggttcttagttccaatcataaattgaatcctcatttggttgtttgatatgtttatgattgggacttagagaggttatttgtatttaatttcaccctaaacatgaatgtatgaacttgtaaatcctagtaagggaattgctattatgaagatcaacatagtcagaaacttttgggatatccatactgtccatgcatgacaaagtacgaattcaattttggttgacctgcctatttttttgatctgtctatattcctcgaggtagtttatctacattttctacatctgattcttcctccggtcctcccttaaaaaaatgttgatatttgctcagtttgcctcacatcaaatatgttatttcaaaatgcggtttctccatggccctttgtacatgcactaatgaattatatgaaattacctttattcttttgcagaactagacaagctattagagaatgcaccctccccggtcataatgcaacaagccacaaggatttgttctattcgcaagagagttttagctctgaacatgctcctgcgctccatacaaagacgtatagataacattgatagaattgtttctactggtgtaacaagtggtattgctcttctacgatgaataatgtattggtctgaatctttctgtcaacactttgatgagtcccttatgattaacatcttgcattttgttcgcagatcattcttctcatgtacagttgcacagacagaattgaagttggattgaggtacagcatatagtccccagatgttggccttaataaaatatgctgacaacagattagtcctgatgaatcgaatagagatgcagagttgtgattttccttatttgctagtataatctagtgctaaaaactcgaacaattttatatctgaaatgttataagcctcaccaagtatcacataagaaatcttctctaccttataattgcatcttttattgacttgcatgctgtatatgacacccctgctatgaattacagggtttagaagatagtttccactgttaccccgtgtacacccgtttctatctgggagagttgccatttgaagttctactgtaagcaacattttcgtacgaagttgtgcctaaaagtgagagtaacatttgcagtttgtcctccaaatgagtctcacttactccatttctttttgccatttaatggagtgggagtaatatattggaccaatcttttttttttgttcgtactgcagactgggaaatgtacttcagatgtatcatttgcatttgtgaactttctttttgtgggtgaggaatcgtcactgcatatatcagatgaatgttgctccatcgacacatcgaagttgccaacaacgtgaatcaatcgattgtgttgttatatgttttctgttgtacctttctggccaaccttgttcccacatttcaaacaaattgtctaaattttgtttaatcgatgaagccgacctgtgccggcttgcgtatattcattgatgcggcaacgttagtgaaaacaagaaaatttagaatagttgttaattgattcatctagtacgttactatgtactcactccctttcaaaatataaggagttttggttagacttgacagtattgagatgtgtctcgtctaattaaaactccttatattttgggacggatggagtattatgctctaaatgtactgccagacgaggaaaatattgtgcgcagcgaaacaatctttgatttatcgtttcaagaatgcttcacttacagcctcaatgaacaattaacaatgatttctccatagaatagatgccgtgctctgtaacattctggcgaggcgtattcccaaattccaaacatattcgatcgatgatttggtacacattctggcgagggctattcccaaattgcaaacaaattcgatcgacgactccaaccagtaaattttacagacattcttgccggcagattgcaacctgatgtacaatctggagggttttcttccatgctccaacatgaagtgaaactgactcacagttaatggcacttgcgctggcaaactctagcgccaaccatatatgaagtcactactcagtaaagcatatatgaagtcatgactcagtaaagaaaaacacaccgaattgctcatagtgaaggttgaaccacagggaatgaaaacaatgtgtacagttaacaacaatagatatgaagattgaaccacagggaatgaaaacaatgtgtacagtcatgactcatagaatgctgaagtttacagggaaacaaaccaccacattcacaagcttcccaagaaacaaaggaaagaactaagcaatgaaaaagatatgaacctccagtagaggctctgaatcaaaagctgtacatgtgcgaatgactatctaggatttcctcttgccaatgttacaatcacatcaataaacttatctttctgtcaactttgcttgctgacaacatgagcgcgttggattttctatctatggttccatattacaaaggcatccatgtgctggctaagtacatggagaacctgcatcaatatagagattgtaaggagattatcaatccatgggaagactgcaataatctcaactagtaactgataattatgattcctatggaaaaccatatattaccagttacctgcatttctgttctcagaggcgcatgtaaccatctttgtgacccttaaagagtttcagatgtctcttgttctgagaactgctccgggccagtgcacggcgggttctccatgccgacacgtgtgaatacaatgaaggaaataagaaacaaagcagcaggatcaacaagatcacgacgcatattaacatgacattgaagaagccatctagatttgcagggtttttctgctcagtccatggcacaccaccaacattcatcccaaa

SEQ ID NO: 80208 - DNA, 24792 bp, Oryza sativa
aaaaaatgtttgaggcacattaccaaatttatttagagtttttatagcgaaaattaataaaactactacagtttgggaggaatatgttggtgatagtgtgtttggtttgctacattgccgaattttaataatgacaaaatttagcaaggttaaaaatagtatcaaagtgaacacacaagatatcaaaacacgagtagcaactcatgggcaatttaagataaaaaggagtgatggggcaaatttctagcataaaaacttaagagagttggtaagagagtaaggtttaaaaaacaactcgatctaaaggtaaaaccatttgcatgatccagatagccacattacattaaggtgcaaccacgcgtgcaccgtatcagtcatcacattgttgagagaacattcgtcagatcatcaaatgtaccaaaacaaacataaccaaaaaggaaatctccagacatcgcgcacatatatcttctgaatcaagaagatgttaattaattcctgcgaacacggctcctcctctcccacacttcaaacgccagagagggaaatgctctcttcagctgctggtacccttgacttgcagccacggcatccattctctcagatgggaccatgaactccatgcaagcttccttgagcttcttgagatctagcaagtcagctagacccagtatcgcagatacatgctccgtgtcgaggttcgtagctagaaatctctcgcacatgatcctgagcctctccaatccataccggtcaccggccttaagcaaatgcatcatcaaatgcatcttctcaccattgccaagatcatccattcttggaacacaatcggtgtagatgaaatagaggaaagcctcgaagacagatggctgcatgtcttggatggttatctcctgcatttgtgtctccttcttctccttcatcggtccacagagctgagcatgaaatactggagacctcgcagctagcaccgccctgtgggcacggaatgtgtcttctccaactctgaatgtcacatctgctcctacaccgtccttcaacatcttggcgaaatccgacgatatctccataggaggcacctcgatctcgcgcaatgccgaactagtttcagcgtcacacaatgccctggttttagacacttttggctcatagatgacagtaacattgcattcgatcacgatgcagtcattgacgatgaaccctggagtgctctcaatatcgctcctcttcatgcacttgagagaccccaaggtagactcctgaaagcttgaagatctgaacggggtaggcacatcggtcttggtgaacagctgacgaggttgcccgggttgcagctggttgatcagattcacgtcgacgagtgcccatggctcgccgttcttgctgatcagctcgaggtagacgccgatgtagcccttgctgtcgtcgtcgatgccgtcagggtagtaaagcaacgcccaatcgaatcctcctacgttgaagacgccggaccggatggagtcgtcttcggcttcggtgttcatcatgctgtaactgaagatctcgaacctgtggatgccttttgccgtctcagttgtgcagcttgatatgctcctcgacgccattgctgttgcttaattggtgtccaatgatgatcgatgaccctgcagttaatatatagtgcagattaacaaatagcatattttttttagataatatagaaacactaagaaagtactcagggattttttggtggatgtgacacatcctctttagaatgtgtcttagaatgtgtcacatccacccaaaagcacatatattatgggacggaggacattttttatatatattttatctttgtagtagtagtatagattaattggaaagcttatgcgtcttgggaattaatttggaatcagtcaaacatgtaaaggtactatatggcaagaagagtaagaaatcaggtgcagattttttcttgcgattataagaatttatctcttgctaaaacagccttacaaactcctaattaggcacaatttccttttagcattcgtagatcaatcattcacaaccaatcttgtccatgcaaaacatcatttggaagtgccaacctattgttcgttggtgagaaaggtaggagtttcaacaaattcaattttgaaaacttttgcataaacataatttacatacaattatttactttcaaaccaagatatatactaataattaaacattcactactacataaaccctaatgggtgccagttgggaatcctacgtaggtgccagattttccaaccggcacctcataggtggcactgatgaggaggaatcttaggtgccagtttaggaaccgacatctttgagagtcccgaatccaaaacaaaggttgctcgattcgagccgatgcatcaagcaactctccatcatccctaaaatcgatcaacatccaagaacacaattataaaatcaacattcaagagcaaaattaacaacacagaggagaacacaaagagggagttgagggagccaccgtcgtcgttgagcagccacccctgtgcctgtggcgattgagggagttgaggaagccgctgttgtgagtaggccgtcctcgtgtgcacggtggtagattcggccgcccccaagcacacggtggttgagggagttgagggagccacagtagtcgttaaatgggctgccccgtgcttgtggtggcggatccggatacccccgagcgtgcggcggcggatctggctgtccctaagcacgcggcggcggatctggccgtccccgagcagagaggaggagaggagaaggggcgacggaagacaggggaagggaggtggaggagagggggagggtcggcggaggcaaggaggtagcaaaagagagggggaggagtggcggaggcaacgaggacagaaaaggggatcggagagcagtgagaatggtgagagatatgtgaggagggcgagaagaaaaattaggtcagctcggttttcatcggctcggctttcacaaacgtgtcggtttttagaaaaccggtactcatatattcttctaggtgctgattttttttaaaaaaaatagcacatgtatttatatgtgctggtttttttaattaaacttgcacctataaaggcatgtcagtatcgttttttaatcttagactcatgtgaagattgtgaagaggttaaatgtgatggttttttagaaatctgcacacgtcccctattaggattttgtagtagtggttagaggtaaatgcggctaccctgcctagcacgccgattagggcctaatttttctccttacatatctctcgccgttgagagcccttgctgcatcggtggctgttagctaggtgctcgacggtgagaaaaattagggcagcagggactcaccatcaggcacctaaaaaccaccgaggtgatgactgcgccgatttttagaatattgaacatgcaagggttttttgcttgatgaaatatagaataaagtgctcctttcccttgtgcgcctgttgtagcttgtagacatatggcaacccagcagtccaaatttacttctaatcgctaaccactagcagtttatcctcttgacagttttggcagccttagttgtattaacccatttaattacttgcttttgttgtcttcaatctgatgtggtaatagcagtgacattctactggggacatgtgccaaacaaagaaccaataatccccttgtcagaagggagcagtaacagcagcagctactgcccactgtcgatcaaccccgacgagctcgacggcaatgccgggctgtgcggcggcgtgctcccgccgtgcttcgggttgtgctccatggtgggcatgggcgccaccggtgtagtctaaaaaggccgatcagctcccccgcacgcgcgccgtgatcgccgtgaagaagctatggcgaccagccgccgcccaagcccccactccggcggcggcggtggttgtggacaaggacaagccggtgttcagcacgacgccggactccgagtctccgactacgtacgcttagctaggagcaagctagctggacggccgcaggcccaaaagacgtcatgcctctatgcaatctccaagaagaaaaacgatgactggatcggagatttggtctcggagacaaacccgcaaatcacggcgacttttgtggaatagctcgtggcactatggatcgcagtccatggcatgcatctggatgaaggagaaccagaccaaatcacatggaagttcacaactcacgggtagtactcggcttcgtcagcctacaaagcacagtgcattggcacgcttgacacgacctttgacccattaatttggagagcttgggtgtctggaaaatgtaagcttcatgcatgctcatcatctagaatagagtatggacctctgaccggctcacaaacaggggatggcagaacaacgggcagcgccccctctataggggagaggatgaaacggcgtttcacctcgttgcggaatgtcgatattccaaaaggatttggagactggtagcggactgggttcagctcaatctctggcattgggagatgacccagacaatcaaagattggtgggaaatgctagccgcttcggcgggcatccccaagaaggggttacgcaccctgatcctccacattgtttgggaaatatggaatgtgcgcaaccggcgaatctttgagcacaaagaggccacaacattaatgtacctcattgcaaaaataaaagaataagctggcatgtgggcgttagcgggtgctaagagattgcgcgagcttatcccgcaccttgtatagtgtacagtttttggtttttgccttttctttgcccctaggggctgtatttttctcccactatattcaatgaaaaggcacactctcgtgttggttccattaaaaaaaaagagcaagctagctgtgtccattttctttcttctttcttttaattttctttcttctttctttttttctgcggtgcatgttaacacggccggtcctaacttttcagggccctagcgcgaaagtaaatatagaggccctttcatactatataataataatcaatagatacatatactgaattattaatgttaacatttaaattgcatttagaaataatatttatataaaaaacatatgttacctcaaaagttattatagtactttaactcatataaattacactacaaaattacaaatctaaatttagaatcttaccaaatagtttatcgcgagcgtccagatgcgcaccgcaaatgagccggaaacacaactagtgccttcgtcagtttgtccaactatcgggacaactgaattgccctaatataggactatacatcagtacacgggcacatatatagctatttacatgttaacagatataatcacaatgttacaaaattagtgatgatgtattgatgtattggtgttgcactcacctgaatagaatcctccttgtccaatctcgagggggcagccgggagccggcggcaggcaaccggcagcggctgcaccagcacctcgtggcctactggctactgccgtcgcgcggagcagcggaaaacgggaagccgtgagccgcggagtcggcgccgatgcgtggcctctggacctggggattgcacgcgatttcggcgccgtgaggaggaggagatcagaagacgtgggcggcaggcggtggcaatcgcggcatggcgcgtgcgccggtgcgcgttctggtggcgcatctgttcgccttcgggcctacggccttccgtattgggctaggcctgagcctgaggacccggccctgctgcatgttaatgatttgttcatgtatgtagattattctaaaaaatgtaagaattttgagcttgtaacaaaccaaccaaccaaccattttctgtaaggattagacatagataatgtagattaatgtaagcaatttgaaagcatgtgaataaacagcccactcggttaattactcttatttatttatccgagtaggaaaattaagaatgaaaaagatgaacaggattaaaaccaagctttcgaaagggccatgtgaatattcatattctccaatccaatattgcagctcctatttatttattttttggaaaaagtacgaattatcgccccccctgaactattgcggtcgaccgaattacccctctaaatccgaaaaccagatattactcactctaaacttttaataccggacgaattaccctcctcaatactgttttgagcggttttgaattgagcttgcacacgtggcgccaacatagcaatccagtcagccaaaaaaaacccttcttgggcccacctatcatacccccccccctctcctcggatgccacccagccacagcgcgagcgccaccgtcgtacagggcagcgacgaccctcgccgcccccatgggcctctcccccactaccgccgccaccaccgagtcgttgccgttcgcgcccacaccgcagagaggaagccgagacggacgaactgtccacagcaggcggtcagtgggcggcggcacgagacgaggaggaaggaggagcccgcgccgctgcgatagaggggaaggaggatcccgccaccgcctcactccacgtcccaccgccgtcctcggttccttgcccgtcaccctgccttcgccccctccggctgccgtcctcggctcctcacccgccacccgcacccgcctccgcctcgaccggctgccatcatcggctcctcacccgccacccgcagccgcctccacacccgcctgccgccggcctcgactcctcgcctgctggtcgcggccgcctccgcgcactcgctccgcgccggcctcagctcctcgcccgccgcccgcggccgcctcctctgttcaccgagagagaaaggcagagaaggagaggaaaaaaaacactgacaggtgggtcccagcggtttttgctgtgtgtatcgccacgtgtgtgccacgtaggcttaaaaccgctttgaatcaagttagggttataatttatccggttttaagagtttggggtgtcaaatgtccggtattgtagtttagggggtaaatcgtactaccgcaattgttcagggggagggataattcgtacttttttcttatttttttaacgactcgcataagacggtgcgaaattttattgatagagcagaagaaaaattataagattaaaaccatgggatgtaaaggaaaagattacagctcctatttatgggccatctaacttaagaatgagctagctagcggagattgattcacggatcgccacccaaaatcctgacaaatcgaatcaggatataacaaagcaggcaagaagattgtttttcgtctagatttacactgctagcagaaagaaagtaatcaatcaacaaatcatctatcggcagcaggcgtgtggagcaacatccagcgatccttcgagtccgggaaggcacacgccgagggcgaggtgaattatatatcatcgttttgattgattactgcactttttttttattgttgttgagctagtgatggtggtggtgtgaggtttgtggatgcgcagtaccaggcgcgacgtgcggtggaggcggtgacggacgccgccggcgccatccacattccattcaaaattttcactgttatacctctcaaccacctttctatcatcaaccataaattattttataaagtttatagtaatttgttcttaaccataaattattttataagggtattatagtcatttgttttaaactttaggatatgccaaacaaccttaaaaaatactccctccatccacaatagttatacatattacttttaacaccaagaccaaggagaaattaaatcacctcggatgttgtaaaatcaaggagtgaatacaagcatgcaaccaatgagtatttagatgactccttgggttctaataaaacatttaatttatctcttcatttaagtcttgaatgcataaagactacaaataggaacaacttatttgaaaaaaatcaaatgtgaaataggtgtaacttttgtggatggagggagtaaataatttgagacggagatattacactgcaatacggcccattggtgactcgaatttcttggcagtgacagcctagggccgtgggccgtatgcaagtgctagttgtaaccatcaatcagggaagtgtattagagcaagtatcatagtaggctgcaagtcacttataaatatatgcggaaaaaaataagtcaaatataaacacatgcggaaaaaaaataaaagatgagaggactacagatttgtagcatggactttaatatgttgtgtcaatggcagatctagcactaaaatttagctatggtggatcatcacaccagaactaactgcatggtattttaaaaatgaagcaacattttattatacacaaactataatatgtcagcacttattagaatatatgccattaaggatgattataatcctaaatttgtcatgcagtttttacaactgaagccttataaattcgtcgtataacttctacaactaaactacatttccacgagtgtttctctgttttgttttctaggtgtgtttattcataataagtagacattcattgaagttacacatatattctttaacattcaatttttaccgattaacattttgttgttagctagatttgttcattcatttgtgcagacacaaggcagtcccactataggtctttatctcctgttaattaaacgaataagcttgtaccaaatgaaatacaactaactaatcacataattagcatctgaaatcaaggctgagatggccatatgctcgaatactctacctactttgggcatggcataggtatgactggtgccatcccttgccacgagagaacgccgttgtgttgtgtgtgtatgaaagatgtaatcatatattataatagtgtaatatacacttataagtaactatattttatggataagctattagattgactatatataatttggagctaataggtgactattctaaacttctctaatcttttctcgtgagaatgtagactggtgagcaggtggcgcaggcggcacagaacgcggcgaccgccaccaagggatccgccgtccaggcaggcatccatccgtatgaaaatctgaatatatcattcgactgagcagtgaaggtgaagcattgcctggctgaagctgcattttacgcgccttcgttctctgtttcatgtttctttcgactaacctggttgtaacaaacatatgcatttgtttgctcgaagattccgaaatgttgtcacgctgaacaacattccacatccgtgataacagtttatcgcatgacttgcactgtaatttttagcttccgccaaactgtatttcttggggtacattttactccaagtcagttttagctgataactgtatttcacatgctagatgtagttacatcctagctaatatactttcaaatttagtttttgctaatgaacgcaacacttcccgaagcaactttgttagtaaaattacatttaagaaattagtaaaattggtccagttaaactggaaattgaggatggtagtcaggttttacataccgtttcgagatgaaaaccagtcccattctgcttttaactaaaacaaaatggctttcaaaaccgatcgaaattgtgaatcctggtgtcagttcccaagagggacaacaggagatttcctaagggcctatttgttagagctccaactcttaaatttagctctaggagttaggttagggtggagttatggagcagcctaaacccagctccccctctggttcattttgtgacagtgctccacccaactccactcccattttaggtggagttgaaattgtttggttaagctccagctctagataaggtggtgccggagttggagttgtgccaaacatgccctaaaattagttgaatggcagcagaaaacaagcggagacaccatggaacaaaataaaatacaccgctaacatggacacttgcagacatcaacgaacatggtatgaaacaaaaatacgagaggttcaactgactgatatttcagatgtcaagttttcaagcaccgtaacaaataaaatcagatcagtacatcatattataggagagatggcacaatccaggcaaaagttcttaaattctagtttcatagctgctttcatagcaaaacggatctagttggccacggcagctctcttccttggggtagcctcagtacctgaatcgatagaacaaaaggaacataatgaatccaaacaactttgctatttttaacgcaattaacatttcccatgatatttaaaacatcagaaaagtttcagacaccttctctgaagttgctcttgaacctcctaggcacatgtcgcatgtacctcatccttccggttcctgtggtcttgcgcctaatggccttcacgctccagttgtctgaaatgacatcgcagaaattaaaactaagcaaatccaaaaagacaaaagaaattcaaccacagaatctaactagagatttagaggctaaccacaaacaatacaactcaaactaagtatgttttcatttaatgtgtatttggtattaaatgaacgatgcaaggaaacatatatgcaatgatacgaatttaaatggttacattacaaaccaaacaactcaaccaagtactggctaccatacattaaacaaggcagcagcaggagcaagttgacataatggtgaacagaatgacaaatagaattgccatatgtttgaactgaaggttgaaaaagagcaaatataataaaattgcctgatctcagaaaagaaaaagaaaacagaataaataaaatataaggttagaggatatgtcgaaagaaaacataagaaagggaaaattgagtacttatagaaaaaactatgtgcattgggtacatcagagacttaaatacttaggaatcacaggagcatatctcccatcatattgttgcagtttttctctcatcacttgagcctgcctcatgacagaagcaggcaacatggaaatacataaacacagtgaaggtacaaaacttcaaagtgttacaaatttccaaaagtctaaataaccactgcacaaatcatttaatcaaatgtgatagcctgaataaaatataagctcagaaaatgaaaacatcttctcattgatgccatggcatctctgaagtctgacatgcgaaagttttcatgattcctcatagcattttttttgtaagacagcaaaatcatttgggaaatcaaatgcaaagaaaaaacatagtatttgtgatcaattacgacatatgagatatatcagtgcttgaattttgtacgttaatactgaccgttttcaagagcctttcaaaaggaaaatatgtttgaaggatcatcagagacttaaatacataggaatcacaggagctaagctcccatcatattgttgcagttaaaacctcatcacctgaccctcataaacagaattaagttttcatacgaaaatggtcatccttatgttttccaagcaagaattttagcttataatcatttgtgaaaaaaaacatgtgtacaaacaacacattaaattttgttcagttaagatcaacgcagccgagcaggtaaatcacttgtcaggaccacagatcaaaagaggatggataatgcccaatacatacaataaaaataaaaatgagaccaaagttttcttcatttccatcaaaatgccggaaatgccacgctctacaaagagggttcaggtaggagaacgcatctcagcttgagaagccccgatttctacccattaattggctcatctaggcgcagtataatcatcatcaaatctacatggcaacccaaaagcaaatacaagatctagtggggaaaccgaatcatgaggaggaggcttacacttgcggatgcgggcggcggggtaaccgcaggaggagcaggtgctcttctggaggtggaagctgcggcggccgcagcggacgcagagcgtgtgcgtcttgttccggcgcttgccgaagctgcccgtacccttaccctgcgagccacaacaagatcaccacgttagagctatggagaagccatgaggaggccgcggcggcggcggcggctgcgaggtttaccattgcttgatctgctcctctcggctagggttggagaatggggcggctgcggcggcggcggtggaggcgtgcgccgtggcgtaaaaccctagctatttatagggagcaagggagcagcaatagtgggcttccatgggccgttcagaacaaacgcaatcgattgggccgcacgtaagtccaaatcgtaccgcgcgtaatagaaatatgtttactttacatccctcatgtttgacgttgagtttgaatctcttcccttaaccacagcaccagatataatgtgtccctcagtttgtaataccttatctccttttctgtttcttttaacgtgaacatgtaaattgaaagatatgttatatccggtattacggttcaataatgtattattccaatattaagaattttcggttaatcttacagaccttgcgattgttgagtcgtcgccacggcgacggtcggctattaaaatatacgagcaactcgagcttgtcagagttacggataaggtataccctctatccttagatatacgttgtatactgatacggtatacccgcgcgtatacggatattttctgcgtacgttaaggaaatctatcacgtgatagaaacggagttcacagatggaaggagtcctactcggacagaactgggtcgttgccatatcgtgaggggtccgatatctccgagttatacttggagaccaactgatccgcgatataaaagggaccccctgggcaggactgagggcatcaaatctcaccgccaacacatctaccacagcctacgaagccgaagcctacaggagccaagtcgccgggtgatctagtcgaaccaactcgattacggtctcgtcggtatcatcgagttccattattccctttgtaatttgtgatttccatcatataatcccataccaactggattagggctattacctatcaaggggcctaaaccagtataatcttgtctttcatttgcttgatgtcgtattacgtagatcctcgttccaacataccccaatactctctatatccggtctacgggtatcccccgtcgacagagctgcagtgtcggattattggacactttatgccggaaacacgaacaatgatctaaggtagggggcggctaaaataaccgagacgcctacaaatcgggcacccattttttttcaaaaatcatgcacggctccaccaagtagatcggaattatttcactaagtagatagaaaatgtttaaatcgtttaaaaagctgaaatacaaccaaatcacctcacgaaatattttgctacaacatatgaaacaacggtttttgaagctgtttcaccgtatataaaacacaatgtttcagcaaatagcgaaaggatgtttcaattcaccgcaacacttgatctatacataatgaaacaacatgagtatactttctgaaacattactggtggaacaaaaaatgaaacggattcacttaatatagcgtttccgtgatatgtggggtgatttgttgcaacggcacatgtggtggggcgcgtggtggggacgacgcgggggcgcgggagcgcgcacaggaggactgttgcccgattttttcggcgtggaggcgcggtgtaggcacgggcgcccgatgcatgcgcgcccgcatcgggcaccccgatttaaagaatttttggttaatcttagggaccatgtgattgttgagtcgtcgccaccatgacggccggctattaaaaggtacgatcaactcgagctgcagtcagattattgcacactttatacaaaaaaaacacgaacaatgatcaaaggtaagctacacgtaaagccagtttaggtaggtctgccgagagataataatattattatccccgaggaggatttcacatagtgcgagacgcctacaaatcgggcgcccgatttttttttttttttttgcaaaaaccgggcgatgttccaccaagtagatcagaattatttcactaagtagatagaaaatgtttcaatcatttaaaaaactaaaacacaaccaaatcacctcatgaaacattttactacaacgtatgaaacaacggtttttaaagttgtttcaccgtatataaaaacaatgtttcagcaaatagcgaaaatatgtttcaattcactgcaacatttgatctatacataatgaaacaacacgagtatacttgctgaaacattattggtggaacaacaaatgaaacagattcactcaatagaacgtttccgtaatatatgggtgatttgttgtaacaggccaacggcacgtgtagtggggacagcgcgggggtgcgggagcgcgcatggtaggcacagcgcctgattttttcggcgcggcgttttgaaagtttttcataaaataacactgattttttactttttgaaaaacctttcctcgttagtgttgcgtgtccatttgtataagtaacaagcatccaaatgaacaactcatcggagtgcttgacgtctccaataaccaaccgaccaattgtgttccatcaaattcatgtgtaatatacactatacttaaaagtgtctaatacataatttaaatataatatatcctcatgtacataatatgcactctgcttaaaagtgtaatacataatttctacatgattatatttatacgtaatcggaaatggaccagcgcagctaggcaccacacatgggaatggtgcaaaatagaccctaattgatacacatcacgagacctgtatacacatctaagcatacactactcctagtctgtgccagacgctcacataagcaaaggctatgaataaatatatgaaccttgatgaatcctcactaaaagttcactcgtgtacatgattgtagacactagattttaaacccagattagaggatcaccacacagaacatgtttccctaagcaaaactaattcatttcatactatttttcttagataatgattcattttatactatagccgaacttttatatatttgatcaattatccaaatcctagactcacgcgggtaagcttttcattcgaaaacaacagacattaacttctaccccccccctctccctcctctctctctgacttatttttgataagaaaaagtaatgttgcctggatcaactgttatatttggtggggcattggatttttagggatgaagataagaaattgagggttgaaccaatgaactacttgctttttaatatctgtttagttcatcggatggagggtgacgacaaggtgaggtcaacaacgacaacagatgccccttgagcttccagatccggaatctgatcgagccctccctcctcttgtcctccttcctacctgatttggtcgagcttgagctcttgggtgccagatttgccacgtggcggtgctcgtgacctcagatccagctcatcggagttaacaaaggtggaaggagggcaccaacaaaccctagtttttggtttgggggagaaatgaggaggaagacagggtggtgaccggtgacccatcgcaaccccttgcccacacgagtgtaacgtgagttgcgcaactgcacgcatcgagccagaacaagtatccaatcttgattcggtcattcctgctcaagcaggatgcgagggattctttcatcagctaggcctagatctgggacatgtgtaggtaaccaaacaaggagccagttgcacctggaagatacaagccaggttgatacaagcaaccgattatgcccttaagatctagtctctagttttgtactccatgtcaattcccactaactctaccaaacaagatattataattatttttttcatattaatatcgttacctgttcctcttttatactcctgccaaactaagcggtagaagcctctactatctaccctatatatgcatcatttgtgtaatcttagaaaaataaagtgccccaatagtaaccccacacatgggttgcgcgcctacacacgtcgatccaggacaagtaatgaagttcgattcggtccttcttgcttagcttagccatggggcttttttttcatcggttgtgcttgactcagatacgtgcaaacaagcaaacacacccttaagatctagtctttatactccatgccaatcctcgtgtaaactctcattcctcttctcccgagttaccaaactaatccgtagagacctctaatctctatcctatacaggacgtacacgtgcgtgggtacacggtgtgaatgtggttttgtgtctatatgcatcctctgtgtaaaccttataaaaagaaaagcgccccaaaagtgccccctttgtgtgtaaccttaaaagtgtgcctggtccacacggctggaacggaagcgtacgaccgcaccggattgtattgaccgaccccgatcccacgcacgcacgcacgcacccaacacgacaaatccccacgccgcagtggtgcgccaccacccaaccccaaccccaacacatccccacgcccacgccacccacccctcttctctccccccttcccgcttccctcgtcaaccgaatcaacgcctccgcctcccatccctcgccgccgacgagctctcccctctcctccccccctccccacctcgccgtcgcggatcgccccgggccggccctgaccgctcgatcgcccgccgcgcgccgcccacccccaccccccgggatggttcacagggcggcgtctcctgctcccgcggcggcggcggtggcggaggaggaggcgtgagccgagggggaactggagctcgagcgagatggatgccgccacgcgccccgccgtcgtcatcgacaacggcacagggtaaggcggttgttggttggttcgtttgtttgtttgtttgccccctctcgcgttgtgctctcctccggttgttagcttcgctgcgtgatccgtgcgcggcgtgcgcctagctagggtttttccgcgatgggattggctgtgctgtggattcggcgaggcgagcgtatgtcccttgtgtgttatggcgatggattgcctgtaccgttgcgtgtatctgtggcttggattattcagtcgttcagaggtttcccatttcgcgtccttgaggttctagtcaatcagtaggaactccacttcatatagttcagaacttcggatcattggatttccgagtgatgctgtgttggattggagtgccttttttgtttagttgcattagttgcaaatggaataggattgggttcatgtttggggtgtggggatggaacatttaaggttaactccctaattagccaggacatgatgcagctctcatgactgacgggtttgatttagtgtctgaaaatatgtcttacttgaagcatcctgattcctgaaaagctaaaaatggtagataccagaatcgggcaatacctgaagatactgaaatagagtaaaacatatataaatagtttgtaggataaagatgtttcccctgaagctgtgtcttgatttatctgcaattgcttgaaggccgcacattgtcaccccagtaaggttatgtttgattgttttcttacaccatcttgcatgatcttatgtttaggtatagcaaacttggattctctggtaactctgagccatgtttcaccatccctactgtagtagctgtgaatgagtcttttctggaccagtcagagatgtgcagtagtgcaaattggatagcacagtacaatgcaggtgtcatggctgacctggatttttttattggtgatgaggctctatcactatttaaatctagtgggctgtacactagaaaacacccaattaatcatggtcaggtatgtttatgtgttttctgtttgtaataacaacaattgtttatatttctatgttatacgactatagtatgtcccttttacccttttgcaggttgatgactgggatacaatggaaagattttggcaacagtgcattttcaactatctacggtgcaatcctgaagagcactacttccttcttaccgatagtcctgtcagtacacctgaaagtcgtgaatgtgcaggggaaattatgtttgagactttcaatgttcctggactatatatttctgttcaatctgtcctcagtctttctgctggatatgcctttctgaaaagtatttctgatgaggactcggtttctgtggtaggttctgtaaacatctgcttttcatgctttttatttgctccagtgagacatttgtttccacatggactgcatctccttgactgaaaagaattttctgtattacaaaattattgtaaacttgttttaatgacatgtagccctgctatgacaaactctgtttttgctccctttctttaagatatttaaatagccacatttcaaaaaaaaaaatccagtctgttcctgccatattatccatagatatttgttgcctgtgttgttcctagaattcctattcttgtatgcagttttgttttgctattcccttgtatactggtatgcaaataaacatgttctgcatattgtgttatatgcgaagagaagtatatatttaagcaatatgaaagacagataatactgattgaagcactatgagaaatcaacattaatacaatatgactgtgtaaatttagtcttttagttgccagtttggttgaggataaagatctgtagttcctagcaagccagtaccaaccttgcaaaagtttgaacacccataattcatatctgttgggtctattcatgctcccttttaattacatgcccttaaaatttctggtacaccatgctacttattattgttaagtttgaccagtatattttgtcagtctgatatgacaggtgtagtagttgatattggggatggagctccacatgtggtgccggttgtaaacggctacgtaattgggagtagcatcaagtcttttccattttcaggaagtgacgttacacagtttgttttgcagcttttacaggtatttcatcttctcctcataagtcatgttgttcataaacaggatgtgtgtgtgtatctagcattcatatagtgcaaatacattgaaaggagcatcgagtagtttttacagtactaaattagaacaattgatactattctcaatgttctactcagttttcatctgtaatttgagttatgctgctcccagatctttattgcctctataattagttgtggcctgtcacataatgtttttagtgattaatggcatcttttgttgtgcaggaaagaggtgaacttattgcacctgaggattctttggatatagctcgtagggtgaaagaaatgtattgctacacttcttcagacattgtcaaggtattatgctgcttggtttcggagctacttactcaataataccttatgttttttagggtaccttgttgtaattttccaacggtgtacataaatacattctttgatgaaatagttgaaagtgatgtttctgttgaagtatctgtatatcgactatcgagtcaacacaacaaattccatgaaaggaatggtgtgctgtatttttttttcagaatacgcaggagataatggcgtgctgtatcatcctttgaattttaaatgcgaaacaattatgtttgaagaaacaaaaaaaatgccaactttgttgtgaattgtaatttgttttgttatgattatcacggattagttaatgcctggagaatagcccatgggcaagttgcagcatgattcggatggcagagattaaattttttgtgatgttacttttgtcatggatttatctgctggctaatatatactacatatgatattattattctggttctaccagcaagattgaactgtagtttagacttatcttgaacagataggttattatgtgtttccgttacaatttcaggagttcaagaagcatgacaaaaagcctgataagtatatcaaacactggtctgctattaagcccaagactggagtcccatacacaattgatattggatatgagcgttttcttggaccagaggtttgttcccatttctatcatctagtttccatgttcttttagtagtgttgctacaattgacatgataccaatcatgctttgaacaggcgtgctaccctactgacgtgataacatttttacagcttttgatgttataattgattgtgtcctgtttgtttgtctaatgtgctactccatgaaatcatgtgcattgttggaatgaactgaaagcccatgttatgattgaacatgtatgattagttggaagagtaattctgttctctagggcattcagtattagtgaaagtccaggggcttcaacacaaaaaggactaataagaactatgggtcaaatgtaaattttgtgttgatctgataaatgcttcctccagaagtcattttattgacatttggactcttcaccttgaaatgacattaaaaggagaaaaacatgaatttgatgtaatttactaaccttctactagcgcaaatgcagatcttcttccatcccgagatttactctgccgacttctccactcctctacctgaactaattgatagctgtgttcaatctgcgccaattgacacaaggagagatctgtataaggtgctttgtttgaactctgggacacatctaagaatgtgacatatattgattatgtgatatttgactatttgcagaatatagtattgtctggtggatctacaatgtttaaggacttccacaagagacttcagaatgacataaagaagatagtagatgagcgtgttgccgcaactaatgcccgtcaccatgtggaggtgaaagtaagtacaacgatgattggttttgagttcatacggcaatacttgaactattccatttgtgttttgtctcaacctgttgtctcaggagtctttgttgacaattaattgagtgtttcgttcgtctaatgttttggttccagcctgttgaagtcaatgtggtcgcccatcctatacagagttatgcagcttggttcgggggttcagtagctgcttctaaccctgaattttatgaggtgccttccactttacactctttgagtcttgacacctcattctgcaaatttaataatatgacatattctgccatataactttgttaataagtcaataatatgcttcaggtcaatgcaaaccatatgcactgcacacgtgaataaagtgataagatggaatctaaagtgtttgtatgttctctttcagagttgccacacaaaggaagaatacgaggagcatggagcaagcatctgccggaccagcaccgttttcaaagggatgtactgaattttttccacctgtccaaatctctcagtaggagttcgtttaggtttcaccagatagaaatatgtagtcaaaattgattctttttggcccatccaaagcatcgccggggccatcctgattagattggtagctcaggttgttgttagctctctctgtgttcatgctgtgtatagccagcagctgctgttcctctgtttctgttcgaggtgcatgtttgtagccaaaaccttgggcagcgaggccttttcccactttctacatactcctatttcacaacattttttttctacacatctttttttccagatatatattcatgatgaagaagtttttgctaataagaattcaggttatgcattggactgttgttaagctgaggtaattgttcgttgatgatattgaagactttgaaccgtatgacaaaataccctttctgatcaatcaaccaagtgcatgtatgttacggttgcaacgagccaataattaccgagagacgattctatcagaaatgcagatgtgcataaaatttgcatctgaacaatccactcaaccataaacgaaaactttagattcagttgtagtatcgatcatgtggtctatacccctaaattttaaatcttaatatgcacaacaaaaaagacaggagaagcctacagcaatttacatggatgaagctggctctatgcacagcgcacagcctagagtggagtttcagtgatcaactgttcaaaattacatgatgttctctctgtttctcatggaaaattggcatgacgtggattagcggcaaaacagggtgttcatcaggaaatcctcaagagagaccaaccttgtagttctcagatccagcagatgattttaatcctcagaagatcagattttctgtccaccagatcggattctggcatggtggcaataggagcctgatgtgtatcctcaattcaccatatctagcgatccggaccaaattcagatgtttgagatgtgatagcccccatcatggaaacctgatgtaatcaagaactaatgttttggccggaaccacaacggtcttgctaagcacgaagagcacaagtgttaattcgagcatcagaattgtatttaggaatgtccgatcaacgatccagccaaatatcgtgatgccacctgggttgcccagaagatacagcactgcagtgaaacacagaagaataaaaaaaacataagaatcaaacaggacacccaaaaaaaaaatctgtatatgaaatgttagctttaacacttaacaatataaaagaaaagaatgtcttgtaaagtaaggtatgcattaattccaagttatcacaatgaaaaaagattaagcaatgcaaacttcaaatggaagctttagatttactaaccaagtgattccctcttgtggtatgaagacatgtatgaagccaattgagctgtgccatgagaattgccttgtactgagccactctccagagactccaaatcactttctgaaaagtctctcaagaacatatgtgctggaaaaggcacaaggttcccagaactgtttggtgtgcttacataagtagaatcactagagcatgttactaaggcatgccatcgactagccagtgaagcaatgttttgagctctgtgagaaattttagcagctgcatgcaaacaaaggacaagaccgacaacttgaacaacggaagagacctgcatcataagagaaatctatttatgatctgttttgtttttaaacataaccagaagggaacattatgtgatttttaatattgtactcacagctatatcaccaccattagtgaaattgattggtccagtatatgctgttgtcttgaacagaatggcaaactggcttgctgtaacagaaaagaagagcagcaaaaggaacatgcggaacctgtgactgattttggagagattatgacgaagctgcaggtgctcttttaaatagaccaaaggatctgaatcttgttctagaagttttccatagtcatcgaaatgaataacttgtaggttgcaaaccaagttgaaaagcatgcaggaggttaatataattgtggtcagatacatccatgacatgatggaagcaaacagtacagcacatgatctccaagtcgactcttggaagatatgggagaaacggaacatttctcgtgtgaccttcacaacaaagcatggcaatatccaccacaaaattgtgctgaagaaatcctgccatagagattgaaaacacatgtcaatatggcaaacaaaactctggcatatcaaataacaaatgcatggttattaccatcctaaacattaaattttgcaattaaaacatccactagaaaaataaagcatgaagcatcacgcaaagggtgatagcagtttcagccagaccatagacctagcaggacacagctcatttttatttttaatttgtcttctgttccaaaaagaaaaaagtacagaaatcagagtgtgcccatttcctaaccaaacattgtctattgataacaaatcaagtatggctttatgcttcaattgattcctcccattagaactgctaaagacatatctgaagaaatgtgagtcttccagagcacgattctttgttcagcccctaatgacgcgtcttcatgtaaaaaaacacaaacaggtttgtcggcacagacaaaaaaagtgacctcccatgcacatgacatcaactcacatgggggcataagtagaagtagcaacatgcaaatgcatatataactgagagaatcaatcaccgcagttcacccttcactgaagacaatcccatgaatccaaggtgctaccataataaaaaatgtaactccatacaaaagatctcgtactaaattacaacctagatgcaagcacaagcttacaaccacagcctcaaaatcctccaggtttcctcaatgctaaacaatctgaacatcacattccacctgagtccacaaatttctccttcaaatgcacaagttgcagtaaaatgacacctactttcatgccataatctagtagtggagtagtaattcatcgagaaaatgtcttaactaaatataaaacaatttagcaactactcctcactaatcactatcattatctaaaaaaactcgctaatccctatcaattgaagtcaatgactaggtgaatttcagtgtaatccaaaattacatcgatttgaaggcggcgagacatcaccttgatcttagcgacgtactccttttggaagcggatccgcatgccgagctccgggtcgacgaagaggaacttgcggaggccgtacatggccatctttctcgacacgcacgcgagcgcgacggccgcggccgccgcctgcgacagaagcacgcacacctggaacacctgcacctcgaactcgtcgcaacccctcccgcgcccgcggtacggggagagcgccaccgccagcgccggcagcgcga

SEQ ID NO: 80209 - DNA, 60136 bp, Oryza sativa
tcacattaggaaaagtaatatattgatttgtggcattccatggaataaattcttgattaatcgatcagtagatatttctcacacatattcatccaaaaaacaaactgtgaccacatctgtttgatgccagaagcatgtggaacttggttttctacactgaagccaactcctttgaggtctgaaatggaatggtattattttggcagcatgacaagcctttgaacttgctactgatttttgctttcccgccatacaaaccatatggccttggttctaaaaatattttggacgaaagagtacaagcttggcatgctgatctaatctggcttcaacagaaaatcatgacgatgtgatctaaattagtgaatcctttgcattataacagcatggataactatttcttatggaacttgagaataataataaaaaaactttactaatctttgcctcctgtttaggctgttagagtttcctcagtgtgtttcatgttcattgtacttgcttattgaattcgaagttcactttctgcactgttcctaaagagacttagataaacttgtgccctacagaaattgcttggttatgtaatggtagaacagaacggacacaaatacctctatgttgtgcttataccattttatttctctggaaactatggacattttgtgaaacaaggtgctcttctatggggcacagcactctttatccgacctaactttgaattgttggcagatctactacatgttttatcatatataccaaaggatctcaacttcatccagcataccagttatatcggttggagggagtaaggacatacgatcattctgaatttctttagttttaattcaaacttgggaattcaagttcttgactttgtatgtttgttcaggtcaagacagataagaccgattgttgttgatcctggtctatatctctcatccaggactgatatattttatgccactcaaaaacgtgaactgccaaatgcttataaactatttacaggtaaggggttaatgcgcttcagtatttattagaagatcatcccataaatcattatataatgataggggacatagaataatttgtcttatagtgctaatgatgatgcaatacccagttgatggaaaattgtgaaacgtctttatcatatgtcggtttaatggactagtttcccttttagttattgacagatggtttgaaattattagataacatatggctatccatataaatagtgtacttatactattcaattctcttactttggttgacattttattgggctcattatacttggcatcccatttgttatctgatgatttgtaaaacataggcacttctttcggtacaactccgatgacatttaactctgcctgccctgcctgaacaagagctttgcagaattctaatgtcttgctcatgaaataggctggaaaaaatatgtattgttttgaaatgaatccatttttatatagaatggcattgaattcactatacatcttgattacaccttatgttaatgtcttttttacctaactatttaattgattggaagacactgaagaagtatttaattgtacctattgttccaatgcaggttcttcatctgttatcctttctcggaaatttatcgaatactgtatcatcggtacggataatctaccaagaaccatgctaatgtactatactaacatgcccttgccacacaggaagtatttccagacagttctttgcaactcccctgagtttaacaggactgttgttaaccatgacctacactattcaaaatgggactcatcttcgaaaaaagagccccttctactgaccctggatgatgtagagaatatgactcaaagcggcgtagcatttggaacaagattttccatggacgatcctgttcttaaccacattgatgaggagattttacaccggcaacctgaagaaccagccccagggggatggtgcataggtgttggggatgctagtccatgttctgtttcaggtaacccggatgttcttagacctgggcctgcagctatgaaacttgccaagcttcttgcacaaagattgacttaccgtaacttctattcgcagcaatgtatatgggattaatggaacatgattgtatctctggaaactaccaatttgatcatctatatttaactcgtactgtggtgcttctttgtctatcctgtgtggcttagcagtcctgtcagtttgttcttggtacctatagcaagcacagattcacaataatccattttgcccaaatttcccaagtataatcacgttttccactacctcttacctatctgagctagtggctttcagttaaaaaaaattaggattaggagtccatgtataatcaacaaggtagtaatattatttgtaccttacactatttataattcacttagtttcaggcaactaagaatgaactcatacacaaattttggagataaatgaaggaatcacaaattaacaacgaacatagacacgggatataggatagatcaggcacgtgcacataattaagtagtttcagttgaccttcaggcctgcctcatcaactccagagccgcctcgacgtccgcgcagacgctgaccccgcggcggctgaggccgacgctgccggagaagacgttgaagcactcgagctccgacgtggtgcccgcgacgcgccgcagctggtcttccattcccagctcaacgaacagcgccacgtatcgcttgtccgaccgcatcatggcgacggcgagctcgatggtgtaccggcggatccgcggcaccaccatggacggccggctgtactccctcaggacctgcaccatcgtcttcgccagcgccgcgtccgtcaccctcgccgcggcgaggctcgcgcggagctcctccggctccatgaaccggagcatctgcgccgcgaggcccaggaagatgttgagcaccttgcccttctcggccatgattgtcctcagcaccttggtggcgccggcggcgactcctctcagcggaagccgccactcgtcgccggcgtaggtgcacaggttgcggaggatcctcgcggcgccgacgatgacgacggggtcgctcatcgcctcgacgagccgttcaactccgccgccgcaagccgtcatgatggcgccgcagttcctccggctgtcgagggccagcatcgccagcgcctcgccggcctccacacggaccgcgtcggccggccggtctccgaccgcctccgtcgccggcaagaacatcgccaccagctcgctcaccacgccacccgtcctgccgatcatctccctcgcctcctcgtccatggtgaggctcgtcagggtctcgatcgccagctggtgcagctcgctccaggccttcccgtcgcgctgctgcagcacatccctgacgttgctcaccgtgaacacgatgccggagagctccctccggaggagcttgccggtggtgcccgtcgtgctagccagcctcttcaccacgcggagcgactgcttcaccgccatgaggttcgtgtcggtgggcgcggccgtcgcaggtgcactggcgatgctcgagtaggagatgatcttgtcgaggagtcccttcgtcttgccgatcttgtcgcagatgtcgtggtcgtgcgccagcttgttgaggatggagaggccgaggaggttgagctcgtcgaggtcggcgtagagcagcgacgcgacggactcgatggcgccggggatgccggtgacgcggagagcattgagcttcccctcggtgagcatggagacgaccaccgcggccgaccggcggacgcccttctccgacgagttcttccagctgagcatctcgatgagccgctcggtgaccggcgccgacgtgccgatcctgcgcagcgtggcgtcggcgaagcggtcggactcggcgagcgcgacgaggacggaggcgccgagccgctgctcgtcgtaggagccggcggtgagcaggtcgtcggcgtaggacacgaggtccatgtgcaggccgtcgaagatgctgccgttgaggcagcgggagtaggaatcgtagaagaagcggcggacggccaccgcgccgcacgcgccggcgaggtggcactccttggcgacgcgctcgatcaggcggcggtgccccacccgccactgccacagcgccttctcgacgaggaacagcagcgcctcggcgagcgcgaggccgtagaagatgtcgagcgccgagctccggttggtccgcgcgtcggcgctgccgccgtagcgctggtggacgaggcggacgagcgagagcgcgacgcacgcggacgcggacagcagctgcatccagtagaacacgaggccggccgccgacgacaccggcgaccgccacgtcgcctcgtgctgccactccagctcgtggctgcggcacaggatgcgggcgccctccaccaccagcagcacggtgatgcaccagaagtcggtgcgcccgagcgtgatggcgaagccgccgagcagcaccaccgtcgcccagatgaaccccagcgtgccgagcctgctcgccgccttctcgaggacggcgagctgcagggccagcaccgtgagacgccgctccggcggcgccgcgtcgccgtcgtcgtcgtcgtcgacgcccgcgcggatgttcggcgtcattatggccttctgcggctcgaacagcgtcggcagctggtccgggatttggacgagcacgctccggctagacatgctagcgcggcgatccatctctgcgaattcgtgtgcgttttagcaagaggtcactcactgatcactgacttttgcttgctgcgtgtgctctggattggcgatcgcgcgcacggtatttataggcttggaatgcagatgcagccaagcaaagtactacggattttgtacgatgtacgggtgtgtgtgtgtgtgcacactactggatattaatcccagcaaatgggaatctgcaacgaaacgcacgttgcgaatttgtttgtttcttgtgtgcatggaagactctgtttttggggcttcagagatgggagtctgcgtgtcttctttttttcttgttaggagaagatgttgctgtgcaaggcaaattaggcaatgtaggggaagagtagctgccgccctgaggtttggacgtgaacagctagcgtcaatatagcatgtagctcaatcatggtctaatgatcaccaggctgtcctctctggtgatgcgtgatatcttgcagctcataaacttcatactcgagtcacgccgcggttgtgatcagataagagtactcatccttggtgatcaccaagcttgctgatctctgctccaacgaggtgcaattttgtcacgtgatcacgcctctgttgcgtgcttgtgttgtgaggtgtggttggttaatgtctgttgcatagccttataagttatactgctttgcaaattgagacgatgttattcaccatgcgtccttgccttgtcattcagtcaaggttattacttcttccgtttcctccgttttacattgtttcacaatgtaagattccgaatcttacattatgaaatggagggagtaataacttatgatggttcatggtttgaaatatttacaaatacccttcgaaaaagctacgaaagatgaatacattataatcaactaataactgtgatgacgttcttgtgcacccgaagtcccgaactagggacctaacccgaactccgggtatatgcgcactgcaatgaataagctatcttatttacaggattcttttcactatatacgctgatttgtataacgaagagaatactaggaaccaaaaatatatataactgtaatgcagcattgaaacatttcttttccatcccatgtataccttcccaaacccaaaggacaggtgcatcccatttaaaagactgggttgcatcacacatttttcatgtccagactatccgattcatccgtcttttaagctccagcattgaacggaaacttctggggcttgcgcagtctaaccctcaattctcggtccggactgccttttcttcccattgcccgatcgttctaatgacagggaaattttcgccacaaaccggggaagttgattactttgatctctgactagagcaaaccgttttatgttagttcattctcaaatgtggaaagtcgagaatctgatagaacagagaacatctgcgtctccacaaaaagctgcaaacacaagtttcgtttcattagagtcgagaatttgcatgaataacagaaaagaagggaagatgattagatgaaaaacacagacaatacagctctggcatccttacaaaattcgtttcattgagaaatttctatactgagacctgttcatatactaatactcttgttatgtccctccacccttctggtttcttttattttttttaaaaaaggtcagtgacctaggttttcttttagcagtgatctaggacaaggaacagaaaagagttaaaagtgcagacaatattaacatcttttgaaagctctatctcatcaacaggacctacgatgtggagaaagactggcatgcctctagaagtatactacaggtttgccatccaagggttcatgaacaacttataaatttctattaatttcgtaaaaacgtaactcaactacaaatacctttacaaatggtcggtcctttgaggggaatgaatcgataaaactgtcttttagaagcaacgaaacctgataagatagaagaaatatcattgactggatttatgctgttttcaataattaaagtgcaaaccagtgttcatattgctaaccctgtcattatttgactgtacattggtgatggtatgagatggcaggtcagaacaaagcgactccagataggatctcatgacgttcaagaactgccaagctgcctcagcctgtaatgaaatccaaactagttgtaatacatgggaaatatttcgagccatctttatccttcaataaaatctaacatgaaggatcaacaagttttacatgatcaagatctgcaaagggaaaaatccaagggaacaggcaccaaacaggattgatccctattccaaattttataaataatattactacctgaacttcattgcatttgtaaattggatgtctcttagccagggcattctcacatgaaagtctagcatgaattggactgagatcagaaacaagttctttgaatcgtggaagttgaggtaatgagcatgccttcacctgcgcattttcagtatagttgctaacagttagtggctatgaatcttttcctgcaaaaagtcataacagcagcacgtatgctttgcttgcaccagtaaaatatcacaaaatcaacatgatcagcccaggagttccatcatgcaacagtagacgtactatgtaccctggaagtataaaccttgaagccctggtctcatagactcgcacaaaacatttttgttctttgaaaatcagaatgtatacggaactagcaattcccgtttggcagagcatgcatatggaacttgtgattcctgattgggtgtagtgaaatgtcaccaagacaccaatgggtaaaatcaattccaacttactcctattgatattgttcacttaaattactccaactgacatgctgacatgttagctaggcatagagcaagaataaattattcacttttgacaaaaaaaaagcatttattcccaagatattttaaattacaggaaaaatatgatgcacttacctgatctttatctacattgattctgacaatacttgatgctttcatcttaatatcagggggtttatgttggacaccagcctgtaggagagaacacgtccatcagctaatatgcacaaacaatcagaacatggtgaagatcggtaacatgcacaaattggcaattgcggtcagtgatgactccttgaaagagcatgaccaataagtgtgcttaaaagaacattcagaacttacaatgaaagggacgggagcatcaagaaaatccaccaattttcttggtagaacctgaaaagcagttgtttgacttcagagcagaataggaacatgagatatatgaatgagctacaaatctatcactcttttagggtattagtccaatgttcaaagcatgtatagaatctagacatcaatacatctgtttcagagaaagcaaatgcctacggtcggatgacaaatgcaaatagagaaaagacagtccaacagttaaaataccgctcttatgtacagactatttatacactacattaaaagttgcatctttcacaatttatttagttattactaagttgcacacagcatttaggagcacaatgagtccatgcgagtgcatttaaactgggtttgaaaagcccaagttttattaaaacacaaactctacaaaggccataccctcttgatactagttgtctacttcaactaccaattcatattctccaaaatcaaaagttgaaatctaaaacagaaggacaatagccacgtatattttagcatcaaaggcaatatgatattttcactaatttatagaaagttattcagttacaaagaagacggatcctgcatgattacatcataatgataaggtatgataaacatgagaaaaaaaaggagcaaaactgagccaccaaaaaaaggtagaatcagtcagatcaaagcccaggcccccatggggccactcaaacaaaactgaaattaccgatatgatattaaaaagtacataattgaacagaaacctgaaacttacaggaaagagtatgatagaacttacaggaagcaataaactctgccactggaatggtcttatcatcggcataactgacaaaacaatagctgacagtacaccctgcagttaagcatttaagggaggtgctggaatcagcaggaagcataagaggaaaccagggcacatagttacaaagctcaagctaacaagcataccagatttgagcatattaccacaatctgcttctccaacagagcagcagcaaataactctagcacctgcagtgaaaaacaattagttatttttatgcaaactgagcatagaagcttacgtagggacagacaaacagactgctatattgagtttaataatagcaacggaggactattttgccgatgtaatttaatgtgctttgcccttatagagtgaattgtgctatttctacttaggcttcgccctttctttaagaagaaaataatagcccataggaatgcttgttagcttgtggatgatgtcaaggaagaaaccctagtgtggaagacagcgggggttattcaaccatgtaataacgagaatcactgattagagttcgcctccgggcctgtaacttttttcgttcagctcacaggatgagggcctagccaacatccaattcgacagtttactgtcattgtaagctatctgtattgtttcattacctttctttcttaatgaaattggtcgaccgaatctttcggccgacccggcaaaaaatagcccataggaattaccatgcattggaataacgatctaactatgcgtcctagatagacagactttctatatatatatactcaaatacactctatatttgctacaccaccaaaccaaaatctacataagatacgtactactcaaattaaacaaacaacctaaaaacaagaggaaagacagtatggagctctcattccccgctcaccagtctacgattggctcgacttcttttgagctatgagaaatgcttaggggagcaccttctttttttctgggatctctttgtagccaaggagatctatgaagcctagcggaaagcttgataaggcctatttagtgtattttcccacccaaccactcgcaggttaatgaaggcagcagaaaaggggaaaaaataacagagatacaacttcattattatacttactactacaagcttaccctgttacaagatggctagtttaaaaatgggggaatacagcacaaaaaaatggagccacataggtaaaaacttagagcagaaagtacaacatacactttcgagagacaaagcacgacaaattgtagctgtagtccatatcgataatgcgatagcttcttctgcagccgccaaacgggcattgacctaataataaaatttcatggttagggaagctgggggcattgtgcttcaaaacaaatctctaaagaccacacattcacctcagttttttctactgaagtcaaaccattgtctgaaattgtgtctcctaaccccaataaagacaatccaggccgggagtatttaacaggttgcagatgttcaagggggtggaaaacaagttcacctccacgaggtggcagagcaagagcatggtagccacaaacaatctgcagaggttcattgttgtgtacctattttatttttttttttaaaaaaagaagtctattattagaacaagggccaacagatgccttttgtcaagcttgaacgtgtcagacaaaccttagcccatcccataactttttcatcatcaacaactatttcttgcttcatatttagttcttcttcttcatctgacccaacacctttcacagaactgtcagaaaccacggcataattaatgagtaaggtaaatagcatgaaaaaactagacataatatagtagttttacaggaaagaccacatgatttcagacatccagcagatctggtgagtgatgaccataatttgcactcgacaactgcagaatctatgttttttcttctaattatcagggttacctgtgtaaagactccatgctctgtgcacgcatgattcttctggagataggcgaatgtgtggagagaagatctggggaagtatgtccattctcataagtataacttgttcttccaaagctatcacaacgggatcccaagttctctgatatacaatcctcatattgttggaaactatgcctgccttccttctcgagttctcttatgtaactagaatctgaagtctcactagccgacatactttcaggagaattaggctcccaactcctgaacaaatatgaaggaatctctccctctgatggaagtcctgatgaagagatgagacctgatatactgttgacaggtacagcatattctgtccaatcattgtaagaaagctcatttgcggattcaaaatcctccccatttacttgactttgctctttcatagagcgggggattggttctgccagagcaatttcactagcaaactgtgttatcctgtcaagcctctcctgagcaattatgctgttcatacaaacaacaccatacactattggttagcagagaattgagggagcacagactagccattttatacataacattgttcttaggccagataaatcaaagcaatcttgaaacttagtaaagatagccaacctgtttagcatctcataatgcagctcaaaaaagggcacttttgtgagtaaacagtaacatcgtggtgcagaaaccaagaaacgacttggcttgtaggaagtagggtttagtggtgaaaccatgcctagtatacccggtgctctctgaactatttcctggacatgcagacaaacaccatatagtggtgcattatctgatacctggtgtcgtgaacaacaatcaacaataagaagggtaaatagatgattatctgaatgctaacatccaggaatattagaaaagaataaacaaactaaccttcatggagaaaataaaagacaggtcatctcgacacagatgttcctgtataaaatttgttatagttagatagtactttgaaagaaagcacattagagtcaagttagatagtaatgcaatctccacaagagtattcatatttatagtggagacatgacaactgccccctgattatccattgaccaccaaaatttagactgaattttaaaacgaattttgaacaaccatttactatatctttctacagactagcaaaacagtcgactgcaaataccaggagatttcccatatcctgctacaactagtctcacctgcccaaataccacttcattcagatcactcattgatggagtcctctctattaagcgggcctggaaatttgaaattaaaaaatcaatatatatatttacagcagaaaatacatatcccaataagaatagaaggaaaaatgaaaagaccattttttttgttggttaacactaacaatacctaacactacttagtattccaatactccacagaaaattatcgaaacaatttaactaatttttttagtccgagtcaaatgaaaagaatcaagtcctaggactataaaaagtatcagcaagtaaacaatttcagataatcatttgcttatcacaattgttagaaaatagaacagcattattatgccaaaaagaagtgtgtaccactaacactaacaagtatcattatgcattcctcaggttccggcaaagaagtacaacaaacaaaattcattttacccttaactgaatcttcctctcagacctccttttaatgaaacaaagctagataatcaacatgcaaccatagtactactaaataatttttgcagacacaagatatcaaaaccaattgatatgtttcaggaaaaaaaatcaaccgatggacaaaaatccaaaaatatagaagagatgaatcatgactccatgttcaaacacccagatgaatgatagatatcttcactcaaatttgaattacttagaaaacaacatatgccagaagtaaaatttctgtcacattagagacagttctactcaactaagaaaaccaaagggcaattcattataaatccaatatgtacagtacaaattcagcgagaaaaaaaaaactaagttagctgacctttacaccctcgggaaaacagaatgacggcaaatcaatttccctaatttccgctttctttccaggtggatacttgaaaagaatctgcaagtaaattgctctttgatcatcttttaggtctagagaccaagtccaacagtctaaatcaggatagaatcttgggatgtgccatataaacaagatagacgttttcagagttcatgaaactagagttatgtgcacaagcagaagaattccatgttttttttttcaaagaagcacacctgtggttccatggttggtataggtccatgatattgaatttttctaagatctacaatctccgagtgttctacattagattcccaagctttcttctttgcaaatgcatcctcaatgactccaacatttgcataagaatgaagtccgactacgaaaaaatgttcaaagagtgttgttggttccttatactgcttattgtcctgcagaaaaaagaagagtaaataaccagcgtagtaacaaggggaagttcacattgaatacaaaccaaaataatgcaacagaaactaacatgggcactagcgcactgcaatacaaaaggcagatctctgtggttctaagggaagtacttttgtacttgagacatgtttgatacttgtagatcaaaatattagaggtactatggtgtgtgaatttgctctggggatcacactctcaaataataccaggttcaccgggttatgattcatgagaacatcagaatgcatcaactacttcgctacaagtatgaaaattcatattgcaccattgcggtattagcaatttgatcgttttctttaacaatatagctgttgagcaatgattccgttgttgaaatgcatacaacacatagtaagataggtggaagcattagagctcattgtctgctgctgttttctactatctgattgcgtggacctgcccatttctacttgacctcgaagactaaagctatttgattgatttagcacttttgttctcagttatcaattcaaataggttttcagtcactcctaagcaaaagttgcaaataaaatgcaagaatatcataagcaggattgagtgaaacaggagagttttatacccgtgacttggattggatttgataccactgccgcttctgatgcgccatagcttcaaagttcactgtcgtacgcagcagctgctccctggggctcctctcgccgccgcctccacttccaattggcccccatttccacgcccgctgcatctgctgccggaaacgctggaagctgccggtgcgcacgtgccgcgcctgatgcttgatctgtgacagcggcgacgacgacgaggtcgacgtgcccgatagaaccggcgacgacggcgccgaagagatcctcgacttcgtctcctccctcgctggcgatccttcccccaactgcgcggccatggaattctcctgctcctccgcccccctcgcacgctgctccgatcgcaaaaccgacggcgacgcggcgcttcccgtatccacacttcccgactcctctcgcggttcagaaaccgacggcgactcatccccgccgtaggcctccacttcccctgcgcccgcggccgccggctcgtcgccggccagcgtcctcgacgctgatggcgaagaggactcggtggtggcctcgccgtctggccgcgccactgccaccggcgactccgtggcagtcgacgacccctccactgcatcctcaaacatccccgccccccgcggcgacacctccggctgccccggcggctccggctccggcgccggcgaggcggtctcgccggagagttccatgcacgcacgagaccggagcaagtgggaattggaattcgtaggcttcgccttgtgttgtggatgaaatattaatgccaaattgccaagaatcaaacccaacggaaggggaagagaagaggacgagatcgtagagagaataataataataaatgataaatacagaacaaaaattaaataataaaaaataaaagtcgatatctcgatagagaaaaaactgaaaataaaaaattggagcccgacggaaaggctactgccaaacggcggcacgtcagcacgtggtcagcggggcaggcacatgggacccacctggcagtaatgttctcgtaggtaggagtatatcccactgacatgcgggcccggcgcttttcagttccgcgtgtgcgtttgcttggccttttcccggggatgggaagtgtgaattcgtcggtcataagtaaataatcgctttctatgggctttttcgcaaaaacatggactaacattccagtcctttccatttcctgtttattacaaatacgtgcttgacttgatgcatgcgcaggcgcgcagcaagggcgaaaggctcagtatattggaaattaattgagggcgaaagtgcaaatacagggcgcatcacgtggagtataacgtctacaccaaaccaaagcgaccaatacgatacgcgtattttcagttggcccccggttggttggtgtgtaggcgcgatcgccggtcaacgtcacggcctcacgggtgggagacggaagaaggttcgagccgccgccggccagtggcaggcaaacttctcttctcttcttttcttcgcgtcggccgcccaatcgccatatggtccacggcctcgaagcagttcatggtccagcccccgcacgcgtggcagatttgcaggcagcagcaacacgtacttccttcatctcgtaaaaaataaatctattactgaatatgatatattttattataataaatttaaataaagatatatccagatttataatcctcacatctaatattatattggtttcttatgggacggagggagtatgcccatgaggccggcgtttcaacgctctctcggagtacagcaaacggcaagaggaagtaaagggccacgcctgatttgtctcatcaaggctttcagaaacttgaagagtttcagttaaaaagtaaaactgtattgacaaagcaacaggtttcagcgcaggtaaaaactagaaagattagcaaagcaagcggccggtggcatatgcctgaagaatctgttagtttgtttgttgtggactatctcggcatctcgccatgagcaactggacaatagctatgtttgtgtgatgatgtaactgaacctgaaaccagtgtgccgctcgcatcttgcttgtgtaatttttcagtggtcccaaatggatgaattgacggtaacaaagcgtaagatgagcagccacatgcatttcttttgttctaaactcagtagtaggtactaactaccacatgataattacagtatacgattctgaaaacatcatccatatgttggtacttggtactccctccgtttcacaatgtaagtcattctatcatttcccacattcatattgatgttaataaatctagacatatatatctatctagattcattaacatcaatatgaatatgaaaaatgttagaatgatttacattgtgaacggaggaagtgggaactaataaggtgaaaccaaaaaatatatatcagtcagttgcacagcaaaagttgttagtcgattgccacgacaaacgttaaccaatgcatctagtgcaacttgtgatcccctacgtgattgaaacaatcacaagtcacattgtttctgcaaggtaaatcgatccgggaaacaccgcaacacaatggttctatcttgtttctttactttctaataggtttctatttcactccacttatctatttaactgtgtcactccaattctgcatcaacccggtgatatttaacaacatatttggttcactatcactgcataaaaaattacttgttttttaactaaatttcacattggaccccattttattaccctagttgcacaatgtactatgggcctatcaaactttttacttagcaccatctaaccttgccaaaacatagtagtttggaccaaggggtagtggggtaatgcttgagttgctaccatggctatttcacccagggaggagaatgaggtaagcactgagcgcaaggggattagagccaatgggtcctagactcctagtgccttgcattgagaggtccgtggcaactgtatagccgattcgcatggctaggcaaaatcgattcagaaagcaacaagtttgatgcttacgttatggatggaggcaacaaaaattgatgattcagatagtcgtagttataagtctgtgtcagtttcgaatgtttcagtgtagccatgttctgtcgcccaccggagttgaggacgaccaccaccgccctgtgcttgctcccttctagatcaggttcccatggtaaccgcctcctcttgtgatctcaaccactcgtggcccgggccgcacaactgatggaaatgcttggaagggacatggcgggagataacagagacagaaagagggagagcaatggcgtcgtcgtgtctctgatggcctatcggacttggagaggatgagggggtggtgttgagtaaaacaaatagtaattttaagtggtccaaagtgaaaatcttggctaagacatgatccaagctataacaagggtaaaaatatatggccccaactgcaattttactcttttaattttaaaacatcgtacttatgcagtatcttagcaaaactattttcggttaatggaaaccgatatggcacttcgtcatagtaagatcattgttgctcatctctatcagtattcacaagcttcgcatctttatcaatattcacaaaccaacgagcaattcctgtcttgcactgttatattattatccatgcattggattagaaacaaggagcaaaactccctgatggttctcttaaatcaaaacattaataattacaaacaggcagatctgaactaaaaattcattcagatttaaccttgagcctcacaccgttacaaaacggagggagtagtattcacaagccgcgtagcggttccactgtttacaacgttgtgtacactacatacatcggagtactgaatcacaagaccacaaagcaaaaattggctgatggttctcttaaatcaaaactaattcaggccatagctaaataagactctgctgcatcactcagtgatgtccacttcaccactctgacctcgccggacgcatctccggtgaagacgacgccgcgcgacctgacggatatcgtcctgacctcgtcgtcgcagataatatcccctctcttcttcagcgacgggagatcgtagacacggacaacgccatcgccgcgggagacaagcagcacgggcttctcgtcggcgtcgtacgttccgtccatggaaacgacccgttcgtcttccttgtgggtgtagtgcacctcgaggtcgaggtcgtcgtgatcaggcttccactgccagaccttcacggtgccatcgtcggacgaggagagcaagaaccgctcccagcagagcaatgcggtgaccgtcgacgagtggccggcgaagctgtagatgcagcggtgggtgtcgaggtcccagaccctgatgctgccgtctgttgagccggagtagagcgcgcccttgccctgcgcgagcgacacgacggccttgtagtggccggtgagcgcggcgacctcgtcgaacgattgctgttcttggttcatcctccacatgaacacggcaccgtcctccgcgccggcgaagaggtggtcctcgtcctcggctagcatggcggtgatctgcgacgcgggccctcgcagccggagctccttgccggtccccgtgtggatcgccttgacggcgccgcgcacgccggcgaggacccacgggcccatggcgatcagcttgtgcacctccccttcttgcatctcctcgacgcggacgcactgcccggtgctgcagtcccaggcgcgcaccgtgctgtccaggctgccggagaacagcttgtccgacccttccggcagcgcgaagccggtgaccgccttggcgtgacccttgagccgcgcgacgccgcagaagccgtcgccgacgcaccacgcgccgccgccgcatcggcgcttggcaggcgtttccggcggcgcctcaacctgccgcttcgccggctgaaccggaggagccctacccttgccatccgaattcgcggcgacgcaggacgggttgacccacgtgttgctgcgcgtgttgacggcggcgatcggcggcgccggatcaggcgcgtcggtgtggaggaatcggcaggggttccggctgcacctgccggacttccagtagtggcaaaccttcggcggcgctggcggcgtgttccagcaaccaggtttgccgcggcgcggctgaggaggggcggcgggaggaaggggaaggagctgcaccgccgccatcgtcgtggttgggacttgggagagtggcggatcggcgattgatctcacaagagatggccagatgggccgtccgcttatatcggttgaacgggccagtccgactcggactcgtttagtgggctgcaccgccatagactacccaagccactcaaatagtacgattttctgactgaattgatcgggattgaatttcaaaatatccataatttgccttaattaaactaaataaacgcgtctatctaactcggcagtgaataggttacactggagatatggttagttggacacaaattttggaccgtattcatgagggcccatgcacccttgcttgttttaaatgggccggtatcagatagagctctaatctgttgtaattgtaatctaatcatattaaatccttagtttttgtaaccaagctctcgatcaaccacagcgcagctttgccctgctacagggtaacagtagctggctgcatgtgcgtcgtccgattcggtgctctcatcctatcagagccattcgttcccccatcacctcccccgttgctactctggcaccctaatccctctcatcttcccacgagccgccgccaccttggctactcgccgttttcccctcccaaaaatcctccgccgcctgctcatggtctcatggagcctgtggtcagccgccgccttcccctcgagcttgagaagccggagccgctgccttcctctcaagctcgctgaaccagccgtcgctgacgtcgtgtggagccagtggttaccgtcgctgtcttcccagcgagccagcggcagctgccgccaccttcttgcgagttcgatgtccactgtcgccgtcatttcgtctccttctccatcccacgcgagcttggttctgcaagatctgtgccgcatcgagcgcctacaagcacgcggtaaccaacaggtgaaactccacatgggtggcagcagccaaatctcctcctgctgatatgactcctcaaattgatttctcagttctctttacagtcctacatctcatgctctcttcttatcaaccttacataactggtggaaacctctacttgatttttctgtggtgcatggtcaatcaggtctgaacatatgaggttacaaatgccttacctgcattatgcttctgaaatttcactgttagaaggccatattccgttgattcagaactttttttttgatgtgcaggcctgcttggaagcacaaacgaaaggatcacatatgtatgtgagtatgtctatttgctaattactaccttttcctgcaaatacgcatacaccacttggatgtagatacccattctgcattgcttttcatgttaattaacttgattgggtaaatgtttactacattgatcggccggtatctcagagtacaatcaataagtgactgaagataattcattagccttttatgtctatatatgatcataaaaatggctgcagggtgcatcagacaagcaaaaggtatatggtaagtgatggcacatttcttagggaagggatttacgagttcaatgtcaaaatcctctctatcagtcgcctcacattttcaacttacctaggttgcttccctatttttagctacataagaactatatgtatgtcaccccatcagagttatttatattcacatgttatattctaaatccatatttgttgagatgtgttctataattgatctctatgcagagtatcctatcaaaacattaacaatgttagaccgtacttttagtgggtgttgcatgcagttattattatcaaagctatcaaaggtattttacattgttacatctccttcaccctttataggtttctatattacaaatgctcatgttattgttttaattctttttcgaccagtacaacctgattagctattcttactaattctatattacagatgctctgtgatattaattgtgatcctctttcattatacaggtatgattccttctatttacattttaaatttttttatccgatggatttgttttgcctcccttttactctacaattgataatttacatggctattgttccatacgcaggaaatgcacggacagcttgtaaagtaaacttgatgaagagtggtttcctatctccatcaaagtttgtcaaattcacttgtctgctgctgtattgtattgcttacaagctatttttcttataccatcatcccatacgcttagatgcatattgtacacccttgcctcatgtaatcatgtttgcagatatattttggtacatatatagtccagtgactctacgagcaactcaatttactactagaaaaaagatacccagtgttcttctcctttttatttaaatattttagtagctttcattttctttacaaccttacaagcaaaatgtttgatcttgatcatggtttagaaattggccgcctcttcgaaatacaaggtaaattaaccaaacattgacctactatatatgcttgcgtatgtcatatgtagatatactcattacttgaagaaatgcttgacggacatagtctacaggtattatatgcattattggttaggtactaaaaaaatgcacactgattttacttgattttagttttcccatacggccagtaatataaggtctcataggagttgttaaatattcaatcgttttgcccaaatggttcaattgagaagaacttaaagttagctattgcaggtagcctaggccaacagaaagtctgaagttgttatctccttattgtttgcagagatcacatcgcaaccaacttgagttgtatgttacctttagcttgatttggtcctgaaattgttctcacaatttaggaagcatttttactcagtgtatgcaccttaattttcttctagactactatgaagtgatgtgttcatagttgttttcttattaatcttaatatgtaaatttgctgagatgtccttcaaatatgatgacttcaaatacattgtgcatcttttattctctcagatttatattattatcccccacaatgatggcttcaaattaactgtgcaccttttactgatgttgatatatagttgtgattggcagatactctagccaacaatgagtctatcatgtgcttatgttgtatcacctctacaatttccaaaaggaaaccctccttagacacccaaagattttgagcaaatggatattttcatcagcaagccttatgtccacattcacctctttcatttggatagtagcccaagctaaaggagttaaaccaatcaactaaatgaactgcttgtgtattttaggatcatagccatcaaccttgatttctattttattttgttaatggataatttagtacatactgtaaaacatatgcaatatgagttacgtgctccgctgttgtaaaacatgtccacctgttcatgttctatttaattcttctgattaaaggttatatctaatgcccgcgcaacgcgtggggggggggggcacggctagtctggtattaaactcgttcccctcgtcccctctgccctccccactccgcgccgcggcaggcggccgcgcgcctggatccccctctccgccgcgcgaatcccttcctcttgtccgtcgcgtcgagcccaattcggcgcgccacctctcctccctccgccgccggctcagtcactctcgccataagaatcccggaaccaccgccgccgcataacctcttagccgccccaaggccgggtgttcgccggcacgccggtccaaggaaagccgtaggaatctaaccatgtcctcaacacagtccttcaagagtggcgccactcgcagcttcacaactactatgcggagaggggccaatggcgcccccctctgcttctccgggagcagggaaggaaagcggcgcgccctcagtttacccaatggcagccaaggaagaagcttgcgcttgcgcttgtgttgtgctcctcccgagtccaagtggtggacgacgccactgactcctgacgatctaatcgagccgacgggacatggccaggaggaactggaggctatatggaacgccctggtcgaagaacctctccggcccatcctgactgcctttcaggaaattaaggccactaatggcaacgtcttccgctgtcgctgcttccacgcgggcataacgtcaggtatgcatcttgcgtccctcagaaaagaaaaaaaaaactactgtgcatgtatatagcagttactgaacatgtcatgtatctgtgcaggtttattagttctcgtgattcgtatttgtcagttccacaaactggcgcctggcctttgcgtggattttgttctcggatatgtatgctacaggatgagtgttttagcagcggagctgaaaagaaatgggaaagcaaacaacatttgtgctaggatacagtttggtgagtccgaaattgtttctacacattagtgttcatagcaccaaacaatctgaaacgcgatactaactgtgaccataaattatgaactagcatccatctgtttattgggttatgggtacatggcaatgcacgtttgtattagtcaaagcgaatttactagtttagctttaactgatgaggcaaaggcaaacctttcagtgctgtcctactttgttttgagttttccatatactgagtttattttttgctggctacatgttttagtatcgcaaacagctattcgaacacactcatcttacatagttttctttgaaatgcagttattatgcttttgttgttctgggctaacaatcctattaaggtacttttttttttgctgaaaaagaagtacgcctaggctccattctttcgcatgagctcttttgatggattctttcaataattttactaaatgatccttccccccttctaataggactcttgcttctacttcacacagttgatctggtaagttcttccaatgtttcatgcatggttaacttttccttatcattatttgcgacagaaatccttttacgcatgatttatctgcattctgtaagtggaaaccattacatagtttttgcgcattgtggaaggaacttcattatctagtttgatatgttaaaaatatctagttttatacgatatttcttatttaggattgaagctctcagatacctgacacatttgtcaagttgctttagtagttgaaagttccaacaacaatgttaatgtcattttatatatattcctcatatggatctgaggattttgggagggattttacagtaaatgaactaattctggtcaaaatcctgtgttccaacggagcccttaggttatgcatcaatttatagcactctcatgttgattcgtcccttaatctaagaaaagaaaaaaaatcatcaaaggatggtagtatgcactgaaaatcactagggcatgttcggttaatccccagggagggattagaggagatatattccacacctattgtggtatgaaattattccccctcaatcccctccaaaacaaacaaggcctaattgtgtaggttggaagaacctaagattcattaaacctttggatataaaaatgggcgtaaattgtcattaaaatatttgtagcatagattatgttgacatctattatcttacaaaatcttgactggaaacgtcatttgtataggaaacaaaaggaaaataagtgaaatagtttaggggagtactgtttacccttctacttagaaaaataacataggaattaggaagtccatagttctctaatgacgcgtccgagagaaaaatagctctctattgactcacattgctttagaaattggaacatgagtaaaaacattatgtggcaagtagattgcataaaacaattgaaggcagtctgcctgcccactgcctcttatgtaagtgttcagtggctagttttcacagaattgcatgaagacctcttcgttaagcttcaaaatctgaaatgatatgtatgaatttcacttgtgtagctttggaagccagaacatgattaattcagtctaatataatgttcttattatttttttatgctgaaaagacccttgcacacattcttttacacttttattcttctcttcgatagcctttgctaatatatttgtgtatagctcgtgtggtgtgcacacgtcttctcatcttattttggcaataccgtgctatagcctataggctcaaactgtcccattttgtgaatcaaatccctatactattagattgttgatttgttgctttaacttttgagcctaaaactaactcttgtcatgtgagattaccaccaggtcaccaacatgtaaaggcgttgttaaaattgatggtctaattaaatagatgggaagtcattttctttaaaatttgtacagttttcaaggtttgctgtacaggaactcttggaaatacataaccaacataaaatcacagaactctgtatcaaaagtagccatttgtgtggaccaagctggctacaacttacagtatccagctagaaggcaaaacttgaatacaagaaggaacctttaccagatattaacatagttgttaacaaacacttcaaacccaaagtactccctccgtcccacaatataagggattttgagtttttgtttgcaccgtttggccgctcgtcttattcaattttttttttgcaaatataaaaaataaaaagttgtgcttaaagtactgtagataataaagtaagtcacaaataaaataaataataatttcaaatttttttgaataagacgagtgattaaacgttacaagcaaaaactcaaaatcccttatattatgggacggagggagtatatgacaatagtgaaacagggttaccacatatgtctccaaagttttcgatgctctccaaaattactgtggcatctgtgttccaatggatcagctatagcacaaggaaatgggtaagagctgaatatggtggcaaatcttgcgcaaaataatttcaacacgccgtttgttactagcaatggcacaaagatgaacatttttagggttccaataaaaggatcagtagtgcacgtgcttaattgaataaatttgatttttgctttctgttgtatactaatttttgctttggaacatttggtaccatgatttgtttatacgtttaaaacaattatctgttgatacaggtactttgcactccatgtgtattcctgcgctgtgttctacgaatacattggtgtaaagcatcccgcacgctacctggaagcaatgttttatacaatactaacaaccaacggtggcctgatgaaagtacttaagttcatgtttttgggacaagaatgagaaacattttccttgtctggtgatatagaattagggggatattataagttcgatgtataaatcaaattcaccatggggattgccagatgtgatctacttaatgaaaatgggattttataacgttacatgttccttcaataattcattttagcatgaccaatttgattatatgatcgtgatttcgtgagttcgtgaccagggataaaaataccaggccgccctggagccgctggctggcattctgatactggccagaataatttaaatttcaaatttgaaactgtataagtacatataaaatatttgaaaattgcgattgctatcaggtaatagactattgcagtactattttcttgattaatagtttaggtacgaacttttattcgctaaggaccggtagctgtttgcataggaacatgtacttgtttgaaacgggctcgtgaaaactcaagcagctgatccatcctatgactgcggtatttgatagtaggatgtttatgatctatctgatagtacctagtactagtaaacaatctactgtcctcgccttgccttttgtactgtaagttagatacaatgaaattccattttcggtaagcatgtacaaactggatgttactaatgttagttaaacttgcaataagcagaaaaaaaggtataaggcaagcaataaaatattctcttaaaaaaagaaggcagcgatagagaatgatggatttaagacggtatttctcccggagctgtttttaggtagaaaagttattaaatcaggttttgtcgactcaattaaggttcagtttgtctttaccctttatcaatgtcgttcattctttgtcactctttcaaatgccatgctttatactttaaacatcagcactatatacgtttccacaaagatgtgaggaaatggaaagattttaataagcaaaggcagaacacaaataaagtactaaaaaaattgtatatgaaccgtcacaaaaccgaagcaggatacatgcttcaatgtcgtcaaaactagttagaacacttatatgtatgataccgatatatatcttgcatggtggcaagcatctcttctaaactatgcaggaagatcagtcctggtgaactcagtccttgactcgctcccgacttacgccatggctgctttcccccttccaaaaggcacaatcgaagcgattgacaggcgtcgaagaagtttcctgtggactggagaagagtcctaccatggttctaaatgcctcatagcctgggatcaagtctgtcgatctaagaagcaaggaggcctaggcataaagcacttgcagacacaaaacaccgccctcctcgtaaaaatgctacacaggcttttcacccagccctccccctgggcatcctggatctcgaaagaacatcaaaactacccacttggatcaattgacctcggcccgcactggcgatccctgatcgccttactgcctcttctacgcaaacatacaaagatgttaccaggtgatggccggcatataaacttctggcatgatgtttggctggatggacagttatccgctaaattccaagctctttatacccacactgtcaaactaaactgtttgctcagctcagtccttcatgaagatttcagatgcttctttgtccccagaatcactcctactgcccaacagcaaatgatgcaacttcagtacttgctgcaaaatgtcaccctctccactgagcctgatgaaatagtgtgcaatctcaagacaaagaatggtctcatctcctcctcggagctctaccggtctgaaatggcaacatttgaaacctggccgccttggtctgcaatttggagaagtgcagcccccccaagagtaaaattttttgcttggctgatgtccaagaatagattgccaaccagagttaacctacataagaagacaatcctccctactcctacatgtgaactatgcaatgccaacctagaagacacatatcatattttcttaagatgccccatggcagcagccttctggaatatgattcaaatcatccctgagataagctcgctatcagatctccacaacctggaactctcagggcccctaccgacatttctgagttctaccttttttctcctatgttgctggcggctttggaaccatcgcaatgaagtcgtctttcagaaccttccaccttccatcagtcggctgataaattcatgcctacaagatgcaaaactatgggctcaccggttcaatccttcgcagaagtccgtcctgccgctttggacctccattctctcatcccctcttacactgttgtaattgtgttcttaatctgttaccttcctagtctgttgcttctctcctactttcttctgttgtcgtttgttgtacagttatctttttaaatttaattcaggtggggactccccccccctgttgattcagttcaaaaaaaatttgtcgtattaaaccaaattcacttctcaagtgacaagtgtcaacaataggcgaacaatgaatgtggattcgtgggatggttagagttgtcagtatcatggtcagtgtctgatatcagggacgttaggtctatcgagtcttgagccatttgtcgatctactaatcgagtgctcaatacaaacctgtaaaacataaaactgtattagacaaatacgaaaaacagtattagacaaacaaagggcaaaatagcatgtttggtccctaaaaattatgagtttagtccttgaggttccaatatacccatccaagtccctcaatgtttcgttttcgttcaaaagtgtcataagagcaaccaaatacacggtatggccaatcatacttacctcttgacaagatgctacgttaggtcatcgaaatttgagccatatatcagtctactaatcgaatcctcaatgcaagcctgtaaaatataaaactgtattagacaaataaagggcaaaatagcctgtttggtccctgaaaattatgagtttagtccttgaggttccaatgtgcccatccaagtccctcaatatttcgttttcgttcaaaagtgtcatcaaagcaaccaaatatggtatggccaatcatacttaccacttgataacatgttgtgttgtattcagtcctgggtgacatcagacttctcagtttcactctcaggtatcttgtcttgagcttcatcatttttagcactgtaaaatagacaatgcacgggtatcattgtatgactgtcttatcccgtttcctaaaaccaaaataagttctgcaactatcaatccatatccatacctctggttactttcattcttcaatttattttccttgtcaatttccacagcagctgtttttaccacttgatagaagaaactcagcaattctccgacctacttggtggtcttcagagagtcatagagttttttgccaaccatgcaaacgatggtaataaagaaagctttaaacccagatggtttttcatccgaattactagcttcacgccatactttccagaaacagttaaggctcaggataatcccaatagcgatatagctgtacacagtatagattgcctctttctttccacttgtatcaatcataaactcaaagatagagaccttcattttctcccagcaatcagacaaagacagccatactcgcgggattttcatcgacccattgactttcttcttgtcgtcttcagtatcatcatcctgtttctcagtaagcttaatctcagaagtatcagcattgagctttgcaaacataactccagtactaggtaccttgcagtatgaaccatatttttataaggaaagatcatcatcacaactatattcacaggatatatctttgattgcaattacaattaagaggactaacaattacattcacgggctgagaggattaccaatatatcacccgacaattttttttcattaaaatcacacggatgtaactacaatactaatgtactgtaattacaatgtaactagcatgtaagtcacatcccatataataaacacctaccactgagtgagaaaggtatgtgtgcgcgatcgtgatggtcgtaggatccccgcagcgacacaattaatgtttgtagtttcttcaatctcttaacctagccgcatcgacgcgtaatgcgtgtactcatcaattctatgccaagctagatgttgctggcctcatgcgtgcgtgggaaggaaacgtgcaatccttttccagcgttcgaaaaaaaagagagaaggaaacgcatcacaaccgctaattaaatcatacaaagactaatccaagggaagcaaatccgagtgatttcgggtcaaaaatgtgtcgccagatgttcaaaatcgatatggaatcataccatcgggttgttgcgggaagagtattgggtcgtagtagcagtcttggggaactaccgcgatcggagttgggggtggagaaaaccctaccaaaaccacacaagtgcacacaagcagtaacgagatgagagcaaaaaacaacaaagcagtaacgagataagagcaagtaagacgagatgtgagccgagaaaccatggaaaaaatagtagcggagccgtcccagttgggcggccgctggccgccggctcatcacggccggcgccgccgccatcgcgatgctgacggcatccatggagaagttggggggaggggattcgagcgatttggagaggcgaggagagagaaacggcgatgctgcgtcgccgcctgctcctccgctctgcccccctccccgccttcttcttcctcccgagtcccgacaccgctatctcgcaccccgcccttctcgcgccggtgcgcttgcgggctatacgtgggacgggacgggatggtgttcattccgacccaataaaacggcccatttaggcctgcacctttccccacgatatggaaaacaaaaaattccaccggtttacaccgatctttaaacgaaattttgttgaaggaatggaaaccaaaaaattcatccggtttacttcgattttttttcaacgactttctgttgaaccaaatacttcgttggggatacctttgtttgttcaaactgaaattttgagaagattggagcctcacaccgttacaaaacggaggtagtagtatcacaattcacaagccgcgtatcggttcctctgtttaccacgttacagcacatgacacatccgaatattggatcacgagaccacaaagcaaaacttgcaggtcagagctaaactaattcaagcttgtgcctcagctgatcacccggtcatgtccacttcgccactctgacctcgccggacgcatctccggtgaagacgacgccgcgcgacctgatggatatcgtcttgacctcgtcgtagcagagaatatcccctctcttcttcagcgacgggagatcgtggacacggacaacgccgtcgccgcgagagaaaagaagcacgggcttctcgtcggcgtcgtacgttccgtccatggaaacgacccgttcgtctcgttcgtcttccatcgtccgcggcacggctgaggaggggcggcgggaggaaggggaaggcgctgcaccgccgccatcgtcgtggttgggagagtggcggatcggcaattgatctcacaagagatggccagatgggccgtccgcttatatcggtcgaacgggccagtccgactcggactcgtttagcgggctgcaccgccatagactacccaagccactcaaatacgattttctgactgaattgatcgggattgaatttcaaaatatccataatatgacacattgcacatctaaatacccagatggataaggttcatggcatgcttcatacagcacagatactgtagcatcgtgtatcatcaaccctgataattaacgaactatgacatttttccaatgtacaagttctatcgcaggaaaaaaaaagaagaaaatatcgacagatacggcatggatgaggatttgaggatggtacagtgactaccttcctgacatggcaggatacacataccaatcaatgctcccaggtcgtcatggatctatcaactattgatgaaatgattcttcacaaatcttgctagacatcaagcaagcccaaacatacgaaatagaaagatagaggcagatggcaacaagccaatacaaaacaaaagggtggtgatggatggtttgccgatgtttcccgcataccactacacagttccaatgactacagatattcagcctgacagtaactcattttaccaatttcaactaaggattgccatacgtcaattaattgctagtatgtgtgctggcctcaacttgctcttgaattaacagtttccggacttcagtgccttcatcagccatctcagcagggacctggccataagtattctccttcttggcacatgccccagctttaagcaagagatccacaatacccagatgttcccctctggcagcatgatggagtggctgcacggagtaattgcagaaattatacatcatgctgatagcatttagctgaaaaaatggttcatgtaatacttaaagctcaagaaactttacagtgtcgccttcagaatcaacagtgttgagcattcttgttacgcagccatcaatgttcgcagcaaaattcaaaatgtactggactatatcactaaagcctacatgaaaagtgtttattagattacacatacaaactgccaacaaaagggataaaaatagccagagcgcaatgcataataaacatccatacctccagcacaagcatcatgaagaggaattgctccttcttcatctttgcattccaagctagcttgacgttccaacagtagctgataagataaccacagttaggatacaactaatagcagagcaaaaataattcaagataacaacattaacctgaacacaaggtagatggccatataagcatgctatgtgaagcagagtatcaccatcttctattggatcatcaatgttgccagaataattatctgcatacacatatcaataggattttaacgaaagatctgcatctacaacaatcatctgtgtacaaatgcttttgctgatagcagcttccacttgcaagtaattgtccaatgagccaacagaaaaaaaaaagtgaggtaccttaagaatggaatcatttttgctatgaaatttagaaaaacgaaatagatttgccacaacacactgagatggttagcatggtgaaagcatcacacatatgtaatcattacaggattgcagcaatgtgttaagaatgccataaggacatgacttattaaagccctcactagaaaagaatggaaaatacaaagcattggcaacagtttttgaactcaattctacccaatcaatagcaaagtgcttcgtttcagtgcagcttctgtgaaaattaatgggggaaaactactactcttcaacttgataagtttcaaacacaaacagatgaatcaaccaggacagcctatgtatgcacggaagttcactgttccgaatatacaactgaagaatagagaatacatcatcagaaaaaatcaaggtaaccacaaattggtgttgaaagtgaaacaaagatttaaaaccatccaatgaaggttaataggaacatagcatgcaggtaaaaaaggaacaagataacagattcacaaactagtgttgtcccttcaaattacatgaattgcccaggacaaaatttcatgggttgggcaaagaagaaattggcattgttgtggattttcaaaagggattatgttctgctattttcaaacctgtttttttactataataagaaaagatttatgtgactaacgttatcccatcacttcctcggcacaacacgccaagctaactttacatcaaatgcagataactagacacacaacagttacaaatatcacaaaaagtgcatggtcaggtgctacttttagattcaatcaccagtttaccacgttttccaacaaaggggtactatagatttcaactaaaaaaagatataattagccttgttttttatatttcaaaagcatgtctccatctagtctagtccatatgcagactcgtattaaaataccaagtgcctgcacacagagttgtactaaaattcaagctgcttctatgtaatagtggcaatcaatttttcaagccgatactgtttttgcatcacatagggcctctgcagaaacgactcaaacccataggccagaaacatccagtacaaacttcagactaccacagttcaggttgaactactacaggagctgatccacaaacacggaagggcaaatctagaattgcgctgcataggtaaggaccaacaccaacctacccaacatgcgtacccccaatccaatcgaacgatcctacataataaccctagaaaaactcgaggattgggagagagtgcacaggatttaagcctcggtaccgagcgcggcgcggagggcagcgacgttgccggactgggcggcgtcggcgaggcggaagagttcgtcaggcagttgcgcctcctcgtcgtcggagggggccatgtactcctcgccgatcccgtcgtcgtcgacgaggtcgtcgccgacgaggtcgtcgcggcggccggggactgccatctgcggcgaggaggctctccggggttaggggtttgggctcgcggcgtcgggacggcggatgaagatagtgacggcggggttgagcaagtgggggaaaacctagctggcggctgaactacttgtagtatctcgaaacgttggatggaaaatggacgttcagatcgtatggtttttctcggtgacagctaggctcaattattagcaacatttttcacaatagtaatcatttaaacacaacttttttagttgctttttatttgaacacaataaacacaaaccttaaaaataaagaaaacggttatcaaaactgtagaaaaatatggagaaatttttataagatatgtttgaatgcaacatctaaagtcaataactcccctaaccgtacaaattttctccttttttggaattttttttcagctcctcggggaaggataagcgtggttgactatttttgcaaaaagctcatcgtttttgtacaaaatattacacagatccttgaatcgactgacagcccatcatattttatccggaaacccccttgtcttctaatgaaatacaatgtgaagaagagaaaattccgattctaggggtagcgctctaaacatgaaaagtatagggtttttctgcaaaacatccatcccctacccccaatctccaaaccctcccggcctcccctccctcgtaaatataatagccatataaattttacataaaatcatatgacatattaaaaaaagtactccctctgtgccgtaaaaaacgaatctacgtacagatttgtaggactagaatatgtcacatcttatactaggttgtttttttatggtacgaagggagtgcctcaaaaccaaaggaggaacttggtatagaaaatataaaaatataaatgctaaaaaataacaattttacgatcgtgtcactatatcttgcttcgtcaagattaaagcaaagattaaaaatgagccactgcttcgtttgataatatcatgatacagaaacagtgagacaacacaacaaggattaaaaaaaaaccagtgcagaccgtgtggtggtgagagtaacaacattactatatacagttcaatggaaaacgacacatccattccatggtctttttagttgcaaattgcaggtcggccttacaagattaaagaaaaccatggcacatgacgcacttccaatacatcgcaaagaacacaagaaaattgctccacatcccatgaactgcaccatcgagctagctagctgatggttacctgcaactgcaagacaccctaccctgcaactcgcagcacttgtttaccaagcatcggcaccaactcgaacctgaatacacgcctcttcatctcttcttctcattttatttgatccggtcggtcatactgagatgcgtcaggtagacgatcaaacgcgatgagaaggtgaaattcgaggcaggcagaggattgctttcaggctgcccaatctgtatagaactgcattaacaaatggtacgatcattctagttgctcagatactcggatagcatgcctcaattctcaggctgaagattctgccagacggtacattctgctgattcttgattagtttagtttgcaggtcaaatggctttgggacatgttaagttgaagctgctttcactagtgtttttttttttggggagcaaggttggagctgcttttacgaaagacgcgcacttccggttcagagaagcaacagttgcttctctcgacaggaaaccatgcagtagaaataccaggttctgttttggccaagaaaacccgagaaggtatctcgtgtacggtgtaatgccagagagctcgacgggaacagaggatggcctcatggccgacatcatgtaccaaggtgtacgagatcattcaggtcggaacaacgcgttgcataaggataatccggtcgtcagcaaacaatgcattcaagcaggcacaggaacttgacatacagtaacgatccagcgattaatgaccagctttacttttccgcattttgaaaggcatcgacgagcagatttatgaccaaccccaagtaggggtactccgtatctgccaacaacttcggacaacaatactttcaaccatgattacactgataaaattacagcacgacactcacttcattcagttttcgcgctgcaaggaggaggcgagcgcaacatcaagcatcatcgaccacaggacggccaaagtcggcagacgagatgacggcccgaacatgtcaaaggtttgggggaggatgggatgggcagccgcacgcgggtgggtgacgcgcggcccgcccgactactttatttactgcgtcacataaagaccaagcgccaccgaatgctacgcgaccccctctccccctcgtttttctcctcttctttaaaccgcgccgcgccgcgcctacccaaatatataaccgtgggtgcagccgtgcgccgagccgtgcgtgcagcaggcgcaggccgtgctcgtgctcgctcgctcgggcagtcggtctccctccgcgaggagagaggagacccttggcaagcgtggaggacgactcggtgccggccgagtgcggctgctgctgctgcggctgtctcctgccgtggccgcgaaatcatcgggttggccggtggtcggcgcacgcaggtactacgtgggacggtgccgtgtggctcgtccgtgcggctctgtttttttttctctctctcgggtttggcgttaagtacggtgagaggcagctgcttcgcgtcttggtttcttgttctaccttgcgttttgtttggtgtctcgtcgtcggtctggtctgtggtggccggcggcgagatggccgagctgattcagaggaggtgaaaaacctgagaagagatgcagagcagagcaagaagttttgagttgatttgcttcttcatttttggtctctcttcaggtgctaagagctacaatacctgagaattcagttagtggatcatcagttcgaggaaagctgcgagaaatggagatggacttggcagtcgagcagtacgggtaagcaccattcatcatgtctccgttcctgtggatgcagtggatcttttttactagcaagtcgttactgatcactcgtttgtttctcctcctttttttcctcttccatatgcaagatgcgtgcattacaggaggaaatgcaagataagggcgccctgctgcggcgagatcttcgattgcaggcactgccacaacgaagcgaaggtatcaccgttttttccttgtctcagtattacatgctttgaattgtctctggctaggagaaaaaaaccttattgttctgcttactttgttacaggactcgttggaggtcagcatcagcgaccggcacgagatccctcgccatgaaatcaagctggtcggtgtccctgtccagttattttggctgccctttccagcgtatcactatcgctgttactttatcggatattttgctgcatttgatgctaactgtcgtgtcggacatgatattagtaatttgcgctgcccaatattcttggaaatgattgattactgctgcttcagttccatcctgaatttcttttccttttctactgtacgcttatccactactactgtatactccctccgtctcaaaatataagcatttttttagatttcgacacatttttcgagatattattatgatcaacaatatgtataaagataaaatattttaaataaaaatagttgtatattatgatagtttgattaatgataaactattagcatcaattttacatgattgattttttttgtcattaatagtcaaaattagaaatgtttgactttgcaattttctaaaattgtttatattttaggacaaggagagagtagatacttagccagattctgttgatttttttggctacttaatgtgtccgtgcagcagtataggtgcgtcctccatattaagtactctctccgtcccagaatatagcaacctagcatgggatgagacctatcctaagaccatgtaagagaatagtcaagtgggagaaactattgtaggcatggttcaccgttagtcaagaactcaggatgatttgaagcacagcatagttgcaaaagaatagattgtaccatcaactacacactcctattattgatggctgactataactggtgtttcagaagttactcaaagactgaatgaactataactaacagtgcaagttcatatcctaaagattgaattggttgcatgtccgatctagatcattatctgaaaatgttcatactagatcattatctaaaaaaaaaaaatatttcactacgtgcccatagaatctagttttaaactcagcgtaaaaaaagtcaccaggtcacaaataactgcacagattaagtagagaagacagctggagtaaaaccaatagccgttatcaaatttcagaatctgcgactgcttgtatggttgaaacgggcaaagtctgttcttttgtggatatggatacaagtcactatctcccctttcgccacttttggttgtttaatcataatgagcctcctccaccaatataatgaccttttttttgagataccaccaaaccatatagtgatcttattgagactgttctaccttcctcatcacaggttatctgctctctctgcaacaaagaacaggatgtaagttgccaataactagtaagaatagtcattatctaaaaaaaaaactagtaagaatagtgtttatcaggtgtcatcagatttggctgttcccatcacataaaattcgtccgccttttgatttgtaggtacaacaggattgctccaattgtggggcatgcttgggtaaatatttctgcgcaaaatgcaacttttatgatgacgatgtaagcacataaagaacatttgaaccttgtgctgttaatgaaactaaatagcattttgattatattttttgggtggtatttctgttcttttctctgacttgcgtggctctcgctcttgttccaggtatcaaagaaccaatttcactgcgatggatgtggcatatgcaggcaagttgtgctaaatatgcattcctgtgacggagtaatgaaatatgagccctttttgataaatctcaccatcacattttacagaactggtggtgcagagaacttctttcactgtgacaaatgcggtatgtttagggtcgagtgatttcatcaatttcagattttggtattagtaaatatttgcattgacaaatattgtggttatcaggatgctgctacagctatgtgctgaaggattcccatcattgtgtggaaagagcaatgcaccataactgccctgtatgcttcgaggtaaatatttgttgtcagagaaaccatggactctgaaattttctgtattctactaaaataaattcccttatttgtttctgtgctagtatctatttgactcaacaaaagacatcagtgcactgcactgcggacacacgatccatctggaatgcctatacgagatgagatcccatcaacagtaagtaatcacagataagacttacaccatggcctctcccaactgattgctgactatggtgtcaatctgtgacatttcgccagattctcttgcccggtctgcctgaggtctgcttgtgacatgtcccatgcatggcaaaagcttgatcaagaggtgcattttccttctcccattgcacagcttatccattgacactgaccatgtacatatacatacatacatacatgcatagaacaccatccaaataactcttcactcaggttgcagcatcgccgatgccagtgatctatcagaagaaaatggtatgtaaattcagttacttgtgttcttcagtccaaccaggtaactatacgctgaacaaaagtttttgtggtttttttggctctgtcagatatggatcctatgcaacgactgtgggacgacatcgaacgtgcaattccacatattgggacacaagtgccccggatgcagctcttacaacacccggcagacaagagccgcccctgctgccgcgtgctccagagtctgaattctgaagaacagtgagatgagagctagtctgaactccgaagaacagcgagagatttgcactgctctctgcagtctgaaatgcccaataaaaagatttgcagcctgtgattagtctcaaagcccatcaaaacgcaaacaaccgtttgttctgaaatttgggctcgtccatggtttgttccccctagtaggccggtctggtgctaatctggcccagcgttgtgctttaggcggatttcgactttgcttgcctgctgggccttggccgcaagcgccagtcaggactctgcatcgagatgatttttatcattaccgtgatttttatcgcgttgtgctttcgccggtgaggtatttctcgcaaagaaaaaggaactaacgaaatgtgctcgtcgttcattggcatgccggtgcttacgagattgaaataaagaagtagcggtatgatcatcaagcctcgtgtgcgttgtccactttacaaagcatccttcctgtgacactgatcaccatcatcaccagttcaccaccctgtgaccctaaagaagacgtcgacgttgtttgttgcaaataaccaatcgaaggcaatcgtggcatgtttgttaagtttttttatgaacattttaatttttttttacaagtcatcataaacttgactatattcatcatcggtcatcacttaggatgcatcctaattatacccttgaattttaggaaaacatacagcacgaaggcagaagggagtggctcgatcttgttttgccaatgaggttgacatgcaactgaaagatataattctagccacactcttggagccagactaggaccaatcgatcgtgcccaaatcagttcctgaggcgagcatcgcgacgtgatagcaaacggctaaaaaagcgttacatccaagcgctccagttctcgagcacacgcctccgtcctcgctcgcctgcgcgaacgcgacaccgcccccggtcgccaccacgtccaacacaacacgacgcggcccccgcgagaagtggctgagcgagcgggagcgcgccgcacggcacatgtctgacgtctcccccctcccacgcgcgccgatcccccgcaccgcgcctggaaaaacgttacacgtgcgcggctcgcaacgctcgatttctccgaacatcccagtgcccccaccacgcagccgcgtatgctgcgcttccgtctcggcgtctcgcactctcgctgctcgctgacggccgcggctgcaccgcgcacgcacgcacccgtgggccgtggcctcgcgccgattccacaatccacaccactactcccctcgcgcgcggtggcgtgcgccccaacgccacgacgacgcgtgccgcgcgggaagcgagacagcgcggtgcggcgcggagacacctggccaaagcggcgtccgcgcgggcgcatccgggcctcggacccacacgcagcccccgtggccgtcgcgtcgcgtcgcgtcgagtcgagtcgtcaaaccgtaactgatgaaagtagaccacccgacgcatcatctatcgtcgttccgtttcgctttctgacttccgcctttcctcctcgcatcgaagagcctcgctgcctgctttattcccactcctcccacctctctctctctcctccacaccacgcagacgcgcaccaacccgccggcattcgcgtccggatgctttgctttgcccgccgcgattcgatccacgcctgagcgagcgagcggggcgagcaacgcgcccttccttcccttgccatggcctcttcaccggcgagcagctacgactgctccttcaagatcctgctcatcggggactcggccgtcggcaagagcagtctgctcgtcagcttcgtctccgcctcccacatcgacgacgaaatcgctcccaccataggtgcgtacggatgccttccccccgtcctctctggatctcgttgattcctgcctcctcctcctgtgctcaatatgtccgcttccttgccttgtcccgatcagggaacaagccgacgccggcaattaatttttgtctctattatatactgtattagtttcctgttaatagagacgtaaaatatgtgcgtactcctacctttgttgaaagatgcgatgacgatggtacaattctcggttcggtgtagagggatcaccaaacactggagtaaccaagctgtggacatctctgtggtactgttgtttcacgcaccttgtagcccgtagtacactactactactgcttactgattgttttgcgatctgtctatgtattgatgatctaattgagagtgaccttgcttgcgacaagcctaattccaagggacacgtttggatttgttacgtcgtctaggtgtgaaaccgtcaactaagcagtagcacatatcatgcatgtctgctcctttgtgtgaagttagagaatcagtaaaaaagaagttatcagcggaattagagaatcagtaaaaaagaagtgatcagcggtttacggcaactgaatggatagcactacctcttaattttaacactactacaaaactaactgtgcggaaagcttgatcctgaactctcctcaagatttttatgaattgtaatcgtactaactactatgcatgaattgtcagtagtgaatttgttcaagagtcatgcttgaaaattattcagatctaaattgttaatggggcaaaaccttctatatgtgctcattctggaataataaggtaaaggtttatcacttcagtggcaggaatccagctcatgttcatgtactgtataagtgtgccctctttgttgaactacctataacttcattctatttacttctacgaatttaccttgtttccacattgatttatcaggggttgactttaaaatcaaatttctcactgtcaatgggaagaaactgaagctaacaatatgggacactggtaagttgttttttactccgtacatgtttatttgtgaaaatggtgttctcctgttgatttgtcaatattttttaatgttggaaagcagctgcctttgccttttaccccaaaggcagcttcattgtacccagaaaggggcctatgaaaaaagctgtttccactttccattgcatacgtagaaataagtaatactcctagtacaaagaaaaggctttggtttttctcctgtaaagttcaactgttcttgctgcatgatatttgttggctcaatcctgttcttctgtagcttatgttatttaatgatttcaaaagatttcaattgttcatggacttctttttattgcttgcagctggccaggaaaggtttaggggaatcacaagttcttactacagaggtgcccatggcatcattctaggtaattctattcccaacttatgttcaggaccatcaatatttctaagcatttatcatgcctacagtacatttttataccaatctcactgtcacttagggcatatcaactctgaaagttgctcgtattgcatccatgtatcacattttaggtcacttttatctctgatattgtgtgcatgctccaacgtggtgttgcattgtcagtttgccatcattatttttctgatacaggatctttttaatatagtttaatagtgtgattcctgaacgatctagtgactagaatatcctgccacaaattagttgtatttgctattagacagttgcttcctttccatcaccatggcgcttcattgttttactcagtatttgtgtgctgatatcatgggttttcttttccactgaggtgaaaatttactatgaccatgtatgaacaagtctcaaacaaccctcttttttttatgttgcatctgggaaattgaaaaacttctgttgcaacctaatttgtaggaagaataatatgtttacttgctcttttattctggaaaaaagtgttcctggttaattcatggaagtttaactttctgctgtcttcttctgttagtgtatgatgtcacaaagagagaaagtttcacaaatttggctgatgtatgggccaaggaaatagaattgcattcgacaaataaagagtgcatcaaaatgcttgtcgggaacaaagtggacaaagtaatcattgtttgcctatttaaatcaaattattatttggtggaaccttgttccatttcagctgctgttgatgcttcccatttctaaaatataagtatttattggttcatcgataacatgttatagcactttctgtaacactgtacagtttatagtatcacttcagcaccttatcatagatagcatttggtgtaattacataagtgaggttgacaatttcagagtacagctattatagttggcatgcgggaagaaaataaattttcaatacacatggcattagattgttaccaaacaaaggaagaggttaatgatcgaggccatttttcttataggagttagcacctaagatgaaatggcagtgcatggttctgatatttgataattctacattgtagaatgaggaaaggatggtgacaagggaagaaggtcttgcctttgcccaggaatctggatgtctttttcttgagagcagtgccaaaacaagagaaaatgtggagaaatgctttgaagagcttgcgttaaaggtatacttgcagaaataatatactaagagcaagtttaatagtatagcccactattagctccaattcatctatagtcaatctaatagccaattcatacaatagttgcttactatactattaatatatggtcccacccgtcatacgcacattgcgtcttggagtccatgctgtagctggctacagtctacagatctgtagcccgctgctcttctctctcatcgtttatctcattaaaatatgtttgtagctggctaatagcctgctattgtacctgctctaagcactgtagtcttaacctctgctttgattatttgaactaatggatacatacaggttgacctgtgaacttatgaaaccaactccatgcagtagcattattgaagttaaagctgaacatatctttagtttgtagcgtatttttgttatgacagtgcgcttcagagttcaggccttgcagtcttctggcacataacattatttttctctgtgcaacctgtcatgcatttttttcttcttaatataagactcttgctgtggtgatatagcttcataggtttctttggtcacatgatcatatttttctaaatgctgtgagtcctgcatatgatgtcttgtgccatttgttctgttggttagtgcagcaatcactgcgtattgaagtcattagctatccatttgtgcggtgtcttttgtgcagcctagcagtgggaagcagtttctggaggattaatgtttttttaagtgattatattttctttctcatcctggcatagaacaagttcaacaagccttcaagcgggggctgtcaacaacccacctgaaatcatcagatcatttggcacatatttttagagggctgtgctgttaggttgccttttctttgagctttagattagtgctgcacttattcatgtcttaggaagtcttttttttttttgttttcatcacagtaccatatgtccatctccacaccattgagtgttgtgcagcaagtgtgtcagtatcttgttatgccattttttgtggcaatgcttcttgccttagttcctggtctcctgcagttttctttgcttttatttctccttgagaacctattgttctctttcttatcctgttgtcactcttttgatggcttatgcctaggagtcttgtgtgtttaaatgttccattattaggttgtatggacatattcatttttttccttcatttctcggaaggttcatttatgaaagaattaatcatggagtatgatttcttctgcttattgaatcatactcatcacctgagcatatggaatatgttcctgtcttattggaagcatgttacctgtggtaccaacaaagagcatgcttgcgccagtttagtgactcttgtgttctgtaatttatttctttttaatgtgatgtttgcacatggtggtgcatgtgcaatgtttaatgtgccacatttttaatgtagctctggcacatgagtgcatgaactatatatatccttgaagcgtacaactagcattccttttctaaaaacagatttgtttaaaataagccaaagtttgaattattcatgaatatttttgcatctttcaccaagcgtaggaggaagagtgttgatgtacaactattttcagctcctgctgaagattctgcttttcactaaaaagttatttatatattctaagtagttttaaacaagattaaaggtcatcttagtaccttttgatgtgacaatgttatcttgataaaattgtgtattgtttacttaattgtaatacaatattgtattgtccttattacgacaatgttgtaaatatcttgtggtgtgtcctatttcagattcttgaggtaccaagtctcttggaggaaggttcttcagttgtcaagaggaactctctgaaacagaagcacgagaacaaagcaaaaaatggaggatgctgtcagtagttccggttgctgtatgcgagctcatgatgcttagacctagcatgttcttgtgtactgatgtaaatgatttgtacctaaatgcttgttggtgtagctgatgcgagttaagaaggaaataaccacacgaagtttttggtgcgaacactgggaattgatttgtacaaaagaaaaagttctcccttctaacttccttcaggtagcagtttggtgtgctgaatgtgccaggatcatgtcgactagtcttgttttctggaaatgtacatgtaatgggatcctgacaatttgtcttgcatatggtggaagtatatatctggtgcataattctgaatgatctgtgtacaaaagaaaaggcgtatatcaggagcatatggtggaagtgtcattaacttatcatgcaggtaacaattattatcaacgaagctctgtgacactctgttaaactgaatcagttgaattattccagatctcacagtagttttcagcttggacctacaatgcctgtgtcattgacacatactaatattttgccagattatgtttctgtagcaagaaagctgaaccagatgctcacaaggggtttgcatgtgcatgcgcctgataatttgcttaaactcttttgctctcactctattgtgcgcgcggtgactgcttcctgcgaacactgaggagacagtcatgatgagcatgggctcccagatgaatgcatgtgaatgtgtgatgcatgcagccatggaaaagatgatcccgcatatatccgtgagcggatcagatcttctcatagggataccataaaaaagggcacggttgtacgtacctttcatttgtgcaactaagcagctttcagcggaagaaaaagacagtacaatcatttcacaggaaggggaacaaaactgtactcttagtatttaccagcgtcacaaggaggcatgtgtcattacagtttagtccaaacataggcaaccatgcatacttgcataggcaaaaacattcaggagagagttcagtgttggcaaatgacaagcaaaacgttgtcctcagtcgctaacacggtggccttgtagtggcgccacaattctgctatttttgggctagccattcacgcaagaccgcaagatgacgacgcagctagctaggcagagcaaccaaaccgaagggacaagaaagatccaatctaggtgctaccctcatggcaagccacaagcggtcaagcgcaggagaaaggccatcacgtgtatgtaccggcaaaacgaacagtgacatggtggatgacagtataaaccaccaccacggcaccacatcctccgttacgttctactcctacgtcaggttcagatttcaccgggagaaccaaagccagtgcaggacaccaacccccgggtgtccggagtaggcagcaaacattatggcgacattcttgctttctcggcgcgcagcctcgcacactgatcacctctccccttctccgcgaatggattgagccaaacacgagcgccatgggccacgaccacgctggtttttctcataatttcgtcaggtgcatggcacggccgctcgcacgggctccacctccacccatccatccatccagcggtgcatagccgagtttgggggtacatgtcatgtgacgaagacggtatccgatgaacagtgtgccataacaagcagtagaaagtttgtctggcttgctactactctactaatctatggagtatttcacaggcatttgatgcgagtgagcatcaggcgagccgacaagatcatcgtgcaatcaggtcgagagggatggggcgtacggctccatttctagatatttcagaaacatgacaaaaaacccattaattgtattatcgatagtaactttcagtctttcatgagggaattaatggctgcgagtaccttcactagttgcgtgtagttatctggcaataagttcattagctagcgacatccttctctccactgagaagagacaaggcatgccaataaaattcctatttggaattaccgctgcgattaaacatgtctgaattctacggttctagcacatatgcttacttcatccgtccaaaataaaaaaaattaatctagaagaagatatgatgaccagattgttgtcttaagagaagtggttgagttttttttttttttttggagagagggaagtacgagctaatgcagacaacatgtgaggtccgtgtcacctatctatcgcgaagcatcaaccacgaattaacgtggagacaacggggcttggcactgctggttgcacgtatcgtcaacgaaaagctgaaaaagaggcgatccagtaggttccggaggccaaagcggcggatcgtccaagcaattcttgttcttgccataaacacatgctcttggtttcgttgcgccaactttgtgtagactaatcattcctttgtctcggggtaaggataatttatgttgttgattcttagctatattagctcacaccaaacacattactggggtcctaatcaagactcaagagacaagctaggcgaggacgacggcttgaaaacaagataatgctaagctacagaccatatgattgatgtggtccatgtacactttaatggcttaaaaatatccagagatgaatggtatcagagcatcgttcttctgaagattcgaacgaagtagtagcagtttgcaactttgcactgttagttcagagcattgactgaattacagcagaacagagccaagtgaatgtgaaaaataacacttgcagtaaaacggattcatgcggcaatcacgttaataactggacagtcaacatcaccatactagcttgattgcatcatcaacagaaacgaagatgctacttataaaaaagaaagaaaaaaaaggagaggagaagatagaggaagacaagagaaggagacggtgatgtgtaggcgtcgtctgtctcaagagttagtggtgggccggacgtcagggcgtcaggctggcagggagaggcacggggcctctggacgcattgccagcgacacgcatagggccgttttggatcagtgtcaaaacggtgccctaccaatattttggtagtttaaatagtgtatatggtggttttggtttgaagccaaagcttattctagtttgatattttctatactctactcaaagcttattctaaattggtctccaaccaaatataactctaccctataaaaaaaaaaattagtagtgccaaaacttacctagattttggcactaccaatattttggtagggtattaaaccaaacaaacccatagtcgcccggactttcatcagcccctgcgcctttgttggtagtagtaggtacagtacattccacggtggacaaaaactaaaaactcaacatgatgggatgggagtgatagctacgtacactattgaatagtttctcatggtcttggacttggagtgatttgctctcaacagtagagagttgttggttcaccaattaccaactgtaataactaggactgaccacaagtagaatgacaccgtacgagtagctgcgaaattacgcatcgacatggcaagtatctgtgccaactttgcatcgatgagatcggatcagaaacagtatgccaaaccaaccccacccaacccacgcgagaaccgtggaccacgaccccatttacacgcgccgtcgaccgcatctcatctcatctcaccgttggatcgcgcgcgcgagagagagagacgccttggaacggagccgcgcgccgcgcatgcacatggtgcgcgcgcgcgcgtctcgactccgtcccaatcgatcgatcgatcgcgcgagccgccgtccaggccccgacagccacagcgcggccttatctccactgctcccccactccgacgtggcgcgcgtaccataccattcgtcgttacgcgcggccgcattattgggatgatgcaactctgcaagctacgggccctcgggtcttgaaattaaccgcacggattggattcgagaagattttaaaacttttcaaacaagcaaacgagtcgtacgtagtgcggtactggttgcgaatagcgatcgaatttgactaggaaaaaacgaaggaactcaggcaaatgcatgcacagttttacagaagcaaagcaacgggttcccaaaggtccacacttacagtacgttcaacgtacaactgatccaagcaaatgaaacaggtttgatgatgcactgatgcgagaaactaaacggttggatcggagtcggagacgaggcgatcatggacaagcggcggcggcggcgatgagcttagtagtcggtggtggggagctgctcgtgggtgtgggagatgaagaggacctcgtagatgacgccggcgaggccaccgccgatgagtgggccaacccagtacacccactgggactcccaggaccagctgacgagggccgggccgaaggagacggccgggttcatggaggcgccgtcgaacgcgccgccgacgaggatgttcgcgccgacgatgaagccgatggcgatgggggcgatggtgccgaggctgcccttcttggggtcaacggcggtggcgtacacggtgtagacgaggccgaaggtcatgacgatctccagcaccagggcctcccacacggagacgccggtcaggccgaaggtgccggtggcgagcccgccggtggagaagcggaggaggaagcacgccacggtggagcccaggagctgggcgatccagtagaggaggccgcggaacagggtgatgttgccgccgacgaaggcgccgaaggtcacggccgggttcacgtggccgccggagatgttggcgccgacggacaccgccacgaacagggcgaaggcgtgggccaccgccgccgcgatcagcccggcgggggtcgtcgctccgccgccggtcagcttgcctgcgtacgcgcatgacagttaggtacacgtaagaagaattcagagatcgaaatggtaatttaattttgtggatttgcttatgatttctcgtttgtgttcttcttttggtcatgttactgattgtattactcttttgcttaactaagctagtggattttgctactctgaaaaaaatatatattattttaaccttcagtatttcgttgtaaaataatatgtttgagcaattgctaagctatggagtttggaaacaatttatgctcctaattctaattaaccatattattttgtctgaaaagttttttttttgcttctagttcttggcacaagcacatggtctgtgactgccacatcattgactgaaacagaactactgagatcccttcgtccacgtaatcagtaagggcaaaccggtcatttgggcccaatcatgcaacctaaaagccataccactttttatttcacgaacttttgactttttctcaaaagaaaattttctttcaacttaattatcatagcacggcgtctagtttctctcactcctgcaaggacggagagaaaaaagttttgtatatcttcccaaacttttttctcccccacatgtcttgtgttattttgagggattaattcatgcgttgctaaactagtccacaattaagtcctggactttgtagtatcatcatagtatatggagtggatttgcagtggcagtgacaacacacaaggtggttaaaattaaggtcggcgacttactgaaggccatgccggagccctggccggcgaagacgaagatgagggtggagatgaactcggccaacgccgccttgagtgcacccgggtggtacacctcctggtggctccccacggcgatgttgcggatcggcatcttgcactactcccttctgctgctctctcactcaaactagaagagctcagaaatggagtggtgtgtgtgtggctgcctgtgtggtgcggagacgggacgggagagaggccggtatatatacacccagcgcagcgcatgcacgagagacaccgggtgtggccggtggcgagttggcaacacatggggatattttttttttcttttcttgtttctctcgctttctctttcgagtgagtcacgaatgtgatcgtgtgaggctgtgctcacccctccggatttgccatattacggttatcggtgaagtttctagagatcagtagggtgtggtttgtgattttggaaaattagccgggtacttgtgcgtatagcaagctggtaggtgctggttttggggattaatgaacgacatgatggataaggatatgatagaattgaatacaagctctcagatgaaaatatggaaaaaaaaaattaaaacttgacctgttctgtgtcacagctaatggagctacgtaataaaacactggggatgaaccgtgagtagcactaccgaatgtttattcaggcaggctgctaagctcgaaattaagctagcaccagtgatcaaagtcgacgatttgttgtccagtcctcggcatcatctgtgcttgttttccttgcaacatgctaaggacgtgtatggtctgttgcagtgttgttgaagctttttttttcacgaacgcgcaaaaagattacacgtcaatatattagaagaaaagaatttaatttacacgacgcaatcagctagaccggcttatgctaggggagagagaaaaaacaaaaatagaaaactgaaaaaagaaagtgttgttgaagcaaacactactgaatttttacaatcaagatatggatatctgtaacaaattttgtcgtcagtctcacgcagagctccgttaaacaacacgataacacgatcatcgcttggtattactctccctccggttccatattaattgagatcaaacttttataattttgaccatcaataactttaaaaatatttagtttaaaggaattagaacatcatatatagatttgtctttcaatgcaatgtaataaaagtaaacatgcttttatttatctattatgtaattaaaggaatagaaaaaagagactctatgttcgctctcatggcctagaaattctcacattaatcggagaaaaagaaaaagcagagtctatataaaaatacaatttagaaatagctgaaattcagaattaaaaaataagaaatattagaagagtagactagagtagttattacacattagtagttttgaaaagttattgcaaaatttaaaattatgttgtcattgtaatatattttaataatataatgagaaaacatatatgctattatatgagagaaaatataatgatgctagccgcacaatctgcgtgggccaccatgctagttatatatattataatagaaaaataagatcaaagacatattttatagaccgtgttattatctaaaacgtcaattaaaataaaactggagggagtaagccgttaaacaacacgatcacacgagcgtcacttggtaatcaagctcggattgtgaggggggaggcgacagcaaccggggggcgggcggcttgccagctcagccacgccggccgaggagctgtcagcgagccacgtgtgcgggggaggcaggcctcgtggcccgtgtggattcggaggctgggcgacgtgacgtctcaccacaaatccctcgggattggctgatgggttcttttgtcccggcagcgggaagtgatctgggattggctgcgttgctccggggcggcgaggtagactgattgctgattacggccgtcgcttctacggctagcgtttagggattaacgtgttctccactattctttttttgtctctgccgtgattgataagtgcagggtgatgcttctagcgacttcgtcagaattattttctcaatatttaaccacaaaagtttgatggttatcctcaagaaaaaatcaggggtaacacattcatctagaaatccaaggggtagtatatgtcgtgagaacttttaaggtataatatactactgtaagtatacataatttaacggtgtatactgatttgaattttttagttaattagattgcaatataaaatttgaaagggtaataaattgtgctatcatcacgtgtttcgtcatcaaatgcgctcaggatactcctaccataatgcacgataagatctaggactaagtactctcaattacagtcaatttgaacccaaaattactaaagtgtattttaaattttctatcaaatttctaataagtccttctaaatactgccagtatatattggtagtatatcgtaccgtaaaatttctatatgtcacacgctctcatagtcttgttattttacctgaagtggcaacatcgagatggtattaacgtcattcttggacggtcgaaagaggacacggttaacccatttctccttttgttcttcttgaaatgcaaacccttggcagtagtagcaacattcatccatccatgaccatttggattccactccggagttaacaattcctgaaggagcggctacgcaaattttaattcgaacagtgtcatcaccctcgacaaaaacaatcatccggcccatatatttttaggagtagctatatttatagcgccataattttcacaaaaaatagtcaccatatatttacattgtaagtccctaaattacatatgtaattttagtgtatttacaatgtaagtttcaaaattacatatgtaagtctctaaattatatatgtaagttgaatgtaattacaatgtaagtgcaagacaacgtctatattttgcattgtagattacatatatttatatactatatacatatacatatgagtagaaccatcaaaagcttaaactaatgaagcatgttaagttttaattaatcgtgtaatgacagcagagaaatactaaggacctgagtggactgaacaacatctgacgggtcagaaatttgagtaatcagccataaaatatggcgacatcattttagcaaatccgtatattttttctctccatacgtcggttcgtacgatggtgacacgtcagccactcagagctgctcgtttctcggcgcgccacgtcagatgctgtgctgcacgagagcaccccccccagccaataattgggtgacagctacggctgaaattaccgtcctgcccctcgggttctcgaagaatccactcacactcactacgacgtgatacatgcgccggagaaccaattagtccacactaacctccaggattaggagaaccactaattacacaactattatccgcgtgattatattaagaggagggctcaccctatccacatgatttgtttttcatacagcagctggctccaccatttgcaaaaccttttgttctttaatttcttactatctgcctccgtgttcttgccgtttgcaacccagtcacatgcatgcatcaacatgttactacgagaagagatcgatcgattgatcacgagatatttatccacaataggagagggatgcacggatgacttgatgtaattttagcacatgtagtttggaattttggaactaatacgtgctcgagatctgatccaattcttcctaattactacctccgttgaccattcgttttatttaaaaaattagtacaaatattaaaaaagataaatcatactacttttgataataaaacaagtcatagttaaactaaataataattctaaaatattttaaataaaacgaataatcaaatattaaaaaaagtcaaaacgatcggtaatataggacgaaggtagtagagtttactcctactcagtacatattaagataagatcatgttgtcattaccggtaaactctggcttcgccttgcatgtgatggggcctagcttgacttgcccctggagagaactgtatgatctctgcaatacgatcgaactgtttgcattgcaatgcacatgtgtatgcgagaaaagtacttcttagttatcacctgatccaatcacaaattggtgataaaatgaagtggatggatctaatctaagtcgttgccttgctggatgaggatttcattaattgcgtggatcaatttgttcgcgcgagctttgatctgatagggaaagatatttttgtatatcattaagtgtatttaaaataccttggagaaacttgaatgtgcgacaatttccgcgaattatgagctggctagtgctcttggtcaaatatttggatgtgcttctgagctggagaacttagcttgtttagttaagacataacaattcaaggcaatttggttaggtggcactatcctatacttaagccagactaaattaagcattgtttccataaatatgtcgccatcaattaaagaaaatggagtaggcattgcccttttccctataagaatttataaataagcaatgcatatttttgtacctgttcttaaatgaaaacaaaagtatccataaggcataaaccacaaaatgccatctctttgccacctgcttcttcagaccgggtttcttgccgatcttcttcgccatttttctgatgacaagtagtacttgactaccttttccatctaatacattttttttctggaagggtggccgttttcatttttttttaaaaaaaaaattccgggctacaaataccaagctttgattctttttcccatttttagagaaaacattgagcactgatgattttgccgtttagactttgacgtctcctctctttgatacggcccattcagatcgaagatgagtactccagcacggcccacatatgacacttcctgggcttgctatctccgtgtccatccacgcacttacggggacgcttaatgcgtgactgacggcaggcgcgcgacgcccccagtactactgctactagtagtacactaggaaccagttattccctccatctaattttaatagttatatttctaaatttaaaaaatttaatttagatagtcatatttcaatctaacaacctatactcttaatgactttttcggatttaatacatgactctctattcttccacacaagattggctacatgggcatcgaaaaatgtaaattttaatgaatcgcttgtttacgagatataactattagcatgtttaaatggatgataaatagaattacttatccttggtctgtgtgccaagataaaatatgactataaaaagtaaatggatggagtatttactaccagtattactactagtagtactactacactattactactaatactactatactactactataaacaaatatatatttttgttgtataaaaaatatacacatatacaaactttgtatatgatgtgtataaactttgtatacgatgtgtacaaactatgatgtatacaaactttgtgtactatttgtgcaaactttatatacgtaaatgttaaaaaatcgaaaaaaccaaaaaacacatcacgtgtatacgtatacaagtatacaaacttcatatacatacgcatacaaagtttgtatatatgtatgcaaactttatatacagcgtatacaaagtttttatatatacatatacaaactttgtatacacgtatataaactttgtataacgtataaaaaatatgtatacgtatatgtttaaaaaaataaaaaaatgaaaagaaaaaaccaaaaaaagaaacctaaaatgaaaaccgcaaaaacggaaagaaaaaatgaaacaggaaaaaaaaagagtaaattgaatcgtcagtacacgaacttgtcaggtggatgcaatctagtgcacaaacttgtaaaatgcttgttttggtgcatgaacttgtgtggtgcgtgcggggaagtcaaaaaggacactatatgactaatcctattgatttagggggtgattaggatgctatgtaaacatacatacatacatacatacatacatacatacatacatacatacatatatatatacacacacacatacatacatatatatatatgtatgtatatatgtatatatatgagaaggttgacactagacttacacctattcaataaaatatagaataggatttagtgatagtagaaaaagattaaaaatatcgagcactgatataagggttagaaacatataaaattcatcatttcaatgatgaaggataaagtagagactaaatttataaatattgcatgtcttatacatactcgctacaggtatacacgtcgcatcctaaccaacattaacttcataaaattgacattaccaagttattttggtcatcgttcgtacgaactagacaagttcgtgtactgaaatgagcattttacaagtttatatactaaattgcacccacctaacaagtttgtgtaccaccaatgtaatttactcaaaaaaaaaagaaaaggaaaaaaaaccgcgcgggccccaccctgtgcacgcgctgccgccgcggccctctccgcgcgcgccacgttcctcgccgcgcgggaggacgtgcgtgcggctagtcgcgcattagcagtttcgcttacgcatcggcctcggtggtttgccacatttgttaaggctttcgaagtgggttgggccataatgcttcgtcctctgacctcgtctgcaccggtcggacaagcccaataaatttcagaccgtcagcccatcaccctcgccgtaagcctgtgtaggctcgctctttccctcctccctgccacaatagaatcccagaaattgcccgtttaaaaagcaaaatgtattggtccgttgtaaaggaaaactggagtactagtatctagtttgaattcaa

SEQ ID NO: 80210 - DNA, 19498 bp, Oryza sativa
tgctactggtacgaaaaacatatccatactttctatatagttgatacccacaaacaattattagaagctaaagctcaacatgcaagtataccacatcatcacccactagcaattactattctagcccatttaaaatcctatgcaagcatgccacatattcacccactagcaattattattctagcccatttaaaacccatgcaagcatgacacattatctacaatattacttcctctgtttcataatataagtcattctagcattacccacattcatatagatgttaatgaatctaggtacacatatatgtctagattcattaacatcaatatgaatgtggaaaatgctagaatgacttacattgtgaaacggaggagtagtatattatagagatcaacaagtatgtgtcaaattatcttcctcacattattttctcaatatttcaagtttcatcatttcgataatatttaacatatacccatctataaatcccgcagcaaagcgcgaggtatcacatagtatagttgatgtttgggccaaaactgaactaaactccatattggggcggcagatttaatttgggcccaagaaactgcctaggcttgggtccctgggaatgggctggccagagcaatatcagaacagaacagggtcacctatatatttgcgacaaattttctcttaaaaacttgacatatataattatagtacaatcatgatgtaattacactataacttgcatgtaactttcaaaaatctctccgtaacatgctatttcgatgaaacggaggttgttggaacaaatcctcttacatgtgtgcgcgtagtgacctttttccttcttcacttgcataaatcttgaaactaatataacggtggaaaattatgtgcaagttatagtgtaattacactacttcctccgtttcatattataagactttctagcattgcccacattcaaaaggagggagtacgattgtagtgtaattatatatgtcaaatttttgggagaaaatttgtcgataaatatatagcaaaattggaacaaaaatatgttgaaacacaatatgtatacatgcaacaccttttttttatccgactaattggtatacctccatctcagaataagttcacctatatcaatttccatatacaaaagtgaacttacagagtagacgaatagacgtacacacgcgcgtttaccatgcaccactcgtggacaagtttggcacggaagtcaatgttgtgagaaaactatttcatacttcatcaatcccaaaatgcaaccatttgtatgttaaatactaaggttaagggggtccctctcagtcatcttattggttaaattttaaattttgaaaatttctcagactcatcttctaagcatagtatggatttcattccactttcctatttcttttcttaacaacaacttatctcatcaaatactacctccattctaaaataattgtaattctaggttgtttggcatatattaagatttgaaaagaaaaactatgatatccctcgttaaatggtatatagataaaagtgagagggtggttgagggtaaaacagagagaaatttaaatgagaagtgattggtaagacaattagtactatattgtgacaactattttaagacaaaattgaatcctagaaatacaattattatgggacataggtagtatgtcgcattttcaaagtcattaatcgtcccataccctattttcttgaagcggattgtgtgagtgttgtcagatctatggtggcgcagacggataacaggtcatcttggtgccatgttttcaaggaagcaaaggcggcaatcacactactcccggcgtttcgtaccgagaaaattagaagataatgtaataaagtagctcctgaattagctcaattagcgatgcgtactaaacattgtgttgtgtggcgtatgcaagctcctccttgtatcacagagctgcttgatcatgattgtatccaacctcttgagtgatcaataaagcattttcttcctcgaaaaaaaaacttcatttattcagccttaaaagatcccaccacagtaggggatcggatgaccgattcaccatcaccattactagctaggtttttatatgtatatagtagagaaaccaagtcaatttaaactatagatggccaaatgagccgctcggccaggcacgcccgtgcctaggccgaggtcactcgggccggcacggcccgacttatacatcgggccatgccgtgccgtgccagcccacgggttgcacacacggcccaataatactcgggtcgtgccgggccggcccgaagacataacagtccattatgcttctccaaagaatatgtctatttttcctccctcaactttttgggctgtgtctatatggctggacaataagtctattttgtattcctcttctctttgggtcttgtcttatatggttgattaagtctattttggatccctctactatttttcttcaattgtgctaggccgtgccggcccaccgtgccgagggagtagctcaggcacggcacggctgtcgggccgggccggcacgggcacgaccctagtcaggccgtattgtgcttgggccgggccaaattgccgtgccttgggctgggccgtcgagccgtcgggccatatggccatctataatttgaactcatttttttttaaatgacggtcaaggctcagccatacttggtcaaaattaatccatctggctgcaaactttaactatattttatacatggtacacttgttttattgtatcatccgtaagcaatacaagtaataattgtataaaatccatagctatgagttccaacaatctatatatatatatatatatatcaatcaacgctggtaattgatctcatggcattcattctaattgcatgcattgatcgatcgatcgatcagttgccgtacttggccttgtaatcctgccacagctgctgcacggtcttcccggtgatctgcacgaagtagtcgacattgtacccgtccttcaacttggcattgatgtcggcgacgaaccctggcttgacgctgtcgcagtagtcgaagaacctcgccgtcacggagtagctgtcctcccagctgttcccttgccccggctgcacccagccggcggcgacgtagccggcgcgcagccgcacgaagtcggcgatcccctcgtacacccacgagtgcgccgcgtagtcctgcagcccccactgccacacgtgcgtcgcctcgtggtacagcacgccggtcacctccgtcctcacgtcgccggagctggagctgtagccgccgacgtaccgcgcgctcaggtggatgccgtcgccgctggtgaacgccacgccgtcgatgtcctccacggtcagggtcaccgcgtccaccggcttccggtcgccgccgtcgccgggctgctcgaaggcgtcccagatgaaggacgacgcgtcggcgagcacctgcttcgcgtagtccacgccgacctcccggtcgaaccgctgcccgccggcggtgctcgacgccgtgttcgtcgcatcgaacgtcacggcgccagcggccgtcgcggccgcggccgcggcggccatgagcgccgcgagagtggccatgtggaaaggcttcatttttctttttatgatcttgtattatcgatgtttgttacggaattttgctaaccatggtagggtttatataggttagagaaaaatgtgttttcgaaattcgaggataagtttgattagctaggtgattgtttttttaagtctatagtcaaatcgattgacttggaattagtcaaaattggttatatttcttctgaaatttgatggaaggaagctggcccgtgaagatttgatatggacatctaatattttatttttgtttttattccaatcaaaccaggagttgtttattagtctcagataaaagaagtgcagtgacggcaaaggaaacgcctgaaaataatctggcttttagtatcatgacttctaactcttctggatgcatcaattaatgtatgtttgcagatccgctagcaatttcactatgggtgtgtttagttgggaaaaagaaaatttttgggtgtcatatcagaagtttgaccggatgtcggaaggggttttcggacacgaatgaaaaaactaatttcagaactcgccgggaaaccgcgagacgaatcttttgagcctaattaagccgtcattagcacatgtgggttactatagcacttatggctaatcatggactaattaggctcaaaagattcgtctcgctatttccccataactgtacaattagttttttctttttatttatatttaatactctatgcatgtgtctaaagatttgatgtgatgttttttggaaaaaattttggaaactaaacgggccctctcttctctatctgaacataatataaatatgcgtgtcctaattaatatcaagcatatacatctgaaattatttttgccattgcgtgtcggcattacatttcgtgttggagacggtgcagcttgacttaatttgccaagagattaatttccatgttgccaataattagatacaattcagatcctcttcagtactacgcatgcagcactgcagactaacatgtaggcccgaggatttgtggggcccacatgttagtgagcagtactgcagagaacctcagtggagatgggacatgtgtgaccagccaatttccaccaataatatttcaaatctttcctgttgcaaaaatgaatatgtactctaaaatgagaagtttttttaggacaaactttaaatcctaaaatggcatcgaggaagtagtagcatttaggagtaaccatttatggagtcatgatagattgacaggacagtacttgaagctttgacagtgagcacaaattgattacagatggagtataacaagatcaggcagtagtatttcgttgaattttcagtaaagtttcaggcctgcttagattatagttaaaataaatattattaaattttattaatgctaaaattttagcaatttaacaatattgttaagttttgacaggatttcttatgtatttatcagagtttaataatgaactaaatggatgcatatatttaacaactttacctaaatttggtaagatttattttagctacaatctaaacagtccctcggacatcaaacatggctttatttattgccttattatccacatatctgatactaactacagtactactatagtactatatatatatatggccacctcgccggagctgacgtcacgtcagctagccgccgtacttggccttgtaatcttgccagagctggtcgatggtcttgccggagatctggacgaagaagtcgtcgctgtatccgtccttcatcttgccgttgagctgcgccacgaacccctgcaccaccgccggcgagtcgcagtagtcgaggaacctcgccgtcacgtcgtacccctggtcccaccggtcgccctgcccgggctgcacccagtgcggcggcgcgtagccggcgcgcagtcggacgaagtcggcgatcccctcgatcagcccgccgtcggcgccgccgcggccgtcccactgccacacgtgcgtcgcctcgtggtacagcacgccggtcacctccgccctcacgtcgccggcggcgctgtagccgccgacgtaccgagcgctcaggtggatgccgtcgccgctggtgaacgccacgccgtcgatgtcctccacggtcagggtcaccgcgtccaccggcttccggtcgccgccgtcgccgggctgctcgaaggtgtcccagatgaaggacgacgcgtcggcgagcatctgcttcgcgtagtccacgccgacctcccggtcgaccgctgcccgccggcggtgttcgacgccgtgttcgtcgcgtcgaacgtcacggcgccggccgtcgcggccacggcggccatgagcgccgcgagagcggccacgtgagaaggcttcatttttttaaaaaaaaaataaaaatcttatggatgcacttgcaaattcgataacaatggcagggtttatataggttagagaaatgtgttttcgaggataagtgtgatcagctagctgatgatttttaatctatagtcaaatcaattgacttggaattagtccagattggttatgtttcttctcaaatctgatggaaggaagctggcccgtgaagatttgatgtggacatacgtgtcatacctaatatttatttatttattccaatcaaaccagaagttgtttacagtattagtcttggataaaacaagtgcagcgacggcaaggaaacgctggaaataatccaagcttaatctgacttatagtagtgtcatgacttctaactcttctggatgcatcatttaatgtatgtttgcagatctgctcgcaatttcactttcttctctacgactgaatagaccctatctgaacataaaacatacgtgtcccaactcccaagtcctaatataaaccatatctgaaatcattttctagcatttgcgtgtcaacattacatttcgtgttgcagacggtgcatcttgacttaatttgccaggagattaatttcaccagatgacccaatataatcttggagatgggggcatgtacgagatctttgctgtttcataaatgttgatctctgtttggtgtcctgcagcgtacgaaattcagatagaccggcctaccacaagctagaaacatctggagaagcagctagctgaattatatcttttctgaacttgtgacggctgggagattcagagtttcgtttgatggtggcactgacaaaacctgaattctggttaattacaggtaacgcctaaaccagaatcgctggctcaccacctgtacacatttgtgcagcatatggtctaaactctgaagataatggagcgatttgtttgatttgcaagccggcaggcagctgatcggaatcagacgatacagacaaggcagtctgcagtccgaccaaccagtttagctggagcagttcggcgttttgcagaagctgcaggagaaattcgagaccttggatgtctcaatccgaactcactgttgaaaaccattttctaaattttgccacaaatcacggattaaatctacgtacgtggcgtgcaaatcctgtgcagaaaaaacggtgttccctgttcagttgcataccggcgactgagcagactcgctcctgattgggggaaaaaaataataataatctgcagccagctgcagtgcactcgcagtcgattttccgaccgaaaccgtacgtggcgttcacttcaccgtgggatcgaatcatccaaaaacatcaattcgatatttcgagagaaagcctggaaaatttaggttgacagctctgctgcccagagaaaaactcgtaacgaactctgctgaaatccaaaagcggaagtccaagtcaagaaatttatcatttagtacaccaaataggtcaggctgctttctttctctcttttttcccttttttttgtgagaataggtcaggatgctttgactaattggcttggtgataccgagtactgctcccttcgttgtaaattgtaagaaatatattttttatataatttttaatgatatattttaaccattaacgtattccatattatgtttttaataaaatataaaattagcatcacacgaaagtacttttaaatatgaatctagtcatataacttgtataataattagcatatatatggttagtttgattattagagcttttcttagaaaagaggtcgtcgtttaatttggaacgagggagtactaacaaatacgtatacgtacttagcattgctgatgttcttttcgaagaaattcagacatcccgatgttggctataaatacttcctctcaccaattgcccacataactcaccaagaccaccagacatgaagcttcacgtcgtggcagccatcctgctggccgtggccgcgtcgtcgtcgccgccgcccgccgccgccgtcacctacgaggtgagcaacgaggcggcgagcaccgccggcggccagcggttcgaccgggagtacggcgccgggtacgccaagcaggtgctcgccgccgcctcctccttcacctggagcatcttcagccagccgagcgccgccgaccggaggcccgtcgacgccgtcgtcctcgccgtccgcgacgtcgacggcatcgcctccaccagcggcaacaccatcacgctcggcgccggctacgtcgccggcgtcaccggcaacgacttcaagacgcaggtaattaatagactccggctcatccatgttgactgactaaaattttgaccatccaaactatacacctagactgtgtttagactgtgtttagtttacgtcaaaattaaaagtttggttaaaattagaacgatgtgatgaaaaagtttaaagtttatgtgtgtagaaaagttttaatgtgatggaaaaattggaagtttgaagaaaaacttcggatctaaacatggtgacaatcaacgataatatttacggtgttcctactaagacttcgttcggcaatggctaaattaaagagagtaaaactatttcgttttctgcacgcacgtcccaaacattgtgtttatttttaaaaagttctagaaaagttatttttaaaaatatatcaattcgttttttaatttaaaataattaatgcttaattaaatcatacactaattgctcatcttgttttatatatcttctcaatttttctctttcccatcatcttaaacacacccactttaataaatgtgaccatagatgactagaattccaaccccgatcgatgtccccaaacaaaattaaatctaatcaaccacaacttttacgacaatctctagtttttccaaataatcaagttattttttctcataggtgaccggagtgttgtaccatgaggtggtgcacgtgtggcagtgggggctgcaggattacggggcgcattcgtgggtgtacgaggggatcgccgactttgtgcggctgcgcgccggctacccagcggctggttgggtgcagccggggcaagggaacagctgggaggacagctactccgtgacggcgaggttcttcgactactgcgacagcgtcaagccagggttcgttgccgacctgaacgctaagctgaagaatgggtacaacgtcgactacttcgtgcagatcaccgggaagaccgtgcagcagctgtggcaggattacaaggccaagtatggaaactgatgatcgatcgacgcagagaatgaataagacaagagattaccatcattgattgatatagattgttgtaactcatagctatggagtttacacaattattgtattgcttacggatgatagaataaagggacgctgtctagttttcaatcacatgaaaaatacttgcaaattttagtcctttttcaacggtctagattgcctcaagatttatgcgctacagtaatcataactaatctttttctcttcctctccctctctcctcactgactggcacaagcgtcagatcgaaaatgccctgtcgtcgagagccacctgtcttccccgccctagcacgtctcttttccttccctctcttcctcccggctccctaaggcctcctttggcagcccgggatcccggtgggatccccgcccattcccctgggagaaaggcccgcggtgaaaattttcacgggcttatttcctgtccatttggaagcccacgaggcagggatttcccagcccaatccgcggggaagccctagggaaaggaccccgacctccggagatcgggaatttttcctcgcgcgatccgccgccgcttctctctcgcgcggagtctcttctctcgcgcgcaaccaatgttgggcgccgccgcgcctcctcctccggcgagacgcgccaccgccgggactcctccggcgagacaccaccagcactgccaccgtactagggtaagccttcttctctttcccctcctctcctcctcctcctagggtttctgctcttctcctctagggtttcccctcagatctttggctcagtggctcaatcctctcttctcatcttcccccaacagcttctctagaacagccaccgtcaatcttgctcccacctgaagcaacacgacgcgctctctccagtggcagtgcgccagtgccccatcccccaggtcaacctcgatagccaccaagagcggttctccagtggccgtcactaagcatcgccagcaccgtgactcagttcgactggttcgtgtcctttatcccaaatctgtgctgtgattgtttatggttcagtttggtttgactggaaatttaatttttgcatcttgtgaatgtggaactaatgagagaaaccacggtttgtgtgaatgatctttgcaaagacttgttaagttcttgttttttggtagacatgttcaggctcagaaaagagttgatctaacgaaccgcaggagaaaccaatgctttgctttcttctggagtgtgaaatttgcatgcaaaaactgattagtaatgtctttgcacaggaaatttgggaccatcagtagagcccaggtctcatcattgcaagttttaacagacaacatattattcttattttgggaatctatccatcactagtacatgtccaaaagaggatagcattagtcagtgcttagagcttacagtcaagatggacagtaggttatcgtgcatgtgtgatgacaatttacaattgtgcaggttcatatgctttaacacataagctacgtggtaaattaaacaacattgattaagaagggaacacacgcgttcactgcttcgacagatcaactacaagaattgtcaagtatgcctccttgtacttcctctcttgccataatttaatttaaatttaatacgcaatttgcaaagggttattgtactttagcatgcactggtatgtaaacctcaacttcttcactcaagattactatttagttttttttctctgctccgtttggtttcccttttctcatctctagctctagttttaccatgattctgtgaaatgaatatttttagatctaacagagaatctttttttactggacagagaatcatttttgctggagttattaggaacattttatgtttagcaatagtatatgttctgatatcttcatgaaattcattattaaactgacaacaacccttcaaagctgaacactatatcgctcatccattagaccagctaatgctactactatttttttttctgaggagccaaattgctgcataggtatgtctgatggccctacaatttaacttgaaagctctgctatttgtatacttgattcaatttcagcagatgtaaattttacaactctttgtattcagttaatctggtttaattcttctctattcttgatggtcctagcttagcttaattctgattaattattgtagtctctgtcagggaaccgtataattagtgattaatttagcatgcatgtgagactaaataaatggtaaaaaacagatttttgataggacctcgctggccaaacaaagtgacctagtagtactaattaattaaaacaacaactactactactaattagtactgctaagtgctaaccataactatctacactaatgacagtgtttgtgtgcttgcttgggggcataaaactaagagacagagttagctggagatggccacggtccgtctgaagcattgcgcattaatttgcatctcaaactgtagtagcatgaggctttaatctgtctaatcagtttgcacctaaacagcagctcaatggcactgcagttcagctgaaaatgttgcaaaagtttacctaatgaggactcacatagggggtatatatatgagatgcacttcttttccttgtcatgtccataatgataattgtcctcttgcactcttcctcttgccatgattcaatttgaatctctggattggcataaacaaggattgtcccacacagagctatactctagtctgcattttctatacaagaagtacttgaatgattttttttctaccaacgctacaggttgcacccttacttgtgtttttaattcttggatgtaggcaacaggccttgcccttgtatattcagccttgttctcaatttggagcagcgatggagatagttgatgcttatgaatgcaggaggaaaacacatccaagatatttgtaaatgataattgtatgattatatcttgtatttgctgaaagtgatatttcttggatgctcatataatacttggctaaatactgtagatggtagctcaatttgatcatctcatgaattaagttgatgcttgtatctataatgttctctattttacctagaatttattgctctaattggagttcatatgatttttcagattttttttcttgcatttttaacttaattattctatttttgtgctcagttatgtttatttagacattttttttatcttgttgtgtgtgctccaactagccattatttggtagagtaggctcaaaaattaaaaaccctaatcatcccccagtcccgtgagctgcttccaaatggtagcagggaaatctcccctagcgggaagtgcttccctagatattttggggggattcacttggtacagggaaaatccctgtatggggttttttcccaggggttttctccccgtgcatccaaaggcagcccgggatcccaccgggatcccagcccattccctgggagaaaggcccgtgggggaaattgtcacgggttttattccatgtccatttggaagcctgtggatttcctggcccaatccgcggggaaaccctagggaaaggtccccgacctccggaggtcgggaatttttcctctctcgatccgccgctgcttctcgctcgcacaaccggagtcgcttctctctcgcgcgaacaatagcgggtgccgccgcgcctccttctccggcgagacgcgccaccgccgggactcctcctccggcgagaaggataagcccttctcctcattcccctcctctcctcctcctagggtttccgttctcctcctcctctagggtttccgcttcctctagttagctcccaatctcgctctctggtctcagcgcttgcatcgcaggcaccgacgcgtggcaccacggcagccggggcaacgacgacgaggcgacgcgccggcagcgcgggcacacggctccaagcaggcggggacagggggggatccaaggcggcgtgactcaccggcagaggaggcgctgaggcgcagatccgcctcctcctcctcgctgcgcgacacccaccggcggttgcccggctaggtttgtgcatgcccttgtagctgctgcttgattcttgggggttcgttcagtacttcagttttcttggtgtatgtatggtatgtttcttgatttggtttgggagagttgtaatctgttctcctgttctttctaatacattgtagtattgtaccctgcagtagcatttcattttgttatggaagcgattcagaaggggatatgggtgggcgtatggtgctcttgttttagatcatgaatgagttttggtaagatgatgttctaatttgatggagtaggttgtgctctggttttttctgcagtgtaattatcatgcttagtgcagtctaaatatgtgagatcaatgcaccagtcccaagaaatgaggaattatcacacatgcagtgaggatcattcaactggtgaggtatatgagaaattttagtctgcaaaccagtaacagttttttgcagttaattagagatgcagttcttttagttggatgctgtcagctctgttaacctagaggtagatcttagtactggttgagctgctagcatcaagtttttttttctggaggcattttttagtctaatccattcttgtagtctctgtcagggaactgtagaattagtggtcaatttagcatgcatgttgggactaaataaatggtaacaatcatatttttgataggaactcatacttactacaaaaatgaagtcttttatgctctatacttatacattagtctaaactttagtttcatgtcatgtatcaccagcagaaaatgagcaaggtggcattgtgcattcaaaaaacacaagctttggcagcaacctatatacaaagacacgcacacacaggtatttcaatctcctctctctcactcactgcacaatacactggccaaacaaagtgacctagtagtactgattaattaaaacaacaacaactactactacttttttttccttatcatgtccataatgataattcataattgtgctcttgcattcttcctcttgccaggattcaaaggattcaatttgaattgcatgctcaacttactttcaaatatggacttgaaatagagtattgttggaaaactatcaatacaaaaacatggacttcaaattgtttgatttaaaaataatggtgtgtatctgcatgtagggtgtttgatctaaaaagaaagtgcttataccaagagtttgtttacgctgatgaagctgacaattgcaatatgttggttgatgtgcatgcattttttcctaagctagtatcaatggccgtccttcaaatttgattgctgaagtatcactattttatatttattacttaaatttcagattatctttttcatcctggcagatttattagaacaaatgaagatttgtagaagagatgatgaagaagatagaagagataaagatttaaattgtgttcttgatcaagacattgtaaccctatataaatatgatgtacagttctatatttgtggatgcaaggatgattccaaagattctaaattttgtatgatatggatgattctaaagtttgacttatgtcatgtcacgaagttggtttccacataaactaatctatatttctttgttttttctgaatttctaatacttgttgattttttttatgtttttattttttttttctggaatttttttaggttgtttcctatttatatggattttctatattctttctatttttcctgaaatttctataatatttctaaagacatgttttgttgttcaaacactatttagcagtttgcctctctaaatcccccttcccccatcaaccccctccccctactcccaaatggtagtagagaaaattcccctaataggagtgattcctctggaggtggaaggggatcggttggtacaggggaaaatccctgtacgggactttttccctggggtttcctccccctgcatccaaaggagccctaaggcattgttcggttacacaaggattcgttccgggccaggaatgataggtataacaagaaatttataataggtataacaagagaccgggatttattccagatcaggaaccaatttacttatattaggtacaacaaaatatccggattagttccacacctcttaactggtggattaattcccggtctcttattgtccctatcatgagcaaattagtttccggcccaaaataaatcccgacctctcgttgtatctatcataaatttcatattatacttgttattcccggcccggattgaatacttgtgtaaccgaacaagggttaaaccggcgatagcaccattcctctacgccattctcttcgatccccgtctctagcagcgagccgcaggattcgtcatctcctaactccacagcctcccttgcaccctatcatctcattgcccaaggctattcctctaagcttaaaaccatcctctcccctcccctcccaccctggcccttacccaaaacctaaaaccttattagcataaatcatctttgaaaatacacagtaaaacatgaaggctagctagaaccgtgatacagtaaaataatatcttctcaagaacagtaaagcatctgttaaaaagagagcatggtgtgtatatctttcatgcatgctcctttgatctaatctatggattagaaggaaaatataacatcagcacttatattttaatgagaaaattactctcgtctagcttgcggtgatcaaaactctcaatagctgtattttaactgcaacaacgttaagttctgaacactcagcctctttttctcgaactaacaaattacggtacttttcatgcgagatactctggatcaagtcacaaatcgtggctcaaatgcatatacgcacggtgacgtgcatgcaaaactgcagatcatgggaacaaaatggtgttctctgttcagttgcagaccgagtagtgtgcaacaagcaagtatatattgaggaccaaattaaacacgacatgagactcgactcaactcaactcaaatacctcctgattggacaaatctggaagccagctgcactgcacattcagtttgtccccatcaatcggttgctatgagctgattataagctaaagtggcttatatacatgttcttagcggtttagaaataatattctaaaattaattttaaaattaagatcctgcatgtctaatgtaaatgatgaggctggttgtctatatattttccgacagcaagggcgtggcatccctttcacaagggaatcaaacccttccagaacttccagtcctgtgagaaaaaaagcttggaaaaatcgggctgacagctgctgcccagagaaaagctccgcactctgccaaaaatccaagactccaagtcaagcaacttatactgaagactacttatactgaccaacaacgacgtatatatacgtacacgtttgcacatgcaggacatcttcgtgtgcctataaattcgggaaatttaactatttgtcacttttacgtttggcaattagtcaaataccttttttagatttgtacttaacaatttgccatgggaaagagaagcttttgtatttttttttgccactttgtgcactgtagagcgtcacctgtgcatgccagcatggaactgacgcaaaaaataactaatctacccctgctagcaattggtactgtcctgagttgataagcttgaacacattgaatcttagtcataattttaactggagagataacaagagaaatcggcaacatgtccaatctatcctttttaaatttgcaagacaacaagatcaatggcaccattccggttacatcagttcatcaacttgtttaatcgagctaagtttgggtggcaccatcccaacaatgccagccaaattaaataccgtttttaatcttaggcccagttttttttttcaactacaaattacaacttcctcggtttccattatcacgtttttcaaacggttaaatagtgtgtttttataaaaaaaagttatgtaaaagttgtttaaaaattcaaatgaatccaatttttaattttgtaacaattaatatttaattaatcatgtgctaatgagctttctcgttatatgtgcgctggaaatttctctctcaactgagagatcgaacaggtcctttgatgtgtccaagacccgggcattttttgttggagaaatacaagtggccgtgcaggagcaattcaaagaatatatatatataggttcggttcttgtaccgataggctaattaaccaactatcattaatagggtcattagcggctggattacccaagtaattagtacattttactatctgccctgtaacaggggaggaatttttgtgttgttctgttgagagttctccaggaaagctgatggcgatcccatctgcgaattgacattattgctgccgctgtgaaggttggagaagaagctaggtctggagattattttcctggtcttgctacttggtacatgttagtgccctttcttctgatcgtgtagaaagcacgggtagaggattattttatctagggtttggtcttcaactgttatacgccgagctcttgattatttggtttgtttgctgctgaattttatctatatatgcaagtctggttaatccatcagtgttgagattaattactggagttgtgatttttattagctgctgattcagatcgttggtgacctcacgctgcctggcaagttcagaaagttaatttgttaattgctattggtaccgtaaaagagagggataaaattagggtactcggtgttgggtaatcatcatccttacccataacatccggtggatatatttcttcaaatattggttcgttattcgacttggcggtactcgatcttttatacaaggacgagcaggttgtcctcggatcatcaatgaccacctcataacagtgaacaacatccatccagattcagcctataaaatacagccaattgctagcaggggtagattggtcatttcacgtgcctggtccaccctggcatgcatgtgtggcgctgcacagtgcaggaagtggcaaaaaattacaaaagcttctctctagtggcaaattcttaagtgcaaacctaagaagggtatttggttaattgtcgaacgcaaaagtgacaaatagttaaatttccctataaattctgcttcaccacactcccttaaatcctacactaaaatttttcactctatcacatcgaacatttcaacacctgcatgaattattaaataaaggctaaaaaaatatcgaactacgtagattgcgtctaatttgcgagacgtttaagcctaattgctccatgatttgacaatatggtgctacagtgaatattggctaatgacggattaattaggcttaataaattcatctcgcagtttataagcggattctgtaatttgttttattattagactgcgtttaatactttaaatgtgtgtccgtatatccgatatgacacgttaaaactttgcacccctgaatctaaacaccccctaagaaatcctatacttttcttaaaatacattcagacgatgatatgccatatttagaaaatgcgcaaatattttggattagatatttgatctggtctccgtcccacatggcactaacgtggcattagaattaaaaaagtatacgtaggactcatttgtcattcacataaacaatattatgggacccactgacatgtaggtcatcatctttctccatatcttcttccttctctttccctcttccttatctccctgtctcctctttctattcaccttcatctggcagcgacgagggtagcggctcgacggcgatgagggccgcacggcggcgggcatgagggcgatggagcgacgatcgcggtgggcaggcgaggccctaacaacttgccatggccacccaccaccgcagccgctggcgtagaccccggagctgtggagcgacttagtcgctcactcgctcgccatggcgctctccttcgcagtgatggtcacgcggcgtccgcatcactatccgtaagtccgccgcgaagcgcaagccatccacctctggcagcccgtggtacggacccgaccgcgtcttccgctccaccgatccggctaggcacgtgcggagcccggcaaggaggagagaggaagatgggggcggcctccgccactagctctctccccgccagccaccgtcgaccgccgggctctccaccgacctgccatcactc

SEQ ID NO: 80211 - DNA, 15377 bp, Oryza sativa
tggtgtttccgcctgcacggctggcctattatgccgccgttgttgggcgtctacgtcttcaccgaccggcttgccttcgccgccgccgactggtgcttccgcctgcacggctggcctttatgccgccgttgttgggcgtctacgtcttcaccgaccggcttgccttcgccgctgccgactggtgcttccgcctgcacggctggcctttatgccgccgttgttgggcgtctacgtcttcaccgaccggcttgccttcgccgccgccgactggtgcttccgcctgcacggctggcctttatgccgccgttgttgggcgtctacgtcttcaccgaccggcttgccttcgccgctgccgactggtgcttccgcctgcacggctggcctttatgccgccgttgttgggcgtctacgtcttcaccgaccggcttgccttcgccgctgccgactggtgcttccgcctgcacggctggcctttatgccgccgttgttgggcgtctacgtcttcaccgaccggcttgccttcgccgctgccgactggtgcttccgcctgcacggctggcctttatgccgccgttgttgggcgtctacgtcttcaccgaccggccgccgcatccgccgctgactggtgtcaccgcctgcacggctggcctgttataacgccaactgatgctatcttcttcacggctggctacatcgctgtcactactaataggcatcagtatcttcaacacaagctgcctacgtttgccatggctgccgactggtgtttccgcctgcacgctggcctattatgccaccgttgatgggcgtctacgtcttcaccgaccggcttgccttcgccgccgccgactggtgtctccgtctgcacggctggcctattatgctgtcgttgttgggcgtctacgactccaccaccggcctgcctccatcgccgccgactggtgtttccgtctgcacggctggcctattatgccgccgttgttgggcgtctacgtcttcatcggccggccgcctcgtccgtcaccgactgatgtttccgcctgcacggctggcctattatgccgccgttgttgggcatctacatcttaatcgccggtcgtctcgtctgttgctgactagtgcccttacctctacgtctggtttatacagctaccactactgatggacatcatcatcttccgtcgccgactgattatgccgccgccgactggtgcttttatcttcacaactgcgcgtcttcactaccagtttgcttctgttgccgacgactcgtgttcacttcatcacggcaatgcaactttgtcatcatggtagagcgacttcatctttattatcttcggcactggcaaactctattgctgctacttcgcaagttttgctacttcaccaaccacgacgtctttgtgagcctcgacatctcggcatgcgatgccatgttattttactacaacaagaggctctccaatattcaggatttctacttggacatcttcaacacatatcttcaatcaagcaatgactacttgacgacaagaagctataattctcgactctatgttcagttgtttcccaactaaccaaagagtcgggggctacacaaatacaaggctcaaaatttgacaaattttatgtcaagctgaagaaatcaattcatcaaccaacgagtcaacttcaggagtcattatcttcatctttgattcagagcagacattctacttcaacaacttcaaatatttcggtttagacgagttgggcaacaacatcaactctcctccaattatttgtcttcacggttggcctactacgcaaccgccgatagaggatctcatcgttatcatcggctgctacatcgctattgactggatcaccgacatcgccatcttcatcaacatcttgtcaagcctcatcaacatagcctactctgctgccgttgatgggaaacttcatcatcatagtcggctatctctattgccgctaatcatcattaccgtcggatgcgtttgtcgccgccgattattttcttcatcttcatgattggtggatttcgccatcaccgttgatgcgtgtctacgtcttcatcgtcggtttgcttttgtcactaccgactgttctttcgttgttgttgggcgcctacatcttcactgctagctgacctgactgttgccgactggtttcttcgcctccatggttatgcaacttcattacatttgattggtggcatctttactaccactgacatcttccgttacttctgatgagcaatttcgtcttcatgttggtcatttcatctccatgccgactgcgtcagctattgccaatagacaattttgactatgacagaaggacaagctatatgctcaggagctcatcaactcaagcgtgaggattatatctctaatttggacttgttccggatacatgcaacatgaatttatgatcatgggtctattttctatgctcaaagactggactatttattattccccgtaagggttatcaaccgaatacttgcgccagtcgggattcaatttttatatctattttggagtatcccataagggataatcactcagatcacatggtctatatcacccgggagcatgttacatgcgtcatcctttaaagggtatcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctgactttttaatatagtcatggtgctgtttgggtttttaagcaattgattggatacaatatcgttgctttttgccacgtaagtgtgcatttttattgaccaatattatggcttaggctgattatatattgtggtcatttttctaggcggttggtaaatcctttatgagtttatttactcggattttacaccacatatgccatatatttccaggtgtggtgaaaccatgtgtcttttagggactaaagcacgtctgttaaagcagtgtgcgcatggcgtatgcccaatactttggaaatttctttattcacaacatccaagcttctttatagctattttgctatgtgaattttcaatgatgtagccaactttaggttacactcatcatattttacaaagcagtcggtatatcacttggatcatattattcggggattcacaccgcatatgctatatattggtatcaagtcacttggttgactacgattatcaaaaccactcagttggtgcatctattagatacatctattcgatgcacctgactttatttttcagccctccacagtcttcatatttggtaaaagtactcgggagatcatggtgaggatgattgaagcactcggctttggagtaatctagttcgagaaaagattatctttccgactgtgaaggtctcaggggctactgtggagattatgggtaccccatacccacacggcatggttatccgactagtaataggggataacatatatctatggaatatgtaaccgatcatgacttgggtattacgtttccttttatattatggagcggcctaaagtcctgattcgataatattgtaaaatagatttaggaaaccgataccgtattggttaaggtttctatcttgtaatcctgccccccatcctatataaggtgggcaggaggccctctagggggcatgaaacaacctgatcgtcagatcaatacacactcggcggattcaaatccccaacaggagtagggtattacctctcattgagagggcctgaacctgtataaatcatttgtctcggcatccatccactttaggtctcgtccgctacccccttttattattgccgaattcatgtttcgacaggtagaccatagattcaagatttgatctaatactaacaaaaacttgatcaatatttaatgagataattttagttattatcttttctcatctatgtacgtgcatggctaccaaaaattaggagcattcggtctgtttgtttcctagtcctttccttgcatatggccgtatacgtaagttggacatgatttttttggggcatttgcaaatttgccactggttttttcaatattgcaaggatgccactcgactgacagatctagtggcatttttgtaattttctagtagcagtcttacaataacgattcaaattagtagtaaatttgcaattgcccctttttttcctattacccgacaataatcaggccatgcaatccggttcatagagcacttggagtcatgttgatgtaaaaagaaaatacacactggcctaggagatctgtttagctctagtgcaggtccaagatgttgatgagatgcgggtgtgtcagtcagtttgatcctgcaactgacaagatatgtaaacaatatatcagatagccgatcgcctgacaagccgatggagtaattccagccgatagccgatactaaccgatgccgattccagccgatgtcaatagggttttgagcaatcggctatatgttcaatgtagataataatgcaaagataatcggctgatgataataaaatatagttataatataaaccaacaaaaaccaatgggctaataataatatgataggataaatactgatccgatggttaaagcatacatcggctggaggtctgatgctataaaatccacaagagtagattaaacaatgaaacctttgttgtcatcagctaaatccaatttatatatgcaaaccttataagttgatgcaacgtctagataactcatcgattgaaaccccgataaaacccttattggtagtcaataagcaggctagagattatggttctaagcacgacttaatagattaaacttaactgatgcatacactaagtatgaaaagaaacataatatctagacgatcaagcccttgactgattttcagggtgataaatgccttagctaatctaatctagtaaaacaacttagccgatacaggcagaaacactaaagcgagaggcaaccgatagagctaaattgagatactaagactagattaactaaaacatatgataaattggcaaacaaattgttgatgcgaaaaacacacactggcctgggagatctgcttaactccagtgtaggtcgtaaatcttgctcttgggttcaaaggcatgccagttgatttgatcctacaatcaataagaaagaaaaacaagaaaaccaaggttaaatccataaacgatagccgatcggctaggggccgatgacatatcgtcgaacattgagccgatgttattggtattagatcggcaatgaagaataaggcaatatagagttaaatctactcgatcggctgtagacatcaacgatatataatcattttctcaaaatatatttaaaccgagtgattgggatagatcgaacagcaagtcaagacagtataaatcacttatgtttaaagatactttaagataacgattatatatatgtttatagcatagccgatcaaatagatctaacatatatcggctaatactccgataccactccatattaagatattaaatcagacaaaatatatcaaataacaagcctaatatactttaatgcaacaatatcttaatataaagggcagatttagcatatcaagtaagcatacaaagtataaaatagctaaatcaggtaagatcggctgaaaccccgatactacctctattggtggtcataaaacaagctagatattgcaattatgaatattacttaatagatcgaactcaaccgatgcagcattaattaagcataagaataaatacaagatctagacaagatgatgaaaacctctaaaagatggtagatatgctatacaatctagattaacaataaaatctaactctatcggctactctctagtaatagatgttagccgactgaaggttagattatgatagtaataaagattacaaggcatatatgataactcgacgatttacataaacaagattagagtgttataaagatggaagcactaatcccgagaacgcaagccgtcatgacaaattttacctcttgttgaagatcgaaatcgatgcagttcaacccgaaagcaagaacttgtcgaaacaatgaaagtagaaaaagggcggcgatacaccgaaagtgttattgaactatcgttgtaaattacatgggatcgggttatatttatacctgggatacatggctagtccttgccggacaagactcttatctctaacaaactctaagatacgaacaagtctttacagcagactcttaccgaaatatatctctaaagaaactatttaaaatatcctaattaatagatataattgcctatcggtgagcttatctccatcatggcaatccttgtgtagcacgttgatcgatcccaaagacggttatacaaccatctcaacgaaatcggctacatcggctaaatcggctatcttctatccgatccatctcatccgatgcagtctttagccgacacccttagctaatgcgcactgttcttggaatatgattccctgccaaatccgctttgattccaatgttgaacgtagttcatggcttaccaaatttggtcattaacccaaatatatcatccaaaccaaagcaatccaagaggtcgaatgtactgatgcagccttgaacaacgccaacgtagatgatacaattgcctaagccggcggaacattggacttacctcttcgccggagatcgagaaccaatgcagccccgtatcaggtgccaagttccgccgtgataaataaaaaggtagaaaaggtaaaaggtggcgatgcgccgaattgtactgatcgtggagataatttacaatgacctcgggtgtacatatttatacccatgggtagacactagtccttgtcggacaagaaagaaactttcctaaagataaaagaaaaacataaagttcttattggacactaaacacactttcttaaagataaaagaaaactaataaactcttcctaattactagataaattgccatgccgcatcctcctcgaacttggtctcttctggataagtttccttaaatagattaatttccttaactgaatgctacaagaatccgactattggcgacatgataattctcggcaaaatctagatcaagaggcctctcgttttagtgctaacgagagatcctatctagatgccttaactgtaggactagtccccatcaattaagtagaaaatatattcctatcacctatgtttcaaatgaaattttctcttaaactactcatccgatttatgatccaattacacggttgtgttcgtaagaattaaatctttacaacaagatctcacatgattatattttgatgaaaaattacaaattacttttatagtatatctaaattacttttagatttcactaaattacttcttagacatataaaagtaatttcagtaaagcttaaaaataatttattatagaagtaacttaagacaaaaaggaagtaactttgtcatgacattaaagtagatccgttatggaggtaaaaacgtgagtctatctaaaaattaaatttaatcagcacgaattatggaattgactaaaaaagataataaaataaacaactcacaacattatggttgtataataagtaatttaatcaaatcgaaaagtaatttatatatatgataaaagtaacttacatatataataaaagtaatttacaacatagatatttcttttatcaaaatatagtcatgtaagatattgttataaagatttaattgcaacgaacacaatggtgtaatcggatttgatgttaatgaatctagatagatatatatgtctatattcattaacatcaatatgaatgtgggaaatgctaaaatgacttacattgtgaaacggagggagtacttctctgtttatatttgaaaccgggcaatgaattgaaaagaaaagggaacagaacggccttgtgaacgcggccaccggagccgccagcgcccggcaggacgatttgccgaccagcaacggaaggcgatgtgccgtcgagtagccaagcgatagatctaaatgtacaaaaactttttttaatgaagagtggataatatcctaaataccaaccttacctctaatcactaagttagtaaagtactaaaatgtccttatgaatcaacggttcaaatcaattctactagttgtataatactacgagtagagagtaccgagcatcgctctttattttttgggaatgctatgaatctggaatcgcatattaggtttcatttatacatctatagtcaaattcatgtacacacaaaaaaagccgaccctaaaaaatatgattgaattcccagttagatttgtatttatctatctgtatagattttattttagtggaaaggtcgcaaggacccggcctatattgaaagccaaccacgagcagagtttttgctgcggttaccagctttacaaaatggagcacagaaagcactcggagatgattaagtaccaacagacaaggggtatattaagggggtgtttaggtgagagaaggactaaactttagtccggacttattttttttgtgagagggaccctctcacccaaacaccccctaaacctctaaagactagacggcagcaatctaaaacagaccgaacgccaaagcattgcacggggctagcaagatcaaccaactcctattctattttgtcttagagcagctcctccctccttaaacctctttaccagcttctctagatcactcttattcatctccagccgatgcagaggactacactgcaataagaaaagacaatttggaaaggtagtattaggggtgagtaaacaagtttatccctgaacatgatgttgtttctcgttgtccatatatagagtccggcaaatggcagcaagcagggcatttttcacaactatatgtttaattcagctctaatgtcagcaaggataaagtcatcaaggttaagaggaacatgatcccagttcagcacatctctacagaaacaccaaacaaaatgcgccaaagggcagctaaagattatgtggtttgtagtttctagatggatagtggagaaaaaaaactaattttaaaatcagtaactagagggtgagcgtgcatacggtacggggtcgaccacgggccacggccggcggggagcacaacggctacagtttatacttattttagtgctagaggagacacagacagtaatacacgctacttccttcgtttcataatgtaagtcattctaatattttccatattcatattgatgctaatgaatctagatagttatatatgtctagatttattaacataaatatgaatgtggaaaatgctagaatgacctacattgtgaaacggagggagtagtatcaattatttgaagagttcagtgacattgtaccataaggacgaaacgaatactccactttagtggcatgtggtttgacttactcttgtttgtcgtcacgcgccagcccgagaacgggtccaatggaggatacctcaaatacagactcagactggcagtataggaagttgtgtcgttgctcctccagcaggagaagccgatcagtacacagtactgatatcacagtactgtatcagtatcaccttgcacacgatcgatcgacgctggctcgccggcggcgatggccgtcttttcgttgatcacttgtgctgccgacctcgtcatcttcttctccgtctgctacattcagcctccggctcatttcgccgccttgtccttcaactaccccaccttcgcctcctcacacaaccagtacatcgaaattgaaggcaatgcctctgtcagcgtcgggtatatcgacatcagtgcgaacagtgtgggcaacaacgtcggacgggtgttccacaaaccgccagtgcagctctgggacgccgccaccggcgaggtggccagcttcaccacgcgcttctccttcaacatcatcccgggaaatagaagcaaaaagggcgatgggatgaccttcttcctcaccagctacccatcgaggttaccagagggcgacgccggtggccaaaacctcggcctaacgaaccagacggtcggcgtctcgaccggcgagaaccggttcgttgccgtcgagttcgacaccttcgtcaaccccttcgaccccaacgcaaccaacgaccacatcggcatcgacgtcaactccgtcgtatctgtgacgaacgagtccctaccaaacttcagcctcatcgggaacatgaccgccaccgtcgactacaacaacaattcgagaatactgtcagttaagctatggataaatggctcgacgacgccttacacccttagctccatggttgatctcaagagagccttgccggagaacgtcaccatcggcttctcggcatcaattggctcagcctatgagcagcatcagctgacttcttggtacttcaagtcgacttcgtcgttcgagcagaagctggcagcagaagtagcatctccaccgccgccgtcgtcaccgtcaccaccaccgacttccagacgtggcggagttgtagcgggagccacagttggcgtggtaatgttcgtcatactcctcttcaccatggtacaagtccttgtacgacggcgtcagagcaagaaaagaagggaggcacaggatggaagctggcacggcagtgacgacgacgacgacggcgagctcatcatggagatcgagatggggacgggaccaaggcggttcccgtaccacaagctcgtcgacgctacgaagagctttgcgccggaggagaagcttgggcaaggcggtttcggtgcagtgtatcggggctacctcagagagcttggcctcgccgtcgccataaagaggtttgccaaaaattcctctaagcaagggaggaaggagtacaagtcagagatcaaggtaataagccggctacgccaccgcaatctggtgcagctcattggctggtgccatggccgcaccgagctgctcctcgtctacgagctattccccaaccgtagcctcgacgtccatctccacggcaatggcaccttccttacatggccaatgaggtttattaattaactcattgatttagtaattttcgttatgtgcaatcgacacctttgaaattcaattcatctgctaacttggatgttgccacaggatcaacattgttcatggactcggatctgcactactctacctacatgaggagtgggatcaatgtgtagttcaccgtgacatcaagccgagcaacgtcatgctggatgaatccttcaatgcgaagctaggcgatttcggccttgcaaggcttattgaccatgccgttgggatacaaacaatgactcacccctcagggacaccaggctatcttgatcccgaatgcgtaatcacgggcaaagcaagcgctgagtccgatgtttatagttttggcattgttctattggaagtggcatgtgggaggagaccaattagcctgcaggacacccagaacaattgcctcttccgactggtggaatgggtgtgggacctgtacggccaaggagccgttctcaatgcagcagacgagcggctcaacaatgaatacgacacaactagcatggagtgtgtcatggctgttggactctggtgtgcacatccggaccgatgtgcacgtccatctatcagagctgccatggcagttctccaatccaatggaccactacccgtgttaccagctaagatgcccgtgccaacatatgcaccgccgatggcctcagcggaggggcagccgttgtcgtcctcaagtttgacactaacgtccatcacacctcgctaggtttgcaagttttctcactcataggatttgtatagcgagataatttttgtcatatttagatttttatccatacccacaagttggtttggaggactcatcttcgttaattgctccatacaggagtattagtcatgtttagttcattttacttgttctacatttacaagggatatgtacagctcgtgaggcaattggtttgctctttagagagctgcctaattggcaatgtgagcaatgtgtttagtttacatgatgctgtctattttccaagcatttatttattttgtccagaaaacttttcctacaatttcctctgtccaacaatccaatcaaacagtccatatatctaactgatatttgttacatacttttcttgttttcagtcgatatcctagtccttacagagggcctggaaatgttggagttgtaagaaactcagaaatattaacaaaacagaaatgatcgaaggcaccaacagaagagacctcttgcaagacatgtgttcattgttgatagatctcatatgatattcagctaatgctgtccaatgactgcatagattactaccgaaacattgttttgtcctaattcatccccatctctggctgagatctagaatggtcaggggcggatccagcaacagaaaattggggggcctcaagtacgttgtttctctaacctttagccatctaaagacctttagtttattatttatggtgaaaaaaattaaagaaggtgctctgggggtatccatgggtcttgtgggtgtaggggggactcgagtccccacgttggatccgcccctgagaatggttagttacttagttcagtctaaaagatctaaatgtgtataacatgatcacaataatcatataagtatactaaaattcagaacaatagatctcaatttgcagaatactttggatacactgctgctatgctctcgtttcgtcaagcaaccagcgtaacaaagataggtgaactggaacttttagtgcagtttcgaactggtcatcttctccaatcttcattaccccgtggaagaacaaagtcttaaagtgtagtttcaaagcaaaaaaaggaagggtacaataaagagattaggattctctgtacctaggtgtcatgacacccaacatttatgtgcgacttaaatagttattgaaaaaaaataaaaaaattagtaacatcaattgtgatgatataagtctgtacacaaacatgcaagtttctatttgatctacaactagaaaaataaaaataataaaatttgttaattttatttcttcatgtgtctgctagggaactcatctttagtcctttagtcctgcttcacagcccctttaatcccgggttacaacccgggactaaagatgcctattattagtcccgcttgaaataaccgggactaaagatctatcttttgtctcggttggtaatttttagttccgcaccaaccggactaaaaattgtagcgctaaaatttggactaaaaataaaataaaaatctgaaattagaaaaatatcaaagagagttcaagtagggttataattttgaaacaactaaaatcgaaacaataattaaggaatattaaaagaattatccatatagaacacaaaacgagattaattaaaattctaaataaaaataaaataaaatatgaaatttaaaaagaaaaataagagtttagttaggaatacaaattaaaaattcataataaaaaattaaatctattaaaagaagagaccatttaaaacacatgacgagatcaattaaaattttgaataacaaataaaataaattccgaaaatagaaaaatagttagatgaacattttttagatgtatttgtgaatttgcggtgtccatttgatatgtgatgttcaatatgtgaatttgagtatgttcattcgatctgtgaatttgtgacgttcattcaacctgtgaataacaatgaaaaaaaggccaatatgcaaacagcaaaagacaatgaaaaaagaaaaaaatgttcttacatggacttttctttcaatattacatattttaatttcgaattttagttattttttactttctagcccactaaccgccattacagtgttgcttaacgacttgcccgtagttcctcttcttaatcatcgttgggattctaaaaatcgaacctaatcatcttttcggttttgttaatagttttcatcagatgtcccattaaccgtcaccacactattgctttataggtctgttgttcctcttctctttattatcatttgctattattgtatttttttaatggactattgttttacaattttgtattttttcattccttttttatttgaaaattttatttctacgtgaactcttatttttatttttctattttttggagcttattttattttttctgaattttagttaacctcgtattctattctacatgtatgttcttgcaataatcatttttattttaaaggaaaaggatataattggagagaaaagtgaaaagaacagtagaggataaccagcaaaatatcaggttaggaaaggagaaggataaaattggagagaaaagggaaaagaacagtagaggataacatgtatgttcttgcaataatcatttttattttaaaggaaaaggataaaattagagagaaaagggaaaagaacagtagaggataaccagcaaaatatcaggttaggaaaggaattggataaaatggaaaaaacgaagagatcgatggaatcgaactcatgaactattggtcaaatgtttcagtctaaccaattgagaatcatcgacattgtgctacattgtgtagctacattttaaaaatatgggtaacgttagtgtgtccgcccctgcaccctatacatgttggagcgcggtaaagaaaaaaaattggtatggacccgcccacctatcgaaccttatctccttctctgaaatcctccacctccgcttctcagttctctctggtcgctttctccgtctcccgaatccccgtctctcctcctttgccaacagccgagagttagagagagcgccgcgccgccgcccccgtctcttctcccaccggtccctctctctccctctcgtctctcccttgccggtagcagaggaggtggcagcgatggcttcagctgctcccgcgggccggatccgggagtggcggtggagtcggcggctactattggcggatccggtgacggtggcggtggcggtgtttccggcaggcggatccggcgggcgattctctaccacctcctcctcaccctccacgcccaagcttgtcctgcggcagcggcggtgacatcggtgctcccgtgggcagatccagcagaagtggcggcggcgttctttttggtgggcggatctagtgtcacgcaatttctatccaaaattccaaacgcttacatgtgtgtgaaccctcgtccaggaatcagccgaggcaca

SEQ ID NO: 80212 - DNA, 16897 bp, Oryza sativa
ccaaccgggactaaagatattagaggggtttgacatcacctaccgttttttaaccgggactaaagatcaaaaagtagctctaaccttttcaaccgggactaaagataatctttagtcccggtttttattgcaaccgggactattgtggaagttggtcgaccgaccaaagatggtttctccaccagtgatatgtgcgtcagagaaaaatgaacacattttttcccattgaatcatctccgatctgctggcttccaccttgtgataaacatatgtgcgtgatagattacctcggcttccaccatctacgatctgccgtcactcccttcctcatcgtcactctcttctttcttccttacccctcttacgacgaggtatgtcggcatgtatgatgaagatgaggtggggggaggaagaggaggaaggggtgtgtggcactgtaggcgacggggatggataagagcaacgccgacatgggcaaggaggaggagaacccgttatgtggtgcatcgaggcctgaggaccctctcgatctggcagcaacattactctatggcgcttgatctggcgcaacagtgctcgatccggaaggatgaaagatggtggaggatggggaggaggggaggaggaggaggcgacggggactaggaggggagcgaaggggatggtggagaaggagacgaggtagcgaggggcgacaggaaaataaggcggcggcggtagcgcacgagaggataggggtaaaatgaaaatttttaactttttctccatgtacgtggaaggactagaaacaaatagaaaattcttaaagggacaaaacgatatttttccaactataggatctaatggcttagaactcgcagagaagaaatcagacggtatatatttatttgatgatgtggagcattatccttctagaaagcttgttgctttcatctataataaggatttgcaaaacatgtaactattttgatgacgtgatgcaagtagtatttctacaaaatggatttggcattgaacgtactgttttaacctaactgttatggagtttcaagttaaaaccttgccacaaaagttggcccgccagttacaaagttagttagtacttcaactgagtaatttgcgttggatttatggagaacatggttcgtcctccaatggatcaactccaacatcttgtccttttacctcttcagctcgatcggccagctaagtggcaagtttgtttcctgttgtattccatattgctactgtatgatcatagtcgaataggaaagaaaaaagtacttttttcatcaacatcacgaataggtacgaagcaatgtctcttgccgacggcctaagaagtagcggacagctgcaagacaagccagctttgcctagaaactatattttttgccaccccagtatttgtttggctgctgcaatctcccacatatctatcatttatatatacccttcatgtgcatgaagtatgttgttaataaaacccggaactcttgatgttgctttccattttgtcgttcaaagtcagttaatttgctatatagttgtgcacggacatgtcgatcgtctgtgcacctctgcttgtgcgcgcgcctatttgctgttaggttttacatggagtgatttcacacgtgtgacgaactgacaatgtgggactatgtgacgatggttattatgttttcgttgaaaagttagcaactatcttcagttgcattaggttgagtgtgcattatgagtagaggacaatatatatgcgatgcgtgtgtagaatctatggtaataatccggtgaagtagttgaaaagaactggaacttctctactaaaaagagataggagattgcaatcatctacaacataacgaagcattgccgtcaacctcagctcccttgtttttattcttcctaattaactcagttgtacgaaaatagaatagtccagaaatatcatgccttgtccagttacatttgtaggatctgctggctaccctagcgcgtagtgaggaaggcttgaggttgagcagaaggtctctaacaagatgatggtgaactagaacatatcccctcaatgctaggcgctaacttcattcccttactgcctcctattttcattatgttctccatcactgaaataactgcccagatgtggctgttgcaagtacacacaaggaaatatactttactcatggcattggttggtaggatgctcggtctccaaaaattaatccacacaccacgaccacatatagagatctatattatgcaccgagagcatgtactagcactggtgcctgttggctatgcacaaaatcgcgcacccaattgctcgcactgtatgatgtattcctacaaggtgaactgagaaaaatagaggacataaaacaaagtgcagaagaacacaagaatttgggggcaattttgtggggatttcttttattggaataaaaagctacaactcgctacgtgccactcttataattgttaactactattacctggacggattgttgttgctactgttagtggtggctaaatatggtgattagttttgaaacgcataatgccatagactaagcattaactcattaattatgaattttctatttcgagaagtaatttttttaaaaaatgctatattggtagtccaagatggataactccatatatattttgattctaaattacggcatgttatagattgaagcaatgatctatgtccggtacaattagctaattagtaatgctagatgtatgaaccaaattatagggctgagtacgcacacgttatgagtaagtatgtttatactttatttaaaaaataaagtgctaaattaagagcccacgacacgaaataactccatattgatgaatttaatattttagaaaaaaaaatctaaactgtcgacgataccccctcggcacattgtattgaacacaaactctttataggacatacgataataaaattataatccaactaatgaagggccaactatttttggagttttctacatctctccgttgcacatgctaatattaatggtgacattataaatataggaattttgatattgttttaaaatttaaattatcttagagtgtcaattttagtatttttattaacgtacatgctagttgggcactgtaccaaacagctcattacgtagaaaaacaatcaacaaattataaaacaccgaaaaatacagaacaacacacaccagacttgcggggccacagcaggcttcccttcgtcattgtctggccagtggaggaaaacaaatcaaaactctaggaaagatcgaaataagaagctacctcaaaagacgtaccagtgttgtatctgtaaaaaatcaatctttttgattgaggaaaaaatagcaaggaggagaggtctcgatgtggtcgccacagctcgtgttggtgcagtcccacatctagatcgaaggcaggcttcatgggctttcaaaggtagattagttggccaatgacgttaaatcactatagatttatggtgcagattttgtaatccatctaaacgataggtcagatttttcttgttaacatgagggctcgtagaaagtaatcaataataaaggtatagacttgtatatagagtacatggaagttttacgatcgtgcaatcccacgacctccaacaactcatttagccgattattactttcagtgtatttacttggtgcgcatgaaatggttgtattgttaggctattgcaaacattgattggattaggaccaatgagatgaataacattaattagtgaccctactgcacaaaggtggacaatgtgccaagatggagaggggccagccaaagatggcacctgtcgtttaactgtccgaccttgttgacggacagttaaatatattatttattaattattgtggcctatattaaaagaagagtttggcatcaccaacacttctcttataatagtgtagtggtatatgatagatcatagataccactacactaggaaggtaaaatgcctgatgtattaaaacaactccctatggaatggaagaacaaagaaaaaagccttttagttggcttggccataaaagaatttgcctcgcttcgattggacctaaagcagttataaacctcaaccgagccaagaggaaacacaaatcaagccaaatgtgtcatccagatggtaacacaattatgaatgtacatgtgcaaatagtatctatacctgcacgctgtctactgtgcaaaaggaataaacctccaccagatgatcaacaacaaaagaaccacttgctgaaacacatgttccaatccacactcgttcacaatacaatattacggctacaggattcaatccaatccacacatgttccaatgaagttgtgttgttcttgctgaatccctcccatctcaaaagtaaacttctccaatctgcggattgctgcagtaaccacctactggatcgcgttacattcgaccatggtgtcatatcactcaatgcttgagtaggaattacctactggatgattatgttataaaaattgtctttcatatagacttgactagctgaattcggaagaacaccataagagaagaattctttgtactcgggattggctgacatcctcagtgtatttgggaatgtccatgattaaagattaatttggttttcaatttgctgtccaaatcatcctcattatctcgagtgcaccatattcagcctcgatgctggcttgatctgacccaaacaacttatgcggaggcttgaaaaacccaagcatgtccccagctgccatctgccacgtccacatatgaggtgaaagaatgaagttacggtctaattgtcctactaaggctccacataaaggcagtataattcaagtgaatttctactgcattacattgagatatcctaattatgggttttccttcctatatgcctcccattcttattacggtcatttctactaaaatactagtgggtacagttcacagttttattgacgatcgagcatggattgagaatttgaggtcgcgaatacttgtggccaagatatactacatggcagagtatatatatatatatatgcagaaattgctagctgcagtataattccaactgacatcaagctgtcaatgcttaccccattttgctgttgtacggtcgtgcagccgccgatcacgtgtcatgtattatagcccattatgtttggaatcactcccccactctactaacaaaatgtaaagtacaatacaacatattctctacgtacatacgaataaagtaaacctgcaaggttcgcattgctctagcccagtgcgactctgacagcccctaaagctgtctgaggtcgcccttcttcctgaggcagctaccggcaaagctggatgcctagaaggacagcggcggcgtggctccttcttctcccgacagtgaagccatggttgggttccaaggcagtctggagaatggacgtcacgccacccagatccagacctccatgacggacttcccaagtgccattagacataactgaggtcacctcacttagatactgcttccttccaatagtcagcatcaatagatgaatatgtctcttgtatggtttgtagtatcgtccacaaggtatacaatgtagtcatcatcgagtagcaacagtgtgatcctccttaggattttctatggacgtttgaacatcgtgttctatcagcacaaaagacacggggaataaaatagattcttgactagaagtgttaggtgtattcattttcaaaaaatatagtaccatatctttactaaaaaattttttacaaacatgcatgtcaggttctcttgaattcgaaattaagaatctatatactatgatgtgaatagcataaccaagaaacacacaatccacgggttttggtccaaatttatgctttttgactataggcacattgaccatagccaaacaaccccatataatctttgttcttattaggaattttattcagcacatgatacacaatcaatatagtctcaccccaccattccttaaaaagtcccgtagtgtcaaacatgacattcactaattcagttagactatgattctttcttttagcaaccccattagattggcgtgaatagggaggcatatcctatcatgaataattccagacttttcacggaatgaagtaagctcattttaaaaatacactccacctcaatcatacctcaaccgtttaattttactttcaagttggttttctaccccagctttatagattttaaagtaattcaatgtttcatcttttgtaaaatctagtgcaataatctcttaatctgacgagaggatgactacaaactcataatgctgaagtaaaaggctatgatgcatagtgtaggatttattcaattaactagctagcagccaaaaataagatttttggcacatgtttccagtgcccactcgtaggcattttgaacccaaacgactaataatacacaggttggacaaaattgatgcagtcaggaaggccctatttctccacgaaaagctaggacttggataggaattaatctgcgtatgcacaaggtactcttctttcggatggccaagacgacatgatcttgggagattacacattgaagctactgtgtctagatgaaccaatgtccctttatttgttcttccttacatttgatcggattggtaactcttggatttctttcctatgtacgtacacacacgtcccagtcttatgagagccattaatttctaaaatacaagcgggaactgattattgttgtaccgatggtatttgaggatgaattgagataatgaggtgttgaatatttgagaatctcgaagaagtgctttggcagagtatagacttcaaatttttgtactcaaacatagaagcatattgaagctgatctccttgtggtttaagtgggcttatctagtagccagtcgcacgatgactatattggaatccttgcatctatatgtcagatcctatctgtgtagattgtccatattgttactgaccttgccggagctcgtctgtgatataggcaacaacttgcaggttctgaagatgtcgctcgttgccgaacgatgaacaacagcttcagcttaatcaaggcacgccggtgacgttgtcttcaaggagattcacgccctcgccgaggtgcacgagacagacggcggctttcctccaagatacaatgatctcgtatcctcacccgtgcaatcggccaagaacgaaccaatggaatttcgtgggatgtaactctctctatgcaaaataagcagaaggatgtagagcaaaagcttcgtgtggtaatatcagcagcagtacgtgccttatatagccttgaatagcaacaagaaaatcctatctctaagccggataacaaacaatcaacagattgattttcgtcggcctgaatatctggaatgataaagactttatcttccacgtacagctcaaaacaacaatatcaaaacttgaaaccaaaatctgaacataaggcaaaagttcacatatgtccatttgaactaaactgaagaattgttggtacaaaatgaacagaaccaaagagacaaaatctgaacaaacatcaaacatcgtttgtgactttcattcagttataatcagaaggaaaatcacctgaattccaacagaccttaggcatgcgccgtgcaacaccactgttaaatcactaactgttacgtaccgtaaaatgacatagttaggcatatgctaattaatctgcctaactgtaatttaaatggctggatagaaagcagagctaaagctacaacaactataaggaagcccaaaaccttgcaccaaatctgtactccagacagtacaccgactgaagtatgcatgtcaatcctatcatgatatccaagctatcaaaacagaagcaataaacttcctatgatcgtcatgaatgaaagaatcagaatgaaatttaagaatatggtggctagctcatacacagcatgtttaaattgaagatcgtaaccgatatcctttgtgcatttggttggtccgatacataagaaggatcttacatattgtcatttgattattttggaggaacaacggattccttcttgtagactcataggtaagctgtaaaaagcgccatgatgttcaatcagatgacatcataacgtaaagaaaacaatatgataggttaaaaattatgattggatcatccacaacaacctcacaacacaaaccttatgtgctgcaaatccccctggtgttgcttgcgatagcatgttgtggcccaaggatttaagtcaacctagtcgtggtgagcacgtggtattgttttccttcaagagtcctcctattcctattgcagttcctaccttcattttagaagtgtgaattcattgtttcttgtcatgagtgcattgaaaaattgggatggtgagggctcgaacaatgtagaagttgtgtcggggtatatataaagaatggcaatgaattgaacaagatagaattcaataccatataacaataatgatactggattggcacaccggaaattcacaacggccagactcgaagtctcttttaaggcatgatgggaaatatttgtttgtattactatgatttaataacaatgtttgctagccactgaagcatgggtcatgatacagcagttaatataacagccattttatgtcaaagttttgtctttgtctatctctgataagcactcagcagacgggagggggataccgaggttggaagtagggccttggcctgaggaattggactagatggttctcttaggccttgttcggttgggctgttccaggccgggatcggggcccaatccctgtggatcaccccggcgaggaaaaaatcccggcccatgcgaaattgtgcgttcggttaagccctgccgtgaattttagcccggcccaccacggggtttccctcttctctaggcccgggaaaaaatcatctactcctggggtgtggaaaatttcctcgagaggaggcagcggcgtaacgaagacgcgacggagggggcggcgcgcggcgcgacccggaggcgacggcgacggcgacggcgacgacatggctctctcctccggccgccaccttctctccggtgagcacgctgcctttccccttcttccctcctcttgcaaagctagggttagggttttcttctcttctccctttcctgtcgtccccgccatctctcttctcgccgtgcagctttctggtgagtgagcgcttagcgattcatcgtcctcctcctcgtatcctgctcgatctggtgagttcttgatttgggcgtggagctttttttcttggttgggtggggatgcgttcttgatttgccgccgccaccgcaccgcccaactctggttcttgatttgagttcttgattcacggtggctttgaggcagcagatggtgagagcgagagctgtacggtggctatggaaacatgcttgccttgattagttttgcttagtgtaactgatgctgtgatgcttgcctgagcatgtcttgtaaaattgactatacaagtttttacagtgaagtactcagttcttggtgcttccggagtctcaacttgtggttgttggttatatttctgtttggaaattacaagggttggggtgtcctgattttgaggattgtagagctatggaggtactctgtaattagtttaacatttctgaattgtaaactaattctatcgtcattgtttcacaaacaaactagcaacaaattgcagtagtatatacagtaatgtatacttaaactgatttattttaaactaacaacagtagcttttagtctcattagactaacagatttgttttcctcaacatgatacttgtataaaacatgtttatcatagctattcaagcactaatatgtctagtgttaaatgaactgattgggtgattaattctgtacccatgttataatgtatttgatgatgagatccttctatttgattgaaaaacagcagctcctactttgatgctagctagctctagttctgggttttatgtaactctagttctagttctgaatttgagttgtcagtgatgtgtataagttgtgcttgttttgtagattgcacttgcacccatgagagttggagaagaccaacctcctccttcctgggaccttgtaccctctccttcctgggaccttgtaccctctccaagaggtactagatctatttattccctttgctttaagttgtttatctatattttgtgatgtaaatataaaaaataaaagaagtggtgtaatgtagaccaaaatttcttttcctttcaacatacggttaaatttgtataaaaaagcatagagaatatacaagttctcagatttttcagatttctgaattctgaacatgctcggtgctaactaataaaagatcatctgtaactaaatttgacaactaaatttggtaagtgctactgccatgtaatctgctttttcatacatcctgtaagtgctactgccatcaattattgttgcactgtgcactctttaagaaaaaaagatccttattgttcttttcatttttcccatcaatttttaaatatgcttcataacttggatcttcttaagattaattcccatagtttagtgattcttgtgtgattatctttctagatcttttgttgctgtgctaagtgcaaaattgtaaataatttgtgtgctatctatagtactactatggatatgagagcaagagaccacgctagaaagaggagggaagaggaggacgatgatatgatgttgtttattttccctgcactacatttgttgagttctagtggagcaagggaaaagaagcgacgccatacatcaaagataacaggcgaggagcgtgttcgggagttgcttgaagggcatgtaaaaaattgccgggtagcattcaggatggagccggaaatatttatatctttggccaattaccttagaactgaaaagttggtcgatgatactaggattaaagttaaagagaagttggcgttcttcttatacatgcttagtcacaatgcttcatttgaggatttgcaagagaaatttgggcacagtggggatagctttcatcatcacgtaaagcatttcttcaactcagttgtcccttcgctctcgaagcggtttctgaagcctccaaatcctaatgaagttcattggaaaatagaaaaagatcctagattttatccctatttcaatatccttattaatatgttgttttacatttttagaaaatcatatgtggtttttttttttgctgcagaattgccttggtgcaattgacggcacccatatacccatatctatatcatctgacaaagcagctccatttagaaataggaaaaatactcttagccaaaatgtgatgatagcttgtgattttgatctgaagatcactttcatgtctactgggtgggaggggtcggctacagtaccccctggaaagttctatttggttgatggtggatatgccaacaccaattctttccttgcaccatatcgtaaagtcaggtatcatctaaaggagtatggggcaggtcggcgtagacctcaaaactacaaagagttatttaaccatcgccatgcggtattgaggaatcatgttgaatggactttgggggttgtaaagaagcgcttccctatcctcaaagttgcaactttccacaaaatcaagaaccaagtgaagataccagtggctgctgcagtgttccataatattatttgatcactgaatggggatgagcaatggttaaataaccaaccacataatatccatccaagcaattatgttgacctgccagatggtgatgaaggcaatgatcaaagcactaatcaagggaatcttttgagggacacgatagcacatcaaatttggaatgactatcgacagcataggaattagtgggttgtaataagtagtatatttgattttcttttgatgttttgtgagctgtaataactacgacatattacaaatattatgttataaatgaactatggtggttgcatgtgacatacatttgctacaatgcttttgttatgaatattgtgttatgcatcctttctcagttaatatgcttctaagaggttctccaaggttgaccatgcttttagcgaaagctgcacaaaagaagaactctccgaaaggtcatcctacaaaaaagcatggaggttctccgataggtatgcaattatagaacatgtgaaattcatgtttgaaattattaaatgtagattatacatcaattcttatcttgcgtagaaaaaagaagagcctcttggaacacagccctagagaagattcttgttgagttattgcatgagcacaacactcctgagtataggggtcagaatggatggacttcagaagcttggaacaaaatcgtgaaggaattccatgagaaggacagatatgtctgcttaacaaagtcccaaatccaagaaaaggagaaagagctaaaaagagaatataggatgctgaaagaggctagaaaacaaagtggagcttcatggaataaccagagatgcatcattgaggctgagcctgctatatagaacaatataatcatcgtaagattatttctgaccattacttaattttgtagttaattacattatgcatctttttagtgttttccttttattgtgttgtcatttcctaaagccaagaagtttcgcaccaaatctttccctctatttgaggccttgggagaactttacgatggttagttctatcacaagctataatccttgttttcaatatcacaagttataatcatgctttcttgcttaccctttctagtactcaattttcttgtgtaggacatactgcagaaggaacctgtcacgcccggaatttctatccaaaattccaaacgcttacatgtgtgtgaaccctcgtccaggaatcagccgagggacacaataacaaattgataatagagtacaattattactctaattaataagcgaataaaatgtcattacagaggtagatagttcgtctcaatcaataaagatctaagcagcggaaaaataagataaacggcacagacgactccactccacaggcagcttgaccagggctacacctaatcctccacaccatcagcatcactgtagaactcttcctctgatgaatgattgcaaggtgagtatataacatactcagcaagccacgcaacaaatatggaagtgcacaaggataccaaagaatggcataatatagggctcatttgcaaaagcagcatttagcaaatatttgagaattataaaacagtagagtaattaatcatcaattttaatcaacactaaacagcacacccatgctgctcaggcccaaccatcctgaacaaccatacccggctgtacagatctatctccaaaccaggaatataccattccaaaccaggagctaaacaaattattaccagttatagcatcttttattatggtgagaagtgtgagactaatcacgaaagacattgttagacccgcccataaccgcgggcacggctattcgaatagttttactctggccagaggtgtaccactgtacccacaagacacagcaccacaacatgtcaccatgtgcctcaataccaccacggtacctcggaaaggagctgtgacagtaaccctcgtacaacacaatccaccacagcgcacctttcctggatcataatcacccccttataaacaaggcatggactccccagcgacccccgtgggcttatctccaccacttctcagtctggtgctccgcaatgaaccatgctatacaaaaggtaaagtcgttgcccacgctggcttgtggttggcacggttaatgtttcacaaccgaaactcgtgaaccggtccttaattgtcatgagcacggctctcaaaaccatgtgctcacaacccaccattatcaagttttagttggcaagtaattaattaaccaatcacgattgaccatcgtgaactatcattaagccatcattaaataatagtgagtcataagttatcccaatagtgtgctaatgtttctaagcatggctaagcaatcatatctaatatctagctgaactaatatatatagcccaactagtcaagttataataacccaaggtatcaaggaataaagtaatcaagaacaaaagggctataacaaacaataggttaattccacccaatgacattcgaaaataaatgcaatagttgaatagaaacaatagctttaaacgggatcaacatgctcaaaggattgtttgggatctgtgtgacttgccttgctggccttggaactcttcaaaatcttctcctgcaaactcagactctccgaaaacgtcggaacctaaacagaaaagagcaaaatcaccaaaacagcacacaaaccagcatgaacagtacatgtagatatttttaacatgtagatctctattttagaaaaatttagagacttgaaccaactaaatccgagctaagatgaattagttatgtgttttcaaagattaaatcggattaaatcattcatttagattttaattgaattatgacgcaataatgaattatttttgaaaaagaaaagggaattattgcgtcagcggctagggttcgcggtggaccgggtgcacggcggcggctcacggaaatgaacggccgagatcgatcctatccaaaacggacggccaagatccatcggtccacgaccgggccacggggaacgacgacgatgacgtcggcggtgacgtcaccaccggcggcggctcgggcgtgcatgcttgccggcgaatgacggcatgacagcgcgaacggagggcacctatgggtagcggacgacacggcgaactcaccggtgaccaaagtagcggcggaggggcaacggacggcgccggcgatgaggaaaagggggcagagacgatcgggtcgacggcggcgacggtgctccggcggttgacaacgacggcgaagggacggacgacgacggcgatgagacggcgaccacgacgatgacctccccgagtgacggcgatgactggagcgacgatggcgcacggctagagcggcggcgacgacggcgacgcgaggctacacggtgctagggttctaccggcggcgagagacgaaggcgagggtggcgacgggtagcggaggacctgggggtgcttatatagggactagggcgcggcggcgaaggcccacggcgaccggcgacgcgatggaaagattagggttcgggagagagagacgaatccgattcgagatcgaatccgcgaatttccaaagcgatttaaacgatgtttccaaaagggaaaaggtagagtggatcacggggatcctttcccctcaattgatttcaccggaaacggaaagggacggccggatttggaaggagatggcggcggcgcgccgctagggctcgggcgatggtgcaaggaggacgacgacgacctgacaggcgggccccacctgtcagcgtccgagggcgctcgcacgcggctgctgcgggcggactgggccggcttgggccgaggagagggagagagaaggttttgggccgactttcgacccaaaggcaaaagagaacttttaaaaccttttccaatttaaattattcatgaaatgaaattccatttattaaaaatacttccttagctcaaataaatcccagaaaaatctaggaattatagaattaagcaaagtatttaatgaaattttatctggccccattttatattggaatttattaattaaaactagatcttctcttctaggcttttaaaataaattctaataattccaattaaacaacaatttatatatttaggatttttagggtgtgacagaacctacaatttcacctcaattgagccattgcaacattcaatcattactcaagttgagagtgatcaagatgatcttggtaacactgagattatatttccagattatgaggacaccttggcttatcaagtacaagatgatgcagatgcaactgaagatgataatgcaaatgcggaaaggcttaaagagatgccgcatagaagggttgttgttgtaccaagaaacaaagaagaaaaagaacccaagaggcaaaataagagtgttggcgtagaaggacttatggaaaggtaccttgatatgaggaccaaacaaactgaagatgaggctgcacaattagcaagagaaaaggaggctcagttagcaagagaaaaggaggctcatttagcaagagaaaaggaaagtaatgatttttcaatcaagaggtgcatatctgttctgaattcgatggatgtgacaaaggcagaaaaggtcaaagcatataccgtcttcaagaatgcagagaacagagagatttttgtgagtgcttgtgatgaggatccagaatctgccttgagttggttaagaagtgagatggcttgaaaggtaccgcttttcttctatataaatcttttttggtctgctaggcaagtaagatgggcttcactctgtcctgtgtgactctctgttgttagttacatgcatgttgtttagggctgtaaaccaagatttacattatgggctactcacctttcttttattttcttgagctgataagctcactcaagtctgaactgatactactcttagcatctgaaaaagctaaacttaagcagtatagcggtgcaattttacttactttgaagcatctgctttgctcctgataaaagaatgttttttaaggtaccgtgtggctctagttatgtacttcattattctggatttttcacattttggtccttttaaaaaacttatttcgcaaatagacccctagaaaaacttatcccagaaatggtcctttttgggacgccagagtggctggcgccattatccaactggac

SEQ ID NO: 80213 - DNA, 34550 bp, Oryza sativa
tattatgccatcctttggtatcctgggcacttgcatatttgctgcgtggcttgctgagtatgtcatatactcaccttcaatcattcatcaaaagaagagttctacaatgaggctgatgggggggaggattaggtgtagccctggtcaagctgcctgtggagtggaaccgtctgcgccgtttatttattttccgctgcttaaaactttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattgcgtgacactagatccgcccaccaaaaagaacgccgccgccacttctgctggatctgcccacgggagcaccgatgtcaccgccgctgccgcaggacaagcttgggcgtggagggtgaggaggaggtggtagagaatcgcccgccggatccgcctgccggaaacaccgccaccgccaccgtcaccggatccgccaatagtagccgccgactccaccgccactcccggatccggcccgcgggagcagctgaagccatcgctgccacctcctctgctaccggcaagggagagacgagagggagagagagggaccggtgggagaagagacgggggcggcggcgcggcgctctctctaactctcggctgttggcaaaggaggagagacggggattcgggagacggagaaagcgaccagagagaactgagaagcggaggtggaggatttcagagaaggagataaggttcgataggtgggcgggtccataccaattttttttctttaccgcgctccaacatgtatagggtgcaggggcggacacactaacgttacccatatttttaaaatgtagctacacaatgtagcacaatgtcgatgattctcaattggttagactgaaacatttgaccaatagttcatgagttcgattccatcgatctcttcgttttttccattttatccaattcctttcctaacctgatattttgctggttatcctctactgttcttttcccttttctctctaattttatccttttcctttaaaataaaaatgatatggcaagaacaaacatgttatcctctactgttcttttcccttttctctccaattttatccttctcctttcctaacctgatattttgctggttatcctctactgttcttttcacttttctctccaattatatccttttcctttaaaataaaaatgattattgcaagacatacatgtagaatagaatacgaggttaactaaaattcagaaaaaataaaataagctccaaaaaatagaaaaataaaaataagagttcacgtagaaataaaattttcaaataaaaaaggaatgaaaaaatacaaattgtaaaacaatagtccattaaaaaaatacaataatagcaaatgataataaagagaagaggaacaacagacctataaagcaatagtgtggtgacggttaatgggacatctgatgaaaactattaacaaaaccgaaaagatgattaggttcgatttttagaatcccaacgatgattaagaagaggaactacgggcaagtcgttaagcaacactgtaatggcggttagtgggctagaaagtaaaaaataactaaaattcgaaattaaaatatgtaatattgaaagaaaagtccatgtaagaacatttttttcttttttcattgtcttttgctgtttgcatattggcctttttttcattgttattcacaggttgaatgaacgtcacaaattcacagatcgaatgaacatactcaaattcacatattgaacatcacatatcaaatggacaccgcaaattcacaaatacatctaaaaaatgttcatctaactatttttctattttcggaatttattttatttgttattcaaaattttaattgatctcgtcatgtgttttaaatggtctcttcttttaatagatttaattttttattatgaatttttaatttgtattcctaactaaactcttatttttctttttaaatttcatattttattttatttttatttagaattttaattaatctcgttttgtgttctatatggataattcttttaatattccttaattattgtttcgattttagttgtttcaaaattataaccctacttgaactctctttgatatttttctaatttcagatttttattttatttttagtccaaattttagcgctacaatttttagtccggttggtgcggaactaaaaattaccaaccgagacaaaagatagatctttagtcccggttatttcaagcgggactaataataggcatctttagtcccgggttgtaacccgggattaaaggggctgtgaagcaggactaaaggactaaagatgagttccctagcagacacatgaagaaataaaattaacaaattttattatttttatttttctagttgtagatcaaatagaaacttgcatgtttgtgtacagacttatatcatcacaattgatgttactaatttttttattttttttcaataactatttaagtcgcacataaatgttgggtgtcatgacacctaggtacagagaatcctaatctctttattgtacccttcctttttttgctttgaaactacactttaagactttgttcttccacggggtaatgaagattggagaagatgaccagttcgaaactgcactaaaagttccagttcacctatctttgttacgctggttgcttgacgaaacgagagcatagcagcagtgtatccaaagtattctgcaaattgagatctattgttctgaattttagtatacttatatgattattgtgatcatgttatacacatttagatcttttagactgaactaagtaactaaccattctcaggggcggatccaacgtggggactcgagtcccccctacacccacaagacccatggatacccccagagcaccttctttaatttttttcaccataaataataaactaaaggtctttagatggctaaaggttagagaaacaacgtacttgaggccccccaattttctgttgctggatccgcccctgaccattctagatctcagccagagatggggatgaattaggacaaaacaatgtttcggtagtaatctatgcagtcattggacagcattagctgaatatcatatgagatctatcaacaatgaacacatgtcttgcaagaggtctcttctgttggtgccttcgatcatttctgttttgttaatatttctgagtttcttacaactccaacatttccaggccctctgtaaggactaggatatcgactgaaaacaagaaaagtatgtaacaaatatcagttagatatatggactgtttgattggattgttggacagaggaaattgtaggaaaagttttctggacaaaataaataaatgcttggaaatagacagcatcatgtaaactaaacacattgctcacattgccaataggcagctctctaaagagcaaaccaattgcctcacgagctgtacatatcccttgtaaatgtagaacaagtaaaatgaactaaacatgactaatactcctgtatggagcaattaacgaagatgagtcctccaaaccaacttgtgggtatggataaaaatctaaatatgacaaaaattatctcgctatacaaatcctatgagtgagaaaacttgcaaacctagcgaggtgtgatggacgttagtgtcaaacttgaggacgacaacggctgcccctccgctgaggccatcggcggtgcatatgttggcacgggcatcttagctggtaacacgggtagtggtccattggattggagaactgccatggcagctctgatagatggacgtgcacatcggtccggatgtgcacaccagagtccaacagccatgacacactccatgctagttgtgtcgtattcattgttgagccgctcgtctgctgcattgagaacggctccttggccgtacaggtcccacacccattccaccagtcggaagaggcaattgttctgggtgtcctgcaggctaattggtctcctcccacatgccacttccaatagaacaatgccaaaactataaacatcggactcagcgcttgctttgcccgtgattacgcattcgggatcaagatagcctggtgtccctgaggggtgagtcattgtttgtatcccaacggcatggtcaataagccttgcaaggccgaaatcgcctagcttcgcattgaaggattcatccagcatgacgttgctcggcttgatgtcacggtgaactacacattgatcccactcctcatgtaggtagagtagtgcagatccgagtccatgaacaatgttgatcctgtggcaacatccaagttagcagatgaattgaatttcaaaggtgtcgattgcacataacgaaaattactaaatcaatgagttaattaataaacctcattggccatgtaaggaaggtgccattgccgtggagatggacgtcgaggctacggttggggaatagctcgtagacgaggagcagctcggtgcggccatggcaccagccaatgagctgcaccagattgcggtggcgtagccggcttattacctttatctctgacttgtactccttcctcccttgcttagaggaatttttggcgaacctctttatggcgacggcgaggccaagctctctgaggtagccccgatacactgcaccgaaaccgccttgcccaagcttctcctccggcgcaaagctcttcgtagcgtcgacgagctcgtggtacgggaaccgccttggtcccatccccatctcaatctccacgatgggctcgccgtcgtcgtcatcgtcactgccgtgccagcctccatcctctgcctccctccttttcttgctctgacgtcgtcgtacaaggactgctaccatggcgaagaggagaatgacaaacattaccgcaccaagtgtggctcccgctacaactccgccacgtctggaatgcgacgttatcggggtcagggaaggcggtggtggtgacggtgacgacggcggcggcggagatgctacttttgctgccagcttctgctcgaacgacgaactcgacttgaagtaccaagaagtcagctgatgctgctcaaaggctgagcccgttgatgccgagaagccgacggtgacgttctccggcaaggctctcttgagatcaaccatggagctgagggtgtaaggcgtcgtcgtctcatttatccatagcttaattgacagtattctcgaattgttgttgtagtcgacggtggcggtcatgttcccgatgaggctgaagtttggtagggactcgttcgtcacagatacgacggagttgacgtcgatgccgatgtggtcgttggttgtgttagggtcgaaggggttgacgaaggtgtcgaactcgacggcaacgaaccggttctggccggtcgagacgttgccgactgtctggttcgttaggccgaggttttcgccaccttcgtggcccactggtaacctcgatggatagctggtgaggaagaaggccataccgtcgccctttttgcttctatcgctcggagcgataatgttgaaggagaagcgcgtggtgaagctggccacctcgccggtggcggcgtcccagagctgcaccggcggcgcgtacaccacccgtccggcgctgttgcccatgcccgacacactgttcgcgcttatgtcgacatacccgacgctgacagaggcttggccttgaatgtcgatgttctgattgtctgaggaggcgaaggtggggtagttgaaggacaaggcggcgacaggagccggaggctgcatgtagcagacggagaagaaggtgacgaggccggcagcgcaagtgatcaacgaaaagccggccatcgccgccggccagagccagcgtcggcgcgcaagccgcaaggtgggttgatcggctggcttgacttggagcaacgagtcgatgcacaatgcgtacactgcttgtagtgcactggcagtgaatggtgccccttctccctggaaaaaaaacccttctttttgatggagctatgtgaatgtggaactatggaagctggactacaataattgtctttgtcgagctgaaaagaacaataccccaaaaatcaacgatgctgctacaatctccatgatccatcggagagacggagaaacatgcataattgtaagtaaatcgtaatgttcagacttgagagatattcagggttgcctcatgcagtcgtttgacgcagaacaagagcccagcggtcagtcaatggcccagcttatctgaaactatattgtgccaactccactgatcgatcgatggagagtgatgcggatcgcagaaagactttaaagactcccctttggccgtggagtttagtctccgcaaatttgagctttgttgtcatctagtacaaccgatcgaagaccgaattaagtgctgagttccagcttgcagcatacacgcacacgaccgtcaccgtgttgaaaaagacagtgaactctctactgacagtatgagctttcaattacttttcgagaccttttacggcaattgcgaggtatttaaaggtatctggaggtggaacaacgtgtacccttaatcaagagaggggcaaggtacgaaacaaaattattgtaacatgatggcaatggagtaattaactagtaaaacatgggcattatacatgaattgaatacctatatccatcgatcagtatatcattgtgcagattggtatgtcgtgaggaaaaaaaagtaaatcacggatacaccgttgatttagcagcgatcaattcgatctgtaccaaaataaacagaaagatcgcatctcctttcttctctcccttcgcttcgttcttgttctagggtttgaacggttcaacggaaggagacagaggaaaaagcgtctgcatggttgagggttgaagaggagatgaggtagcccggtcgatgactaggcgcaagctagcgcatctaaaagttatcctatgcttattcacacagttgtttagttatttatgtagtttataaactccttatataaggtactggaatttctgtgggatagtaaatgagatctccgcctatggtgttcttctagtgtttgaacaggtgcactcacgaggagacacggtcgaggaagaagatctggcatggtcgagcatttgacaggaggcaagacctgattgacatgtgcaggttataagaacacaacgtaaatctagagaaaaacacgtaaaagagaacatcaaagaacggtgtaactctagataaaatgatgcaacttaagaacctgtaatgctagtgccgactaaacgacttaactcaaacacaacgtaaatcaaatctagagaaaaccacataaaagagaaaatacgcaaataataacatgtaaagctggtaccggggaaattaatgttaacttcgtacgggagtacctacgcggtaccgattctaattttggagacaattctaccctttttgctctaatagtaaaattatatttttatccttagtacttaagtacctataccaatagttaaataccttttacatgatacctatgattgaggagtgttggatcttataccttttttggaatgcaaacaccgtaaaaaagcctatcagattttgttgaggaaattgcagcagtaaagccactgctgaccctatcagaaccaactcttctctttcaaattttggcttgatcactctgtgaagtagcagagatgtcaatcttggacgatatgcttgctgcatgaatctcttatgtcttaaatctggcaattggctgctgttatttttgtgtgttaacaattttgcttcgatgttctcgattccgcgttcaatcaacaccggagtactgaacataaatatccacaatttgagacgattgcataagaactgcttcagtagaaaatgattggaggctctttgtgctcttgtttacagtagctagagcctatattctatttattttattaaatttagcttattaattatatctaggttcctgttgtttatcgacgaaaagcctgtgatggtagtgttacctatcttggttcctcttgttaacgccattgtgttgcatgttgtttttcctctttcttgtgcctttacttttcggattgagctttctcattttgtcttgaaagttgaaacaatactttagactttgttcttccacggtaatgaagatttggagaaagggaccagttcgaaactgcactgaaaattccaattcacctatttctattacgctggttgcttgacgaaatgagagccaacgatagaagcaacatgaatgaaacataatgtatcaaaagtattctgcaaattgagatatattgttctgaattttagtagtgtgatacctatatgatttttgtgatcatgttatatacatttagatcttctagactgaaaccattctaggtgttagccagagaagggaatgcattaggacaaaacaaaagtttaagtgataatcaatgcggtcgttggccagcattagctgaatatcatatgagatctatcaacaatgaacaaatgtcctgcaagaggtctcttctattggtgtcttcaatcattttttttttgtttatgtttctgaatttcatgcaactccaacaattccagaccctctaaggactaggatatccacttaaaacaagaaaagtatgtagtgaataacagtcagagatatggacggtttggttggattgttggagaggaaattgaaggaaaagttttctggacaaaataactaaatggttggaaaactgaaagcatgatgtaaactgaacacaattactcatgttgccaattaggcagctctctaaagagcaaaccaattgcctcatgagctgtacatcctattcaagcggcaacttgtaaatatagaacatgtaaaatgaactaaacatggctactgtacggagcaattaacgaagatgagcccttcaaaccggctaaagtatgcgaaaggaacttgaggtgtagggatgcaagtagttcgacttgttggtatggataaaaatctaggagtaaatttcacaaaactacaggtattttgaccaaattatcacaaaactacagatttaaagagctgtatcacaaaactacacatttaacaccaaatttatcacaaaactacagattttaggttaactatcacaaaaatgcatatttaatattgaacttatcacaaaactacaacttttagagtttaaatccctagcactattgttatggtggagctataaacattattactttgtgattaaattgattctaaacctgtagttttattataatttagttactaaacgtgtagttttgtgacacttcatcttaaatgtgtagttttgtgataaatttggagctaaatgtgtagttttatgatacaactccttaaatctgtagttttgtgatagtttggtcatagtatctgtagttttgtgaaatttactcaaaatctagatatgacaaaagttgtcttgctatacttatcctatgagtgcgaaaacttgccaccctagcgaggtgtgattgatgttagtgtcaaacttgaggatgacattcctgtcgatgatgaaagttgcccctccgacgaggccataggcggtgcatatgttggcacgggcatcttggatggtaacactggtagtggtccattggattggaggaccgtcatggcagctctgatagatggacgcgcgtatcggtccggatgcacacaccagagcccaacggccatgacacactccatgctggttgcgtcatagtcattgttgagccgctcgtctgcagccttgagaacgactccctggccatataggtcccagacccattccaccagtcggaagaggctattgttctggttgtccagtaggctcattggtctcctcccacatgccacttccaataaaacaacgccaaaactatagacatcagactcagcgcttgctttacctgtgatcacacattcaggatcaagatagcctggcgtccctgaggggtgggtcattgtttgtaccccaacggcatggtcaataagccttgcaagaccgaagtcgcctagctttgcattgaaggattcatccagcatgacgttgcttggcttgatgtcacggtgcacgacacattgatcccactcctcatggaggtagagtagtgcagaaccgagtccatgaacaatgttgatcctgtggcaacatccaagctagctgatcagttgaatttcaaaggtgttgattgcacataatggaaattatgacaaattaatgagagttaattaaaaacctcattggccatgtgaggaaggtgccattgccgtggagatggacgtcgaggctacggttggggactagctcgtagacgaggagcagctcggtacggccatggcaccagccgatgagctgcacaagattgcggtgacgcaaccggcttatcaccttgatctccgacttatactccttcctcccttgcttggaggaatctttggcaaacctctttatggcaaccgcgaggccaagctctctcaggtagccacggtacacagccccgaagccgccttgtccaagtttctcctccgtcgcgaagctcttcgtagcgtcgacgagctcgtggtacgggaaccgccttggtcccatccccatctcaatctccacgatgggctcgccgtcgtcgtcatcgtcactgccgtgccagcctccatcctctgcctccctccttttcttgctctgacgtcgtcgtacaaggactgctaccatggcgaagaggagaatgacaaacattaccgcaccaactgtggctcccgctacaactccgccacgtctggaatgcgacgttatcggggtcagggaaggcggtggtggtgacggtgacgacggcggcggcggagatgctacttttgctgccagcttctgctcgaacgacgaactcgacttgaagtaccaagaagtcagctgatgctgctcataggctgagccaattgatgccgagaagccgacggtgatgttctccggcaaggctctcttgagatcaaccatggagctaagggtgtaaggcgtcgtcgagccatttatccatagcttaactgacagtattctcgaattgttgttgtagtcgacggtggcggtcatgttcccgatgaggctgaagtttggtagggactcgttcgtcacagatacgacggagttgacgtcgatgccgatgtggtcgttggttgtgttagggtcgaaggggttgacgaaggtgtcgaactcgacggcaacgaaccggttctggccggtcgagacgttgccgactgtctggttcgttaggccgaggttttcgccaccttcgtggcccactggtaacctcgatggatagctggtgaggaagaaggccataccgtcgccctttttgcttctatcgctcggagcgattatgttgaaggagaagcgcgtggtgaagctggccacctcgccggtggcggcgtcccagagctgcactggcggtttgtagaacacccgtccgacgttgttgcccacactgttcgcactgatgtcgatatacccgacgctgacagaggcattgccttcaatttcgatgtactggttgtgtgaggaggcgaaggtggggtagttgaaggacaaggcggcgacaggagccggaggctgcatgtagcagacggagaagaagatgacgaggtcggcagcacaagtgatcaacgaaaagatggccatcgccgccggcgagccagcgtcgatagatcgtgtgcaaggtgatactgatacagtactgtgatactagtactgtgtactgatcggcttctccagctggaggagcaacgacacaacttcctatactgccagtctgagtctgtatttgaggtatcctccattggacccgttctcggcctggcgcgtgacgacgaaacaagagtaagtcaaaccacatgccactaaagtggagtattcgtttcgtacttatggtacaatgtcactgaactcttcaaataattgatactagcatatattactgtctgtgtctcctctagcactaaaataaatatagactgtagccgttgtgctccccaccggccgtggcccgcggtcgaccccgtaccgtacacgctcaccctctagttactgattggactaactgtatttatggcgtcatatttttcattaaaaaatagtcgatatgtatttatattgtaagtctctaaattacatatgtaattttaatgtatttacaatttaagttctaaaattgcatatgtaagtcttaaaattacatatgtaaatcttaaaattacatattaaccatatgtaaatgatgcgtaagtggggtgtaactagtatgtaaatttgtataaatatataattacaacaataaagtcaattgactgctacaaacccatagcaactccggatcaacaaataaagtaaaaaaaatgcaaagggataaacaggtggagaaacggatgtgcatcgtgcacacgatgtccagcgcagcgcataccagccgttaaaatccgactgtactcagccacataatgtggcgtcactttttcagcaaatccgttttaaaattagttttttttctccactatccatctagaaactacaaaccacataatctttagctgccctttggcgcattttgtttggtgtttctgtagagatgtgctgaactgggatcatgttcctcttaaccttggtgacttctttatccttgctgacattagagctgaattaaacatatagctgtgaaaattgccctgcttgctgccatttgctggactctatatatggacaacgagaaacaacatcgtgttcagggataaacttgtttactcacccctaatactacctttccaaattgtctctttcttattgcagtggagtcctttgcatcggctggagatgaagagtgatctagagaagctggtaaagaggtttaaggagagaggagctgctctaagacaaaacagaatacgagttgattgatcttgctagccccatgcaatgttttggcgtttggtttgttttagattgctgccgctttttttttaacgagacggtgcgaagttctattgatagagcaggaaaaaattacaagattacaaccttggaaggtcgtaaccaggaaaaaggaaaaaaaatatactaccacccacacaccgacagcgccaacacacagatccgggagaaggctagcaccggaccggccaccgctaagcgtgaccgaccaccgctaggccaacaacgggacatagacgagatcgcccaaaaacgcccttacaaccaacacaaagcccgactctattcacgtcttccggatttaaggagagggggtgagagaaaagaaggaacacctctccccctagggcctccgacgtgaccaacttgtaggaactaggatgctgccgcaagaggatgagaatctagagcgtgcttgcaccaattgctcgagtgatttcggcaaggggatacctaaacgacgtctccaaggagagaagcgatggaaaaccaacgccaccatccgtcaaggtctcaaaagagccaatactgggcttttgcccggcaaccacccttgaggggtgagacggcacgacaacgccctcaggagggagaatgacactcgagcactgatgctgggttttcacccaccgctcaccacctgcgagtccacggctgacgcaccgatgctccaccgaccgcccaacctctccgacatgtgggaccactgcatcagcgccccctgcacagaaaaatcgattttcgtgtgcaggcctcttaactggaacgcatgcgaaaatttcaattttcgtgtgcggctctttaagaggaccgtacggaaaaatcgattttcgcatgcggtccacaaatcgattttcgcgtgcggtcatattaagtgaaccgcacgcgaaaatacctctccctcgcactcacttcaaatttttcacacctcctctcccttcctttactttttattttcactcctctctctctgtctctcactttccttctctatctctttctccatctctttctcttctccactccactcctctccgtggctggcgacgaggcgcgtcgaccgggtgggcgcgccggcgagcggcgaggggcgacggcaaccggctcctaccaggatccggccgcggcggccgtcccccgcccggatccggtagcggtggcagtcggcgcgacggtggcggcggcaggcgagctcgacggtgacgacggtttcgacggtggcaggctcgatagcgatgacggttgcggcagcggcggctgggtgcggcggcggcgcgacgacagcgacaacgccgggagtggcggcgggtgattccagggttagggttaggattttttatttttttattttttttttgtgcgtgcgggcggtataatttgaccgcacgggataatcgattatcccgtgcggtccacttaacccgaccgcacgggaaaatgattatcccgtgcggttgggccgcccgcacgtgaaaatattgattttccaagacccctgagtgcagatgggcaaaacctctgtacggaaaaaacccatttttaccgcacggaaaaatgcttttcatagtagtggctccgcgtgaccgcaaggacggcggcagcggggcttcgcgcaccacgcgcttgtggcggccgggggagcctccggaggtggcggcggcggtagctttcccatccagatccgggccggcactggccagatctagcggggcgccgggagctagcggttggcggtgggggaggggttggcgccggggctagtgacggcgcggagactggcggcaggcacgggtggcgtcgtggtgggtgggcagaggccactcgcgccgaagttgcagcgtcggcgtcggcgttcgtctgcgcgggtccacagaggtggcgctgcgcaggcaggggctacggcggcgtggtggttgcggcgacgatggacggctgtggcgcgcggacgtcgaagccggcttgctccaccctggatggatctgagcgttcgtggccgaatccgtcgcctccgcgcttgatctggccagggcagccagccagcggggcggttgcgtgtggtggcgttgcatggctcgggtgagctccgatgagctcgatggctgcactgcgtcgcctaggcaggttccagtggggttgctcgctggcgacgagcctcttgctcgcgatgtgcggatgtggagttggcgggacgttggcttgcgttggcatgaagcaggaatggggcttgacatccacggcggtgtcttcctcgttgccggccgagtgttctccctccttttggtttccaccttctttggccagaccctgttctggttgtggggaatgctagggggagggcggaggctccaacttgctgtaggaatttgcagcggattgatggcgtttcgagggtggccaagggcacatccttgccgttggttacggtcaaagtatgacttcttgtgagacgccatggacttttctgtggccgtcgatgtgggggtgcttgtgtgggtgatatgaagacactagtgaaagccttgtcgtgcctttggccagttcgacgatgacgacgcccgtgggtgccgtttcccttcttggaggcgtcgtcatggcgttctttcatatccctcacaaatcttcaggtgaaaaaattgttccggatttcggacgagcggcggcggaattacgcgtcgtgtcctccttggaggcatcgtttcggagaagttcctatgcatcgacgattgttgatggcctttttcggttcaaaagctttgatactttaatgttcggcgaggccttcgccttcttaggtccgcttcgttcttgtggtgggtgacactctcttcggttgtttctactgatgaagtcggagctgctcgctgatgaggtgcggtgacgcttggcaacggtgacatgttacagtctcttccaaggagttggtgctagtcgtgtgaaggaagtggctctttgatggcttggctgatgtccattgttggataacggagctgcttttcgatcgctttggcgactttcgtggtttcagtgtcgctgcggttgtgaagtcggcgctgctgggtcgcttgggcggctagctcggcaacgataacacctcttctgcaatgtcggagctgtggtatcgcttttgtgtttagcttggcagcgatgtcctgtgtttgggctctgccgtcattgttagttgtgtagctaggtctcttgcttttttctctacggtgggtttcagccgatttcccataattaaccatgtagttgtatggtttttgggcccggtttcccttataaattaggtcaattctcttcttctaaatatacaagctgggacaaagttccacctcagttttgaaaaaaaaaacaatgccgcgagctgatcgcgaccgtaatttgtccatgcatttgtaatgctcggactcgaactcgagagatattagggtgttaaactaatgaatgtccatttttcttcagggatgtaaaatggatatttctcttaaattaatgatgtctatgtagagagcagaccaagaaaacatagggttttgattacgccacaagtgaaaattaaactgattactgtatcaccaagacacgtactcgtaagaattagccatacaaacaacaatagtactagttgtatgcttgcaactccctacagttccacgaagataccacaaatcaagaataaaggggttctttggatgccactctgtttattctatcagcaaatttgacaatgccacacttgtggaaaattttgactaaaaaatgatcaatttaggtgtgggtgtcgatggattatatctaatacaagaggtatacctgatccgtaatattgacagtcctgattgtcaaaaaaatatatgacatattattaatgtagtagaaccaacaaacgctaggttaagttagttaaatgtgtataccacaagtgtaacaaattaaagttttgcactcaatcaaacaacgcctaaggacactattggatcaagagtgatgtgggaatgcgcccccctgggtgtgaagaaaatagtcttccgctaatttgcgcgttgtttgcaatctggaaactgaagaccgggagtgggtccagcttaagtcaagggtatttagataaatactcaagattttgtatttaaaaataataggtagatagatatactatgtgatgcatgtgtaccaaaacaaaggttgtattcaatccaagaggttatattaaactcataatacgtatgtgatatatatatatatatatatatataggacactcatatggggctccatggtgcccaggcaccatggtatgaaatacacaaattcgcccaaatttttcaaaattttcaaattgtgagtatatatctagttataagtattcgattcatacctatacctagcaataaaacaactcaaatttatctttatttcataatccaatattacatacctaactaattatatgtttggatgttatatacctagaatcaaaatctaacatattacatgtttaaattcagttcaaacttgtttgaactagttagtaaagtagttaatgttaatacctaaacatttaaaaaaaattcatgctcatttgaattgagtatatactcaatttgaatcatggagcccgggcaccatggagcaccaaacaaatttaatatatatatatatatatatatatatgtatatgtatacatgttatattttttttgcagggatatatacatgttatattaggcttctgcctacaagtttattttaattaccccctcatattttgaataaacaattaaccttagaatcctaacccggtcctgctaaagaccgaaacgcttagatctatactatagctttggagacttggacagcgttcgtttgggtgagtttgagggagaaaacgtatcgttttccgcacgatggtacgtttttttaaaaaaaaatctataggaatgttgctttaaaaaatcatattaatctatttttaaaatttaaaattgttaatactcaattaatcatgagctaatagcttacctcgttttgcgtatcttcccaatctcctcgatttccttctcctcgaacacacctttggaagagatgagtcaaaatacatgtatacagtaagtccgtccgtacgtgttgaaaaacaagaaatggcctgttgggccatatgcctgaacgaaatactccaaacgtggcctgttccgctttttgcgcctgtcactgcgggcgaaatgcaaatatgtaccttcaaactgctggccacttgaattttactttccagttttatcactgctggccatagctgcatgttgctatagtggaggagtataatatcgttcacttgttgtggcgattggatcagcaaatcaaggagtaccaaccatccaaattaatcacgcgctcactcggggtcgtagctgttgctgtttcgtgttgagcaagagaatatccagactttaatattctcttgtttgtgaattgtgatatcacctgccagctgggtcttgtcaggtcttgagcaagctcggcatcatgaaacgccttgttgtttaaatgatcgatcgaacactgtctttgctaatgtacaattgtgtgtataggaaactcggcgagttcacatgcgagtgccaggatcactgcatcgctataactgaacacctgaaaatgcatagatccattgcatccgttgcctctactctactgagcggatgaaagttaaattggcgcacgtaaaaaaaaaagctattagcacataattaattaaattttaattattacaaacttgataaatgtatttatttgatattttaaagcaactttttatatagaaagttttcgcacaaaacgtaccgtttagcagtttgaaaaacgtgctaacgaaaatcgaggtaaaatctgtatgtgtgaaaaatgctagtggttgattggttagaattaatggtactgctgtttgtttgcatatttttttcttgtctaatgatgaaatcgtttgctttgttcgtgagagaatttatatgtgctacatacccaatttggtgccgaatgctcattaacttgcctctacggctctacctgtgatgttccggtggccaaattatattttttaacgaatcgatatttagatggtgccaatttcatttaatagagtagaaaaaatatataagaaaaggaaaagaaagcccgaaaccaggtagcaatgctgcgaggtgttttgctaccccggacccaagtcttagcgaaccatattttgtcgcgtttgaacttaattacgtgtacacaatctcccacggcatttctctcaactttttcaccaggccgaccaaaagttgacagccagcgttttgcgccgatcatcgtatgagatctatcaacgcgatgaatatgtagtcctgcgagaggcttcttctcttgataccttcaatcatttttgttcttttgtttttgagtttcagttattgcaacttaaacaataaatgagttaacccacagaattgctaatttgccatgtagatctctgcctgagggcgaggaagagaagaatatattcttaccttatcattgactctagacaaacgatgaaggactctaggtacaatatatgcaatgaattttttttaagcgaacgattgcaggagctctgctggaatttttagtaagtgagaaagttcaggttaaaaaaaggttacagggatccggagtaaaaaacaccccttttagaacaactggagaataccgcaaggtaagctaagaaaaactatcgacgaactaggcggttcaaaaatgaaatgttgctctgccacgatgaaggactctagatacaatatacgatgaaaaaatatatatgatgaaaagatggtacaccgaagtaaatttggaaatgatggctatatttgtggaatggttccttgtgtaatgtggatgacttaggaatcgagtcaagctcaatatagttgaacatgccctaaggaataggacatccactaaaaacaaaaaaagtatgttgagaatgacagcatccactgaaagaatgaataaagcgtagagagaaaatgacaggaaactaaatggttggaaaattgaaaagcatgacgtaaatgcatgtacgtacattactcacgtcagcactaggcagctctaaagaacagattaacggggtcacgtgctgtacataccattcaacgatcaactctaaaataagagcaaatcaaatgaactaaaaaaacatttagcaccatcttttcacttatgattatgtatgtaaaccaaaatttaaattttaaaacttagtttttttaaaaaacaagtgtgttttggttttatttgtgatggaaaattggtgagaaaattggaaaccatgtaatggtttttggttgaaaatttggtttggaatattggcgattatcggcgtgagtgctgcaatttaaatctctaagggtttgtttagattggtggattatcacgggatttttggaggaatactattcataggattgtttttcccttttaataccattcggatcacaaaaaccaatcataagaaggtcgcaggaaaaatttcctttacttttgcttccatgggagaaacatttgaaaatatccatccactctaatctcttttttcattttcttcgtgttggaacgaggcaatcaagcattaacaaatgcaaagaacagagaaagaagaatcagcgaagaacagagaaagaaaaggcagatctcacatgattggaaacatatcctatgcacacaagcttccgtatacactccatgcacaccaactagcagatgtcacagaaaattttagaaaaaattggacacatactcataatagtattacacatatctgcaaagtctcatattcaaattcattatattttagtcgtaacaataaagtgaaaaatctgacagtttttagggtaaaaatctgtcagaattttgtttttttgttacggctaaaatataataaatttgaagataagatttcacacgttggtgtaatactattggaagtatgcgtccaattttatctagaattttatgtgacatttgctagttggtttgcacggagtgtgcacggaaagcttttgtgcataggatatgtttcccatatgatttctttaaataagttccgtacaggaagcaaagcccatacgacaaagaatcccaagagcaaacaagagcaaagaggtcacgcgcagaggtcaccggcaacggtatcgaggtcagcttccagtgtggagctaatgcggcgcgtggcgtgcggaggtcgccggtgacggattgaggttggcttcggtcatggataccgcgcgtgaaagttgccggcgacggatcgaggctggcttctggtgtgtagtggatgccgtgcgcggaggttgacagcgacagatcgaggccggcttctagcatggagactggagtggatgccacgtgcggaggtcgatgatgacggggatcgagagcagcaggccaacatccagcgtggagcagcaggctagcatgaggtaccggtatctcgaggtactttttgttggactggagcaaaatctttttctcctatcttacgtttttcctatgctataatccgaacaagccctaaactagatttcaccacgatagcaagatctcaggccctcctgagaaaggatccctgcccatagctaggtatccacaattttctatctaatctgaaataagaacacgaagtagaaaaaaagtgcacttataattaaatgatgtggatcaatgtgtaccatgagtgggcaagcgtacatccctaacgaggtgtgattgatgtttgtgtcaaacttgaggatgatattcctgtcgacgacgagtgctggccctctgatgaggccaccggcggcccatatgttggcacgggcatcttggttggtagcatcggtagtggtccattggattggagaactgccatggcaactctaatagatggacgagcgcatcggtctgggtgagcacaccagagcccaacaaccaagacacactccatgtctgtcgcgtcgtagtcaccgttgaggcgctcgtcggccgctttgagaacggctccctggccgtaaaggtcccatacccattcgactagtcggaagaggccattattctggtcatccagtaggttcattggtctccttccacatgccacttccagaagaacaatgccaaaactgtacacatcagattcagcacttgctttgcctgtgatcacacattcagggtcgacatagcccggtgtacctgaggggtgggtcatcgtttgtgctccaatagcatggtcaatgagccttgcgaggccaaagtcacctagctttgtattgaaggattcatccaacatgacgttgcttggcttgatgtcacggtgcacaacgcattgctcccactcctcatggaggtagagcagtgcattcccaagcccaagaacaatgttgatcctatgacaatatccaaggtagttgatcagttgaatttcaattgacatttgttgattgcacattgcaagaaataaaaaaaataaaatctgaaatattaatgagagttaattaattacctcattggccatgtgaggaaggtaccattgccatggagatggacatcaaggctgcggttgggaacgagctcgtacacgaggaggagctcattgcgaccgtggcaccaaccgatgagctgcacgagattgcggtggcgcagccgacttatcaccttgatctccgacttgtactccttcctcccttgcttggaggagtctttggcgaacctttttatggcaacgtctatgccgagctctctcagattgccacggtacaccgcgccaaaaccgccttgcccaagcttctcctccgccgcaaagctctttgtcgcgttgacaagtatgtggtatgggaaccgcctcggccccgtccccatctcgatctccacgatgggatcgccttccgagtcgtcctcctcttcctccctcatcttctttctctgacgtcgtcgtacgaggattgctaccatggtgaagaggagcacgatgaacagaattgcaccgacggtggctcccgctacaactccgccacgcgaatgttgtcctgtcggctgcttctgctccaacgtcaagttgaagtaccaagaacgcagctgatgctgctcaaaggatgaacccgtcgccgccgagaagccaacggcgaccttctccggcaaggcgctcttgagatcaatcttggagctgaggttgtaaggcgtcgttgagccatttgcccatagcttcaccgacatgatgctcgaattgctgttgtagtcgacgatggcggtcatgttgccgatgaggatgaagctaggcagggattcggtcttcactgaccggagggcgttgacgtcgatgccgatgtggtcgtaggtggcgtcggggtctaggaaggagttgttgtaggtgtcgaactcgacggcgacgaaccggtcgccggcggtggcgttgtcgaaggtctggctagtgaggccgagggcgccgccgtagcccatgtacggcatcctcgacgggtagctgacgaggaagaaggtctgttgcagttattcctggtgtggcccgagctgatccggacgacgcgggaatgcaacggtgtgtaacggtgtggcgagatgcccgggcaaaggagatcggtggcgactagttcgtgcagcgcaggaagcgcgatgaagcagagtgcatgacggggagtaacctcgtcgtttccacatttgtaggatcaaagttgttagcctataaatagttggtggtaacagaatttgtacgcgcgcattcagttttcatttcagttcgaaataaacaccgaaagttgcccaaatactctcccaagttattttgttcttgttctctgcattctctgaattctctgtctccctgaaagtttcttcagtctgctgtgccggatagctacaggacgcccacaaggtgttcgattggtgttcttcgccaacaagtggtatcagagcactcaggttgagggctgatctgacaccatggcgttggttccggcgggagccgcagcggatccggcgagggggagctcagggagtgcgttctcctacccacaactcacggcgacgaattacaccagctggtgcattcgcgttcaggcaatgatggaggaccagggcgtgtgggacgccatcgagccggcggccggggtggccgtcgacccaagaagggacaagaagtcgaagtcccatctgctgcagtccctcccggaggacttgctgatgcaggtggcaaagaagagatcggcaaaggaagtgtgggattgcttgaagacaaggttcgtgggcgcggaccgcgttcgcgaagcgcgcctgcagacgttgaagggtgaatttggtgccatggtgatggagccgggggaaactctggatcagtacgcgggccgcatcaccgcgatgagcgtgcgtcactcggtgttgggctcgacactgagtgattccgcgatagtgaagaagctgttcgacacggtgccagagaaattcatcagcctcgtcgcaggtattgagcagttttatgagattgataatatgccatttgaggaggcggtgggtcgtctcaaggcctacgaagaacgagttcgcaagaagaaggcggccgctggtggtgtcaccgccgacggtcaagtacttctcactcaggcggagtgggaggcgcgtttcaggaaggacggcagcgagtcgtcttcgccgcagaaaaacaaacctcccagcgacaggggaaaccgtgcccagggcggacgcggtcgcggcagagggcacggtggaggtggtggacgcggcagcgcgccgcggaacagtggcgctggtggctctggcggcggtggccgtgacaagagccacatcaagtgctacaactgcgaagaattcggccactactccacccagtgccctcatcccaagaagaagaaggtggaggcccatctcgcgcaaaccgacgacgcaaaccctgcattgttactggcggtgaccgaagacgagccggcgagcgggctggtcgtacacgaggagcgtgtgtggccgcagctgctgttggctgacagcggagcagccaccggggacatctggttcctggacaatggggcaagcaaccacatgacgggtgatcgtgctaagttcagagatctagacgtatcaatcaccgggagcgtcaagttcggggacgcctcaactgtgaaaattcaggggaaagggtctatcctgttctcctgcaagaatggggatcaatggctgctgcaggatgttttttatatccctagtctgtgttgcaacatggtgagcttgggccagctcacagaaacggggcacagagtggtgatggatgaagatgtgctcgaggtgttcgacaaaagtcccctgcggctggttatgcgggtgaggcgcacccctaatcggctgtaccggatcgagctgaagctagccactccggtgtgcctgctgacaaggatggatgagccagcatggctctggcatgcacggcttgggcatgtcaatttccaggcgatgaagctgttggctgacaagggcatggctggtggcatcccggcgatcacacatccaaaccagctctgtcaggcatgtctggttgcaaagcagataaggcagccgtttcccgcaacggcgaacttcagggcggaggagccgctcgagttgctccacattgatttatgtggaccgatcaccccgacaactatggccggtaatcgttactttatgctaattgttgatgatttctcacggtggatgtggatgttcgtgatcaaaacgaaggaccaggcactagaggctttcaccaagttcaagccgctggccgagaacacggccgggcggcgcatcaagacgctgagatcggatcgcggtggcgaattcctgtcgggcgaattcgcgcagttgtgcgagcaggcgggcatccagcggcatctgacggcgccatactcaccccagcaaaacggggtggtggaacgccgaaatcgttcggtaatggcgatggcacgatctctgatgaaagggatgtcagtgccgggcaggttttggggggaggcggtgcgccatgcggtgtatctcctcaaccggctaccgacgaaggcgatgggcgatcggaccccgttcgaggcatggacggggcgcaagccgcagctgggacacctgcgggtgtttgggtgcatagcacacgccaagatcacgacgcccaaccagaagaaacttgatgaccggagcgcgccgtatgtgtatctcggcgtggaagaaggcagcaaggcgcaccgcctgttcgacccgcgttgtgggcgtatccatgtaagtcgtgatgtcatttttgaagaaaatgtaccttggcaatggagtgtagtcgcaggggagcaaaactctaccgagttcacggtggaggaggatggagttgatgcaccgccggcaggagcgccggcctacccagtaccgcggtaccgggcgccatccccggcagtcccgcaatcgcctccggcaagcccggtaggggcgtcatcgtcattgccgacttcgccccagtcatcaccgagctctacaccgccttcaacacctgctaccggctctgccgggccggtggcgtcaccaggttccggcggcgaccttagaagcgatgagggtcccgtccggttcaggagtcttgaagatatcatgcgggaggcaccccgcgtggacctggtggaggatgaacacgatggggacgcgctgcttgcagagatggaggagccatcgagctaccgcgaggcagctggccagccggcatgggagaacgccatggcacaggagctgcaggcgattgagaagaattcaacatgggctctcactgcattgccggcaggacacaaacccattggcctcaagtgggtgtacaagctgaaaaagaacactgccggcgaagtaatcaagcacaaggctcgtttggttgcaaagggctatgttcagcgtcaaggggtggattttgaagaggtgttcgcgccagtggcgcggcttgacacagttcgtgtcatcctggctatcgcagctgatcggcggtgggaagtgcaccacctcgacgtcaaatcggcgttcttgaatggcgatcttgaagaagaagtgtacgtagcccagccagagggttttgtgaaacgaggagaagaacacttggtgctcaggctgagcaaggcgctctatggattgcgccaggccccgcgggcgtggaacacgcgtctcgacaagtgcttgaaagaactcggttttgcacggtgcacgcaggagcaggccgtgtatactagaggaaaggggcaagctggtgtaatcgttggtgtgtatgttgatgacttgattgtcacaggagaaaatccacatgagatagccatgttcaagcagcagatgatgggggaatttgagatgagtgatctcggtcttctctcttactatctggggatagaagtaattcagggggagaatgggattgctatcaagcaagctgcgtatgcgaagaagattctgtctcagtttggtatgcagggatgtaatcccacctcaatccccatggagccacggtcgctgctgcacaaggatgctgatggaaatccaattgatgcgaccgagtaccggcgtgtcatcgggtgcctgcgatacttgttacacaccaggccggatctgtcctacgccgttggcgtggcgagcaggttcatggagcggccgacaacgatgcatctcaaggcggtcaagatgatactcagatatctaaaggggacgctggactctggtctggtgtttgcaagcggcagtggctcgttggacatcacgggtttcactgacagtgacttggcaggtgacatggatgaccgtcggagcaccggcggcatggcgttctatgtgaacagcagcttggtgtcttggtgttctcaaaagcagaagacagtggcgctctcgtcttgcgaggcagagttcatggcggccactgcagcagcatgtcacgcgctctggcttagggcgttgctgagcgagatgatgggtactgaagcaaagcgggtgaaactttttgttgacaacaagtcggcgatcgccttgatgaagaatcctgtgttccacgggaggagcaagcatattgatacccgctaccatttcattcgtgaatgtgttgagagtgggcagattctgattgagttcgttcgttctgaggagcagcgagcagatgcaatgacaaagggactgccggcggcgaagctggcgactgcacggcacctgttgggtgtgcgtgatctcaggccacgccaagactaagggggagtatgttgcagttattcctggtgtggcccgagctgatccggacgacgcgggaatgcaacggtgtgtaacggtgtggcgagatgcccgggcaaaggagatcggtggcgactagttcttgcagcgcaggaagcgcgatgaagcagagtgcatgacggggagtaacctcgtcgtttccacatttgtaggatcaaagttgttagcctataaatagttggtggtaacagaatttgtacgcgcgcattcagttttcatttcagttcgaaataaacaccgaaagttgcccaaatactctcccaagttattttgttcttgttctctgcattctctgaattctctgtctccctgaaagtttcttcagtctgctgtgccggatagctacaggacgcccacaaggtgttcgattggtgttcttcgccaacaaggtcatcccgtcgcccttgttgctcttgtttttcggggtgatgttgaaggagaagcgcgtggtgaagctggcaacctcgccggtggcggcgtcccagagctgcaccggcggcgtgtacaccatccggcccatggtgccgccgctcgacaggttgttccctttgcctttggtgagctcgatccattcggcggcggcgccggcgagcgccgcgctgccctggagggtgatgttcttgctcgcgttgctgaagctggagtagttgaaagatacagtagtggtagcgacgacgctaggcatgacgagcaagcaggctagagcagccatgaacggttttgtcatgaggacgccggcggccatggccggtctttgagcggaatcagcggccggacaatactgccaatgccaaaaacggaaaactactagtagtactcaaatcagcaggtggccagtcgccagtcgccactcagagagaccagtcgagatcttaaggactctgctaatttaacaagttggtggttggcaaatcaacactaggctccatgagaccatgaccctgacagctctggctcctcggaaggtgctgaaatgtatcatattttgtctattttgctaatagatgacgaagttaagcgtaagttccgtttcttgttggtatcttccctttttcttcaaatacattttcaagaatgataaaatcctttttatatatatacatcaagctggtttatatatatatatatatataaaaggtgaagctttggacgtcattggcctaggcctgcggattgtttgcaattttttcgtcttttttcaccaaattttataaaaaaatgtactccctctgtttcataatgtaagtcattctagcatttcccacattcatattgatgctaatgaatctagacatatatatctaattatctatttagattcattagtataaatatgaatgtggaaaatgctagaatgacttacattgtgaaacggagtaagtataaaatttagctgctcccttacttgatcaaatatccaaagaaagaagatctaaaatcttgatggtattttgcatagttgactagggctaggttcgggaggtggagttccacggaaaatggggttgtattccattaacacgtgattaattaaatattagtcttaaaaacttgaaaaatgaattaatataattttttaatgcaacttttctatagaaaacttttacaaaacgcacaccatttagcagtttagaaagcgtgagcataaaaaacgagagagtagaagttgagaaagttggaaaaagaacagcctaagaggactaactaaacaatgtataaaaaaagggacttttagggtacaatatacgggtagtatatgttgctagtatgaataagattgtgttgggaatttctcacaaaataggaaatgatctttagttatttcgtgttagatcttaactcggatagtaatcctaattgatcatgtgttagatcggattactgaccggatacatttgatttgattgtgccatctattcaacatatgggttaaatacatggaaaaataatgttcctcctttaatttatcgataccaggtttggagatattagtaaattacgttgttccttaatttaatgataccaaattctccttgctttccacgtttttcaatttgagggtcaaaaccgggggctatgttggtagtggtggtatcagtttttttttattattattttcaggcaggtagtatgagtaccagagtactccctcggtactaaaatataagtattcttaaatacttttaaataaattattggaagtttttttttggttaaaaatagaaaataggtgtacaatttttggaagtttatgatttgttaaaaatagaaagtaggtgcacaaattcaatgagagactgttattattcgttgagatgagaagataaagaagaaataactatattttttaagataaatttaaactctaaaagtaattatactactcaccggactaataatacttgtcgttttttacaggaataagatcaaactttaaaatcttcaactataataatttttaaaatatttatcttaaaaatatggggactatatgtatagagttgttttaaaatatactttaataatatcatttatttgttatattgtttttatatatattataatataaaatagtgtttaaagttgttttctatcggttggagtacaatgattgtctcgaattcgagggacgagccaatatgttgatttgatactagtgccactggcagtcgggcagtggcacacattcgagttggaaatgcataaatgcatgtgcatgaacagaagaaggtaccgccgtgcttctttggttcttcatcttcgacgtgacttgttttggcttacgcttaccccacttgccttactttctggatgtcagtgttatcgaaagaggtgcggacaactttgcgacagtattatatgtattaactaaacccactggttagtactagtaactcatatactctctccttttctaaatatttgacgccgtttaattttttttaacatgtttgaccattcatcttattcaaaagcttttgtgaaatatgtaaaactatatgtatacataaaaatatatttaacaatgaatcaaatgatagaaaaagaattaataattacttaaatttttttgaataaaatgaacggttaaacatgtttaaaaaagtcaacaacgtcaaacatttagggatggagggagtatttgcaacagtattatatgtatgttctgcataagtgttactccccctatcctctgatataagggattttaacatttttcttgcactgtttgatcactcgtcttattaaaaaaatttgtgtaaatataaaaaacgaaaagttatgcttaaagtactttgaataataaagtaaatcacaaataaaataaataataattctaaatttttttgaataagatgaatggtcaaacagtgcaagcgaaatgccaaaattccttatattagagaatggagggagtagtattttgtttttaagtgcttaagaatgaaaccgatagttttgaatttttgaaattggtaattacaatatcataggtatatagaataaaatctaatacttttaatcccttattttctgctacttccttaagttagggcatgtttagttcgcaaaaagaaaatttttgagtgtcacatcggatgtttgaccgaatgccggaaggggctttcggacacgaatgaaaaaactaatttcataactcgtctggaaaccacgagacgaatcttttgagcctaattaatccgtcattagcacatgtaggttactgtagcacttatggctaatcatgaactaattaggctcaaaagattcgtctcgcgatttcccccctaactgtgcaattagttttttactttatttatatttaatattttatgcatgtgtccaaagattcgatgtgatgtttttgggaaaaagtttttggaactaaacaaggccttaatacacacttcgaaattactgaaaataatttttttattaaataatatgaagctttaaattaataatactgagttgtacttgttatgatgtcttacttttttagtatttttcttgataaaggattttctgaatttaggattgataaaaatacaatattgtacattttctgagttttcatggtgttgtctaaaaggacaaacagtggtttctaagtgtacacaaagaagtaaatatatttattgatccttaaaaactcacttacaatatatgttctcttggaggggtctatttataaccttagagttaggtatgcattttttatatttgtcagcgaaatcagctatctatatcgctgaagaacctaatttaagttagttttacaagttggtggtctagactccttgtattgcggttcagagatgcgatttaaactcggtggaaacataagggatgtaaagttgatttaatccattggggataggcacgtagatcaggcttttcctagcggctgtcccccaacccaattcgttctgtaggcaatggcccatgaggaggatggcggccaccccttcaattgtaatgggccgatcgtttaattcgcttcaattgtagtgctgctgcagtacgtagcacctatcgttgcccatctccctcactcgacttattctaatgctggaacagaaaatggccggacagatctttctagagaaactacagtgccataagattcatggcataagtacacatacattactcaaatcggcaattaggcaacaccaaagaccaaatcaactctaaactaagaacaagcaaattaaaaaacaaacactaaacactagcactgatgcttgagcaatgaagacgagtccttcgaactggttgaatcggagggaaccgaggaccacgaggtgtgagtagcatggccactcgtcgtcgatatggacgacgactgcgtcacacctgatgacgacgacatccctgtagatgacgcaaagagcccatgaaacgaggccatcggcggcgcgtacgttggcacgggcatcttggccggtagcaccggcagctggcctccactcgattggagtatggtcatggcatctctgatagacggtcgcacgcttggatcagggtgcgcgcaccagagcccaagagtgatgacacgctccatctccgcagaatcgtagtcgccattgagacgctcgtcggcggccatgagaacatctcccttgccatacaaaacctaggcccactcaaccagtcggaagacgccattattatggctatctagtaggctcatcagtctcctcccgcatgccacctccagtaggacaatgccaaaactgtaaacgtcggactcggcactcgctctaccggtgatcacacattcagggtcaaggtagcccagcgttcctgacatggcggtcatcgtctttataccgatggtgtggtcgatgagcctcgcgagcccgaagtcatctagcttggcattgaaggattcatccaacatgacgttgcttggcttgatgtcacggtgcacgacacattgttcccactcttggtggaggtagagtagtgctgatccaagcccgagaacaatcttgatcctgtggaaacaaccaattaagcaagataaaaatagaattagatttgacactatcgaaacagttgagatgagaaagttaacgccgagaattaataacctcattggccaagtaaggaaggtgccattgccatggagatggacgtcaagactgcggttggggacgagctcatagacaaggaggagctcgttgcgtccatggcaccagccgacgagctgcacgagattgcggtggcgcaaccggcttatcaccttgatctctgacttgtactccttcccttgcttggaggaatctttggcgaagcgtttaatggcgacgacgaggccctgctctcttaggtagcctcggtacaccgagccgaagccgccttgcccaagcttctcctccgccgcgaagttcttggtcgcctcgacgagctcatagtatggcaatcgccttggccccgtccccacctcgatctccgtgatgggctcgccattgtcactatccgtgctcgcattctcctcatcctcggcctccctcctcttcttgatccgacgtcgtcgtacgatgatagttgccgtggtgaaaagcagcacgacgagcagtgttgcgccgacggtggctccggctacaactctgtgtcatgccagcgcc

SEQ ID NO: 80214 - DNA, 2332 bp, Oryza sativa
agaggctggcgccgtccagttggacaatggcgctagccactctggcgccccaaaaaggaccatttctgggataagtttttttaggggtctatttgcgaaataagtttttcaaaaggaccaaaatgtgaaaaatccagcttcattattactatgttgtcaaggctgaattgttagctttttttgttagcttcctagttcctgaacttttaggtctcttttcatctttggttctatcagactgatagcattccatgtagtgcatcagccttagtttggatattagtgtggctctttgctttacttgtttgctcttatgtaatctgtactctgcatttgttcaatttgatatttggttgacaggaaagaacatatatggtgtatttctttttggaattgatccaatgttgctccattttttttcagagatgggaacactgcagctgggtgactgaagctcatggtggcattagtgctaagcttaaacacttgcattcaatttgtagtttagctcttagatggctacttctatttattctaaaaaaaacaactgaactgtaaccatttttattactttgtgacactttcatgtatgcatttgtgaacgtacagcatgcatgtgtgttttccctatgctaaaacaatgttttttttactgcatcctatggatttgatctgggagaatgcatattgtttcattgcttgcttgggaacatacagctgctgctttatatttccctgtgctaaacgaaggcagtgtttatatgccagggattagaaacgggcagggattcgaaccccacagggtttgagtgagataggagggattcactcaatccctccctggataggatcccttggggattaattcccaagcagccgaacaaggcctgagtggtgttagcggctccaacaaccaatgaaaaaaatatggagccgcacttagagccaccggttcttcatgcttaacataagatttaaccggtcttgttatatgtcaacaatagctagcaaaagtaagtagacaataaaaattaaacatcattccttattttgtaaaatattaattgataattagtgcaagtcaaggatgaggacttacgtttccctgtcaaaaaaaatgtttgctgaagctagctagttcaaatggttaaacaaaaaaattcaaaaggtttagcaaaaaaaaaaagaggtcgatatattaacataaaaaactaatggcatcataaagcaccaagcattcatccatggtgctggaaccagatcctctcatgttgggatattgtgtggctgagtcatccgatccgcatcgcagcaaccgagtgaactcagcgactgaacgggctgggctgtagcttggcccacggcaacgaaattaaaatggcccatttgcacacaaataggtgtcgccactataggtgtcggtagtactaaaaccggcacctataggccttttcccacctccgcgggttcaaatcgcaaaaaaccggaacctttaagcaataataggtgtcggttccaaataaaaaccgacacttatttcattttgtgccggtttttttttaaaaaaacattataggtgccagtagtactaaaaccgacacctataagatattataggtgccggtttttaaaaaaaccgacacccaaatcaagccgaaccggcgggccccacaagacgagataaggataaggacgagctagtggcttctcgatctctctctcgtcctcagtttctctctctctctcgcctctctcttctctttctcagtttcccctcctcctctccccatacggcgtcgtcggcggtggcttctcccgcggcggatgcggcggtgggcgaggtggcctcggcggcggccggggtggcgactgctggcggagcagcatccggcgtcggcgtcggcaggcaaagcggtggcggcggtgagtcccgcaatggatccggctcccgcaatggtgattgtttctatgaaattgttgagggatatgtgatttttgattctttcatcagtgatttatgtggaacttctgtgatttgctttgacggatatgtgttggatgaattgatttgtgattctttcatctgtgatttgtgtgaaacttctatgatttgctttgagggatttgtgtgaaatgcaggttgaagggagataactccgctgcccatttgctgagccggccagtaatttccttgccccggagcacttcgcccaaaggatactgcgatggcatagtgactttgtgggcctgaaagtagtgtttaagtttgcacgaagccatcactagggcataagcaagcttttccatttcaatgtatcttatcttcgcccct

SEQ ID NO: 80215 - DNA, 1039 bp, Oryza sativa
tccccctcccccaccacccatcgcctccattcctatttctctatattgcaacctttttatttttgttttattttttttggatgttttttcgcacttaggatacgatacaaccagctaaaaaaaattaatcttgaacggaatataccacttagctagatatccgaaaatagcataccacttagcctattttgcaccttcatcagaattagaccataacttctttagtaaatacctttgatcagcatgttaaatataatgcactctaccactatatgaaattacttaatctctaattcaaaatataaccacatgaaatgatagccataagttaaatagtacaaagagatgcagttttttttatttttattttatttttttgatatttttttcacacttaggagaatacaagaaccaaccatagaaaaaataaactcaaaacggacaaaatatgtgacttatagaattttccaaatctctaccgaaacggacaaaatatgttatttattaaaataggcgtaactttctcatacggactcggaattaggcaaataatatatccacggatatctacagaaaaagttatatccgattcttcccgctctggcgggttcggcgatattagaacctccaaattccgcttgcaagattgtgttttcgaggagatgtttttcggtagagctttggaaaatttcacaggccacatatttcgtccgtttgagtttattttttatatggttagttcttgtgagttcctaagtgtgaaaaaaatatcaaaaaaaaaaaaaaagttgcacatttctctcctctgcactagttcggagagagaggagaggagaggaaaaattctacaggtcacatattacgtccatttgagttcattttttctatggttggttcttgtgtgtctctaagcgtgaaaaaaatatcaaacaaataaaaaaaaataaaaaatttccggggggaagggcgccagccactctggcgcgctccccctagccacctcagcatcgccccgccacgtcggcagggggacggcgcc

SEQ ID NO: 80216 - DNA, 866 bp, Oryza sativa
cacactgtcacactatgtgtataaatgatagaaatgataattacctagcagcattttattattcagtctattcaaaagtcatgtgaccttaatccatcctctattcaaatttcgatgaatgatttttttagatacgtgtgaccttgagttgcccttaatttataaaacatatcttatgaacaaaatataatcttttatttaaataatatggatgcccacacatacgcgtgggccaccttcctagttattaagaacaaccgaatcagtagcgagttatataccgtgttattggaggaagtcttaatttagttaattatttgaaaaccctggttaaatgtgaaatagagaagctcgacgacaagttttgagatatactttattatttgatgacaaattatattgccgagctataggatgaactagaaaatccgcgcgccagttggcgcgctaactaatttgcaccttggtttttccatgtataatattttatttacgtaaaaatcatacacttatcccttaactggatgttattattattattattattattattattatttcatatataatgctttctcagaagttcagaagatccaattatgatagctgtgtttatctcaaagttgttgatggttcagctatatatttgcttctttatattgatgatatgttgatagctgcaaaagacaaatcagaaatagcaaagttgaaggcacaattgagtagtgaatttgagatgaaggatttgggtgcagcgaagaaaattctcggtatggaaattactagagaaagacattctggcaagttatatcttagtcagaaaggttatattgaaaaagttcttcatcgtttcaatatgcatgatg

SEQ ID NO: 80217 - DNA, 53474 bp, Oryza sativa
  unsure (1)..(53474): unsure at all n locations
tcgccgacgtggtgtaccacgagaaacgcggcggcggcggcgagagggcggtgtactgcctcgcgacgagcggcgacgtgcacgtcctccgcctccacgacgccggcggcgcgttcgagccgctgttcgacaggggcaacgcggcgttcgacgccgccgccgcgttcgcgccgccgtacgacacgatccgccactgcaccaatgccaagaacctggtggtctgcgacgacggcgacatgtaccagatctggcggaacaacacctgcaccaggatggggccattgcccggcgggggagagtaccgcgtggagtacaaccagatgttcgttctgagataccaccctcgccgccggccgtgctgggtgccagtggaggatctcggcggacgctcggtgttcgtcgggaagaacaattcggtggcgctgcgcgtggacggcggcggcggcggcggcggcgtgccggggctgagagctaactgcgtgtactggactgacatctgtccagctcgggccaaggtattcgacatggtttccggcaagtcgacgctgtgctttcatggcgtagaagaccaccgcgccatctgctggtacttcttggcgtagcagcagcaagaagcccaactctaggttcagcttgtcagcttccggaatcggattgagaaagtttgattgaattggttatgtggtattggaagtttaggctgaattctgtgataagagacagaagttttggctgtcttcgttgctgtcattccgatggtaaaaaaaaaatgagatgcggaagtaaattttcagtgctgtgaaaattaaacctgtttttcattgtttcagattaaaatagtttccctgtttttgagtgtatctgattgttgcttctgtgatacaataatgtagctgatcgaagtttctgaggccaaaagcatggccatatggtttctgatgaattctggtggtgtagctagcaggtagacttgtggataaacttttcttttctccaacaaaagttggataaacttttggatacttgtggcatgcttttcaaactgctaaattgtgtatttcgtgcgaaaactttatatatgaaagttattataaaatatcaaattaatcaatttttcaagtttgtaataattaaaactcaattaattacacgttattactatttcgttttgcgtgaaacacttaatctttatcttcatcttcatcttcaggatattcaaacaccacctaacagtgatatattacagtagagttagatgaactgcaaagagatgtgctgatcagggcaaagccaaggaaataattctgtcatccattcttagaggcatcaatctttattgtagatgaaaaatgcagtgtccatattcaggcagatgtatctttgtgcggattgattttctgaaaatttgatcgactatatgtagcattaccacgagagcattcatgtatgaatttatcataagctgaaaggttggatgatggacaaggatttttcagacgggataagattgattgttaaagaaggtgtcgtgcaacaacgaaatgcagagaccagtggatggatgggttagttgtactctctgaagattgaaaattttcagtgcaagccgctggcaaatctttgtgcgtgaattaggaaacggagggggaacaaaatttcatgcaccgtgttcacatcatcatcaccctgtcatctccggcatcctttgagccactgttcgacaaggccagccgcagggtgttccaccccgccgtcgcgtttgcgccgccgcacgacatgatccgcgcctcctccaccaattccaagaacctcgtggtctgcggcgacggccatctataccagacatggaggtgcgacggcgtccacatactcgttctccggtaccaccctcgccgccggccgtgctggctgccggcgaaggatctcgggggatactcggtgttcgtcgggaagaacaacaatgcggtggcgctgcgcgtggacgacggcggcggcgcaccggggctgagaggtaactgcgtgtactggatagaccattgcagtgatgaggccaaggtgttcgacatggagactggcaagtcggcgccatgctttcccggcgttggcgctatctgctggtgtcatatgcagagcagcagccgtaatacaactagtgtggcagcttcagcttatcagcttcagaaagggctcgtcatgcgtgaatcggcctgagttctccgagactctctctacacctagcagcttccagttcgctttatataggattacatagtactccctccgtcgaataaaaaaccaactattaaatgttaacacattctattacaacaaatctaaacataccatatatgttcatatcctgtgctaggttagagtttttttaaaaaaaaaaacagagagagtagctattaattaggggtgttaggatatccttaatgcattttcagtgagtggataataaggtgggacctactccctccgtttcaaaatataaatatttttgaacttcgacatagtatttgagatattactttgaccaacaatatctataataataataataagatgttttaaataaaaatagttgcatatttaagatagtttgtttaattataaatctagtaatatcaattttagattgtttttatttatttgctattaatagtcaaaatttaaaatgtttgacttgacactatgctaaaaatgattatattttgggacggagggagtataaaattaagttatactctcttcatcccaatgtaatctcatcaaatcctaagttattatgggatggtttggtttgtggcataaatatgtattaccaaattttgtcaatgccaaattttagcaagttttgacatggctaattttggtaaggcaaagttttgtttggattgaagccaaaatagcctaagttcactattgaaatggcctattttcttagacatgccaaaatttggcttcaaaccaaatagacacagaatactattgaaattgccaaatattggtaagtctaatttagacctcaaaccaaaccagccctatattttaggatagatgatgtgttcatttaattctaagttcatcttatagacactcctccccaaccaacgtagcgtgccacacccccaatcctctccccaaccaacgtatacattgtaatagtctatttaaaggattgccagattacaaaagttctgactcgaacttcacctattcaatttctaagtccaaccttaaccagattatttgaaatgtgtttggattattacactaccaaatttagtagggttaaaaattagtagcgaagtgaacaggtcctgtgaatttcgtagcacaaaattttgttttgtgctaattatagagggaatgccgattgatgatttcatagtacaactatctttttgcgccgaacacaagatggaatgtcgattgatgttgtagcacgaggaagccggcggcacgaaggtggacctctatagagatcaggaaggtgttaagacaaggagaccggcaaagtcggttcagtgttctcccagtttgccttttgcattgaagaggtagcataggtagaggtagcactaaccattaacattgagagcaaccaacaaaatcctcttctagctgtcaacacaaattcacaatcaaccattaaccagtatccaacacaactgaatcgcaaaggccacgttattctggagtaataaacattgagagcaactacgaaagagcaaactaagctgatcatgagacgttgccctacacgaccaaacaaacaagcagaagtgaagaggtagcacgaaccaaacacaaagcccatatatgcaaccagcataacaaaattacaactgcactggacggcttatattcttcacaagcaaaaaagtagactcaggtccatatcatcagcatcgttacaacttacaagtaggtagattggaaaacaaaatgcaactcattatcccaactagcattaacagagggggtgggtcctgatgaacaccgtccacgttttattctcagcatagacaaagcataccggtatctccggctcggcggccatggaataccatggcaagcaaaaggattctactgggtcttggccatgtggcggatcaggtcgatgacacggttgctgcagaaaatagttcaaaaaagaaagatcagtaagagcaaattgggcatggagtattgtacatggttaatagtttgaactgcaagtggctcacctgtaaccccacnnnnnnnnnnnnnnnnnnnnnnnnnnnnnnnnnnnnnnnnnnnnnnnnnnnnnnnnnnnnnnnnnnnngatgctcgacctgagtcaaagatgagtacagagaatgaatgatagcatacaggagatagttcgtccgtaaccacttagtttggagcagatctgcattacagatttcttacagggcctctcaagacaaaaaggcatacctgctgtcaccaacaaagtcagtagaaaccaggtcttcctcaacatatcctatgattcccttgagctttccctctgatgcagacctgtaaaacaattagcatattctcgtcagggacacactactaacttaaggataacttgtgcagttctgcgcccaccaacacacgtaactacacttttctaggaatccttcacatgtatgtttcagtaacatacatcactgagcggtatcccctgccacaagatgcagttctagcaacagtgcgcaaaatgagatgtacattccccttgcgttggaagctatatacttacttgatagcactcttgatagcatcatatgaggcagccttctcgattctaactgtgagatcaacaactgagacatcgacagtgggaacacggaaggacattcccgtaagcttgccattcaaatcaggaagaaccttgccaacagcctgcaatgcattgatgttagaagtcattaaggctgcagtcccattttactaacaaaacatgctttcacaaccaaaaactaccgcccacatgcacccccttttccctaagcaggccagaaacaactctgaacagaagcatgaacagcaagcaattcgtcataggacatgagagagaattcatacttgaataaagacagcgcacatgctcatttatcaacaaaaactctagggctgaaatcagcaagcgcgccatttgtgcagttacttgctattatcactgggtcttctacttaacattcccaaataaagtcaaaaagaaaactatacgcagccccataacacaggagaatacaaaattattggaactataaagaggattttgaactgtggttgtgcatgcacaacattgaagttcatgacgtactttggcagcaccagtgctgctgggaatgatgttaaaactggccgccctgccacccctccagtccttgctggacggtccatcaacggtcttttgggtggctgaaaacaagtacatcagcgttagctattacagaacatctagatgttcatattagctgccaaaaagccaagaaagtcttaccagtgatggcatgaacagttgtcatcagaccctcgataataccaaagttgtcatgaatgacctattggatgataacgagtcaattaagaaccaaaccaaaagtccaactgaaagtagaaaattgtcactcggaaagaaaaataccttggcaagaggagcaaggcagtttgtggtgcagctagcatttgagacaatatcaatatctgaagtgtacttgtcctcgttgacaccgcagacaaacatcggagcatctttgctcggggcagagatgacaaccttcttggcaccaccctgttttcagaacagccatgtaagcataaaaaatgcaccgaaatagctaacttatgcaacaagggagatgcacaacaagtacttttcagagtaaaaataaacaaggcatcaagtaataaaaaaaactaaattgacaacacaaagccataagttatatatgctaatacttaagaaattaaggcaaaagaattaggagctgtctgctttgtgatgcatcatcctaactttagaagacttaggtagtcactcttaactttgcaggccaaatctttttgggtaaatgcaaagaccttgacatatatcactggggttcataaacttcaaattttaatgagctttccccttgtggcacatctctgcctacatttagttatgcataatcaaaaaccatggattgcttagtttcttttagttagataatgatgcttttacacaaaggtgtccatcattagcaaaatcgtgtaagattttgtaatctaactacatccattaattcttaaaaataaccatagcattatttacttgcttgtatgcaatcccatgggaacaatatgtaacaatatgccaatttgttggaatgaaaagcaacagtgataataccttcaagtgagcagcagccttctccttgtcagtgaagacaccggtggactccacgacatactcagcaccagcctcagcccacggaatctcgtcagggttcctttcaaattgcacaggatcaaacatcagttccacgctcgctaccataaacaagttactttcatctaagctgtaatatcaatatcaagttacctgatgccgaaaacggtgaccggcttctcgcccaagagcagagtcttggagtccttgatcttgatgtcgctgtgcttccattggccgtgcacggtatcgtacttgaacatgtaggtctgcaaatcacacgaccaacatagaattcatcaatcgtgagcacaccacacgaaaatcaaagccatatgcagtagcaaacagcataattcagcaactaaacatgcgaaaaaaagtactcagatctgggaaaattaactgccatatctcaatcaaaacaactcccaaccactaaacatctctttgagcgagcacgcaaatgtatatctgagctaaaaccactgtagaaccctacaaacgactagatctgcacatgaagacggtgaaacccacagatcgaagagcgtaccatgtagtcggtggtgatgaaggggtcgttgacggcgacgagctcgacatcctcgctctggagggccaccctggccacgagcctcccgatccttccgaaacctgaacaaaatcacaatcccaaacacacaaaaaacccccactcaaatcaccacaaatccaacgaaaccacacccagcacagcacaaactcgtagtaattcagatagcaaactcaccgttgattccgatcttaatcttgcctgcgtccccaaaaacaccaccagaaaattcaccaaaaaaatcagaaaaaaaaacatcaatcagatcaggacgcgaagcaccagcagtaatcaaacgggggaattaattcgattcggaggtgagcataattacccatggcgagtggagatgcgaggacgacgagacagagacttgagattagaggaggagagaagcgtctggaagccggatatggagaggtggagagggtttaagcgctctcttttataaagccaagaggaaaaagtctaattaattattaataaagccaaatggaaccgagaaagcgtgaggaaaaaaaattaaaaataaaaatggaaacaaataaattaagcgcgaggtgcgtgggtgacctgtctttctttaccttttctccagaaggcgcagccggcgcagcgcaggggcaggcaggtgaggtgtcccgctgacgtgtgggcccgggcatgggcgaggcccacgtgtcattagctagtgacgcgcggcgggtagagtagagtacgtggcaggttgtggtttgtcgcccaagaaagaatcaggggaggtgaaagaaatagaaaagggcatatttgctccttcttgcttctgcaataatgcggggtaaagaaaaattgatggaaaaggatgtgaaattttgaaaaaagagaaaaaaaaagttgaactgatcgtgttgtggtgtggtgtgacatgggggtgttcgtgtcgaggtgtttctggctacgtgtcgtcgtttggtaacatattttaagaaaataaaataagaaagagaagagcagcgagctaaagatttgtagccagctgtagcatggacttcaagagacagtgtatgtatgacaggtgggatcaggtattaatagtgtagtatgtaactattgtatgaattaactattaagttgactatatgtgatttggagttagtagttggctaaacttgggccctgtttagttcacagatttttttcctaaaaacattacatcgaatctttggacacatacatgaaacattaaatatagataaaaacaaaaactaattgcacagttagggaggaaatcacgagacgaatcttttgagtctaattagttcatgattagccataagtgctacattaacctacgtatactaacgacggattaattaggctcaaatgattcgtctcgctgtttccagacgagttatgaaattagtttttttattcgtgtccaaaaatctatttcgatatctagttaaacgtccaatgtgacattcaaaaataatttttttttcttgaactaaacaggcccgtgctctaacagaaagtagccggcggcggcgacgggcgatggcgccgcatactgtttgtccggcactcacctgatcgaatccggatcctctgatgggtgtttgtctctgacctattggctattgccgattattaagagctaataatattcataatgacgtttaagttttgtccgaacattacattagtgttgttttgcagtatattccaaaaagaagaaacagtagtactaatattctacctcaatcaatatgcaccgtccattttatatttactttgtataacttataaataaaatcccaattcctaaaccgaggaagtattcatctacatcggttgtcaaaatagtctgtaaactttttaaatactccctccttctctaaatatttaacgtcgttgatttttttaaacatgtttaactgttcgtcttattcaaaaaatttaaataattattaattatttttctatcatttgattcattgttaaatatatttgttttacatatttcacaaaaaattttaaataagacgaacggttaaatatgtttaaaaatgtcaacgacgtcaaatatttagggacagagggagtataacgaaaaaaggttacaaacattcttacaatgcaagtagattgtttatcatcagcctcatcgtttggcatatttttttaaatatgccaaatgcatatttgcaaacgaaaatcattttgtgaataaaacttttatatatgtgttcttagcgatctaaaagcaaaggctgaaaataaacttcgatgaaaaaaccccaaaatcagctccaaatttaacgttgaaaattcaaattttggctgataagcatatgaatatgccaaacgacgaggtctcatgtgttattgccaacattccggaagggcctcatgtgttattgccaacattccggacttccggtggcaacaagacaagggctgtgtttagatccaaagtttggatccaaacttcagtatttttccatcacatcaatatgtcatacacacacaacttttcagtcacatcatctccaattttatccaaaatctaaactttgtgctgaactaaacacagcaaaggtgaaaaaaaaacacccggttgcaataccaatcccaattcccaatcgtccatccacgtgaaaaaaaagagagagagagagacaacaggaatggtgaccacggatgatccgcagatctcgcagctacgagcatcccgtggcgccgccgggggcccaccacgcagcggcggcgataatatcgggaatgccacgggagcgaatataccccagccacacaaacccactagcttccagattcttctgccagcttattcatagagcaagttcaatagtatagctgactactagctttaattaatttatagtcaatttaatagcttatttatacaatagttacatactacactattaatatatggtcccacctgccatatacactgcgtcttgaaattcgtgctacagctggctataaatctgtagcccgctgttcttatctctctttatttatcttcttaaaatatgtttaccgctggcttatagcctagtattgtacctgctcttaagctggtcgtcatctgtgtacccggggggtttggaaaacgtccacgtcaccgcctgtcaggtctcgcaaaaaccggcgaccgctcgcggcggcggccggcgttggctgggcggtcgccgtcgactcctcttcgttccatgttttattgtttcattttctttgtcaaacttttcttttagaagaagtaagaactctagaatctggagagtagtttgttctggaggcataggaagaagaaaacaagtcgagccgtcgaggagatgtgataatatgggtttttttttaacttattactccctccatctacttttgatcattatatttcatcttggcacacagaaaagtataagtaattctacttattatccatttaaacatgctactagttatttctcgtaaacaagctattcattaatattacatttctcgatgtccatggcaatcttgtggggaagaatggagagtcacgcattaaatccgagaaagccattaagaagataggttgttggattgaaatatgactatcaaaaataaaattttcagatttggaaatatgactatcaaaaataaaattttcaaatttgaaaatatgactatcaaaagtagatggagggaatatcatttttaaccctatcaatatatggtgttaccaaaatatgatatgttttggtgttatcaaattcggtagtatttgatgcattaagtttaaagtcttaccaagtacttattggtagagttttttaaaagtgaaaaattccggattttgtaaatttttgtatggttgcaatgataacaatgtatttggacttttaacctattaaaatttggtaatacaaaaatttagttatgttaaaattggtaataaattcaacaagtcctatactaagtatttttttttaactttatgacaagagttgatctcacacgataccaaatctgaactaaccactcgcgattactagtactgaaaagcttaaagatttccttttttttcttaaaaaagaggcgaggcttgagaagttgattgaccacaagattgctgttgcttcgcttcgattgtacacgggttaacttgaatacatcgcacagcaattttccttggaaaacaaagataagatagggcagggattgcagaccatggagcccaaaaggccacagagcagacgatatcggcaccatcctgtttcgaaaattggaaatttagaataagttcaccggaggtcccccaacttaacaccgagactttttgaaattccttaatcacaaaatcagaaatatgtacccctaaactatgtaaaaccataaaaaaatagatcccgaggtagtatagccgcccgctttagctgatgtggcatcctaatcagaaaaaaaataaaataaatatgtggggcctacatgtaaatgagagaaaatggtgtgggccccatatttctcatttctttttttttctcttctcttctcttctctcccgattctctcgagtggacacggcagcagaggggagaaaggtggccgacggtggtgcgggggcggtggtagaagggggagagagccggctggcgcaacgatggcggcggggaaaaggagaggaggcggccggtgcgacggctgcggtgggagaggaggaggtcggacagcgcgacggcagcggcgggagaggaggataggaggcggttggcgctgtcgaacgcgcacgggatgtggcggacgatgccgaccaggacggggtcctcatcatcatcttcctcatcgtcgtcacgatcggtggctgccgggcggaacagtttgggagggagggggaggcggctggcgagcccatctgagcttgcccagcctgcgcatgacccgccctcgccatagcttggtgcgctgaggacgacgacgaggaaagagggagagaggaatcgatggccgacaacaacgaaagcgggcgagtgtggcgccaggctgctcacgctcaccggccaggccctccgctccaccgcactcgcctgctgccctccgcccaccgctcctccacctgtcgctcttgcccgccgctcctgccgcctctctccccctctccggccgccgccggcgtgctcgctccacgccgcccactagccgcgcccgcgcccacctcctctccccctctcccgcttgttccccacgcgctgccgagcctgctccgctgccgagcgccgcacccgcatctgcccgcctgctcgtgaatgtgcagctgacatgtgggccccacataccatttttaatttttttttggctggctaggatgccacgtcagcgaaaccactcacatatactgccataggaccttgagtgcacggtttgtgtgagtttaggggtacacatttctggtttgtggttaagggtcaaaaaaaaaaatctcgttgttaagttgagggacctccagtgaacttatccctcgaaaattagatagttacggcccaaacatgctttctccaaaattcgcagactcacgtgcccaaatttgatcgccagccgaaagcccgaaaaaagtaataagtctattccaccttcctcaaaattcttgtgtacgccaagatacactccaacaacatggcagggtacatgagccccaactatcaataccatataatacttttgagatggaatttcatatttgacttgaaagtttttatgatttttgaggtgaaaatttcaaatcttttagttggaagttttcatgcttttaagatgaaagtttgcatactttgatttgaatgttttctggctttaagatgaatgtttttgtggttttaagatgaaagcttgattcgagataaaagttctctgattttttatttgaaagttttctaatccgaagatgaaagttttggactcgggatgaaagttttcagacttcgatttgaaattttcatgttaagacgaaagtttcatatattttcaggttgtgttgtgtgtttagttcgcgccaaaattgaaattttggttgaaattagaacgatataacggaaaaattagaagtttgtatgtgtagtaaagttttgatgtgatggaaaaattagaagtttgaaaaaaaagtttggaactaaactcagccaaacttccaatctctgatttttagttggaaatcaccaattgaaagtcttgacttcggagtccgatttcccctgatggagcacagcgttaaacgtctggaaaaagtctacaaaaagtagaatggacttataaaaaatatgttgcctaggcgtcttcttcaacggtcacggagcaaaaatgggtactgtagtccgtagacatcttcggtctacgcatcgtgcttctatgcagatgtcttgtttaagaaaaagaaatcaatttccgtttccggtacaggtagataggcgtacgctacgcgtcttttgtccaataataatacgatgttctcctaactgacttccatcgttccatgattagcgttaagctcaagcaaacgcaacgaactacagtagctagtagtactattgtgttccaaaatgtagtaaaatatacagaagccaaattagcagttaggaaacatagagtcgaaatgtcaaattcctacatgtccttagccgcgtcgcgccggttgaacgcacagttttcaacttgacaagaatgttaggggcatataaatttggtttattgttagcataaatcttatcaaagttcggtctatagttattttactccctacgtcaaaatatctggacacattactagctattccctccgtcccaaaaatatataagcatttttagaatagtaaaaagtcaaacatttttaactttaactattaatagcaaaaaaataaaaaaagatcaataacgtaaaattgatgttacaaaatttatcattaaacaaactatcataatatgcaactccttttatttaaaacattttacttttatagttattgttggtcaaagtagtatctcagagaccgtatcggagtctaaaaaatacttatattttgggacggatgtagtattatgcatgtaggtaaaagaatgtgaaatgattgtttgattttgagagttgcgagaaacgtctagtggtattccggctagcttcacaaaatggtggcctagatggcttgggttcgaagctcacccattctaattatttgaaaggcaaattttgctacaggacatcgcgactttgtggaattagctccaggacactgcacgaagtgagttttgggggaagacactcccaaaacatggctatttgccagaggacaccgcgtctatttgtttagtatatttgcgctgactaggcttgagggggcccacattttgacgtgatcggaccaaattgcccctgcacatattctccatcctctcccctcgccgtgacgctgccctggccacattgctgcggccttgcctggccggcctccttcccctcaccttgctttgcctccgccaccatcaccgctcaccgccgaccccgtggtatggcggtactgccgccacccgcccttgcccaccacccaccgtcgggttcgccgcctcccaggctatccctctaaacccaatcccccacttccccctcctagcaccgacctcccccacccctaccccgaaaccttaaccctcaccccgcccctcgtacccccaagctttgtcgtcactctgtaagaaaccgcacgcgacttttcttcctgacgtgtgtgcgccaattataattcctgttccatgtgatcttaagagtacgaggccacacatcataatgatgcctgtgtaaatttgtgtgttacagctaatagaaaattttgatagtacaaaattcagtacaactcccttcgtttaaggttgtaagacgttttgactttggttaaagtcaaactattctaagtttagcttacccttaaaaaatattaatatttacaacactttcattaaatctataattgaataaatttttattatatattttaatattttttttacaaaattaattaaacttaggttagtttgattttaaccaaagttaaaacgtcttataatcttaaacggagggagtagtaattattatgtggacaaaccgacaaacttgcctataaatacagatcaaacgagcagcagacgcacagaccagccattcccaatttcccattgcattctgcaagatccaactatccaagccaagacgccaccgtccgtccgatccacgataccatggcatcggcgggaggccgctgcgacggctgccacggcgacttcggcctctgggagcctcccttgacggcggagtgctcgcacaggttccacctccactgcgtcgtctccggcgccgacgtctgcccggcgtgcaacgcgcgatggaccaacgcgccatcgaacccgccgccgcaacccgccggaggcagcacgacgccgtttggacagacgacgggctttcccatgcgcgtccggccatggtcgtcgtgcgacaaatgccgcggcgtcatagaccacagccagcccaccgtcacgtccgagtgcagccacacgttccacctccgctgcttctccgggagcgtcatctgcccggcgtgcaacgcgcggtggcgcgacacggtggccgtgccaaacccttcgccggcgccgccgtccaccttctttcccgccggcgttcccgcgccgccgccgaccttttcgcccttctgggtgagccaagagtatgacgacgacgagccggtggagccgccggtagcggcacacggtggcggcgtggcaccggcgagcaatggggcgctcgtcgtcaggacgcactgcgagcacacggccgtggcgaggagcgtgatcagggacaatttcgtcgtccttgtccatgccaaagctcctagcatcgccgtggcggaggcgacggcggcggcgcgcgcgccggtcgacctcgtcacggtgctcgacgtgagcggcagcatggaaggctacaagctcacgctcctgaagcgcgccatggggttcgtcattgataagctcggccccggcgaccgcctcgccgtcgtgtccttctcctacaatgcgcagcgagtgatccggctgacgcggatgtcggacgacggcaaggcgtcggccaagagcgccatggaatccctcgctgcgggcggcggcacgaacatcctcaagggccttgtcgaagccgccaaggtgttcgacggtcgccgctaccggaacgccgtcgccagcgtcatccttctctccgacggtcaagacacgtacaatgtcaacggcgggtggggcgcctcgaactcaaagaactacagtgttctcgtgccgccttccttcaagcgctccggcgaccggcgcctgtcggtccacacgttcggcttcggcaccgaccacgacgcggtggcgatgaacgccatcgcggaggagaccgggggcacgttctccttcatcgagaaccaggccgtcgtccaggacgcgttcgcgcagtgcatcggcgggctcctctcggtcaccgtgcaggaggcgcgcatcgccatcacctgcccgcaccccggcgtccgcgtccggtcggtcaagtccggtcgctacgaaagcctcgtcaatggggacggccgggccgcgtcggtggacgtcggcgagctctacgccgacgaggagaggcgtttcttggtgttcgtggacgtgccagcagccggcgccggggaagacgtcacagaactgatcaaggtgagctgcacataccgcgacaccgcgagtcggcagcagatggtcgtcgccggcgagcacgccgtagtgcaaagaccagtggaggtggccaccaacacggagccgtccattgaggtggagcgcgagcgtttccgcgtggaggcaaccgaagacatcgcggcggcgcaagaagcagccgagcgcggcgcgcacgcggcggcgaaggcgatactcgaccgccggcaggaggcgctcgcccggtcggcgccgggtctcgccggcgacgccaggtgcgcggcgctgctgtcggagctgcgcgagctgagcgcccgcgtggcgagcaggcgggagtacgagcagaccgggcgcgcgtgcatgctcgccggcatgagctcgcacgcacagcagcgcgccacgtcggtgcagctgtttggagcggcggcgccgacgtggtcaatgccgatgtgtggatcggcggcgccgccatctctctctttcggggggtttggagggttcgcgacgccggcgatgcggagcatggtggagtcgtcgcgaaagagaagaaagggcggcgacggaagcttaagctttttggatctggtccgaactgaggaagaagccggcagctcagatgacgagaaggagaacctgtaatactccttccatctacttctgatagtcatatttcatcttgtcacatagatcaaggataagtaattctacttatcatccatttaaacatgctactagtcattccttgtaaacaagcgattcattaatatttacatttcttaatgcctatgtagccaatcatgtgtggaagaatggagagtcatgcattaaatccgaaaaagtcattaagatgatagattgttgtattgaaatatgtctattaaaaataaaattttcagatttggaaatatgattatcaaaagtagatggagtaagtatttcagttgaatttactcatgcattttactaccgcatggtgaaatgcttcgaaatttggtttgtctactatgtcttgcgtttgtccatcgttttgcgcaactttggatatggtataaagtaataataagaccatgtatagtggagaaaatttgttataattaaattctcgcatgattatattctagagaaaataattatgtgttttaacggttgaatttagatgtttcacatgtaaaaaacaaatgttttaagtgaaactaaattgtgttgcaacacattttttttagtgttgcacgctttgtaatttggatgtttcaataagtccttttttaatgtttcacttgctcatttgtaaatgtttaatattgttctttagatattatatcaagtattttgtgatattttagtttttataacttaatgttttatgtatttttattattataaataatataatgataagggatattgttgtaaagattcaattgcaattaatacaacaatgtagttagataatttaggagaaaatttggtttaaagtttgaaaaatatgttgttcggagaaggaggtaaagtaatgatggctaatgccaaggagtagaatgcatgcatactccaggcagctagtgagttgacggcattgccatctttgagcaaccgatcagggaccctaaaagttaggagtttcaatttgttatattttaatctatatattgatatatttaatgacatcttatttcattttttaaaagtttcactcttacttattttatgatttagcttgatttcttcagctccaataagtgttcgatggtaatcatggccaactcaaagggctatagctcatgacgatgatttgagcgtgtgttctagacattaaatattttagtttttcgcctaataaaaaataaatcactaaatcatgacataacattttagtaacattttttttaaaaaaaatctccttccgacttaggtagagctccaccgctgatttattctttattctttctcatttttctgggcctcaaattgtgtttcgtaatggacctcaaattcctaggtacggccctgggtgatgaaatatgaggagtgtgcaaatgggccgatccgtttgcacttgaatctgggcaaatttaattgttttattttgagatgaagtataagacatgcacagacatgaaaattgcatgttttagatggaactatcatcaaaatgtataattttctgttcagtcaatgtattcagctttaataaacaatgtggtacttgcttaaaggggtactgttaactaaatataatttggtaaggaggaactggaatggtagtttgagatgttgtttctgtatgaaaaatgaaactattcaatatcttttttatggaatgctattttgcaaagtttatttggagagcagttcggttttcttttggtctttaccctcctaatagcatatctcatatttttgatgattggcttctgggggtggacaagaaaaataggaaatttattctcataggagcttctattatatattggattctatggttgagtaggaatgacatggtttttgacaaatcaccatctgtttcatatgtgtaggtaattttctcggcgacatatttgttcaggtcttgggcactgctacaaaagtgtgatgaagagggcgagtgattaaaagttgcatgtcgtaatcttgagataacaattatgcaacagtttaccaattttgaatggagattcacaaacagaattcaataattgtgtactcattatctttggttggtagtctttagtttgctttttcttcatggttagtgttttttttgtgaactttatcttttttgtgttatactgtaataattgactgtagcttgttgagcaaaggacaagatattctattccattatttaaaaaaagacatgaaaattgcgcccaaataaaatgagacagcctgagccggggaacgcatacctttaattgaacaaacgtatgaaatgaaacacatgttaattcagactcaaacgtacttgaccaaaagctctagacaaagacaatttaaaatttcaaacttaagattgacaaatccaaaccaaaaacaacctaaacttaacctaaaagcttcgacgccttcggtgttgtcttcttcttcagcttcagttgcccccgctgccgctctctcgtgccttccgcgacgactccaccatgctctgcatcgccggcgtcgagtaaccaaatggcacggcgccggaggaaagcgccgacgccggcgagaacagctgcaccgacgtggcgcgctgctgtgcgtgcgagctcatgccggcgagcatgcacgcgcgcccggtctgctcgtactcccgcctgttcgccacgcgggcgctcagctcgcgcagctccgacaccagcgccgcgcacctggcgtcgccggcgagccgccgcgccgaccgggcgagcgcctcctgccggcggtcgagtatcgccttcgctgccgcgtacgcgccgcgctcggcggcttcccgcgccgccgcgatgtcttcggttgcctccacgcagaagcgctcccgctccacctccatcgacggctccgtgctggtgctcacctccgctggcctttgcacgacggcgtcctcgccggcgacgaccatctgctgccgactcgcggtgtcgcggtatgtgcagctcaccttgatcagttctgtgacgtcttccccggcgccggctgctggcacgtccacgaacaccaagaaacgcctctcctcgtcggcgtagagctcgccgacgtccaccgacgcggcccggccgtccccgtcaatgacgctgtcgtagcggccggagttgacagacctgacgcgcacggcggcgtgcgggcaggtgatggcgatgcgcgcctcctgcacggggaccgagaggaggccgccgatgcactgcgcgaacgcgtcctggacgacggcctggttctcgatgaaggagaacgtgccgccggtctcctccgcgatggtgtgcatcgccgacgcgtcgtggtcggtgccgaagccgaacgtgtggaccgggaggcgccggtcgccggagcgcttgaaggaaggcggcacgagaacactgtagttcttcgagttcgaggcgccccacccgccgttgacattgtaattgtcttgaccgtcggagagaaggatgacgctggcgacggcgttccggtagcggcggccgtcgaacaccttggcggcttcgacaaggccctcgaggatgttcgtgcagccgtccgcatggagggactccacggcgctcttggccgacgccttgccgccctccgacatccgcgtcagccggatcactcgccgcgcactgtaggagaaggacacgacggcaaggcggtcgccggggccgagcaaccccatggcgcgcttcagtagcgcgagcttgtagccttccatgctgccgctcacgtcgagcaccgtgacgaggtcgaccgacgcgcgcgccggcgccgcctccgcggcgatgctaggagccttgacgtggaggagaacggcgaagttgtcccttggcgtgctccgcgcgatggccgggaactcgcagtgcgtcttgatgacgacgagctccccatcgtttgccgcggcctcgccgccacctggttcgcccccccccctcgacgccggcgactccaccggctcgttgtcgtcgtacgcgtggccctcctccgtgaccctcctgaagggcgtcgcaaaaaccgatggctgtgctggataggccaccggcggcgtctggactggtactggtgatggcgccggcggccagcacgaagtcagtggcctccttggcaagctcgtcgccgacgagctccacggcggcggtggcccagatcgtccaaacaagccgctcgtggtcgttccatgggcgggctgtggcggcgcgttcacggatgaggacgtcgcgaagggcaaggtgctcgacgccgacgacgccgcgggcggcgggttcacggatgaggacgtcgcgaagggcgaggggctcgacgccgcgggcggcgggttcacggatgagaacgtcgcgaaggacaaggtgctcgacgccgacgacgccgcgggcggcgggttcacggatgaggacgtcgcgaagggcgaggggctcgacgccgcgggcggcgggttcacggatgagaacgtcgcgaaggacaaggtgctcgacgccgacgacgccgcgggcggcgggttggtccatggccttttgcacgtcgagcagacgttggcgccggcgccggcgacgcagaggtcaaactcgtggaggcaggcgctgcaccgaaccctcgtcgtcgccatgggggacggagcaaagcttcggcggcgtctcgatcgtcttcaatcttgcaagatgcaatgcgcgatggctctctgtgtctcttctcaaatatctcgaactcgacgaactttgtttgatctcgcatttataggcgagtttggtggtcagtacgttgcaaaagaccctaaaccgacatgcaatttggtgatggtttcggtaagttcgaatcgtgaggtatcaaaatttgatgaaatttcatcaatttggtgtgatttgtgttttggtaataaaccaattaaccaaatatacctgacatttgcttctgtatatacggtaagtttacaaactgtgcgtacaaccgacgcgacgcggccaggaagcttagaattcggaagtggattttgatccctcaagaggatatcccctcgttgtttgcatgtcactcaaatagttatgaaaaaaattaaaaaaaattaagaagatgtattaacatgtgatatatcactccacaaacatgcaagtaaaaattcaacttcgacatctcgcaacgaaaaaacaaatttgactctgagtatacattaactagccgcggtttaatttgtttttttattacgatttgtagaagttgaacttgaacttgcatgtttgtgaagtgttatatcacatgttaatagacattcccaatttttttaaatttttttataatcatttaaatgacatgtaaataacaaggggatatcttttcgagggattaaaatagtttccctaagaattcgactctcttgtagtttgtgggtttcctaactgctgttgagtttgcttgagattgacgctgtcatggaacgatacagggcgtcgcaggtgctgactcagcgacagcggcggccaacttgacacgttagtaacaaccgtttccggaggagtcaatttgctacgaatcaagagcaagagatgagggaggtatagtagacttatttcaactacaataaatgctggcccaacagatcttccggcccaacagatctttctctggccaagcggcccaagatcgtgaataagcgatcagaaaggcccagagagaacagatgaaaaagaaataattaggagtgaggcgtcaaactaaggtcggctaatccactatctcgtagtcttagagctagccggaagaccatggtggtttctcagatgaagatggagaagactaaattcggtctatctaatctaagctagaggcagctaggtgagaaagcatcagtacaggcggcgaggcaggcgaggtagaagatggcggcggcggcggcgtcgccctgctcgccgccggccaagtagctccgcttgaacctcttcccgccgtgctgttccttggcgctgctgcactgcagcatcttcctcttgatcgccatgatcgcctccccaccacctcgcctgctcctcctcctgctgctgctgctgctgccacccgtgtcttcttctccatcgcctgcattttgcctgaacctgcactgcaccattttgcctgaacttctagtaatttttatgtgctctgtcactgaaggtcagatggccatatgcatggctctagctagatccttttatagagatgagagcagcagtgcagctgcaggggcggtttctgaattctgaataaatatagctggaccagcagggagcagggcgaccgttaacttgggatcgagcaatatttgcgtgatatatttaagtgtgtgtatagctgacattgatggattattaaagcattttttgcgaacccaaacgcaggagcagagcacggaacggtcaatggtcggtgcgtgctgatgcataaaattaggtgagattcatgcacaaatcgatccggtagtttgcatacttgcatatatatattttgcatgcatccgaagtaacagcagtagtgcatgtacatgttcaggttgaaaagtggattacttgcagcgcgtacaaagtgccccaagtgcccagcaacgcacataaattaattagtctgtgcttaatttagcatgcatatcctctacaagtttctgttgtctgtgacagcctttttatctctctgtatcccacgtatcctttcgatgacctagcttctaagagtgttgcagatgacctagcttctattgacgtgcaaagcttctgcattggaagaataaaaaagcatccatacatgatcgatgcatcaatccttacattttatagatttgctccgatacagtaaaaagtatctcgagttaccggtacctcacggtactaaatcgtttccgattattgaatctaactggataggatgagcattgttaaattaaaaagatcaaaaatgatttgataccgtgaagtacctgtacctctagataatttttattggataggagcagatatctacattttaagattccctgttgtgtacacgagttacggccggcaggcagcatgttcaattccgttctgccaagatcgatggcagctagtgacagaggaaatgaaatgcacctccagttgaatagagttaaaagggcaggtcccggtggtcttgaagcagtagcagtacacgcccctcgtgtgatcatggacgcgtttcgtgatttcatctgctactgctagtgctagtgattagtgatagcttaattgaggagctaagcgccattggtggccagcggcaagggcatccataatgtggattaaaagtgggtattagacattaaaatatctttactactgggtaagatacatcgtggaagtagtaaatagttactattagatcatatagctactaccgggcaacaaagaataagttatgttatttgtacagtgtcaatgagtatcaacgaattgttttctcgcagttggagtcatggcagctgatgattggtgagtttttatagtgggccccatgttataccctaccgtcctgcacatacaatgtggagttcatatgctgctactaccgcctgacgtacgggcccacgttactgcctaactcggtcataaacattgctgttgcccaaaatgcagtaaaaagttcgggactcattgggttctcgtactacctccgtttctaaatatttaacgctgttgatttttttaaatatgtttgaccatttatcttatttaaaaaaaattaagtaattattacttatttttctatcatttgatttattgttaaatatactttcatgtatacatatagttttacatatttcacaaatttttttaataagacgaacggtcaaacatgtgctaaaaagccaatagtgtcaagcatttagaaatggagggagtattttctaataattcaaaacggtttattgagaaatacaaattaataggtaaaacttttacatatttattcgtaatgacttaaacaccaacataaaaagaaattatattaaaaatataaaatcatcttctatatatttattcgtaatgacctatttgttcccgctcttcttttgtgtggttgaatgatataaattaagtccgaccaatatttaagagagttaaattggactttttccttatctgtgaaatctgcatctatctcatctcgagcacagttggttctgctgatcaacaccgcatcagatcagatgcaggtggtctaaattgctgagacagacagagagggaaacagacaaatagtgcacaagaaacagcaagtgaggtgtgattactcgatggttggtcctcaatttcttgatctaacgttccaaccggtgcaacaagaagtgaaacgctatttattactggagtagcaacattcagagacttttccttattatggagtaatattacatatggcctttaaataagttggccgggcctgtttaaatcacactaatcacctggaatattataagtacagtatttttaaaaatcgcgaaagtgaaacacgcccagcagaagaacctcggtatcttcttcagatgttttttttttttttttttttttgaggaaactatcttcttcagatgttcacccttgtcttttcaacacctgccaccactatctgccgacgtatttttgcataaacacgagaaagtctccagaagaccagaggatgagcagaaacacgagaaaaggtcaaaggcggaggtcagcatatcgctcatcagttctactccgtagtccgtagatgaacaaacatgcagattaatactcgtattagatagcagagagactctttccatcacgccaagcctgggagcaatttaattccgcgtaattttcgatttcttttctaaacctgaccgcgtcagtcagtgtagaccggtcgctgtttcagattaattagcctctggttcttgacctgaatgtgcgtggaattgcagagaactgcaagttttgtttgctacaagtagtaggtgtagacttgtagtagctgtgttctccggctgattcggccgccggcgatggccgctggtgagctcgtgacaagatcgtccatggctgctgcttctgcttctgccatagcctgcctgctgttcttgggattcttgcctagcctcgctactgccgtgtcgttcagctactccaccttcagcaacgggaccaagaacatcaccctccagggcagcgcggcgatcgccggcgatgggtggatcgagatcaccaccggcagcaacctgccgagcggcggcaccatgggacgcgtggcgtactcgccgccggtgcagctctgggaagccgccaccggcgaggtcgccagcttcaccacgcgcttctccttcaacatcaccccgacaaacttggacaacaagggcgacgggatggccttcttcctcgtcggctacccttcgaggatgccggacacggcggacggcggcgccctcggcctcaccagccggaccttcgacgccgtcatgtccggcgacaaccggttcgtcgccgtcgagttcgacaccttcaacaactcgttcgatcccagcgccacctacgaccacatcggcgtcgacgtcaactccatcgtatcggtgcagaccgagtcgctgcccagcttcagcctcaccgggaacatggccgccattgtcgactacaacagcagctcgagcatcctgtcggtccagctggtgaagacatggacgaatggctcgactacactttacaaccttagcaccaccgtcgatctcaagaccgccttgccggagaaggtctccgtcggcttctcggcggcgacgggctcatcccttgagctccatcagctgcattcttggtacttcaactcctcgttccagcagaatccaccaccggcggcgcagccttccccgaccacctctggtcccggacttgccggagttatagccggagccaccgctggtggagcactgttcgtcgtgctcctcttcgccatgatagttgtcctcgtgcggcgacgtcggagcaagaagagaagggaggcagaagaggcagaggaggcgagacacgtagggttggccggagatgacgacgatgacgatgacggcgagcccatcgtggagatcgagatgggcatggggccaaggcaaatcccataccacgagctcgtcgaggcgacgaagagctttgcggcggaggagaagcttgggcaaggtggcttcggcgccgtgtacaggggatacctgagagagcagggcctagccgtcgccattaagaggtttgctaaggattcctccaagcaagggaagaaagagtataggtcggagatcaaggtgataagccggttgcgtcaccgcaatctggtgcagctcatagggtggtgccatggccgcgacgagctcctactcgtctacgaactcgtccccaaccgcagcctcgacatccacctccatggcaatggcaccttcctgacatggccaatgaggtcagtaactgtcctctctaacttcatctcaacttctttggtgatgtcaaattaatcgacatgttcttgattttaacttgtcacagggttaagattgttcttgggcttggatcagcactgttctatctccacgaggagtgggaacagtgcgttgtgcaccgcgacatcaagccgagcaatgtcatgctggatgagtccttcaacgccaagctaggcgacttcgggcttgcaaggttcatcgaccatgccgtggggatgcagacgatgaccgccgtctctgggacaccaggctatgttgatcctgaatgcgtgatcaccggtagagcaagctcagagtctgatgtttatagcttcggcattgtcctattggaagtggcatgcggaaggaggccaatgagcctacaagataaccagaagaatggcatcttccggttggtcgagtgggtctgggacctgcacggacaaggagatgttatctcagcggctgatgagcggctcaacggtgactacgacgtgtcggagatggagcgtgtcattactgtggggctttggtgtgcgcatccagacccaagtgcacggccgtctatcagagcagccatggccatgctccagtctagtgggcaactaccggtgttacctgccaagatgcctgtgccaacatatgcgccgccggtggcctcagtggaggggctcttcacatcgtccactggaatgttgtcctcaagtgcaacacaatcatcatcgacaaccagtggctatattacccacacctcaagttcctctaacacatccacttcagctggttcaaaggactcgtcttcgttgctcaaacatcaatacttatgatgttcaattcatttgcattgttactgattttgacttgatgcttgaatgggatgtacaactcgtgagccattgattttccttttagagtagtctaattgccaatgtgagtaatgtatgtgcatttatgccatgatttaaattttactcccattttagttattctagatagatttatcctgccattttctctctaatatctgactactataaagtgcatacctggcttgttttcagtgaatatcctagtctttagagggcctggaattgtgaattgtcgaagttggaagaacttgttttaaaaaaaaaaacaccaagagaagataactcttacacacttcacatatagtttgcatgttttcacttttcggtgaataacgcaaaggtgtaaacaacaggagctaaatataataagctaaattcaatagagatggaatatggcctctacagactggagacaatagtacaaagactgcttattttcagaagttcttatgcagttgtctcaaatcgtggatatttatgttggatacttcggtggtggaatcaagaacatccaagcaaaattgttaacactaaaaaatagtaacagcataatagttcactcactatgatctgtagcttttcagctggttgttttgccctgtttttcagcttttcaaccaaaaggttgttctcccccaaatcttaagaaaaattcgggcagcactctttgtcggcccgaaaaaaaaaagattcattaaattagacattcatgaaataaacatatcacctaggattgacaactctgctacctcacggatcgatcaagacaaatttggaaacaaaagagtggttctgatagactcagtaatgggtttgctgctgcaaaattctcaacagaatctgatagaacaacccattggacactactccttccagaagaaagggaagatctggaaacattatatcatggcacagtagcaagtgacccattctctttcacattatgtccttagccatgatcagacgcgcttggtcaaacctaccaagatgattgacagaatagtaatgagaacgaattttgacaaagagaaacagttccagtgatttacgcattcggaattaaaaaccactacaatagttacagcaatttttcatccataaaagtccatgcatagcctcttttgaatgtccaagttagctattcaacattgatgcaggattgtgctgacctaaaatgaggttgaagcccttacattcttttgttaaggggacatcgatcggaagacgttaagaggctaaactaatactccctccgtatttttatgtatgacaccattgactttttaatcaacgtttgaccattcgtcttattaagaaaatttatgtaattatcatttattttattgtgagttgatttatcatcaaatattctttaaacataacgtaaatatttttgtatttgcacaaaaaattttgaataatacgaatggtcaaactttcgtaaaaaagtcaatggcgtcatacattaaaatacggagggagtaaatacgaacatacccaaccttagaggaaagttagtgttggacaccaaattgggcatttatcacatctaaattatctcaataaaaaaacaaaagaaattcacattatacaagacaaaataaaaaaaaacagcagtaccaatgtaccattgtgaccaatcaaccactagcatttctcacattaagttgaggttatgaggtaaccctcacctagtcacctattggaagaggaacctccagtaggacaagtcggcggcgatgcactgtcgcagcctagcgtccaccgccgcgctgtgcagcaccatcagagaatcagccctcgccgccggcgcgaagtgcctgacaaggtcccgccattttgggattaggatagttcccttccagacctagctagcagcaagaacacctgcgggggcgggaggcgtggaggagctacagtatactttgccgaccggaactgctcttcaccggagatctcggtcggcgcgcggccgacgactcgagtatggtggcggcggcggcgcggtagaagacgcttcggttgcggaaagaagaaaaagcttaaaccgagcatggctagttgggccgtgcaacgtcgggagaacattttttattgggctaaactcaagtcctaaaatgggccttgggccagagtttttggaagagcgggggagtatgttgggcccccattgggggtgggacaagtctattttgtgtcggagccatgaaacttggaggcccgtttgatctggcatgggaggacgacgatgcgaaggaatgggggaaggggaagatgaattggggagacctacggtgagcgttgccgccttcttcccatagtggaaaaagccggaccggagaatgacccagtgagctcatctattcaccggttcaccggtcggaccgccggttcatggctaactatattttaagtcataattgactttaaactgttaaataaaataggtattccattctgaatagcacatatctcttgcccagttggttaggtgggaaagtacaaggcttgtagcgcctcaagcatgtggtctggggttcgactccccttctgctcatactagaaatttatatttttccctgccggtcttttctgcaaaccgaaccgtggcatgcactggttccctttttttccggttgaaccggtggctgaccggttttttgtactaggcttcttcctgttggcggagctaatgtggtaaggttgggacgacggatcgttggcggagctcacggtggttccctttttttccggttgaaccggtggctgaccggttttttgtactaggcttcttcctgttggcggagctaatgtggtaaggttgggacgacggatcgttggcggagctcacggaggaggagctaggcagcagtgcagctctccgacgagatcgtaccagcctgtcgtctccatcttcgctgtgaggaggtcgtctcgaatttgcccacgtcggctcgagtactggccgtctcgagctcgccgcagtggacgacattggtgatgctgatatggggaaacaacaatacatggcgtcgctcgagacccctatgtcaagggcctattgggtccactaggtcttttgtttttaaaatttttcaactcaacgacatgcaggtcccgttaagtttttattcttttattgtagtgccatgtaggatgaaagaattccacatacatacgtgatcttcgctaccggcgccattgccgtcgccaccaaagccccgcaacttctgagcctgacgctgccgttgacgagctcctgagcgccggatccactgtccttgtcatcaccactgaggtcctgagcgccggatctgcctctgccgtcgtcatcgccgctagatgtccctgcagctcccaaggctagcgccagattcgttgttgttgtcatcgctgccgaggttccgagtgctggatctgcctccgctgagttcccgagtgctggatctgccggttcctgagctcccagcccgcacctaccattgccactgccaaaagctcatcaccgccttcgcaagcccatcgccccactgctggctcccgtcgcggcgccccgccgaggcctaacttcgccagtggatctagagggggagaagtagaggtggagaaaagctaagtgagagagggagagagaaggagaggatagtggatcacggtggggggatggttataaagaagagggttggctggaaagttgtttttgcatacaattcttttaagtggctctgtggagattatggttaccccatatctgcatgacggttatactttagtcggatatacggcactaaatatagatagaacatctttatgaggattcgggttggattctaaacttgtatctcaagaaaatacccgggatcctagtcggttacgattgtattctatctgtaatcccatgttccgttaggatatgggctgtactttgtaatacggatcccttcccctatataaggaggggtccgggttcctctcgggacgattcttttttctcccaatcatacaatcaataatacactcggcggaatcatccccggacaggagtagggtattactttttgaataagaaggcctgaacttgtataaaatcccttgtctctaaacccatccactttcctaacttgatagccacccccttttattattgccgaaatcttgtttcgacagttggcgcgctaggtaggggtagcgtcaagttctcgccgactaagtgcgatgggtttcgtttctggcatcgacgacttcgccttccctcccgggcatgcgttccagttcggcagcctcaacttcatcaccaacgacttcggcaagatctctctccttgactcggatttaaaccagtcggggagagaccaggtccctgtgccattcggtatcccgaactcggccgaggcctactccaagatcatctctcccgagtcagcttcaaaccactcggatgagatccaatctactcttccgcgaccagatcaagacgacgggtcctatcccccaatcctgatgaaacttcctgatgatttggccgttgtcttcacagtcaagacatcttccactcgaagatctaggcgagctccggcttcggccccgatccgatccagatccagggaggttggcgttatactccaacctctcgggacagtctcgacggaagagttggatggctacctcagctcccccggcgtcagttctcgaccaaccgagatcctcgactacgacgatttcggctaccactacgaccacggcgacctcgacaacttcgacgatagctatgaggataactacacgcccctctacttcggcgtattcatggctgacaatgaaacggaggaacagcgccaagcccgagaagcggaccaagatcgcgcacggcaagaagctgaacgtcgccaactggaggaagagcgacagcgacaagagcgagaacgactacagcgtgagcaacaggatcacgaacggattgcaaaggaggctgaagatcgacgacaacacgccttggaatctgggcggagagcgagagagctcattgggcaacaagacgtcgatgggacagcagtctttcgcaccccccagcagaacgcggttgcagcaatcactctcctcgacaccctcctcaaggaagacgcactcaaccaagccgatcatgttgtcaacatcttgaaccagacgaagaccatgatcgctgcctcggttccagccaactccacaagcacccgcaccccgactggtagccgagtcccccacttccgatctcatgattatcatcagccaagcctcagcatcatcggcacaggatctagtcgcaggagcaggggtcacgacgaacgatctgttcactcgcctcccgaacgtcacagggagagccgagtcgaacggcctcgctctccacctcaccgacgtcccgtcgaccttcgcgacacgatcaaccagcgccgtgcagcacgaagtcaccgccattcaccagatcgctacgacgacgacgtggacggagtagctgccttcactaatgacctgcgtcgagtggattggccagccggctttaagccgactggaatcgagaagtatgacggcaccaccaaccctgagtcttggctcaccgtatatggtctcgcaatccgcgcagcaggaggagacagcaaagccatggcaaactatctacctgtggccctagcggactccgcccgatcttggctccacggactaccctgtggcacgatcggatcatgggcggaacttcgtgatcacttcatcgccaacttccagggcacctttgaacgccccggcacacagttcgatctctacaacgtcgttcagaagtctggagaatccctccgagattacatccgacgcttctccgaacaacgcaacaagatctccgacatcaccgacgatgtcatcatcgccgccttcactaaaggcattcgccacgacgacctagtcggcaagttcggacgtaaacctcccaggatggttaagcagatgttcgaaaaagccaatgagtatgccaaagccgaagatgctatcaccgcgtccaaacagtcgggcaccacttggaagccaaagaaagacacgccgaccgtaggagggagtggaagtaacaaccacaaggattgcaagcgtaagcccgaagaacttgtggcgaccacctctccatcttcccgacaacattcccgcgtcaacatcttcgacaagataatgaactcccaatgtccgcatcatcccaactctaaccacgtggccaaagattgcttcgtctacaaacagtttgcggagcaatacgtcaagaacgcacgcaaacctgcagacggagatcagggcacatcaaagaagaaagatgatgaagacgatgccccgactggttttcaagatcatcgcaaagaacttaatcacatcttcggcggacccctggcttatgagtctaagagaaaacagaagctaacagaacgggagatcaatgcggttcagcctaacacgccccaatatcttcggtggtcagagacagcaattaagttcgaccgctcggatcatcctgactgagtggtccacccggggcggtaccccctggtactagacccagtggttcgcaatgtcaagctccgacggactctcatcgatgggggcagcgcacttaatatccttttcgctaagaccctggacgatatgcagattcctcgcacggaattaaagctgagtaatgcacccttccacggtgttatcccaggattgtcagctacaccactcggccagatcactcttccagttaccttcggcactcgggagaattttcgcacagaaaatgtttgtttcgaagtcgctgattttgagacagcatatcatgctatactcggacgaccggctttagccaagttcatggccgtcccgcactacacctacatgatgatgaagatgcctggtcctcgaggggtcatatcactacggagcgacatcaagcaagccgtcacatgtgacaaagaaagttgcgagatggctcaaacccatgagactactctcgcccgcgaagagatccgactggctgcgaccacggcaagcgagggagaagtgcctgcaaccaagctgacgaagaccaaagaaagcggtgccaagatgaaaaagattcccttagatccctcggatcctgataagactgctgtaataggcgctgagttagattgtaaataggaaagcgcgctcatcacctttcttcagaataataaagatattttcgcgtggaaaccatccgatatgcctggtatccccagagaggtgattgagcactctttacatgttaaggaagacgccaaacccatcaagcaacgactccgccgttttgcacaggacaggaaggatgcgatcaaggaggaattaaccaagctgttagcagcaggcttcattaaggaagtccttcatcccgactggctggctaacccagtcctggttcggaaaaagacagggcaatggcgcatgtgtgtcgattataccgacctcaacaaatcttgtcccaaagacccttttgggttacctcgcattgaccaggtggttgattcaacggccggctgcgagttactcagcttcttggactgttactcgggatatcatcagatccgactaaaagaatccgactgcttgaagacctcgtttattacgccctttggggcctactgctacatcaccatgccctttggattgaagaatgcaggagcgacctatcaacgcatgattcaaagatgtttttcaactcagattggtcgcaatgttgaagcctacgttgatgatgtagtcgtcaagaccaagcggaaggatgacctgattgcggatttagaagaaacttttacaagcattcgtgctttcaagatgaaactaaacccggaaaagagcatctttggagtaccgtcagggaagttgctcagatttatggtatctcaaagaggcatacaggccaacccagagaaaatcaacgccatcctcaacatgaaaccgccaagctcccaaaaagacgtgcaaaagttgactggttgcatggcggcgctcagccggttcgtctcacgactcggcgagcgggggatgcctttcttcaagctgctgaagaagactgacaatttccagtggggacccgaagcacagaaagcctttgaagacttcaagaaactcctcaccactccaccagttttggcctcgccacatccgcaagagccgctactgttatatgtgtcggcgacctcccaggttgtgagtacggtcctggttgtcgagcgtgaagaggaaggccatattcaaaaagtccaacgaccgatctattttatcagcgaggttttagctgactccaagacaaggtatcctcaggtttaaaagttattatatggtgtcttaattaccgtcaggaaattatctcactattttcaaagtcactcagtcacggtggtcacatcgtttccactcggggatatacttcataatcgcgaagcaaacggacggattgcgaagtgggccttagaattgatgtctttggacatatctttcaaaccacgaacttcgatcaagtcacaagctttagctgatttccttgccgagtggaccgagtgccaagaagacatgccagaggagaagatggaatattggactatgtattttgatgggtcgaagaggcttacaggcactggagctggggttgttttaatctccccgactggagaaagattgagctacgtattgtggatatatttttctgtgtcccataacgtggcggaatacgaagcgctacttcatggactaaggattgcaatatctctaggtattcgccgactaatcgtccgtggagactcacagttggttgttaatcaagtcatgaaagagtggtcatgtctagatgataatatgaccgcttatcgacaagaggtgcgcaagttggaaaataaattcgatggactcgagctcacccatgtcctccgacataacaatgaggcagccgacagactggccaattttggttcaaaacaggaagcagctccttctgatgtgttcgttgagcatctttatgaaccaaccatgcccagaaaagaagcaaatgaagccatggatactcgaggcataggcatgattgaagccgactggagagaacctctcataaaatttttgaccaaacaataactccctcaagacaaaaatgaagccgagcggatttccaggcgcagcagactttacattattcatgagactgagctgtacaagaaaagcccatcaggaatactgcagcgctgtgtgtctttggaagaagggagacagttgttgaaagatatacattctggtatttgtggtaatcatgctgctgcacggaccattgtcggcaaggcttaccggcaaggttttttctggcctacagctgtgtccgatgccgacaagattgtgcggacatgcgaaggttgtcaattttttgccagacaaactcatttgccagcccaagagttgcaaaccatcccgttgtcctggccatttgcggtctgggggcttgacatggtcggtccctttaaaagggcagtcggcggttacacgcatctctttatggccatcgacaaattctccaagtggattgaggctaaatcggtcatcacgatcacagcagataaagctagatattttttcatcaacattgtgcatcagtttggggtacctaatcggatcatcactgacaatggcactcaattcactggcgaagcatttaaagacttttgtgaagacttcggcattaaaatttgttacgcctccgtggcacaccgtatgagtaacggacaagtcgagcgcgctaatggcatgatactgcaagggatcaaatcacgagtttttgaccgactacgtccctatgctggcaagtgggtagatcagctgccgtccgtactttggtctttacgcactactcctagtcgggctactggccagtcgccgttctttttggtttatggagcagaagcaatgttgccgagtgaagtggaatttgaatcactacgatttcggaacttcaacgaggagggctatgaagagggccgagtagacgacatcaaccgactagaagaagcccgagaagcagctttaattcagtcgactcgatatttgcaagggttgcgccgttatcataattggaatgttcgatcgcgagcctttttagtcggcgacctggttctgaggaaaattcaaacaacacaggatcggcataaattatctcccttatgggaaggactgttcataattgctgaagtcactcggccgggttcttatcgactcaagagcgaagatggtactatcatcaacaattcttggaatattgaacaccttcgtcgattttacgcttaggcatttcgtttgtatctttcctctttgactgctaagttcaagttttttcctcgaagttttcagtcagggggctactataataataatggagtgtgatttatatcaattcaatttgcttacttgatgtatcattgccctgtttgatttcttggcttagtcaatgaggactgaaagttttttaacaacttttgcgggttttaggctcaacaaggtttgacaaaaacttttatgaaatcaggagctaagttaagatatcaagcacaacataaattcatcagtattgtacaaattgtgcctccatcatcattaatcatcaaaattatcggtacattaatcagtattagtcttttcatcatcagaattatcaggaccagtcggtcgaagatcggtatcttggaatctctcaactacatcagcagcaattttgtcagccactttctgcgcatcactgatgaggtcaagagcagcttcttcgctcgtcccgtctgcaaagccatcaatggtgtcaatatcaactctaggataaagggatttagtcttcgccaacgccagacttgctcccatacttccagcttctttgatgttcttgaaatatgtatccggagcaactctcagcttgtcgaaaattttagaagcatcaagtgcactcgggccattgttattgaagaacatcgcttgaacgattggggcggcagcgttagcaacctcatcccgggctccttcaagttttttgatcttgccaaccaggacgtcgaattgagcttgagatttgatcttgcggtctgcatcaacaggttcacattaataagtcagtatatggaggataatggcttttgaggtattgattgttgataccttcaacttcctttaaagccaggtctctttgttttgccagttctgccttgtcattttccagaatttgaatctgcttctccaactgagatatcttggcagcttgtactacattgattacggttaatcaagatggcaaagataacagtatgagtcagttgagcagagtttgtgcgtaccttttgatgagccactcagttcaaaatttgattcctggagatcagcgatccgatccctcagatcatgttcattcttcctggcaagttctttcgcttcgtgcaattgattcctggtggctttgagggtcccgagatgaggaactaacctctctaaggttactgttttggcttcgttcctaagatgaatcctctgcaagacagtttaattagcgcatgaattaaatggcaaacaagatggttgagatcaggtaccagagaacttacatttacaatgcgggttgcctgaccaagtgccttcttcagtaggcataactcttcgtcctctttttgcttatttatcacgatcccttgaggctgcatgttgtcatcccaccacttgaccagaatcggagggcgtgaatcctcagctgcttgtatccggaggatctcttcttcatcaccaattattggccctagtgtatccatgaacgaagatgaagcagccaaataaagtttgttggatcaaaatgatttcagatggcatgtctaactgtgatgattcccggtcggggacgaatggatcttggtgccttcataggagatctggtttctgattcattgtcagcatccttcccgagaggactgttcgtttgagcttcaacctcgggaatcttttggcttggccctgcatccgactggtttccagtcgggggctcctggttagcaccgacttcagcttcgactgactggttcccagtcgggggctcgttgctgggttctacattataggttgccggctgattttcactcggatgatcctcagcagttggtccggtttctttggaagagcttgtgtccatgttagtcgggtcagagtctttcccagacgggtctatatcagatggtttcctgcaaatttgattatcagtattatcgccgcaatgggtgtgcatcaatacaagaggaatcgttacatgagttgcacctggaagacttcctgatctttggcgcagggcgactggatgttttcttccttggagtagcctgttttggtagtttcttggtcgtctctcagtcttcaggcctcctggtggtatcgtcggcttcgtcgtctcttagaaccagcttcctctttcgagaatctgactggccgactggatcagaagcacttggttgagtttcagaccgaattcttggtcctccgctcccttgcccagtttggtggcggggagatcggcgtggagcgattggtggattcgacttcatcagagcaaattcctgggtgtaatatctttcattgttaattgattcaacaggaagacaagatcatattttgaggaaggttgaagtatatgaatacgcaccggtggaggaggattgaatgcgttgaacggtacgactggcagcaagtgtgagtagctgacaacgatggcgtttgagaagatgttatacatcctttccttcatgaccttgaagtcaagagaatccggatcttcacggtttgggtcatgcttgccgtcaaattcgaaggctgtgcgagatctttctttgattggagctaaccgacacttgataaagtgccgggtgatctgttctccttgaaggccctgttctttcagctttatcatcctctccatcagttctactgcttgagcagcttcatctcccataggcaatgagttccatgtatcctggtaaaccggaggaagacagcagtactcggggagtgcgggctcaggattctgaacataaaactagtttgcgtgccagcctttatttgaggtcttgaagggcatggagaagtatttttggcttagtgttcccctgagttggaaaccaacacccccaacgacgtatggtttgctcttatttggctggggcttgaggaagaagatgcggcggaacaaggcgaaatgaggcctaatgcctagaaaagcttcgcaggcatggataaaattggcaatatgcactatggagtttgggttcaaatgatgcaagctaatcccgtagaagtttaggatcccccggaagaaccttgaggttggaagagaaaatccgccatagaagaaatgcgcaaataccacgatttcgtgtgtgtcgggggtcgggaatgcctcgccgaacgccggtcgccacccgataatctcctttgtcgggagaacgccgtgcgccaccatctccttcagattatcttctgtcacatcggagggcgcccactgactctcgaagctttctctttcttccgccatgaatgtgaactagatgatttgatttagttcgagatacggctggaaagggatggggaatcggagcggtggatgcggggagaaatttcaggaagtttttgaggatggattggagcggattgatgaaccctagctttgttggcgcggttctgtactgtagcacggagtggggaatggcgagagtctcggcggggaagacgaagcgacgtttggacttcggtatttttagggtatcgggagtactaatgggcctaggcctgtacagtatttcagcccaattatgttttcagcgtggcccgttgtgatccctacggacttaggtgctttttgctttggcaatatgtgctcacaatggcgcagcccgatgctgttaaaatcctttttaacgtgattcaataattctttagaattattatgatgcacatgaaaaggtgcccgacagaaaggtgttataccatttttgtaagctttttaggctacaaaagctgttgggttcatttgagatgactggtttattaatggtcattcttttagcatgttatatgcttattttaattatggtaagagttatagcctaggctaatgaacttcttaattaccatgatctttatcatatttggtggatcattataagagtttcttactcggattcctaccaaatatatctatttttggaccttttgagtgtttatcactcggcccttctcgtattttttgtccttgatatattcagattgagaagcagttggctgggtatcttactaagtaccatgcgtgcttcgctataaaaccacttggttcttgactatctgtttagtttttcaactaatcacatagtcggggggctacacctaattaggtgcatctactcgatgcaccatgttttcgcccttcacagttttttagtactcggcaagccggagcaagttgaattgaagcactcggattattgttttttgtttcgagaagattattttggtcaactgcgaaggtctcgggggctaatgtggagattatggttaccccatatctgcatgacggttatactttagtcggatatacggtactaaatatagatagaacatctttatgaggattcgggttggattctaaacttgtatatcaagaaaatacccgggatcctagtcggttacgattgtattctatctgtaatcccatgttccgttaggatatgggctgtactttgtaatacggatcccttcccctatataaggaggggtccgggttcctctcgggacgattcttttttctcccaatcatacaatcaataacacactcggcggaatcatccccggacaggagtagggtattacttcttgaataagaaggcctgaacctgtataaaatcccttgtctctaaacccatccactttcctaacttgatagccacccccttttattattgccaaaatcttgtttcgacaggctcgtattcgaaaatcgatttttttcatgtgggtctcaaccaaataacatcccaatcttttcacatgcagatgttttttttgcccacctataactaaagtggggtgcttcctagtagtgaacctctccgtcttcaggtgattttcccttcagcttcctaaataatcctgattatgatgtagattcaaaggcacataaattacagaattcatgaaaaaaaatcacgaatgcgcaaaaggattgtacatcaatatattagaagaaaaagaatttgttacataacgcaattagctagaccggcctatgccaagggaagggagaaaaagcaaaacaaaagctcaagctggaaaagactactacgacggctaaacacaactctaaacagcggaaaggggtagagccacgctaacgctacactcccgagaaatctccaaaaacggcaatgctagctaaagactacatatgaccttctgagaggaaggactctagaaccactccgacagaattcagaaaaatgaagcagtagctttcagattctcactagctaaagctgcttcttaaacctccagctctttaaacagagccattgacttggtgctccaagctagagctcagcatttcggtcttcagtcccatatgaccatcaaacaatcgatcgttgattcagcccaatcttttctgaccccgacggtcgaaaactatggccggagcacagaaagaagtgccattttggcacaattaatacaagtggaagaactaatattaccaataaatcaacggcaagcttgtgttacaattccttgttagaccgagccggcttctcgagtctctgtttgctagtggtggctggcacaccagctgctcgagtgatatcgtggacatgagttgaataggctaatgggtagtagaggtgatccatccacctgtgtaatactccctctatcccataatataagatgtgcacatattttaagattttactttaaaaacatttgaccaataattattataatataaattttattttatttgctaaaattaatatcattggattgacatttaaatttactttaagatgattataattttgttgcaataaactttataatatatgagaaattataggtcaaagattagttttgaagactgtgccaagtttgactatgccttgtattatgagatggagggagtattaattattaaaaccattggattgttacacatttaacattttatcctttacttaatgagaatgttcttgaccatttatgccaaaacgaagtccatgacgaacattatttaagaaaaagagattaattatgtggcatcacttgtagtgttgctgtctgtctcattgtttagtgagtggcaattcttgttaccatttcttcaaactagttttgatgtcacatggttggagacctatttctggacatcaccttaccgggggaatgagaatgatattgccaatttatttaagtttttttttactatcgtcttttgctaccaccatatagttgttttgtgatacatctcggtctcttaactcttagaggcatgtggcaacgtttcttgaatgtgatcgaaatagttgagaaaaacaaaagctgacaacgtagattaggtttctatcaataacaaaaaaaaaaaaaaaggtagaccataaaaagtacaattggatttggattcacgcactacaacagatctagacttccctaacggattccctttgacaaacagggaatccgtcttgatttgtgataaattcgcaaaaacaaatatcgttgtaaagttcaccttcaaccgatcctagcgacaactagaagtcttggtcctaagatatgttctccgcgacaaacaggattgtcaagaattatggggatttcatcgttagcagctaggttatcatacgtttagatttgttgggagtacctttgtttctctatctagacaaaaaaaaataacttgatctattttttcgctataggaaatagtaagttacgttatcaatcactttaaagagttttataacctgacaaaatttgctctaggtaactctataattatgacattcactctaagatatagttttgcggtttgccgtatgatggtacagttttgcttctctttgccaaaatacattttggccattgctttgacatatcctcttcaaatgagagattttctaaaagaagaaattgcccttcaacctaccaagtgagcctgagggcaattttgtcttttcaaaagttctctctttccaattgaagaggatagggaaaaataagggactacctatataactcctgacgaataatttttagcgtacttataaatgtcaccataactataatataaatatagtgtacttatattttaactatagtgtatattagatgcaactgctatgtaaattagaatttgctttgtaacacagtgggagatcagcacgttcccacactagcttcgcatcacgatttcgacacgacgacacctacccacagcgcacgctatcaactttttattcttgatcatgcgcacgaatctcctagccaatccaacgataaaaatccaaaagtttttcctccacttttctacagtagtaaaatagcaagtatgtaaagtaataggtcaagtgtcttttggcaaaagaccgcaatcctgtgataaaaccgtaaaactagagtgccttagaatattgagaaaattggaaccatgtcattataatttgcaaaatttgagatgtaccatcctgactcacatgtcattgactcatgtgggtcctacatgtcattgagataccgatggcatatctcaaattttgcaaaattataatggcatggttccaatttaccatagaatattttatcttaggttataggctaactataaacaaatgtagaaacgagataaaaaaaaatagcttggatacatgcattaattaaatatataagtgagataaagattgtggataagaaaagcatggacaatgaaatagcttgcttatttatatacattaggtctaatactatttttgggtggacttagggcctgtttgtttagttcgcgaaaagaaaatttttaggtgtcatatcaaatgtttaactggatgttggaagtggtttttggacacgaatgaaaaaattaatttcataaatcgtctggaaaccgcaagacgaatcttttgagcctaattaatctgtcattagcacatacgggttactatagcacttatggctaatgatggactaattaggctcaaaagatccgtctcgtgatttctcctcctaactgtgcaattaattttttttaatctatatttagtgctctattgtatgtaaagaattgatgtgatgtttttagaaaaaaaaaagaactaaacaaggccttagtttgcttacgagacgttgtatcataataaggacgaaacgagtatacgtactagctagtagcgtttagtatccacatcatctgcttacctgtgttttgtcgtactcttctttcgtcacttatttacaggctggcgcaagcgcggtccaaatccgtccagaggtaaggccctctttagttaccacataaaaaatttacgtcttattatatcgaacgtttaagtatccctgtataaaatattaaatatagaattaaaaaataactaattgcacagattgcgactaatttacgagacgaatcttttaagcctaattactacatgatttgacaatgtggtacttgctaatgatggattaattaggattaattaggcttaataaattcgtctcgcggtttagtgacggatgttgtagttagtgtttttatcagtgtccaaacaacccatgcgacaccctatataatacccaacgtggcacaccaaaattttacaccgctgatgagggctgaccggttaccttaaatctgcgggactcccgactgcattgtcacgtaggaaggctgtaagcattgtctctcgtttctctccagctggtcaagccgatcgatcagtactggtagtatcgttgtcacccttgcgcgccgatcgatcgacgccggcggcgatggccgatgtttctttgatcagttgcgctgtcggcatcatcttcttctccgccgtttgctacctgcctacggctcctgtcgccgccttgtccttcaactacaccaacttcaattcaaacaacccgagcatcgaatatgaaggcaacgcctctttcagcgtcgggtatatcgacatcagcttgaacgaagccaacggcatgggcaacagcgccggacgggtgtcctacaagcagccggtgcagctctgggagtgggacgccgccaccggcgaggtggccagcttcaccacaaccttctccttcaacatcacgccgagcgataggaacaacaggggcgacgggatggccttattcctcggcagctacccatcgaagttaccagaccgcgccggtggccacaacctcggcctaaccaaccaaacaatcggcaacgtctcgaccggtgacaagaggaagacaagaggaagcccagcccagacgatccatgcgagatcggcggcccacgagcaagtatgtgtcgagtgagtggacccggtagctgtcgaccgggccactgtcagagagggagcgagatcttttggcacatcgctatataagatcggcaaagtagagagagaaggaatcgaacattgtagaaacaactaaattcccaattcaattcaaatctctctctctctctctgttctattgcttcctctgttcttcctctgtttctcttctcaattcacgaattcctcttcgaattcccatggtttcgtcatcgtcttggcgtgaattccacaagtgccgtgacatttggtatcagagcagcgatcctggagaaaccaaggtacacttctcgtttgcaatcgcaggttgaggcaatggagaagcagaatctcgatttcggcaagttgctcggcgacatccaggagtcgctggtggcgttgaacaacaagcaggcggagatgcaggtggcggtggcgaagttggacgaaggggttagtggatggcgaccccaagttgaagccgcgatcaaggacttgcgtgctgaggtcgacgaacttcagcagcagcatgatgccgccaacaagggaaagcaagctccatcagcggcactttcccctcgggtcccgttgacgggcgaggaaaggaaggtgccattgttgccgactcctccaccatcatatcagttgggcgcggcggaaggcgggggcaaactggccggtggccacggcgttccacaacatcactggaggagggcatctggagtggttaccactctgatcccaactccgggcaagggtacgttcaatgtttctcctgtgcctttgcattcctgtgaaaattttgattcgggatttggggaatttgatggagaggttgaggaacgtcagtatagccatagagtgcctaagttagattttcccaaattcgatggtaccgactcacaggattggaggatgaagtgtgagcattatttcgatgtgaataacacgtacccggggttgtgggtgcgagtggctatcatctacttttctgggagggctgcatcttggttgagatccactagagctcatgttcggtttcctaactgggaggatttctgtgctgcgctatctgataagtttgatagggatcaacatgaactgttgattcggcagatggatggaattaaacagtcgggaacagtgtgggagtattacgaacagtttgatgaactcatgaataagttgcttgtgtatgatccagtagtgaatatgcgttatctgacacaccgtttcactgagggattatataggaaaattcgtaatgctgtttacttcagagaccccgagacctcgagtctgctttggctgttgctttgttacaggaggaagtgctggagacagctgatgaagtgcctggaaaagaagttaggaagagtgaaggaaattctctaggacgttcagttgcaaatcttaaaggggcatatcctttgccaactcctccaatgaggtctgggggcatcaacatgggcattaaatctgaagaaaggaaggagtctgaagtaaaacgttcatcaggaatgaatgagagattatcttctcttaaggctcaacgtcgtgctcaaggtctctgttacatctgtgcagagaaatggtcgcctacacataagtgttctaatactgtgcaactgcatgctgtccaagagttattcacagtgttgcatgaatcagcagaggacgggttgagcacaacagatcatgttgttgagcaaacgttaatggcagtttcactacaggctgtgcagggatctgaaactggtggttgtatgagaatgctggggcaaatccaaagcaaagaaatcttgattttagtcgactcaggcagctctgccagtttcatcagtaaaagggtggcaagcagttttataggggttctagagcagcctgtgcatgtgcaagttaaggtggctgggggagcaatgttacattgttgttctgagattctgaattgtgaatggaccactcaaggacatgtgttctttactaatctgaaggttctggaattgaacaactacgacatgattttgggcatggattggttgatgcagcacagtctaatgacagtggattggaccacaaaatctctgataattgcttgtgcaggaactcagattcagttacatggtgtaaggtctgatactgagcaatgtgcccacataagttccaggcaacttagggaacttaatgacagaacaacagtgtcttagtccaattttgttcagttttcgcgttggagcaccaagagcagattcctaatgtggtgcagacagtactgacagagttttcttcagtttttgatgaacccaaggggttaccaccaatcagacaatttgaccatactattcctttgctgccaggagctgggccagtcaatgtgagaccctatcgatatactcatgtccaaaagaatgagattgaaagtcaagtgcaagagatgttgagtaaagggataattcaaccatgttcaagtcctttttcatcacccgtattacttgttaaaaagaaggacggttcatggaggttttgtgtggattatagacatcttaatgccataacagtgaagaataagtatcctttgcctgtgatagatgaactattggatgaacttgcgggagctcaatggttttctaagttggacttgcgctccgaatatcaccaaatcagaatgcatccagatgatgtgcataaaactgcttttcaaacccatcacggtgactttgagttcagagtgcttccttttggtttgactagtgcaccggcaacttttcaaggagtcatgaacagtgtgcttgctaccttacttaggaggtgtgtgcttgtattcgtggatgacattttgatatacagcaaatctttagaagagcatgtgcagcatttgaaaacagtgtttcagattttgcttaaacaccaattgaaggttaagaggactaagtgttcttttgcacaacaagaattagcatatcttggacatataattcaacctaatggtgtttccacagaccctgagaagattcaagttattcaacattggccagcacccacttctgtaaaagaattacgtagctttttaggtctctcaggatactacaggaaatttgtgcgcaattatggcattctcagtaaacctcttacaaatttgcttcgcaatggtcagctctatatttggattgctgaaactgaggatgcttttcaagctttgaaacaagcgctcatcacagctccagtccttgctatgccagatttccaaactccttttgtggttgagactgatgcatctgacaagggcattggtgcagtgttaatgcaaaataatcatcccctcgctttcttaagccgagctcttggactgcgacatcagggactctctacttatgaaaaggagagtttggccataatgcttgcggtagatcactggcggccatatttacagcatgatgaatttttcattcgaactgatcaccgcagtttggcatttcttactgaacagcgtctcaccactccctggcagcacaaggctcttaccaaactcttggggcttcgttataagattatttttaagaagggggttgacaacaacgcagcagatgcattatctcattatccaggctctgatcaggtggaactctcagctttatcagttgcagttccagagtggatcaatgaaattgtggccggttattcctctgatcccgatgcctgcagcaaggtacaaactctctgtatcaattctggagcagtaccaaatttttctctacacaatggggtgctttattttcagaacagactttgggttggtcacaatgtagaagttcaacagaaaattcttgctaatcttcacacaacggcagttggaggccattcgggaatacaagtcacttatcagcgcgttaaacagctgtttgcttggcctcgccttcgtgccactgttgttcagtatgtgcaagcttgttctgtttgccaacaagcaaaatcggagcatgtgaagtatcctggaatgcttcaacctctcctgtacctgaccatgcgtggcaaattgtctctctggatttcgtggaaggccttcctaagtcggcttctttcaattgcattcttgtggtggtcgacaaattctctaaatacagtcattttgttccattgactcatcctttctctgccttggatgtggccgaagcatatatgcaacatatccatcgacttcacggcttgcctcagtctttgatttctgaccgtgatcgcattttcactagtacattgtggactactctattcaagttagccggcactcaactccgaatgagttcctcttaccatcctcagactgacggccagactgaacgtgtgaataaatgcctagagacattcctccgttgttttgtccatgcctgtccttcacagtggagtcgctggcttgcgttggcagaatattggtacaacacgtcctttcactctgctctgggcaccactccctttgaagtactgtatggacataagcctcgctactttggtctttcagcttctgctgcttgtcgatcagacgatcttgttgagtggctgcatgaacgtgagaagatgcaagctttgatcagagatcatcttttgcgtgctcagactcgcatgaagcaacaggctgatcagcaccgttcagaacgctcttttgcagtgggcgattgggtttatttgaagcttcagcccttcgttcagcagtcggtggttaccagggctaatcgtaaactttcgtttcgattctatggaccatttcaggtgcttgacaaggttggagcggtggcatatcgcttggatctgccaacttccagtttgatccacccaattgttcatgtttcccaactaaaaaaggccttggctccaacggaacaagttcattctccacttcctgtgctggatccgacaaatgttactcacgtttgtccagcgcagattttggatcatcgcttcatccgcaagggttccaagatggtggagcaagtacagattcgttggaccggcgatgcaccagcagcaaccacctgggagaatccgcgcgagctccgtcgccgttttcctgcggcaccagcttgggggcaagctggaactcaaggaggggggaatgtcatgccagc

SEQ ID NO: 80218 - DNA, 6891 bp, Oryza sativa
ctaaaacgggggagtactaaattggaactccaagatgagtatctatatttattaagtggattagattgaaaaaagtacattgtttttgcaattacccaaaagttgtacacacaccacacgcccgtgggtttgctttaacacacgatcaaagaaacagaggtcaatgacaaatcgctaactcagtaaattcttttgaaaacatgttcgcaataatttgctaattattaatttcaaacttcataattatattaacaaagtgctaaattgggagtccatgacagataaacaataattacttttcaattcaaatgaagaaatttttaagtttgttaaaccctaagaaataaattaaaacctattttacggtagccaaaataaataaacccttggtgcactgtacaaaatttggtatagctaactcgattgatatgctttgatttggatttgcatagatcgatctattgctttctgacctcattatttaatatttaatttggttggatcaagtcttcgtcaggttgatgcggtacctatgtatgcactgtttctgtagatttcgtcagggcaattagcatggctgatggatacgaattattgaaagaagtgacatgaaactaactgttggatcaagtattagtcaggttgatattgcacatatgtataccttgtttctgtagattcatcaaggcaattaatatggctgatagatagaaactgtagaaaagaactgacaggaaacttactatatatggttagaccaccaaatcgaagttattacagaggcttctattggatctgattgagattcatcctcttaattgacgcagtagcaacatcgtcatgcacaacgaaaatttttatcatggatcttgccggccggccgtgacgttgttgatgatttcagatcgatgtgagagcgcttgattctatcttctgttgcgatggccggatggcgttaggaagtagatcgatctaaatagtatttcctcctcgtccctctcagtattagtttctgagatgtggtttaactaagggtggcccacgaagttaactaattaaacataaatcagatttttattatttacggtcaggataaaataatctaactaatcaacggttagatctttctggttaacgtgggagctaaaaaaaagtgcccaattagtataggtatagatagatagatagatagatttctaaatacaagcagtggatgattgagaataaattgaaaatatgaggtgctaaatatctgagctcctggttccgaagaagttccttggcagagtatatatttatattcaaattgtctgttgtactcgattattagattacccaaactttagaagcttattgaagctgtcgattcctaccattttcccatcaagtttacacaatattgtcagtactctgatctcctcgtggtttaagtgggctggtcctgtacccatttgcatgactatattggagttgttgggtctacagaggaacctatatgtgtagattttttctatttttctgtccttaagcacatgccttgcaacaccatggttactgatcacggttattatattatattagcgcgctaccctcaaacgcatgacatataattgtaagagttagccaaccaagatatggagggcatatggtactgtttttcatccagagttctcccatttctactgcaattcctaccttaaatttacaagtgtgaattcattgtttgtcgtcatgggtgccttcagaaattgagacagtgagtgcttgaggggtgtagaagtggtgctaggatatactccctcggtcccactcactagggcacggtcaaacttggcaacacaagactcactgatcacggttattacatcgtattagcgcctaccctcaaacgcgttgcctatacatgtaagcgttagccagccaaggcatggagggcatacggtgctgtttttcttccagagtcctcccattcctgctgcaattcctaccttaatttacaagtgtgaattcatcgtgttttgtcatgtactcatgtgtgccttcagaatttgagatggtgagcgcttgaggggtgtagaagtggtgctaggatatatatataatgttataagtattgttaccagatgatgatgtgacatatttacatgtgatttaaaatactctagataataattgctagtgggtaatgatgtggcacatttgcatgttgagtttagtagtttgtggccatcaacttttatagtaagataagataaaattggtcatttaaaaaaaaagattggatttgttgttagaggaggaaacacacttacggtagtggtaagatgggctttaaaacaggcccatgaggttaattaaactttatagtgtatgaccacggtaatacgatctaattaatcaatggtcatatctttctaattaacatgagagcttatacaaaatacccaattaatattgttagatagatagacaaatcgatcaatcacactagccacttagtcgtgtgttgcacgattttgggtgcatatataaaagcctagtatatacaatagtgagattgtgcattaattttttttttacaaaatcaaagaacttgataaaaaatagttagaaaaataaaacatagaaaattatgtttcaactaaaggttcaaatatcatgtccgagatatactgtatgcgatcaagagatgagaacatgtttactcagcaatctgattcataagtctcagaatggtcaaatagaatgcaataaacatcatgtccttatcatttgaaaccaacacgaggtcatttgacctctgagtatcacaagatgataacataataaacattccgaaatgattcttccccctgaaatgcaaaaatatgcaagtgcacttgaagttactgttttggaacagaaaaaatgaatgattaattcttatgagatatgaaagattccatttaatgttcttattatctgaaaatgtatgtagttcaaataaattgtagtctcacatcaagtatgctcattgagttatcatgacaatagaatcacagttgcaagcctacaatcctttatgacatatcccttctttctataaagttaagtcccaaagctgaaaccacagcattccacgtcatcactaattctcagccattcgatcggtggatcagatcgcatatgaaccgttggatgagaaggtcccaggtgagatgttgagtcattggacagctcgcctcctcaacgtgcgcaccagcgcaacatcaggaaactgctggcggcatctcaaacgctcggcatgaatggcatgaatagctttaaacatcttcctccatcatggatactatttatctttttcactacacaatgttaacagtgttaacaatgttagaacaaattgtttacacccaaatttggcacctcggattaaaataggaaagattgccaaaatttggaagtctaccgatttcctccgagtgggccggtctgaccgccgtgtgttggcggtcagaccgccggttgagggccggtcagaccggcggtgtgtggccggtctgactagcaggtccgagtccgactgtgtttcgttgggttttgaggtttccttgctcgagaaggcatgttttgggtttcctttagtttctaccccgagttggatgtggaggagggcctgtagagggcaagaccaacccctatataagggacatggccggttcattgtaaaaaaccaatctacaatcaatcaatcgaatcgtttttcatattgcttttagttttctcttagtttgtccatctttgtcggtttgcgccgtaaaccgtccgccgccgctgcgagagtgcgacacctctttgtaggtttgtcttgaaaaccttccgttttgcccacgagacgggtagttatctagaaatctgctccgctagccggtttagttatcaaaacccatctaggtttagctcattgctaaatcgaggtggttggtgactctaggatcactacaaggcttaagatgctgcgatcgtgcttgtcaacttgtcaaataaattgccaacacgactccgccggtcagaccggatattaccccggcggtaagaccgggtctcaagccgatccaaccgcacatcttgatgccggtcagaccaggccctgggctggtcagaccggcgcaattgttccaatacaggaaatagatctgatgactaatgctagttatttgtatcactttaaaacatttgatcctcctgtatctactgctacaagtagtccctaagttcccccacatgttcctaatgcttataatgatgtttctagggggtatcctcccgatactagacaaggccaatataatcatattgcgccacaaacacaacctattaggccaccgaatccaccgccaaatcaataagggcctaataacatggaggatataattagtgatattattaggaatagattcgggattgaaactaggaatcgtgctagaacttacaaaaagccatatcctgattattatgataatgtgccgtttcctcgaaattatagagttcccgaatttgccaagtttagtggtgaggatggtaagaccacatgggagcatgtaggtcaatttttggcacaatgtggtgaggctaatagtgatacttttaaattgcgcttgttttctctatctttatccggtaatgctttcacatggtttacttctttaccggcaaattctattcatacttgggctcaattagaagaacaatttcatgattatttctatactggagaaactgagcttaggttatgtgatttgacatcggttaagcaaaagtataatgaatctgtcattgattatattgagagatttagagatgttagaaaccgatgttatactttgaatataactgatagagatttgactggtcttgcttttaatggttagttgctcctcttagagaaagactagatggccaacaattttttgatgttagtcaactcatgcaaagggctttggctcaagaaagtcgggttaaggataatagaaaacttgctagaccatttgacaaaaagcctaatgttaatgtggttgattaccctgaggctagtgatagtgaggaagagggtgatcatgatatttatgttgctgaatggtcatggactaacaaaaataagccttttgtttgctctaacctaatgccgattcctcgcaaagatcggcaaattgaggttaagtatagttttatgtggccaagtgtgatatgatttttgattatcttttgcaagagaaacaaattagattacctaaaggccatgtcaaaccttctcaagaagagttgaaacgacgagcatattgtaaatggcatgattctcattctcactatactaatgattgcaatgtgtttcgatgacaggttcaatcggccatagatgaaggacaattgaagttcaccgatggctccaagatgaagcttgatcatgatccttttccggtgaatacaattaatttcaatgataagaaggtgttgattcggtcggagcaagccagatctactaagggaaaggaagtggtcattggtgaaccaaggtccaagatgatagtaccaaagaagccagaagttgccgtttggaaggagaataggagtggagcttcaacatcaaaagcccctaggaagaccaaggtgacttttgatatgcttttggagaaatatgagaagcaaggtggtgagaaaattcgcaacaaagggaaaagaccaagatcacctcctagggagcgatttggtcattcaccaagtcggtcgcattcaccttcatatcattatccacaagacatgtcatggggttcctatccaatgccgccgccggattatccttatccttgcttcatgccatggggggcgacgacgccaatgttcaatcgtatgcctccaatgcaattcaaccaagggtggggaggaccacggaggccaattcatgagcgtttgtctttactaaacaatagccgattttatggtaagaatagggctaatgaagaaaagagggaaggaaagcgcgtcaaagtggaggagaggacttcggaagtgataactattaaagtggggtctcatgatgtgccaatacctactggagatggagttgaagtgtccccgaacagaaaatctgaagctggtaccagctcctcgtagtcggccggtctgaccgtggtcatgcggccggtctgaccgggccatcaggcctgtctgaccgccgacccgatagcggtccgaccaacacctcaggccggtctgaccgtgcgccaaatgttggtctgaccggcgcatctggccggtttgaccggtggtctacgaccggtctgaccggactctagcgccggtttgacaggagggttgcgaaaggagatgagagggcttcatcgtctttaaacaaggttaatagaggacattatctacctcccggaacagagccgaatcctaggtggatgcctaaggatttgatggctactcaaaagaggaggttgcaacgtcttcgggcccaagagttaagagagaaaaaggccgaagagcaaagggataaaaggttcaatgagttgcgacccccaccggtatggaggcctaaatccatagagaaggcaaaactgattggtgtagaggaaaaggaagaacaatcagttgataaaagtgaatcatctccaaaagaagacatgaatattaacatggtatgtatgttgcctatggagttttgtgctatggatgaagccgaggttgctcagttcttattaagtcctaaagacgcagtttttgagaaacccgatgagtcaaaccgtcacattaagcctctctatctcaaaggctatgttgatgggaagtcggtctctaggatgctagtggatgcaggaaccgccgttaacttgatgccgtattcgttat

SEQ ID NO: 80219 - DNA, 8360 bp, Oryza sativa
gcgtgcgagcgacatatgcacccacacgtgaaaatcggattttcgcgtgtggttgcgccacccacatgcaaaaatagcgattttcgcagacgaagtgctgcagacgggccaaatctccgcacgagaaaatccaaatcgaccgcatggaaaaacgatgtgtgtagtagtgggccttgggccttgtaataggctagacccatctcggaagtgtctccctccatctccacgaattaccaccaaaccctagatctattttcctttatagatatctatgtacaccctctagaatgtttgggttttgtttagttgaattttttcaagtgtcattcaccttgtctctagttctcgcttgattagtcagcgactatagatttagagcccccaacagttggtgtgttgatttgccgggtcaattaaatctaccactttaatcgcaactattcttttgtgcttaatcacctggacttgttttggttggtagccacatcgcaaacgtcgcactcgattaaagcgagaattatcccctcaccagaatatcgggccatgagagagagcgtcatcagttaaagctgctactttaccactacgacaaaaagggctattggtgccggatttcccgaccggacacactggaggggcactgatctggagaatcaatgatgtttttggactgaaaaaaatggtcggcttgaatgcatcgagccgatgcttcaagccgacaactgattccataagtgatgagacatgaacatgaggaacacacgtgaacataagaacatgacttgatcattggtgcctcttccagcgtcgtcccgaccgatgtcgcccgtaaaacctccgctgcctccacaccatctgggccaccatctccacaccgtcctcgctgccagatctggtggaggggaggtccagcctgccgcctccacaccgtccaccactaccgcagctcccatcctactggatctggctgatgggagggcgccgacacccctcccgccagctggaccgccgccacacatagtgagagagagagagaggagaagtaggatggagaaagagatggatccagatctagagaagtggagagagatgatgcctcgcccagtcacaaatatctcctccggctcggctcgatgtaatagataccggtttttaaaaaaagccgacacttatattattggtgtcggtttttctgtaaaacgacacccatcttcgtttaaaggtgtcagttttttctatcctttgaaggtgggaaaagaactattagtaccgacttgtatgtgcattttttatagtgtacacaacacaagccggaaaatatgttgactgccaaagacatggtatatcttgtctggcgacggcagcttcacggtcaccatatattcccgctgtatttgtataaactagtgaggggtgttgttagaatggtttgcgtaaaccatcatcaagcaccgctattaaaattaatgacatcgatgcatttcgttcaagtttatgcatcacacattaatgcttaatgcggtgcgaggggctaaagcctagcaagtgtcggatgtgaacacatggtggcatttgcatacttgaccacatctttgaataggcgtataaatatatgtgttcactttcttattagtgacactgcattttctaatcatatcagctttgatgttggatttatatttcatcattttcatgaacaccttttcttttcatgcttagctagagacttcctaggtcctttttgtttaggcttaattataggacaacttataaaccgaaaagtcaaagcctaaacgaacaagcggcattttcgttttgcttttttgaaaccatatataagccactctaacactattatataagccaaaaactaggttagagaatcttttttggcttatatgaggtagatgtatgactccacccattaaacttaggatattaaattcagcggcttataaatcatataagccaataagctaagtctaagacaataaatctaagcatagataaagaaggtatccataatcattgtgccccacggcaacgtgttggtaccacactagtttgttctccactgctcttatggcccaggatctgcttccacgaggaagaggtctattccacgattaaatattatgtttcttgtggtatggacatgatttcatcatttgaaactccagtttaacttccaatactgtatatctgtcgaaaagaatagaacttgttttatgaagactaaataagacattgcagccgagaaagctgaggtagcggatgccattgcagcacgccagcacccacacagggacattacgagatctacatatccccaaagatcaagcaaatggaagagcatctcgcactaaagaaatcaattctttgcgttgaagtcagtcggttgaggttctggtgtggcaagctttgacaatcggaaagttcgccgttttgtcaatcggacgcggcatgtaagaatgttcatggtctcgttttgccggtggtgaagacgttgactttggagagccaatcacccaatccatgcatccaatcaggtcgatcatatcagtggttgggaactgaacttgcttccaaagcaaacttaacacgtggatatggtatttatatactctgatcctccttgctcttcatcactacaacccacttcatcggaaagctagctaattaagcacctagcctaggaggaagatcgaccatgaggggcggcaggatgaggctggtcggggcggcgatgctggcgctgctctacatggtcgcgtcctttcaaggtgcctctggggccgccgccggcggctctccctccagcggtggggggaggagctccggcggaagtagttccagtggctcgagctctggcggtagcagcacaagaagccctgtaggatctgcgagcccaagtagtggaaggaacccagcaacaactgggagccccgggggtgtaaggagccctgcaaccgcaagagctgggagccccgggggtggaaccggaaccacccttgcaggagcagggagccccggcggcggaaggagccctgtaggaggtggaacgatccctgcaggggcagggaatcaaggcagcgggtcatggagcggtgactatggaagtagaagctcggatggcgggggaaggatgttatgtagaccatataatattgagcacattgccattttcttcatgcttgtcttagctgcattttagctaattcttttccttattttcaacatgcctatgtatatatccaatgaggggaaacagtgaggagtcacaaggggtctgtcacctcccccagtcccagtaaaactacactacatttatgttacggtagcttttatgaaattttaaaagatttgtattatttgattccctccatcaaataaaagatcactgactaaagtttatgacagggcaagttccctggtaattaaattaaaatcgcattctgcagttttgtcggtcacttgttatatgcagttttaggggcttaataaatggagaagaaagatgacaaaactgctgcagcagttcgcagagcaaagcctcgtcgctccctctctgtttgtttcttcctgattttctgtttacgatgtatagctttcagttttgtctgaaaatccataatgttcattgtgtcctactgcatccgagtgagcgctacagacaagtcctgacgaaagggcggtggcacggagtggcgatgacatcagagatgagagcgaaggtgatggcagacgcaaaatcttgtattgcattgctaatcgaagtacgtacctcgaaagagcgtatgtgcccgagatcaatgagtaatcaaggtttaaataggaagatttggggatgctatgtcaggtaattgaaataccatgcagtatgttgacctttttttagtcaacacaatatcacctaacggtttacggtgtaaataatagagtcgccgaaatcgattgatcaaaaccggctagcggaaccgatttcgagattgattcactttcgcggaatcaagcgactaatttacaagcaaattagcaaagaagataaatgcgtacttacgtgacgatgaacgactagtttccgagcaaactagcaaaggataacctccttgctttcgtggagaagcacgaccgtttttcagcgcaaaatggcaaagattaactaaattctagggttgctaaaactcagccataaaaataaaatagaaaagaactgaaaagtgaaaagtaaaaagagatgatagtagattgaaattgttcgggggctcctcgccgacgtcagggctgtagatttatagacgctgcacactgcatccaaagtctcctttatatttcgtgggcccatccttcctttctttccatcctaagtcggtactgcattcaagcaatcagcttgattatatttccataatctttgccaggtatcggtccgtctgattcatcgttgtagtttcatccgtatcatgtgcacgcatgccatcgttgctatcctccatctgcatcctctagtgccagtcctgagtcctgacaagcctaaacagctgcacgtacatgatcaatatacatatcaccaaaccggcatgatcaattgctgcaaccacccatcaatttcacacactaatttaaccggttctttagcaaaccattctatgaatcatgaaagctaaactaaataatctggcccaccaaatgaattatctactagccaaattatggcataaacacatgccccctgtacatgtaacttttattttaccgagaacactattaaattaaccaactcaaaccacaatcatactctcagaacgatactccacacacgatatcggtcctgagcccatccacagttatcctctcaaaacgatactcaaataagtattcgttttaagaccatccacagtcgtccactcaaagcgatactaaaataagtattcgttgtaagataatcaagctttctaccatgcaaaatgataatacattttaaaatatttcccatttagtactaaactttagtattaattcggttgtccctaatgtccacctaaccgaattagctgtaattcttgggtccaaaataatttaaaaacaacccatctaaacttcgacacattttaaaagcaatcttataaaccgattgcagggccgattccaggcctcccattgggccacgtggcaccgcgcccctagctccatccgggttctcggctggagaagtgagccacgtattcgtacccttcccacagccatccgatgatatatcgacggtgacaaaggtccagcggatctcaatgtaaattggatgttttgagagggtttttttcttaacaaaatgtgtgatttcatcaagaatagaacagtgagtagaggaaaaaatctcagaagaaaaaaatccaagaaaaaaaaatccggcaagaacagtagattccccctcctaatcaccatgcagtgttgtggaagacggtatacggatatcagacggagagggtaccgctaaacgattaatcggaatgcggacgattaatcggaatttggcggaaatataatgttttgaaaatatatgtacatagttgataatagttttccctttttgataaacaaatgcatataacttaatatattccttctatatatccttaaatagaataaccatatatgatatttaaataagttcataatggatagctgttactgtatatctcaattctgacgtagtgatgggttttgttcataatgcatgaaatgaattatcaagagaatgtagtacatagcataaatgaccgtaatcaaggtcccaaataacatatgtatcggcttcatcaaatacaaactccaataacctgatcatcatcaaaatcaaggaactcatgttcaaactttagaggaagtcagttccttatcattttacatcttgctgccttgtgagaatttcggaagagcaaacttctagtcaatagtagtaaagggcacagctaatgagctggattgtggaatcgacctttgtcatcacgccgattatacggctgattagacggagatggacgatttaatcggtaatgatcggatttatgcgttcgttaccgactaatgatgaccgcatcggcgtgacgtgacggactgatctccgtatccgtattatcggacgtattaacggccgttaacaccgttttccacaacactgtcaccatgccgtcgccgagtgtggagaagccgagaaggagatgagaaagcacggtgggattcttggccgctggattgggcgaccaccacccccgccatcctcgcattccaccaacttgattggagaaaaaaaagggctgagccgttgaggagaaagaaaggaagggaggggatacaacgccggaccaccgagcaccgctgcttgatcctccaccaccgccatttctggtttcagctgttagcactggctaagcaagccacaggggagagggagcagcagccatgggccatggcgatttctgatggcgagcgaaggaaccgagagaaaaacaaaaggagagcaagcggagaaagagagagagagagagatcggcttgctgccttgcatcgagcgccacgctgagataaaaaaagcggtttggctcggtggaaaaagaagatcatggggacaaccgaaggagtagatttttgtatatttgttgccagaagcccctgtccaattttttgtatttaaatccttcagaatgatccaactgaaggagtaaccagatatccatcattaatttgtagactggttactggtttttcatttaagggggtatttagatctatatgtgtaaaatttggacgtgtcacatcggatatacgaacacacatttgaagtattaaacgtggactaatgacaaaacaaattacatattccacatgtaaactgcgagacgaatttattatgcctaattaatccatcattagtaaatatttactgtagcaccatattgtctaatcatatagcaattaggttttaaaaattcgtctcgcgatttacatgtaatctgtgtaattagttattttttagttatatttaatactttatatatgtgtccaaacatccgatatgacggggtaaaaaattttatcaggggatctaaataggcccttagggtctagagatgtactactgctatgttagaagtgtgtggtcaattagggtctagagatcgattaggtatatctgcagctcgaatggctaatctcaggtgcatactgtactagtataactaaagtatcatccactatttattttacttaatacttaaaataaaatgttgcttaatcgattactccatctgtcctataatatattagcctaatactaaataagacattttatagtatataatgaatctgtcgtttactcttcaacttattggtcacaaacaaaattttaatttcaaaacctaattttatagttgaatttattttttttctttgtaatttattttccaatgttggcttttaagtcacaaagaacaatcataaaaaaaattacccttttttccgaagagcacatacataaaagtattatctataaattatttttaagctaataagcgtcattgcttaaaatcagttatcggcaaaacaatgtgactattaattatgttgaatgaaataatataataatactccacatgtttcatgttatatactgttttgacttttttcttaatcaaactttcataagtttaatcaagttaataaaaagtattgcaactactatcgaaatatattcaatgttatatttaatgaaactaattagatgttgtaaatattgctaaattttattataaacttgatcaaacctaaaaaaaagttttattaggaaaaaagtaaaaacgaatatgaaatagagggagtatattactacgaagtactgtacatcgatccatccctaatcctttttgcaaaatgttatgaaaatagatgcacaacggagacacgaatttttacgtggaaaacccttgcgggaaaaaaaacatggacgccgaccggcaatggtcactatagaggagatgattacaaacgtagggaaataacaatgggaacatcaccccttcccgtatggcttacgagagtatatataggggataatagaaagacacctaataggaactcctactagaaaactatctgaatatattgtgggcccaaaattcggatcacatatttaacaatctccaccttgagacgaatttcctcttgtagcataaaaacatcaatcaccaaaaatacctcatataggtaaaatcaccatgcgccaaatagtttataggactatactatactgtaatacccaccaagcttgagcaaagctcaaacttagtagtgggaactggctttgt

SEQ ID NO: 80220 - DNA, 25103 bp, Oryza sativa
acatgtaaagagtgtaacgacaatcaatgctgacacctattaacaattgttatctacccaattagaatatgtcttaattatattcatctcatgactctgactatctttgatcaccttgagtagtagaaaaaattaattgtactacgggtttaggatgggcgaaactaatggattatttgatttttatgatatctatttgagggtataaatgaatgaattaacttctacaaatttgaaatgttgttctggaaaaagcgctttaagaaaaaaaaatagaattgttttcctgaaacacatcatttaggaacatgggaaacatgcaaatgaaaatacaaaatctagatcgaaaggaaaaacagggagtaagactcaacccttagttttagcttacatagagttgcatgttgcaaaaacttaacccactggacttcattattttccttctgcaatagtcgttcaatttgttttcactttattaacaaaacaatcattatccattgatgatttgatgtgtcctcaccttggcaaactggtacggtgtggtgatcatgatcaccttagttgcctcaatctggtgctccgcattgtcgtggcgcacgcatgcatgtgttgtgcagaggaacggagtgatgtttttagaggctttattgtgtttagaaaaatagttctgatggtttattatctatcagtttaaatgaaaatcgatagccaaatattttagcaacaatatagtctcaaatattgggtccagttgttggtttaggtataaattagtcgatatagattataaattgttaatttaataggtataaaatataatggtgtaaaattcaaacaattttttatttgaaaaaaattagtccaccagtttaagtaaaaaaatttatcttatattattaatttaatgggttaaaagtatattttttaaaactttacatttaaacattgtagagctaatttttagttatatttatttgtaaagagttaatttatgatgatatatatagtctatgtttgtaaaattataattatttcaaatttattatcactaatataactgttttctcacatgtacatggagaaaggtggaaaggagagagaagcagatgtatttttttaattgatgtatataatttttgtttttatgttttttgtctttaatcttcttttattgatagtgcgttacttacgtactttgtattttgggttttttttttacgatcagtactttcgtgaacaggagattataagatggtagttttttaaatagatctaatctaacggtaaataacggatcaccgatttaagtgaaaaatcgaggattaggtgttttgcctttctcttagaatttgtaggaatttctttaatttattaagtgccacatgacggtttaaaagcatttgtataaaatttaataaacttttagtatgtaatagacaatagatagataaatagataattgaaatatagaatgttaaagagtgttgattggatatcttatatacgatctagtttaaccgcatatatttatagagcgatatattttatttttaaatagtaggaaatcctactttaaagcccatcagattttttaatgacactacgtacgtattttttttctttattttatcgcttttatacttagttttttcttctcatccggtgaagagtagataattaagcttcatcgtttttatttccgatgtacgtacgtactgaatactttcctttttcttttccgtcccacatgcggaaactattactttttaaaataatacatctaatcgaatggtctataatattgggtccaccaattttaatgaaaattaacggtgagattaaatagtgccacgtggcgatataggagtgtttgtaggagcgccacatggcggcttaagagtgtttgtaggaaatctaatagacttttagtatataatagatagatagatagatagattgatagatctctgtaccgaatctcctaaacctattgacaactcctggaccacaaatacgccgccatcactatatattggatcggcctcatcagcaaagcaatcctctgcctcttttgtacctaccatggccgaaccatcacgttgctccaactttgtgcacagttttattcatgagacaacctatgagaccaccctctcgctatacgccattgctaccggagacatgcatatatactagtggtcagccctgtcacgtgtggatccaaacaatgatgtttacacagtactaccaaaacacacgcatgcaccatgtcaatacattactactaccatgcagttcggcacaaacacaaacgatagacggcgccgaattgatcccctacagactagaagtactccaaatcaccatttgacagcatcggcttctgtattatcataacctttcacctattaacctaataaccagatgtctgttgttccaaataattaacatgccttaaagtttctagcaatttaactaaacctaaacattggtccaaatgactgtttaacaatccatcaaaacactaaaacttcccattaatttattggactattaaaaataaatcaccaaaggctacatccctcacacccatatagaccaaactctacaaaccgaatataaaggcttatacttggcctaaaagtgcaaggatactttaaacagactgaaagggaccgatgtgtcataagcaatattaagcacctagcccaggaggaagatcgaccatgaggggcagcaggatgagcctggtcggggcagcgatgctggcgcagctctacgtggtcgcctcctttcaaggcgcctctggggctaccagcgatggccctccctccagcagtggggcgaggactcccacctccggtgggagccctggtggtagtggtacaaggagctcagcagcatctacaagctctgcaagagccggaagcacccctgcaggagtgcgggggagccccgcgggagctggtggtagccccggcggtggaagcggaagcacccctgtaggaggagggaggagctttgcgggaggtgggagtgccgacgacggcgacgatggaactgggatctcaagcagtgggggaaggatgttaagtagatcgtatgatgttgagcactttttcatttacttcatgcttgttgttttagctgcattttagcaaaaaaaaaattcttattctcaacatgcatatgtatccagtgcgcggaaacagtgaggggccatcaacggtcactcgcattcccaagttcctgtaaaaataaaccatcactacttaaaaaaccctcatagcgactggctcagaggtgtcagtttatttacaactggcacctattaaccttttcctatctattgtgggataaaaaatagagaaccgaatcctttgaacaacgataggtgtcggttctaaagaaaaaccgacatatagactattggtgcccttttactacacattgtctacatcaagatgaactctggtgtcccccgtgctctccttcgcacacttgcccattcttgttggcagtgtcaaatatcgaacccagatagtttacaccacagaagtgagaatttatcctcggctatacctctacatgggttagctgctgctccttccgatggacaataggacaataacattggagatcacaagttgtagatagtactttctgcttgaactgctcatccagcctccattagtggatttgtgttggatttgatacagagtacctagctaggtgtttcgtttacttcctatacgcctcccattcttatcacaatcacatctgatatacgagttggagctgatcatagttgtagcgagatcgatgatcgagaatgatttagaactttgaggtgccgaatgttgggtcctaatgaagtgccattcatagagtatataataaatgtagtattgttacactcacacgtacaagctagtgtgtctaagagctttgctgcacaggttcggtttccccttccctcctcatcttcccttctcatcttctttctctccctcactctctctctccccttcatcttccttctctccctcctcactctctccctcacagatcgggccgtggccccctcccgagcgccggccgctgatgcctccccgcctcccgaccgttggcagccgccgcctccccgcccaccaccggatctggcctacgacgcacagattcggccaccgcggcctctcccccgaccgtcagccgcttccttctccagcaccacatcaccaaccgccggatccggccaccgcagcctctcccccgaccgtcggccacttcctcctccgccaccccaccgccaaccacggatccggccaccgtgacttctccctcgaccgtcggccgcttcttcctgcgctacagcaccgccaaccgccggatccggccaccacgacctctcctcccaccgtcggccgcttcctcctctgccactgcactgccaaccgccagatcctgccttgacaagtttcctacaccaccgcaccgccgccagatggagttatcctttctgatttgtgcccagatgaatatgattgtgatgatttttctgattctgttttgtgcccaaatgattgtgaatgtggagtgattttgttctttggctagatcaatgtgattgcgatgatttttgtgattctgtcttgtatcgaaatgactgtgaatgtgattatttttgtgatttgtgatgcctaatggtctgcgactagctaggcttataatattatatttttttgccccattttcctaccagaggaggcgccgctccagcttcgccctcggaggccgaaggctctgctccctcttcgtctatcatctccccctcgctgctgcgttcctttcgcttggcaactctctccttgacaattttctttgatggcatcaatggtttcgctcactctcagtggtttcgctcggaggtccccacgatcagtgctagttgttgtcgaatgcacaactgcgttacgtcgaaaggcgtggttctctcgacagtagttggaagtaaagacaattgtattgcttagtaacaattttttggatccccctatttcatggccttagggggctatttatagccctattactggtccccctttagggtttaggttttacaggggaatttacatggctacccttatgatagggacattatcgggggcacacagtatcctttacttgtatgggcccttattgggctaaatggctcggctcatttacttggcgaagtccttcgaaagcgcaacggcccgctaggcctccttacggcggagatcggtacttggcgaagcccatgccttcgtgccaaggctttcacctcaccatcttcgcccgtgcggccttctgacgaggccttttgcctgcccaagtctgtgtgttccgagccactgctttctccatgtggctttcgcccatatggttccctttttgtccttcgccgcttgcttccggtctgagcgtgtcacctatgttcttggtttcggtaggtccaaccgaagacccttcgtagtgtacctccaacaataagactgcaattttatatttaaaaaaaagaaatatatatttacttataccaaaattacagtgcacttacatgtcatatcaactaaaattacaaatgtaatttttgttatataggactataattttatatttttaaagaaaataacaaatacatatttacttacacattatttttattgcatttacatatcatatcaactaaatttacaaatgtaatttttagttatataggattgtaatattatatttcatgacaacgagagggatggtgttgctagccgaacagcgttggccgtagtgccggcggccagctcgctggtcggaggccaccttcatcatggtgcacgcgtgggctagctgacacaggccgtcagctgctgctcacatcgcaagtggtgcatagcggccaaaaaaaaaagtcaaatgccacagaaaaaatcacacgggagatggatagcaaaatctgttgacaaaaatgtgtctacatttggtttattgccaaactttaataaatacattagaaatcctgccaaaattaataatgtcaaaatttaataaggcttattttggctacaatttgaaccgttcccgttctgctcgatcggcagccacagtccgactttgccgtcgacgaaccatccagccgcacattcacgcacaaccctcccgttgctgaccctgccgcgcaccatccggcgctgcttccttcctgctgtgcaaccctttctgccggtacggtaccaccgtctgccgtgatgccatctcgctgctgggctcgtctcccgcgcgggccgccggttgtgacagtttccagcttgagcacgtcagtctccggcaccatcgtcgcacgacacggccgggcagacgttccactagctcaagctaacataggttggtaaaatggcataggtgttttgctcatgttgacgatgcgaatttctgaagatccatgagttgatttctagtatgtcttctatcaaaagcgctcagtctggatctttgttgaaccctttttcactcgtgtaaaaaaaagtacagttaactttgcatagctcaagctagtcttttttttcctgctctgttaaaatcaatcaaagagcaattgatggcaattgacgctgtagcagatgcaccggatcctgatcacctggcgggcggagtcagtcgcaaatctggacatggtagccgtcgcttgccctgatctgccgctagctgtgaccccagcctgggccctgtcccgtccgtgactgcgctgccgcctccaccgcagcgcgccgtctccgatgactgccgagcccgcggctccaacctacttaaaaaaacgattttttttaagcaatgttggccttttattttttcaagacggtactcctgggtagagtggtgggttttttttgctgagatgattttcgtaggacccgcccacaaaaatcatccattttcgtaggagacagagtagcggcggtccttccctccgtctaaaaaactgatttgggccgcctgatcactacttgattcacaaaccacaccggacaccgccctatagcctcaacactccacgactcatgtccaaattacaacattacccctccactccattactttaatagacgattatacctttctatttttctattgctgtaattaaggtggtactgttaatatatctgacccctttagatttgaaaaaatcaacgattaagaagaattctactactaccagcagagagtaccgtagcgagactctttacattataagtaggaactgtaatgtgtataggaatgggatgattcagcaattagaatagcagtgcagtctgggacaaacatgtcagcaattaaaatagcattgaagagtacattgaacttaggttttttctcttattccctatggttttgtttagctttatttcggctttatatctactaggactgaggcagattgaatctatgcattgacgatcgttttattattgactagtggtagttttgtacatttctatcctgctggtgtgacaataagaaaatatggttgctcaaaattaactgccaataaaaaaattgaaaatggtaaacataaaaatataatagaaaaagtagtgtggcacattatgctttcatcttgattttctataatcaccaactaatttaattgaatggttgagggttttgtttgtcaaagaattgcaacactttttacgtatgacatcgttcaattttttttccgatatgtatactatgaatttctcaagtattatatagagattatagagattatatagagattatagacaaatagaagctggcctaaaaacccatgaattgcgggagctgaagatggtggttgcggcgcgggtgccgaagccaatgatgccacaccagcttcgacgacgggggccaaaggcactaccccctcttcggcggccatctcccctcctgcttcactctcctttcgcttagcaaccttctccttcgcgaccctcttcggtgacattcgctctccgtggtttcgctcagaggtccccacagtcggcgccagctgttgtcgaagcgacaactgcgcacgtcaaaggacgtggttactcaacagtgttggaaacagtgaatatactaattgattaaaatttttcttggaatccccctttacatggcctaggaggctatttattatcctattacaggttccctcattagggtttaggttttacagaggaatttacatggtggcccttatgaaagggacgtttatgtgggtacacagtgtaatttggatacatgggccttctatgggccggctggcgaacgttagcttattggcgggtaggcctaagaggccgggatggcccattgagcttccttggtgtcaaacttgtcaaggcgaagtctccttccttcggcccatatccttcgccatgcaccggatggcctattggacctcctcggtattgagcttgtcaaggcgaagtctacacccttcgcctcatatgactggtcctacgaggtacccacgcggctttctggccttcgtcgtctttgttccacagccttcgccatggaggcttcgctcaggtacactagacgtctttggcttgaatccttacaggtagcatggtttcagcaaatatggttaccggcagcgcgaccttgagtaaatgtccaacagaaatatggtaagcattgacagcttgaggtcaattattgagtacacgaattctacatatatatatgctctgccatgtaatttctattgccctcaaatttttttcaccacctcaaattcccaattcatccaccaccagcactacaacatgtgacaggtgcccacttgcattttagaaatgatcgtaataagcatgggatgctataggaaggaaaaatcaacgactaggttattttcaatctaaagactgataagtagatcgagcagatagatgtagtattagcttccacgtgtcacctcctctactcttgaactatatatgagatcgttggcggtaactagatagagcttgcttacgactttgcctgacttgttggactaaaagtcggcctgtttttgttcatcaaaaacatttcagccctgtacaagttgtatcggtccaattatccaaactgccaacacgaaaagggctggaaatttcgtctgtgcgaaaaatactgagttagataaaggtaaaggaatcaaatttgaaaatatactttgctttttcatattttacatttatatacgtgtctaagattaatttgcaaaaatatagctaatccgcggaacggttgtgtgggagagcgggcaaaccacagactggggatgcgggagcggaacccgagccggtcgcgcagaaccgggatgcgcgaccgagtcggtaccacattaccgatgcgcgggagcgatagcgccctcagccccgcggcggtaccgccgaacggcatcgcgggaccgcgccatccctgtggtcgctgtattattcccccaatttttccaactcatctcctctttccgcgcacgcttttcaaagtgctaaacagtgtattttttgcaaaaagtttctatatgaaagttgcttaaaaaatcatattgatctatttttgaaaaaaattatctaaaaattaattaatcacgtgctaatggactgctccgttttccgtgcggagatgtgttcgctgtttggggaatgatgcatgcgggagagccagtcccgcgcatccggcgtgcgggagagaggtcggtcccgcgcatccattatgcgggagcgcgccagctccaggcatcgcccaaaaaacccaaaaaaaaaccacgttgccgctaacccgtcctgcgggactggcgcggtagcacatcccggccagcgggaccggcttggtcccacatcccagtttcgcggggccggcttggatttcgttccttatccccattatgcgggtcgtcctcgctaccgcgcattcgttctgcggattgggtatatttttacaaattaatctcatgcatgtatataatcacaaaatataaaaaaggtaagtatattttcaaatttttttcttaaagttcaaatctaatgaatgtttatcaccctgctaaacgaattggatagctaaaaagatggaccagtcaaaaaaattctccttcttgacaaactggaggagtacagagacctatctattgaagagttgagtatttatattattgccacgaaaccaaaaggaaggtaatatataattttgaacaaaactaggcatgtaccccacgtaattacacgggcacctctatttttaaaatgttaaattcttttctgatgattaataattattagtaactacacattttataaacaaaacaaagttctcggaggatattcatatatctgtcctacatcacctagtcagttattaaaggcttagctagcaagggaagaaatagaggtcttatttgcatgtatcaagttcgagatataattctaatttctaaacctgagttgttttaaaaatacaaaacaaattactctttaaaagtttattttttctattcttcttaatgacttcaactttttgtcattgttaatagtggtaccggattggttgttcataacatttatagcaatttcgataattttaattaactaaatatgatggttaccagttaatatgaagtttagagttccatgacatatatcattggctggattttcctccgatctgtgacccctcaatccgtttcaatcaaacgtgacaaaaataataataaatagataagtgagttgagagaagattcagtcatcacaaatcatttggcaagggttccccttgttaccttgagctcttttagtggtgtggttagttagcaagcaacctagtgcgacttgacgttagtcatcatctctatgaatttattcacgttgtgacggctcaataaaacctcccacgacacatgtacactaaaacaagttaggacgatttttttctttctcataatggccttgatatgggtacacatacaagttgaggaattgaaatcatccaacgtttaaattgaattgaggattaagcgtttgttgttttaccttttatgaagaacttccaaagcagttgtattaaatttgttagaggttaggagggttctatagcaggtgtatggtgcttagaaattcatgtaggatcgaatcacaagaactaaaccaaccagaggggggtgaatggttggtatacccaaaaaccaaatcttttagaggaaataaaaattaccctcaaattcgacggatcgcggtctgaccgaagatgttgcgtcggtctgaccgcctgatgaacgtcggtctgaccgggatcgaactctggtcgaaccgccaaaatcacctgcctgcgcctgtcgccaccgccggtctgtccgccggtgcaccgccggtctaaccgccgaaacccggtgaaacacaaatcaaagaactcttaaagtggatgacgactttattgattctctttgtgtttacaaagtgcaccaacagcactccttgcaaaaatctcgactattcgaaaccctaactcaactgtcaacttaattgctctcaaaagcgataccgggaaatctcacgctccctctctacttatacctgaggtaggcagcctaaagccacgaaccaaacttatactagaagtcctaatcaccctaggaaaccctctagcacaggaaacaaactttacataaccaaacataccaaatttggactccttccaaattcgactctgcatctcatacgcacacaatacctccatcgtatgccatatggaatcttcacctaccacgtgcattgaactctagccttcgtatcccgcatgatctctgaccaccacggacgtcatcttatccctaagccgactcccggtccatcaccgcaaatactctcccggcatctcgagtcatcaacaaatagaacaaacaaagaaactatattctgagaccaagctattcccaacttgactcattagtagcaaacaacaatatttacatatgcattgtatccatctagaagccataataatgaaacaatcacggatatccaaataaacaacccgaaaccgaaatcgacaaagtgtcggctggtcagactgcgggctgtgccggtctaaccgtgtaatacacgccggtctgaccggtagcacatgcccagtctaaccggacccaaatcacagcagttcctgtagatcacctgtgaaatcccaatcatctccaaaaccacttcgcaaataaattctaaatatcaaaaccaataatctccaattccaattgttcatcacagaataataatcaaaaacacctttcattttacaattcatagcttataattatatattctagagattagccattgataaacttataatccataattaagaccatagatgatctcagatgaaacttttgtcaactacaaaattataggtctcatctatacctacaactttcatacagattttgtgtccatccgagattgtctatatcttataacacattttgggacatccagacaatttaaataaaaagtcatcacctatacaaagttgtagatctcgtcgagctttacaaatttgatataatgtttatcttcatccgactttatatgaaaaggttagataaaaagcacatatttatgagttgcatcatcatagagcaaatatttctgcatggtcaagtttggatggtagatgtaggccattgaagaaaatctatagctccctctatctgctaatgatttgttgcatctggaaaatactatgtcttattctgtcacaatgttgcaacaactgagaattctcaattagaatgtttgtgggctcaataacccggcacgcagagaggcagtccttgaaaccgcaaagctggtgaaagcagaggtattctgtgcatgcaataaacaaaactaagtgccattgaccagtggattggtaaggaaattgggggaagcagattgacaaaattcaatttccttcctgccaatggaacacgtggtggcattgccatcttctgggatgactctattgtgaacatgataaacttctcgcacagaacacactacctctcggcaacggcaacgaccataattgaaaacctcagctttgtcatcagtcgtctatggtccctcggaagacagcgataaggagagttttcttgttgagctaatagcagccaagccaccaacagacacgccctggctaatcgtgggagattttaacatgatatgtgaggccagagacaagaacaatcataatctgaatagacggctaatgggacggttcagagcagccttaaacactctggagctaaaagatatcagattgcaaaacatgcggttcacatggagcagtgagcaaggaaatctgattctaagcatattaggtagaatgctatgtaatagcgagggagacatcttcatctctggacactccttgttagcactgttcacatcctgcttagaccactacccactgttgttagacccgatcatagtagaaaaaaccggagcggccacagaaccacttgagcttttggttcaccgggtcaccggttggaccgccggacttaccgtttcgattgctgaaccggaaagagtatatatcataaataatttctcctaaataaggtgagcaagttgccttggtggtgaggttgatgtgctttcataccatcggccagggatcgatccctatgcactcttttaggcaataaaatgcaattgggctacaacaatccaagtgggccttacaagcgtcaaaatagcccgggtcaccggttttcgagaaaaactattcggttcatccggtttgtaccgttcaattgcatgtgcggtctttgaatcaatccaaaccggtgagggtgctggttcctgcccgaaaaactatccggttcatccggtttgtaccgttcagatttagatttgagaatttatgggttagagtggaaggcttcttttttccggttcaaccgctggtccggtccagttttttgtactatggccccaatgcaagatccaaagaggagcccgagattcagatttgagaatttatgggttagagtggaaggcttcctaggagtggtgactcaggcttggagcaagcctatccaggatggtcacccctgtcttacggctcagtcaaaagctaaggaacaccgaaacgactttgagacaatggagcaaatagaagtttgggcaactgaaactacaattcatcatggtccacgaactaatatattggctgtacatagccctggaaacaagaacacttttagttgaggagcatcaatttagtaaatatctcaagataagaattctggggctagcagctgtggagaaggcaaggaaaaagcaagcatcaagagttaaatggttcaaagagggcgatgctaacacaaggtttttccacatcaagatgaatgcccgaagaaggaaaaatttcatccattgcttacagcaggatggaaacactatacatacacatgaggaaaaggctgcccaccttcacgcgcatttcaactcaatcctggggacaaggagaccatgaggctgcactaaattgggaagccctagaattaaaaaaatacaagatgatagcatggatgagcctttcacggatgatgaaatctgggcagcaataaaaaactctctataggaaaaagcgccggatccggacagtttcactggtgcttttttacaaaagtttttgtcaaataatcaacaaggaaataatggaagtcctgcaaagtttttatagcctatttggggggaattttggaagtatcaatagacccatgatagcattgctaccatgactcgccatgttcggcaaatgatttcaagctgcccatgatagcattgctaccatgactcgccatgttcggtaaatgatttcaggcccatcagcctgattcactccatggcgaagctcatctccaaaaacttggcaatgagactggtagcacggctcggtgaattggtctcacatgcccaaagtgctttcattaagaaaagatgaattcaagataattttctatacgtgcgtaacatggttcggtgtcgcgcccagagatttgacaaaccgaatcactggctatttgtgcatttaacctctgtccaggcattaaccagagtacacagacgacaattcgatacagtaccacgtcttacaaaaatataaaataaactcagaaaagtagcggaaaaattaaagaccatttaaacttaatcttctcacgaaagcgaagcttcctccataatccacacgcgaaacctcgacgtctggcacaagcctaatcttcatagaactcaccatccgacaaactctctgccactgggggattgggaaaaataaggcaagactgagtacaaccaccgtactcaacaaatcataccaaggttaatatttgtagtaaaaagcagcattcataaatcataagttgaaagcagtaaaatagtagataattaagcaatattaacctcatcactgtccaacgctaaaaccacgttgcgacaagcccagcccaaaccacctgaactacactagttcattaagtcaaattattaaggtgagactaatcatgataagctagttgaccgcccaataaccgtgggcaaggctattcgaatagttttactttaattagaggtgtacaactttatcgacaagacacgattccacacatattaccatgtcccgaagtacctccacgatactacaaagggggaaatagtgacaaaaccatccatataaccacccctaaccaacacacccaccaccaatttcacccccatccatatacaggcaatgggcagtccccgctcgtgcctaggtaaatccagaagcagcatagacgaaaatctaggtccatccatactccatcaccccacccttgccaacggtgtgttcgctagaaaagattatacttaagattcaaccttgagcctatctggcctgtggttagtacgagtatatcttcgagggattcccaagaaccggtcgttaattggcatgggcacgaccaccaatcaaatcatgcatgtacccacaacccaccaatagagcatatttcagttaattaaccatataccaggatggtataacatcatcataaaaaattaaggactaaattataatgaatcccaatgtgaggtaattgatctaagcattcctaaaccaatcatagagtcaaattattatcacaggctatcaaataaatcagggtaatcaaaaggctaagtacgggtaaattccatcccacatgacattataaaataatgcatgttttaagagaaaagcagggattttgaagataggctcaatatgatcaatgatatccgtatgacttgccttgctcttgagctgatgggaccactacgatggatcaggtcatctctgacgggctcatacccttatctgtgatgggttaagcactggtcacagatcagtgatcactgatgactcggagtcacctgtgacgggtaaagacccgtcagaggtaagagttacctttgacggattgcaaattaaaatatgtcataggtaacgttcacctgtgacggaggggtccgaattgggaccgccatctcttcctcctatagcgcccgcgtcttcgacagatgcggaaaaggcgaaagcagcggcagcggcgaaggccctccaggtcagagatgcgatcctgtcatcccaagcaccgggggcaccttcgaccgccgccttcgcccaaccggccatgacatcgacagccttcaccgccccgcaagccaacaccagtctcaaagctcaagccgaatctgacatgggggccatgaatcagaatatggctaaacttcaagacacgcttcgccagatgcaagagcagcagcaagcgtacgaagcagcaaggcaagcaaaggcccacacccagcagttctacgctcagccccaagtcgttcctccatacgctgcacaagcaccggtgtacttcgccaagcctgcccaagttgtcgccgtgcgtctgactccacaagtgacctcggagccggttcgcccgacggcaccctaagcccagtacccgaagcctgttcacacgccacaagtaatgatggaagcagcttcgaccttacaagcacaatttcaagccttcttgcaataactcaatcaaccccaaaacaatttaccaagaacttcgcctttggccctggccgagggaagcccaagtcagggtgcaccagtgggacagctgttgggccagttcgccgaaccaagtcaagctcaaggggcttcgcctcaaggccaaccgccacagttcgacccaagcacaccggcccaagcacccatgactttcgcacaagccgtacccccacggtatggtgcagccccaccactaaatcaagcctagaatcaagccatgttcgacccaacagtggtaatgcaagctacttcgacagatcagcaaaaccaagcaatgaagttcggcacggggcatcaatcgacacccacagcccaacctcatgtacaagctgtggcttcaccgttcgcgcccccatacccatagttgaattggccctctcagcaaggggccatggtcaagccgggtggcgaaaagggtctgccccttagttgggggatcaagaatcaccccatccccccccagttcaagttccctcctgttccaaggtattcgggagaaacggacccaaaggtgttcctctccatctacgaatccgcaatcgaagctacccatggtgacgagaatagaaaggcgaaggtaattcacctcgtgcttgatgtcattgccaggtcttggtactttaatttgcctactagcagcatttactcatgggagcaattgcgcgatgtctttgtccttaacttttgaggcacctacgaggagccgaaaacacagcaagaccttctcggcattcgccaaaggccgggagaatcgacaagggaatacatacgtcgcttttcgcaagcacggtgccaagtgcaagacataactgaagcttctgtcatcaacgttgcttcggccggcttgctcgtgggagaactcacgggaaaacttgcacgcaaggagccaaggacgatcgaacacctctttcgcacaattgatggatacgctcgaggtgaagaagacaccaagcgaagacaagagatacaagctgaatatgacaaggcgacttcagccgcagccgccaccgcacaggacaacgctcaagctcaggtccaagcccaagttgtaagatcggcgcccgtcctggttcaccctaccactccggcgaaccaaggacaacatccaagtccgaaccaagcctcgatgacatggaagaaattcaggaccgatcgagctggcaaggcaatgatggcggtcgaagaagtgtaagccctctgcaaggagttcgccatccagcaagtgggcggacagcaacaaccttttcgcaagaaaataaaaaaggacttgtactgcgctttttatggacgctcttcgcacacaaccaagcaatgtcgaaacattcggtaggaaggtaacgctcaagcgccgaggcagcaataagggccaaagaggcaccgcgtgaagcggtcctcaaccaagcacctcaagcagaacaatgccaagacgcgcagcgaagagtgattcaagtcatcaccagatcttatccctcctcacaagtgtcgaaacggcagaagaaaatacaacttcagacagtgcatagcattgtttcggcaggtgatggggtcccaagatacttgtcgcagccaatatccatcgggctggaggatgccaaaggagttcttttcccacaccaagacccgttggttgtttcggcagagatggcaggtttcgaagtccggcgcatcttgattgatggggaaagttcggccgatgtcatgttcaccgggacttacgccaagatgggattgccgacattggcgttatcccaaggaccgacttcgctcagaggatccggaggcgaagcagtgcaagtcttgagacaggacctaaagtcgctttcggcacacaagagaacaaaagagaagaggagatactcttcgacattgttgacatcccatacaactacaacgccatctttggcaagggcactttgaccaagttcgaagcagtctctcatcacaactacctcgagctcaagatacctggcctagctggcgtgatagttgtcaaaggttcctagccttcggccgccacagtggccactttcgatagggaagtccgtaccctacaagtcgaaggacaagaaaaaacaaagccaataccgaaacccgcccctcacggcaaagttgtccaactacagatagatgattccgaccccacgaaagttatatcactcggtggagaccaaagcgaacaagaagtgaatagcatcctggtcgcgctcaagaagaacatggatatcttcgcttggggaccaaatgaagtggggggcatttcgccagatctcatcatgcaccatatcgcagtcaagcctgacggaaagccgaagaagcagaagttgaggaaaatatcggcagatcgccaagaggcgacgaaagcgaaggtgaacaaactgcgaaaggcaggggtgatacaagagatcgaccacccaaagtggttagcaaacccagtgttggtgaagaagtcgaacgacaagtggcgaatgtgcgtcggatctcaacaagatgtgcccgaaggacgatttccccctgccacggatcgactagcaagtcgattcgaccgccgagtgtgagctcatgagcttcttggatgcatactcaggatatcaccaaattcacatgaactcgacagatattccaaaaacaaccttcatcacacccttcggcaccttctgccatctcagaatgcctttcggtctgagaaatgcaggggctacgttcgccaggctggtatacaaggtctttggatcccaattggggcgaaacgtcgaggcctatgttgatgacattgttgtgaaaagtcacaaggtcttcgaccatgcatcagacttgcaagaaacttttgacaacctccgtgcagctggcatgaagctgaatccagagaagtgcgtgttcggcgttcgcgctggttagttgttaggattccttgtatccgagtgggggatcaaagcgaacaccaaaaagatcgatgccattcagcaaatgaagccaccatcgagtatacgacaattacaaaagctcgcggggcgaattgcggcactcagtcgattcttgtcaaagatggctgaaaggggcttgccattcttcaagacccttcgaggggcaggaaagttcagttggacacctgagtgccaagtagccttcgatgaacttaagcagtatctccaaagtcctccagctttggtcagcccagcggcaggaaacgaactgtggctctatctagcagcttcgctcgtcgctgtcagcgcagctttagtgcaagaaaccgaagcaggccaaaaaccagtatacttcatctccgaagccctccagggggcaaaaatcagatacattgaaatggaaaaacttgcttatgccctagtgatggcttcaagaaagctcaaacactacttacaagcccacagaatcgtgtaaccttcgcagtatctgaaaataaataaatttacattttaaaatataaaattacagtcctatgtaactaaaattatatttgtaaattaagttgatatggcatgtaagtgcactgtaattttgataaaaataatgtgtaagtaaatatgtattttttattttcttttgtagtacgttagatttaaatctaaaggtagaaaaaatatgggtgatttttttttgttagaaatcacacgacaaatagatagacagttccaggagatcgattcagttgtgtggcgcgtgagactctctttggcaaaagacaaaaatgcctaaagaacaatgatagaaaagaactatcataccctaatgaattaacggtcgagatcatttctactggtagtatatactcgtagtagacagcaccggagtttcactctaatggaaaagtgcgaatacgttgtgcgttttgaatttgagagtgtaacgagcgcctgaatgtacatgtagtggtgtggaaatggtgcttgcagtgtgtagatagaacattgctgacgaattagatgaagaaaataggaaacctattttgagatgacgacattcgatcgctctcttgctggaaggctaaattttcaatggatcataattaacaatacaacaatgcagtgtgctacttggaagcgtgcaccgtggtccgtggtggctcatctaagtcataacatgtggcctttatgatacggtgctatttttattgctgaatcatccaaaacccctatacacgttgagttcgttccagctaaaaaaaaagacattatctaaaatataaaacattgagttcgatccaggtatttacaattcgaaacattgagttgttcaaccactgccacacaacaagcaatatgtgcccaagcaatatgtgccggttgggaacctcacaaaggtgccgaattttccaaccggcaccacgaaggcagcacagattagaaacactcaaaaccagcacctttgagatatacgaattgaaaaaaataataataaaaataagaataataaaattcagctcggctcaaattgaaccgagccgatgcatcaaagcaaccaaaaaaaaatccaaaaatctcaaaaaacaaatccgctgctggcaccactgccgctgcacactgttgcatgccgccgccactcatgctccgcccgctgccaggactctgcgccaccgtcgtcgctgccgagaccaccgcgccaccgccatcgccactggatctgtggagaggaggaaaggaatcatcagtttctgaagattacgaaaggaatcatcagctgagaaggacccagagagagagcctccgccgggccgccgtctctcctcccgccacctacccctccccccgtcggatttggtggagaaatttggaagagaggagagaggggatgagtaggaagaccttgacgacgtgaagagaggccagcgataacgcccaacgatgatgaagggtggtgcattgacaacgccatgatcaatgaggcactgacatggccgacgcagtccgtcgacacccttcattgaccttccatgcccgacgacgtggaaaagggcggcgtggcgcggcgagatctggatgggaggtgggaggctaggagaggaggtctgggagggaggaaaggcttcacaagagagagagagagaaacgcgcgagagaaaggtgggagaccgggcgaaatggataaggatgtgtgggcgagtggaggagacaatgatttgcaggcgaagtggataaggatgtgcgggcgagtgggctcgccggctcggctcaattcgtatgtgtcggtttttttaaaaaattagcacctataatatgttgtaggtgtaaccgacaccaataatatattaaaggttccggtttctttttagaaaaccggcacctataattacttaaaggtatcgttttttttacgttttcaacctgtgaaagtgggaaaagatctataggtgccggttttagcaatttcggaacctatagtaccgacaccgttttgtagtagtgtccggtgggtgcattgggaatatgagatgctgaccaacgcttgaatgtatgctaatgaacggttgcagagtatgtatagaaaagttctggagagtacttcgaagaaactagaaaattcacattaggataaggacaattgatcggcaaaatagccattcacaatagtgaaagaactatgatcatatcgaaacaagttctgatggaaaatttcgtgttggatgagttattaatgctttcttgccattgaaccattggtgttaatttatcctgctgttgattacgttcattttttaaatgctgggttttctttcttcatcttagactcaaccagtagctgcgtgccagctgacacgagaccaaggtcacaagtaggccagacaatttctggtgacatccaactttatttccttgggcggggatcagaagaaatgctcttccaaggtgtatacttgtactggttgtacgtgtacaaagcaacctatgaaaaattgaaagcaatgctcaatgcattgctctccattaaagagtaaaatataagtggtatcttcaacaaaaaacttctgtgatgcgttcattataatattgaagacaaatattttttggttctcgcaaagaaatagagcgtggcttcaaaattcaatgtcatcttccaaaaagccaattgtacaatttatatgtggaaaatttagtcactgcagcaagttcaaatgtgctgaaattcttttttattttttaaaatttttaatttttaaattttaaaataaaccatttcaaaacatatttttaaaataaaaaatggttcagatactagcaataacttttggaatggtttatttttaaaatttaaaattaaaaagttcaataaaatttaaaaaatccccgtgctggtaggaatatgtacgcattgaagtattgaagtatgtactaacaagaaattttctactctcaaactcatgatgccaaagtaaatatagatatcttggatactgaaagatttgttcagctagcggcagaaaattagaagatttttggcacatgttaccggtgccctctcttatgcagtttgaacacaaacaacttttacatgggtgaaaaaagaattgatgcacccaagaatgtcctatttctccgcaaaaaactctgacaaagataggaaactaattaattaactagttatcatcagcgatctcagatgcacaagctacgcctcttccggatggtcaagaggccattaacacacttaacagacgagatgacacattgaagctactgtgtcttctcttaatctctttaccatacagacatctcattcttattatgaccactagccgcccacccgtgcgttgcacgggctatcattttgatattataagtattaaattaaccacatttgcctctgattagtggcttgacaaccaccggatgttcaatgttggttattttccaaattaaaattgtttagattgaagagtctaaaagagctcatcctccagtcagaaaattaaatttccatattattttccatctgtatgttttatttaacacgaactccagtaaaatctattgtcaagataaactgacctatttgacaaacattcaaatacttccagtaaatatgtgagctttcttacagtgcccaattgtttggatttaatatgttttgttattttcatgaaaagaattatagcggtttagattaaaataagagtccatgcaacttcctaattatgtattttaaatttaggactaaactaataaaataatatattgatagtctaagatggatacaacttcatattcactaattatgaattttggaattatcagtctttatgcaactaaaacaaatgaatccatatatacatatagtttatttcaaatgtagaacttattgttaactgccatttcagcatatagagaagaacaattagatgatattgatgtggtcttcatctcgtaggggtaactgaaaatcttatatgtggtggttattgttcttaacgctaattatgtcaagggatcgaattaattcctcatcgaattaacaaagatttaacacatttcaatgatataaaattccgttggagtgacttactatatgaagatttcagaggaaattttacatgagatccacctcttcgaattttccttcgagtgtttcgctctaattcaattattgtatttctctcatagcttatgcgaacatttattcatgcattttattgtgtttgtaattccctcctttacatatgcattcttgtcaaaacttatgtctctcacgttcttagttttgctaatcctatgttgcaaatgatggtgttgactaaagagaagtccatattagttacaactcactaactattatttttcaattttacaactgaattaataaaatactctctctgtttcaggttataagatgttttgactttggtcaaagtcaatcggctttaagtttgacaaagtttatagaaaaatataataacattt

SEQ ID NO: 80221 - DNA, 20918 bp, Oryza sativa
  unsure (1)..(20918): unsure at all n locations
tcggcctttgtgcgcagcgggctttcagcccatttaaattataggccgaaatacaggcctgtccatgtgtgtaggccgggattttagttcaaaattcggcccatatgctaaggaggcctactttacagcggataatatgcagtgtaactgcaaacctagaaactatcgatgaatgaaaataggggggcgcgatcgcctaggatccggcccccctccccctatactcctccctaccctctcctattcctcctccccttctcctctttctactatagtagaccacacaatttttttttgaaaaacaaaagttagaaaaatttatgtatagaaatattatatataaaaatttgaatttaaattcaaatttgaatcgggtatgtaaacttttgacttataaactttgggtctataaactttaggtgtataaactttagatgtatagaaactatatatagaaaatatttgaattcaaatttaaatttgaatcagatataattcaaattcaaatttgaatcgggtatataaactttaggtctataaattttaggtctataaactttttaggtgtataaactttagatgtatagaaataatatatatgaaaaaaattcaaatttaaatttgaatcggatatttgaattcaaattcaaatttgaaacgggtatataaacttttgacctataaactttaggtctataaactttgggtgtataaattttagatgtatagaaatactatatatatataaatatttaaattcaaattcaaatttgaatcggatatataaacttttgacttataaatttttggtctttagatgtgtaaactttaggtgtataaatttactaaaataagaaagtaatgcggtgtcaaaaaaggaaacaaggtggagaggtggagggagggaagggagggggcgcaaaactgatctccctaggcgatcgctcgcccagtagcattcctgatgaaaatagacgtatgagatttatccacatcacaattagtaaaatattcattcctaaaattaactattatgatgtagtagaacagaagtttcactactgatgatgacgtgaataaatttcacacatctattttgtatatcttatgatagtattaggtttcgactatatttttgtagtttacaagctaaacttttctctaaggtcgtttgataatcattatagctcccgaatgtcgtgacaaacataattttgacgcgtcgggcagggttagttgagcattgagtgcttgtcatggagaaaatgactcagggttcaggtggcccccattcttctcacggattgagcttcatttagttgcatgcatgtagaccactagactactccatctgtcccacgatataagagattttgagtttttacttgtaacgtttgaccactcatcttatttatttttttttaaatataaaaaatgaaaagttgtgcttcaagtattgtggataataaagtaagtcacaaataaaataaataataattttaaaaaaaattaaataagacgaggggtcaaatgttgtaagcaaaaacccttatattatgagacggagggagtagttgtacagccaagtagccgacagccacccactcggcatgagcgtctaggcgcgctgacaacttaatccacattaagaggagattaagagaaaatgaggtatagtgcaaaccgttctacgagtatggcctcgatcacaactaatgaagatgaaaatcaagttttaattattataaacttaacaaatactctctccgttttttaatagatgacgccgttaactttttctcatatgtttgatcattcgtcttattcaaaaattttatgcaaatgtataagatataaatcacacttaaagtagtattagtgataaaacaactcataacaaaataaattataattacgtaaattttttgaataagacgaacggtcaaacatgtgagaaaaagtcaacggtgtcatctattaaaaaatggaggtagtatatttttaaatatggcatcaggttttgaactgatagcaggctcatctattgactattacagtgggtgaaagctgttggttatgatgtgggactgcccagcatttgctcctcaagctttaaacaaggaagacttggttgcattctgaaagaaaaagaggtcaactgcagcaggtcacgcggcaggcagagattctacgacaaagcatcgctttactactggagtatacaggttttcaggagcacttgagttttttcttttgagaacggagcaaagttgtatgtgctgccatttctcggttacaggcaaggaaatgcatagaagttgcattgctctgtccttgtctctgctctgccccgcgcaattaactctgcaccctttttttttcctcgcttaattctcgactgtttgtgtaattacataagacaaaattgctagtagatccaagcttaatggcagcacgtgagatactattgtaccccaatcaaacctaacacatcttaacaaatcccatttgaaggaaggcacataataacagcgtgtttggagggttttgatcaagtggccaatgcagaagtagttggcagatggtgcctactggctagaattcggcgatctaacctgaaaacgaactgaaatgcgcatgtgaagggagtagtttgagcgagtgtgattgttcttgcaacaaagaaagcaaaggtaattaaggtcgatggaatttctcagattaaatggcgctttaaaatggagatgggtatggtaggcaatcaatttcccgggggaaaaagaagaagaaaagaaactgacatgtcgctaaaaaaactgctccgcctccgcgtcccccggccgcacgcgtcgcgctctgtgctgctataaacgacgagagcctcgccgcgcactcgacgcgcatcttccgaaatagagaaattgccacggatcgagggcgaccgataatggaaggcgagcagcagcagcagcagcagcagagcgtcgcggcggtgaggccgtcgctggggaaggcgccgtcgccgtcgttccggctccggaacggcagcctcaacgcggtgcgcctccgcagggtgttcgacctgttcgaccgcaacggcgacggcgagatcaccgtggacgagctggcgcaggcgctggacgcgctcggcctcgaggccgaccgcgccggcctggccgccaccgtcggcgcccacgtccccgacggcgcggcggggctccggttcgaggacttcgagtccctccaccgcgccctcggcgacgcgctcttcggctcgctggacgtccccgaggacggcggcggcggcggcggcggcgacgaggagatgaaggaggcgttcaaggtgttcgacgtggatggcgacgggttcatctccgcctccgagctgcaggaggtgctgaagaagctcgggatgccggaggccggcagcctggccaacgtgcgggagatgatctgcaacgtcgaccgcgacagcgacggccgcgtcgacttcggcgagttcaagtgcatgatgcaggggatcaccgtctttggcgcctgaccacttcttccatccagggtagccatggcatccgctcaccctcacctagtaagtttcctcactgaagaagtccctccaaacattttttcaagtagaaattatgaacgtgttagggattgaatacggaacatcggggttgaaaccacacgccctttacgactacactaataagtttcctcactagtttttgatgaagataaaagcttccattgaattttcaagtcaagttcaattcacaccgatttgctagtatgaaattcaacatttttcactgtgtactgcaggcttctgaagttctgaaaacaaagacgtaagagaaggcactagccaatactagatcgcagccaagatcagtaggttcggtgtaatctttttaagcttaaggcaaggcaattccacttttgttgcagctacgaccttatccctgttagtgcctgttttgtgcatcggaatgcagtgcagggcctgagtttcgttttctgtggccttcattcgcacaacttgttgtgtggtgaggtggtgttgatattatacatctacatggacgtacgcttgctaatctagcgaatagtgatgtggatgttcttgaccctagctatctctaactttcacgtcaaccttaaaaattcggtgtttggtttttatcttccctttcaatagcaatccttatgtttcatttagattattgggtggattatattgctgtggtttatcaacttgatagataggtaaactaaataattcaagaaataaaattatcaaatagctgaatacaagctgtccaagtaatagagtagaagaaaattttgttgagacaacatatattttgaagcgtaaagcaaattatctgtttcaatatttgggcgaaaaaagttgaaaataacatggtcactttcacgcttgcattgcatggaaatggaggcacccaaattgctcggtaacttgttttcctggaggatattactactccatgttaggaccctgattgaaagtgaaacacaaaaattttacagttgttattttgtagaatataaggagccatgcaggtccccaaaatgcttggcaacttgtttatctgtcttttttttattaaaaaaaggtcgttacttcatttacattcctgattgaaacacaaaaaaaattgctgcagtaaatttgtaggaatacaaaaggtaccacagcatagcatattagcacatcacactagtactagctagtagcgccagtgtgcccacaggccgtatatacggcccagttcggcgtgagacttgctgggctgtggcgaaaggctgagtgacaccaatattgggcctcagtagatatcaaaaggaataagtctgtttgtctccctcttgtctttctgtttattgaatcgtctcactcaaccgtaaaattgggtataacacttctctcgtctttcaaaactggtgcacaacataataaacttatttggttttactgttgagagaggtgatttaatcgggagcaagagatgagggagggccattaaattattccataacaaaaggccttccagtcgcgcactagcccaacacaattgtgaaaaatggatgagacagatgggctgttagccacaggccggtatcagaaaatccaatggcccatggacgagctaccagtttgttacggcctactaccgtaagagcatgtataatagcagcctataagctagctataaatatatattttaaatagataaatgaatagagataagagcagtacggactccaatacgtaatgtgtgtatgacaggtatgatcagatattaatactatagtaaacaactattgtatgaattgtatattatattagctatagataatttgcagctattaattggctatactattaaacttgtcgtaagtgtcaatgtgtcatactgtcatgtcagtactgaatcactgctagtagtacactttataatagtgtgtcattgacgaagtttgtttgttttttttttacaaaaggtcaacgttcttatcggcggggttacaaggaaggacaacgtgttaatcatccattagcagctggtctttgcatcgtgtgatgaccatcatttctcattgaacgagtgaccaactcgatgattctgtcagtcccagtgagcgtgattgttttggttgcatatcgatcgccccgaccctaccgaaacacatggaaaatatcaagcggctcgacattttttcgttgaaatcaaaaaagagaacttgtgcaactgtttaactttaattgcactaaaacacttttgaagtcccaaaatattgatatctatgtgacatatcctaacactctaaatttaaatacaatgtgttcatctatcactagatgataatattttaatagagatatagtattagacaacatagaagaaacaagtgtcattttaacgtggcattcgaaaccaacttacatcggctatgaaattttattaggaaaattggaaccatgccattataattttgtaaaatttgagatatgtcatcctgacccacatgtcattgactcatgtgggttctagatgtcattgagataccgatgacatatctcaaactttgcaaatttataatggcatggttccaatttacccaatttttatttctacgtcaacaaagagacaaagcacaaaacaattgtaaagggaagcttaaagcgggcgcaagatctgaaaaatgactatagcaaaggtttactatgttcgttggtctcacaaatgacaaacacgaaaaaaacgttgcgtcagctcatacgtctgccgtggccacagctctccagatccgttgaaccttagcatgtgctactttattacgcagagaaactaatccacatcaacacaccatcactcgcacaaaacacactaataaatgaattcacacaatcctaagcatcatattttatcaatccgtttaaaaaccattgaaaacgtaacagcgatacacatagattctcaacaagatgaacacacaggtgccactctttttccccattgtgagccaacagctataacggtttactacatgggacaccatttctttcccaatcattcgtgcttggtcacagtcacccgatgattttgtccggtctccgcgtccgggcccacctgacaggcgtgcccgaccctcggatcagatcggacggcccagatcgatctgccccgccattttcataaacgccaccgcccgcacgaatcggaagactcgagaggggcggtccatccacgtgaggaggacacagttgcaaatttccaaatccaaaccctcgtcggcgtcgtcaccgtggcggcgacggcggcggcggcggcgatggtgcccgccgggggcgggggaggggagctggagaggagggtgatggcggcgctgaaggcgtcggaggcgcgtggggaccagccgctggtgtgggcggtggaggtggcccgcgtcgtcgccggggagggggcggggctccccagcgcggacctcgccgggatcctcgtctccaaccttgcttcgcgcacaactccccctcgctgtggaagctcgtcggccacgccgtggcctcccgcctcctctgcccgctccacgtcctcgcgctcctcaccccgaggtcggcgggggtccccttttcccagttcgttcgtggcgcggattcggtgatcttcccaagcattttgtgagtgactccttggcgatggtgggtttttgcagggtgctgccgcagcggcgggcgcagcctgaggcgtaccggctctacctggagttgctgagaagtaacgtcacatcctcctttctctccatggaggccgggcctaatcgagacaagtaagagttctgctttggaatgtgacatcggaaagtgtgcggtcatgaactttctcaagggcacagcacaatcagtagctatgattgaattttgaactggctcgaaatcacgaaatctcatgatttttgatcggttttcaacaaaattgtaaaccctgcaccgccaaattcaaagtaggggtatactgcaattgcctgtacttctgtagtatgaacaacagagcagaacgtactagtcgcttgtatcctgctggatgttgctaaaatggaattgctgtttttttttcctcaggataacaaagtccatcgatgatgctttgcaactgtcaaagatttatggattttctggaatcgacaatggacatgtcatcattttctttatgatgtttgtaatcaccaaactgatcgattgcacacttgaagactgtggctttccatccgggctgacagaggagcaggggagcatttacgctattgaagggccacaggatatggacttagatgtcaaaggggtttcaactgagaagcaaaacgagcaccgtgcacaactacgccggaagaacactgttatggctttagatgtgttgattatgatggttgctgataggaagatccaatcatttctgcgcttgatattcctgaacatgtaagtcatgctcagttagaggaaattgctatccaaatatccaattctaagttttttttttattgattcatatcatcgcaaatttcctaagaacctttaaagaatacaccttttctcctgacatactttgtgcgtgacgcacattacaaatgcctgctaatgagacagtttttctaggttaggcctgaaaagttcagtgtgttaagccagaggttgagcttggttgaagctcacaaaatggaattggagacactattgactgctaatcataaaattgatgatctgttgatgaatatgtggagggttagcaatacagcctatcaaccaaacaacaaaaggcttttgggtgttcttggtaacatgaaatatggtggctccatgctgggccagtttactggagctgggagagctgcatgctgggttatatttgacatatatgttgagaatgcaattgatggaaaacatctaagcgccatatctgctatcgaggttctgaaaggtgtgcatacacaatccgattaattgacataaattttgcctttgtttttctgtattcattctttaaaatggctgcaatacattgaactatctgtgtgccgtgagttcatcttaaatgttggctagcaatgtcgatgaacatggtttttgtaaccaacaccgccttactgtcaattctttatgagataacatgtttttattgactaatatcatgttgctcttaatcagaaatgaccaagacactccaagcaattaatgaggcgagttggcaggaaacctttaaagctctttggatttctgcccttcgccttgtacagcgggtaaatagaccttttctgtattggctattattgttgaatacacacacacacacacacacacacacacacacacacacttctattgtgtctcacatgtaaatgttctaaataggctagagaacctctcgaaggaccaattcctcatctagattcaagactatgcatgctattagctcttattccattatcaattggtgcaattcttaaagaagaaactgatgtccatggagctcaaggaagcaaaagtcttccaaaaacatcaggacttgtatcatcactccaggatttgatccagtattcaggacttctagtacctccttcatcagtggtaaatgcagccaatgctgcagcctcaaaagcagcagcatttaaggccaactataagtctggaggtggcaaccctggcatgatgggccaaaatgactcttcgacaaaaactggtacacttctgatactcaattgagatttgatcttatccataatattctccgtgtctatatatacttcacatttttcttcgttgacacgagtatccatgcctttgtgttagtggtgatagtagagattttttttttaaaataacaatctttctttgttcacaaatactcgcatctttctttctttcacatcttttatagattggcactaccacttttcctttttgttctatatgcaaatatatttatttttgtatgtaaagttgtttaggccttttgttcttaccatctatcccttttcagttgggaatatgctacatcttatagttgaagcctgtatttcaaggaatttgattgatacatcttcttacttatggcccggctatgttgtatcatctgggcatttgaaagatgcgacattaccccaagaatccccctggttaaactttatgcaaggagcaccactttcaggtccacttattgatgctctgattgctactcctgcttcaaggtatgcagttatactagcagcgagtaacttagtatagaaaattataaattttatgggctggtttgctgcactgcaatttttaagaaagaatactacctattgcacaacgagttatacccctggctaagcaaactctctgaattcttcaggtcaagtgtgttggatgcaaaaaaaaaaaagaaaagaaaagaaaatccaatgtgtgctgaactttccaggtttacatgtcaggaaattatatatttttatgacaaaaatggaaatttaattcaatcgaagccattcaccattaggagtttggccttgaatggttacacttacatcattgatgctactaagttcctcatctgaaccgaagaactacattagttccttacatctctctgtatgatatggtggatatccatattattagagcattttccagtgcatgcattgccctgtaatgtccgattggaaactatcctggagatggagtagttcaatcgtagccatcaatacttctctctgggagacgacactctgagagttggggggaacagatccccaaacctttcctaagatccatctacattgatctttactatctccttgctctatgacctcaatatccttacggtcacttatttggcaaccttttggttttcacatgttagagcctgcttgaaaaccagcaaatgaatagtagccaagtgaaccacttatcctgcagctaggaactttttcctattaccactttgctgcgtgtagacaaccaatgccacaagcaagatgataacttaaatgtgtaacgcttctgccattttccaaacaacgtaaacattaagatatactctgaaacaattggagcttgaattttagaaaagacactaggactagcacttcacgtttaggaactccatttttaagctgattcttctcgattcaatgattctttttatttcccaattcatgctcatttttttggtctattgactggcattgtcatgttcctgccttaatttgaaattctgtttcagcaccacagaattggataggttatatcacatagcattaaatggttcagaggaggaaaaatcagctgctgcaaaaattctttgtggtgcatcatttgtttgtggttggaatatccaggtacctttattttagattaattatattgtgtaaagaagtttggaaattgtttatattgccatttcaacttttatgttcatatggttaaaaaaatctcaccttattgatacaatttaactgaaatacaattcaatcgcatttgatgtgtctactactgccatggccatgtccacatgcaaattcgtctttcctattctttcctatatgatgtatgccttatcttactgcacgcttacaagtggtcatgcccctgatttgaccttgtgcttatgagcaagccaaaaaggttcatttgcacttgcatactttttaacctaaaatgatgattatttaaattttacttgtcgtctcaggaatatgtggtccgcatggtggtcaagctattatcacctccattgccctcaaattcctcaacacagggcagcatgagccactaccttgctcagatgtctacattaaatgcactcttgcttggtatttcttatggtgatgctatccacattatttctttgtatggaatggtgagcaatacatcatgtactatcacctgcacaatttattctcaaaatatcaaactggtgaatgttttgcatagtttttttattcattatagttcctttattttaatcttctgaaaggggaaaaaaatatcctcctgatttgttcttcacttctcctcaaagtaaaaattatggaactgcctacaaatcaatgcagctgctgtaaggccacaggcaaattattaaacatgggagctgatcttgtgtagtcttatatatcctcaatttcaaatcttctacagtttgcctctcattgctaacattttatcttcttattcttttgtagttgttgttgcagtaagctgtaatgtctatcatttgttgttgctaacagttaatgactgccatagcttaccgtgtcgtttggtccccatatcttttttttttgtgagagccattgtacatgatatactgaaaccatatattaatattttacttatgactagcataatggtatacacacattcattacatgatacatgattattttcatgtctatatcatattagctattatgctaactccatgtctgcacctatatgtatttataccatttattatttgtaaaatacaggttccagatgttgctgcagctttaatgccaatctgtgaagtttttgggtccataccacctccatctaaccacaagcctgccattgttggtgaaatatcagtttattcggtcttctcttgtgcatttctttgtcttcttcgactgtggaaattttataaacccccacaagaatactgtctagctggacgtggaggctcagttagattggagcttactctggactacctgctgttaatgcgcaataaccatattgactttgcaaattcatctgccagtagtagaaactctagcaacaacataggtccattaaatgaggttcctgctcaaccactttatattgattctttccccaagttaagggcttggtattttcagaatcaagcttgcatagcttcaaccctttctggtctttgcaacaaaaatcctgttcatcaagttgcaaacaagattttgagtatgatttgcagaaaaatgaacaaacctgttgtatcatctggcaatctttcatccacttctagcagtagtgtcagtggttcctctgtaagtacaccagatgattaccaaaggccaacagttcctgcatgggaatttttagaagctgttccttttgttcttgaagctgttcttacagcatgtgctcatggacggttttccagccgagacttgactacaagtgaggaaactccatttctttcatgtcaccgtattgatttgatccccaagtcttaatcttatttatgtgctgcaggtttgagagatcttgtggacttcttgccagcttctattgcagcaattgttagctacttcttagcagaaattacacgaggaatctggaaaatggtcccgatgaatggaactgaatggcctagtcctggtgcttctcttcattccatcgaagcagaaataaaggaaattctcgcatctgctggcattcagattcccagctgctatccacgtattacctgcatcctattcttgtgcatcaatttagttgcattgcttcacacctaattactgataaatttcagctccatcattatatgatcttttaagttcattccatttaatatcacttcatgaatatagtttctttatttcattttgcaggtggtgtaccaccaatgcttcctttaccaatggctgcgctggtcagcttaacaattacatttaagcttgataagagttcagagtatatccatgcgatcagtggccaggcactagagaactgcgcagggggcagttcctggccaagtatgcccatcatagcagccttatggacacagaaagtcagaagatggcatgactttatcatcctctcttgtctgcgttctccattcggcagagataaagatgcagttgcacagctcatccaaagttgcttctcatcctttctacggtcctcgtgcagtgggtctgactttactgcaaaccgtggagttggtgccttaatgggagatgcaatcaccggccaaggtcttcagcttcccatggctcctggtttcatttacctgagaacttgtcgaacattccatgacacctactttgtgagtgaggtaatcctgaagcaagtcattgagtgggctgacaaacttgcaaatggattctcttccagtggccctccacagttaaaatcaggacgcacgccactatccagcgctgcatgtatggcgcatcaagttgcgatgcttggtgggggactcctgtgtgttgcaggtggacctcttctggtccaggtattgtatgaggagaccttgcctacgctgctgctatcagctcgagaagagagtatgaaagaccctggaccagtttcaagcacactccaaggttacgccatggccaacatgctcttcttctgtggtagtctgctctggggagcggaaagaacttctcctgtcatgaaattgtctttcctgtcaagaaggccacgagtggtgggaaaccatatggatttcatggcgggtgtattggatgggcacattcttctgggttgtgaccatggcacctggaaggcatatgtatcgcgctttgtgttcctggtggtgaagtttgtcccgtcatggttgcgggacattaaactggacacgctaaagaagatagcgtctgggcttcggagttggaatgagcacgatcttgcattggctttacttgagcgaggaggacctcaggcaatctccactgtagtcgacaccttgttgtgatctttgcctcttgacatttcccacccattatctgacataggagtttttgtaatcacatttgaggccaggacttgtgtagagatgtcttctggttcaggatttctcagtcgagctatctaaaatttctgaattctgtcagcggagagatgctagctaatcttgtttgctgggtgcattgctaacgttgctattttcagggtagcattgtgaacccaaaatcatacagaggccttgctcgacaacgtatccagttagaactttctgatctgtctatgtacatttctgtaggtagtatatttgtgtggtctgtaaaactgcagtggtagctgtatctcaacatatgcttattttcgacaaaatttaaaccaaggtagcatcagtccaaatcaaacaactaagattttaacaataattgccaaaacataaattgatacggccggctttgccgaagcctaatgtgccaacggtgggcctgttagtaatgttgaatccgaagttcaaagttatatgatatccttgaaccgtaatatcagtaatgttgaatcctactttctcaaaatcaggttaaataaaagacatgtggggcccaatcatcgtatattgttttatttaacctggttttgaaagatgggggtttcacttcaactattgcggttcaaggatttaattcgaactcaatgataactagggaccacaagtaaacttaatccgaccacacgaaaaagaatacaaggcctaatgggctaaaactgggcctcacaggctttttattattaaggaataatcgcgaccatgcggaaaaaaaaaaggaaacggaagaaatggcgggaagtccaataaaaagacccgccgcaacgctccccgttccgttctacccggccaaaaacaccaaaacaccacccatttcgccaccacctcccgatcgctccgttccgtcctcccattccccttccactccaccccagccgcctcgcctcgccttcttcttcccgaagccgctcaatcgaactcccctcgccgaagccgacgcgggggcgcgaccgcgcgcgcgagccccataccacgtacgatggaggcagctctgaaggcaagtgctcgttgccctaatggcgttcccattccctaataaaccctagccccgcgatcccgcgggctaaaaccctatctggatgcttgaactggggcgtttctgctttttttttttcagacgtatttcggcttctcggggttccgttcgtaccagcgggagatcatacagaaggtcctggaaggccgggattgcttggtcgtcatggccaccggcagcggcaagtcgatctggtgagttagttccctgtggggaaaattttgctgtggctgttcccttccttcgtgcggtgccactgtttgctagctatcgtggatatttctatggatgtgcaagttagatcgttccagtgatgaaatctaaattggaatgctgcatttggttgatatatgggttgttgtatcgccgtgtaatgttcatattggcgtttgtgtaatttgttgattgggcaggtaaaacattctttcagaattgggtttgtcttatttctagtgtgcatttatgctatcttagaaaaataaaacataatgattttgatagtaatatagagcctatgagctatattaagtagttaagttcatcttcattgggtatacacatacataaatcatctaattcttcttccaggaaatcattggattagttattgattgctaattgatttctttttattgcagttatcaaatcccaccacttgttacaaagaagacagctgttgttgtcagccctcttctgtcattgatgcaagaccaggtatggttcaaatactcattgcagatcattattgctttgatctttgttgattgtttttacaagaaaacataatcgtgggtcttatctacttcaaataggtcatgagcttaaagcagcatggcgtgaagtctgaataccttggcagcacccaaacagacatctctgttagcggtcaggctgaaaaaggcgcattcgatgttctgtacatgacaccagagaaagctgtctcacttccttcaaggtaaaaggcagactctagtagtcttttgataaactctagtcacatccactttgtgattatgcgtggttagtctaaaaggaatagttgattatgtatttgcttgtctggaaatgggaggcatgctcattcaatttcatggacacaacaaatcactcatgggtttgataacatagcattcggtctattgatttgacattctaaatcttcttcccaggttttggagtaacttgcaggctgccggaatctgcttgttggctgtcnnnnnnnnnnnnnnnnnnnnnnnnnnnnnnnnnnnnnnnaggttattcatactgcctaccaatttgtgctcccacccttaaaactcacaccatccagtttaataaatagctgaccttttcttgattgcaattctctttcttgtttgcagaacggagtacaaacagttgcatatgttgcgtgaccttctagtgggtgttccctttgtcgctttaactgcaacagccacacaaaggtatagatgttgcactattagttgtttccctgcttggtaaaattttcgcccattaataatatcatattattatgtttcttctctatttaaagtaagaatagtgagagtgtatagctgtatgttttttagaggggtataattatatctctattggcacaatactccacatatcatagaagctggaaatggcttggaaaacttgtaacttacctccattattgtgttcatatgtaaactgacagcatgtctgaaactgtgaatcaagtgatagagtgggggctgcgcggtagctggtgactttgggagaaatgtcattttccatttcacattggcactaaattttggtcttgatgcgtgtaaaatatattgtagacagaaatgcagggatttgattatactcccttctgttcatgaaaccatgctgttttggacactgacaagttccccaaaacgtaactttgaccactaatttctattgtaataaaatatattgatgctcattcttttcaaaatagacatgttcacttgttatagcctcgtaggttgcgttacctttgtttacagtggctaattctttttttcccttccaatcaccaaatatatagtgccatataatttttttttgaccagtgccatataattttgtagggtacgtggagacattgccacttccttgaccctgcgcattcctcacattgtggtaggatcatttgatcgtcctaaccttttctatggcgtgaaatcatgcaaccggtctatggcctttatcaatgaacttgtgaaggatgtctcaaagaactgtactgtgggtggctcaacaataatatactgtactaccatccgagagactgaacaggtttacagcttatggtatcatgcatttacgtatttttgaactttcgtaataggtgcacatgtgatgacttgtaagccgttttctttcaggtgcatgaggcattggttgctgctggaatcaagtccagcatttaccatggtagaatgggaaataaagctagagaggaatcacataggtatatcatctactttaatttctttgtgcacatttcattatgctttccactttactccctttttgtttgcataaagaatgatttgcataattgttttgttggctacggtttgcataactgtattaaattttattgatcgtgccacaattttcatgaggaaaaacgaacatctatgaatattgcagtgctataatttgatctttaatgtttgtagaaatattggcattctgttacgtatgcactagatcatgaagttattagactagaaagatatttagacagatgaaatgagtagttaatacctttcaatttataatatgcatgctgcctttgcaatattggtctggtacaataggggctcatcataatttatgcttctcctttacagatcgtttgttagagatgaagtacttgtgatggtggctaccattgcttttggaatgggaatcgacaagccagatgttagatgtgtaatacattatggatgtccaaagagcctggaatcctactaccaggaaagtgggcgttgtggaagagatggactgccttcagtctgctggctatattaccaaagaagtgattttatgaaatctgatttctattgtgctgaagctaaaagtgtatgtgaatattatgtgcatcgtatctctgttcatgccaaagtgatatatcttacatatttgcagcctagttctttcagttgcttactattttagtgtctcatatttttttggtcactgatagcaaactcatcgaaaagccatcatggagtccttcatggcagcacaaaaatattgcctgcttgctacatgtcacagaaaattcttgctgcagtactttggcgaagaccgcaccactgactgtggtaagtatatatgttacatttaagagtcagtttgaactcatctagtaatgttttccatttaaaaagagtaagatatattcgagtcttatttcaactgctagtggctcattggtttttgacatatctcttgatttgcaggtaattgtgaaaattgcacaaggacaaaaaacgagagggatttgtcaaaagaatccttcttgttgctgtcctgcattaagtcctgtggtggacggtggggccttaatttgcctattgatgttctccgtggatcacgtgtatggtttctatcctgatgtttgtgatttttgccagcttgtgacataaattggccattagcacttgattggataagatcacctgtgtgctgataatgtttttgggaacaaagatcaatgtgaatagaatatttcaaggaatgtatatttaggtcttatattttctgcactatcctggtgatcgttcaagcttttcataatcacaaattagttcattataagataataagatataagtgatacaactaataatttttgaaaaaaataccttagccttgagcagtagtaacaattttgtaaaggattatgtttcatggtaagtattttctcattttgtaggtcaagaaaatagttgaaaacaattttgataaacttccattgcatgggcggggaaaagactatccaccaaactggtggaaagctcttggcggcctgcttttagcacatggtaccatcgtatgcctctctctacatatttttagtcattttcttgtgcaagctaagatacatgttctgtatgctgacttgaagttttgtacatatgtacagtgtcgttttcttggagaaaataaatggttgcatttttttaaaataatagtatcaataaacattgtgatgctgcagttcattcttttagtaaaagtagtgtttttcatgaccttaggtcctcgatcatatggcacggatgcaaacagcatattttgtacagagtaggcaccataatagctcatttcatctgaccctttttttgggatacccttcttctcgtataccttcattcctagagaccttttttttagagctcaagatctgtatttttctaccatgtttatttcttaaattgtctcttagcactgaaattcagatttcggagtatcgttttgtcaatgctgtactgttaattaatggctacagtgagtgaatttattcatcaggtgtcacaacaatttgtcctgtctttcattgtcactttgatttgttatttctttttattctgtgtgcagattatttgaaggagactgtccatgatacatttagatccatcaggtgctgtgctgactattttctttttcactgcataagataatattctacttgttctattttgctagctcatttcgaatttattgactccagttaacccaagcatgaatgctcaaacagccacaactcactgattccttgtgtctatgttcagtgttagtcctaatgggtacaagtttctatccactgctgataaaggggatggagcatcgctgtttttacagctgactgcagagatgattgagctagaggggcatggtggttcacagtgtaaagaagagggcttaaatcctttgggcccatcagaatctgaaaaaatttctgaggtaagtttctcagaggaattatttgtaaaattcattattttagagttctttagtctcattttggatctctttcaggatgaattgaaaatctaccaagtactcttgaatgtcaggatgcaacttgcacaagatattggaacggcgccgtgagttaaatacttaaatgttgacaacaataggtttaggtttctaggctctttacttattggagcaacactgaattgaatctctttaatccattatttcaggtacgctatatgtggtgatcagacactaagaaactttgcgaagttcaggcctagcaccatagctaggttggctaatattgatggtgttaaccaggtatcacttcagaaaataatagtagctaacacacttttatgccataacacagagcactaaacttttttgcggtgcaccctactggaaaatacgacggatgtgatcatattttgtcttaatactcataatgtccgacctttggttttcagcacttcatctcgcattacggcagtattttcatccaaaatatcacacaattggcaaaagaattgaatcttcctgtggat

SEQ ID NO: 80222 - DNA, 2289 bp, Oryza sativa
ccgccgcaccaccggcgcgccagatctgaggtggccttccgcttcccggacgacctgggcctcgggggcggcgcggacggcgggggcttcgacgagatcggctccgaggacgacctcttctccaccttcatggacatggagaagatcgccggcgccgaccgcgaccgcgccgccgagacctcctcccctccccgccccaccaagcaccgccacagcgcctccttcgacggcttcgccttcggggccggtgcgggtggccccggccctggccttgggaagcagcaagacggagcaggaggcgtgttctccgaggttatggaggctaagaaggccatgtcctccgagcagctggccgagctcgccgccatcgaccccaagcgcgccaaaaggtgacgacacccttcggattctcatgctatcttagacttgatttgctggttggtaggattattggtacctcttgcttttgatgaccaaccaacgaaatatatatatatatatatatatatatatatatatatatatatatatatatatatatatatatatacatttattgtgtttactcttgaattagtgagactttattgtctagatatagcattagattttgcaagcaaagaaaggtggtagaaaaataaatgttaacagaaacaaatcatttcatagtctattgaggcccaatatatggtgctagtggtctggaatctctatggatagtgaaaggcagcttgtacgataggactgcagcaacctgaccaactgaattggatgtcctgaaggtctcgccttcctcgcttacgcgggcttctttttggaacgtaagcactcatagaggtggttgaaatgccaatttcttgtttggcaagttgctttcttggaccaaaaagccaatccatgttgttttgttccaaaataagaaggccttggagcgaacgacatatgttcgttatgtgcaataattttatatttactatgcaacacttattagctataaattctctacccaaaactgtttcttttatcaaactattgtgctgcaaccaagttatacaatatttttttttgcggggaagttatacagtatttaactgcgtatattcattatatagggtttaattcatgtcacttagtaaaacctttcctcatttggccccacattctcttctctcttcaacagtattttataacaaaatatgcttctgtatgtgatgaaactgcatataataattttacttattcaatgataacatggttgcaatgtcaacactgttctattttgtggtttgtcttagaacaaaaaactgcatcactttgtttagtctttaaataagctgtgagcgcaaggcgaacggggcagtagtgggaagcactttgcttttgtgtttcttaagcatgcactcttctgatactctttcccccttttctcaaggccttctttatttcatacctaagggccatatatgcagtgaacttagcatggtccactttcttaaatatgtttttctatttgaaaataacagagatatttttttccattagagaatcaccatgtagtggtcttttaatcaaaatgctgtactacaatcaagactgttaacgcacaggttcatggtgtacggtcatatatgcaactggtactataagagcaaacttttgtgcatagctctacaacttatgtagtaataatcattatattcaaagacagctctcctcgatttaattaaccatttgaactttataatgttaactaaatcatttttagcaagtgcattgtatcagctttctgcagctcatgagtaaatgtaaaatttctgagcttgctttggtgcagaattctagcaaacagacagtctgcagcccgatcaaaggaaaggaaggctcgatatataacagagttagagcggaaagttcaaactcttcaaactgaggctaccacactgtcagcacaactgacactatttcaggtaccttttatccatttgtttgtctcatgggttgcagtactactactatgtttagttcatcagtgcaaaaacaataatgtgcatagtaaatgtgccttttgaactgtattgaacaggcagttgtgccacttactagtacatgtgctaaccaaactgcaacttctttacaattaagtggatcatccattagtagaacaatttatttgaactgatgcatatgccatgataactacttcctccgtttcacaatgtaagtcattctagcatttcccacattcatattgatgttaatggatctagacatataaccatctagatgggg

SEQ ID NO: 80223 - DNA, 2969 bp, Oryza sativa
ttaccatcaatatgaatgtgggaaatgctagaatgacttacattgtgaaacggagggagtataacacatgataggattatgtgactagctttatgctcatattggctatagcacatgttgtggaaaggtcgaattctcatccaaatatattctatatggttggccaataatttgttgagctgaatggtggtacctaacaatgaaaatgtatgctctctattgaccaggactattaggttctagtaacactgtattttttttttactctgttcactgttgaccagtattcaaagtttgtgatcatgcccatatttttgtattaaaagctgtgaatatccttttaagacgttttgtttttctgggcagagagacacaaccggactttctgcagaaaatgctgagctcaagattagattgcaagccatggagcaacaggctcagctgcgtgatggtgagcactctgcccgtacatctcaactcttgattttcgttatttccaataaacttgtgttgaaaggtagctcgttgctgtaggctggctgcatacttttagaagatatcttatcaacatttgctatttcttgtatgtaagacattgtgttatcgtcgttttttaatgcaagttttatcatgcgatctcaatcctttccattgtttactttggtaaatctaatcatttgtgagagctccaacacttagttaccgtttagcttcaatagaaatctttctgcattacttcacaatggaactagctaaaattttgcactgctggtaagtgccatgctctattgctgaacataaacttatactgaaaactgattcatcattttagaggataaagctctgtcatgtaaggaatattgagatttctcaagctattagtattgacattttgaacaacttgtgaacatctgaaacacagcatagattaggatacgtgttgtttttcctgctaatagaaataccatattgtttcgcagctctcaacgatgcactgaagcaggaagtggagaggcttaagattgctacgggtgagatggcaaagtcaaatgatgcgtataatacaggaatgcagcaggtcccgtacagcccttccttcttccagctatctgaccaacacgcagttcagcaccatgcaggcgttcagcagctgccacatcaattccaacaacctcatccaagtgtccctagccaccagatgctatcccacccaaattccctctctgatatgatgcagcaagactcgcttgggcggctccaagggctggacattggcaaaggaccagtggctgtgaaaaatgaggcagaggtagtggtgaagtctgagggtagttcaatatctgcaggtgaaagcaacagcacattctaattatagacctacatgtcaacaaattgctccgtccgtttagttttctttgttcatagtctgacatgccttcctgaactgcttccctctctcccactagtttttttttttcaattcaattctttcaattttagttacattgtttgtttgttgatcatcgtgtggctgatcatgtagagacttagatatgctcgtttggaaacatcgggtttatttcttgtgtgttgtgtgttgtttgatttagggggtgaggggcactgagtgggtttccagtgacttttatgtattcttttagttatgttgtagacttgttgtctttgaaaatatgtacatttttgtgttactatgctaattcttaatgggcccgtactatgaaagtgtggaacagtatcagctgttgagaaaatggcgtgttgtttcaactatttttatctttaaaagtggcttatacactttctgaaaaccaaacatggtctaaattggaagtacattatggcttaaaagtggcttatacactttttaaaaaccaacatggtttaaacttaaatacattatagctgaatgtgattagaacgtactggcaatgcgagctatgcatgcaaagtactctctctctctctctctctctggttctttattgtagtatagttatttgctatagagaagctacaataagaaaccacatcattacttatcttttagtatcttcgaagttcagattatcctatagtcttttctaccctgtattagtcttttgctgtccagtttcatattttgcaaagagaaatatatgaccgatctttaaacttggcagtggtgtatgatctttttgaatgaaccatagtatgttcgaacctctttttgaccaggttgatcgctgacgcggtaacgatatatgtaaatttttactaagatgtcatgagacttctagtaaccaagtaattagatcggagctaggatttgttttttcatgggacgatactcgtgtccgtcccataaaaaacaaatctagcactggatataacatatcttagtacaatgaaatatatcttactacaacgaatttgaacagactcttgtttagattcttgtactaggatatgtcacctatacattcctatgttttttttaaccgatggagtagattttttttgtccattcaaaaaaaaaaaactaaagtagattttcttgtagtgagtgcagttttatgtttggatccgcaaataaaaaatatataaatatcagtactgctgcctctttcatagtctaaaaaaatatacactttacacacaatcaattaggggagaagataaggtactcgcaaaatctttgtggagttaacactcaccagatttggtcacattatctagtggaatatactgaatggatttctgacttctaaatttagagttgagatttccaaacgtttggtgtgcaacataaatgtcttgacctatacgtcttatacttttcttcaagcttctattaaagataaatagtctgaaaaaggcttcttttccccgaaaaaaaaacttactgaaattacacttaagttggcacaaatgtgttgaactcattttggcttgcaagatcacatattttt

SEQ ID NO: 80224 - DNA, 21682 bp, Oryza sativa
attgatccagtcaagacgatgtgaaacgacgcaagcttaaaaaaaactgcagttatttaggttggattaagcatacgcgcacggcgcatcatatcgctcactctgcatggcttcggcttcttctgtcagcttaatgctgctcgtggctgcagctatggcctcagccgcctcggcgcagctgtcggcgacgttctacgacacgtcgtgcccaaacgcattgtccaccatcaagagcgcagtgacggccgccgtgaacagcgagccccgaatgggagcctcgctggtcaggctgcacttccacgactgcttcgtccaagcaagttttgatcacctaatctaatcagctgtacaagtagttctccttagactgtactttgagacaaggaaattaataacagaggatgtatctatggacttcactgatgatgcagggctgtgacgcgtctgttctgctgtccggccaggagcagaatgcaggcccgaacgctgggtcacttcggggattcaacgtcgtcgacaacatcaagacgcaggtcgaggccatctgcagccagaccgtctcctgcgccgacatcctcgccgtcgccgcccgtgactccgtcgtcgcggtaagatcacggatgagattactacatgatgcatatatttcttgtagactgtagtagtacgtactcctaatcgctcttggtttggtttggaatccttatatttgcagctcggagggccgtcgtggacggttctattgggaagaagggactccaccactgcgaacgaaagccaagcaaataccgacctccctgccccttcctctagcctcgctgaacttatcggcaatttctccagaaagggactcgacgtaaccgacatggttgctctctcaggtacatatatatgtacacagattatatcagtgattgattctcttacaaattttctgataagaatcataatacgatgagaacttgcaggcgcacacacgatcgggcaggcgcagtgccagaacttcagggacaggctctacaacgagacaaacatcgactccagcttcgcgacggcgctcaaggccaactgcccacggccgacgggcagcggcgacagcaacctggcgccgctggacacgacgacgcccaacgccttcgacagcgcctactacaccaacctgctgtccaacaagggcctcctgcactccgaccaggtgctcttcaacggcggcagcacggacaacacggtcaggaacttctcctccaacacggcggcgttcaacagcgccttcacggcggccatggtgaagatggggaacatctcgcccttgactggaacccaggggcagatcaggctcaactgctccaaggttaactagccggtgatgacgagtacgtgatggtctcagggaataaagctaggccccgacattgctgccaatagcgtgcagctagctgtggccatctcatcactttcatggttcaatggtttcatcagcaagtgcacggaacagactagagagtgtaggtgtatgcatgtgtgatgtcatgtaacgagttgccatgcaaaggcatgaggattacggacctctctttcgtcgtaatcctagcagctacagatttcaactgtcgtgttaaccaagtgaagtgctagtttcgaatgtattggcccctctctgctcttctctgctctggcgatctggcctctgcgatggtttcttctggggaataagttcatctaagttcccttaacttgtcaacgaatccgatttttatccttcaaccacaaaaccagatacaattggtccctcaactatcaaaaccggtgcatattatgtccctcggcggtttcgatagtggttttggctgacgtggcgcctacgtggctaattttgactcggtcttgatctgacgtggcactgatgtggcgcttacgtggcaattcgatccggaaaataataaaccccgtgggacccacatgtcagtttcacacacaataataataataatggtgggacccacgcggaccccacatgtcagtctaattaacccctcctcttctgcttcctctctctcctcctcccctctcttcgtctctctcttgcgctgggtcattctgattctcctcttccccatcttctctgtcttcatctctctcccctctcctctctctcttctctccggttcacgggcggcggggagaggacggtgtccggctgggagaaggggcgcggcgcggcggctagtgggagggaaactagcggatagaagggaaccagcccggtggcggaggcagcgccgccgcggccgtggctgcggacgacgtcgacgtcgacctcggcatcctcggcggcgggatgaacgtgtcccgccgaccggccgacacacgcgcgcatcctcggaggtggctgtccacgtgggcgggtgagggggccacctcgccggcgggagaggggagaggcggccggctgcgaagacgaccctagtgatgatgacgaccgtgcggcgcgcggcggaggccgatcccgtgagcaggaagctcttcgtccacggcctcggctggggcaccagagccgacgacctccgctccgcgtttatatgcctaatcatacaaaggtagaagaaatagcgactagtactagctgactggagtatattttgcttcgtcatcatcatttgcttgtgttatgacggggttgatgaatgaataaatgatcattgttttgggcaagaaaacaccgttccggccggactgacgaggaacccatatcgatccgctcgccgcggcccatggaaacccaacaggagatggcaacgctaccttccgccgtcggcgactactaatggtgggtgatgctcgagcacattgatgaactcgaggtcgacgacgaggactccaactacaactcctgctccgccgctgccgacgacaccgccaatcccgtgagtccatgacgacctcgctcacctccaacggccacgtcgtaagagtctacttccgcctcaaagcgcccccggcgacgtcacacctatgcctctggcaatcactcttctccatttccgccgccgtcgtcgtcgccggccgcatcccctagtgcaagagagagatgaagagaggagagaatgagagagaggaagcagaagaggaggggtgagtagactgacatgtggggcagcgtgggttccaccattattattatttttttttgtgtgtgaaactgacatgtgggtcccatggggtttattattttcccgggtcagattgccacgtaagcgccacgtcataccacgtcagatcgagaccgagtcaaaattagccacgcaggcgccacgtcagccaaaaccgccatcgaaaccgccgagggacctaatatgcaccggttttgatagttaagggacccgttgtatctggttttgcggttgaaagacgaaaatcggattcgttgataagttaagggaccttagatgaacttaagaagtccgcctggagagctgaaatgggctgcaccttttagtgtccccgtgatgtggcccaactacgcctagttaatgggctactggtctggaaagtggattgtagtccgcttgtgtacgctggaataagttcactttgcgtcccgcatctttgatggcaagtttgaaaattcgttgctgaaccgcaatatcaagtatagcctgtccccgaactcgtaaaaccgtgttaactttcgttctaatatagtatggctcctgatttcgtccgatgtggcgctttgactctggtcagttgtgctgagttagcgtgggacccatgctagcccgtgtgttagtaactaactctttcctcctctctcccgctctctcctctcttcccaatccccaaccaggaagcaggtcgcaagcagcgtggataaggttggcagccgacgtccaacgggtgtgtggggagaagggcggccaagcccgatgcgatgcaaggagccatgtccaatttgagaatgtaattcgaactcaatgttaagaggacagatccccggctgtgttcggaagaaggggttgggaacccctcctctccggcaggtataacgaaacaatcattagtgtataactaattaagtattaatttaaaaattttaaaaaataaattaatatgatttttttaaaaaaaaccttcctgtagaaaacttttgaaaagaacgtatcgtttagtagtttgaaaagcgtgcatatgaaaaaaagaggaaaatgagttgaaaaaaaaagggaataagtggacttattcctgtgtacgccttaaatcgccatgtgcatgtgtatagcagggttgtatggcgtccaaaaaaacacgcacacggatagttttgttcggtttggcataacaatttatagcatgttgactgttgacctcatcctgtcagtcgctcggttcatcatttcaactgcttgtgcatcacccaaataattcgactggctaaggtttatcagaaaatgtgtgttcgtctattttttctggtagaagatttacttcggaaatagttgtggtccaaatactgtccaaactcttttccaaacgagtgagaagagaaatggtggccaaatggaagatgatcacgtacaccaaaaaatagtaatcttatagatatatcatcaactagtagtgcacaagctcccacgttaattaaaaattttgatcaatttattgtctacatgcccaattaattaatgtttgaatcctaatacatgcatggaagataaaattagaaccagataataaaagcaatgatgtactcactccttcccatgtttatccatcatataatggaatttaaaatttcttaaatcgatcatcatataaccgcatggacacagattttatcaaaatacaattaatacagcatgaaagaatgtgtacatgctaagatgtaattgacatggtgttttaatcgatacatacattatgggagaatgtgtgcatggtgttttgattaatgtgatttaaattatacttggtcctcgtgcataaacatatatgatgatcaatttaggaatgaggaagtatttagtttgtgtgtttatatgagcgtttgcacgactgtactatgtttttaaaaaatactgttacctttctactccctacattctcccatgatgtattaattgtattctgataaaattcgtgtccatgcagttatatgatgatcaacttgaaaaattttggattccattatatgatgattaaattgggaaagagagagtattagctttttcaaataaatataggggggggtggttcagcaattaaaatggggctaacctacctgtaaactctaaacagaaatctgtgcctaaagtgaaaaccacttatgtcggacaggtatagaaactaaaagataattaaaattgtcaacatcggtttatccagccaagaggaactagaatgcaaaattactttacagcaatgcagctctggcgaaacgttgacagatttggccctctcccacacgaatgctgcatatgttggcttgtagcagccatcgtttctagcaaatcaagtctggtgttatcagacttggacacatgcgtactagtaatattagggagtccctacagagaagtagagaacgaccaagattttgcacttttgctggcatatgtgaagacataactcccgaatatacttgttggctgtttatctccaatgtatctactatctagcaatatgcaggctcattttgctgggagaaaatcgcgagctataaatatgcatgcaatgcagcgttttctcttgcaagagctgcttagacaggagtagttgctacgagtacttgctaggaagaaactgcagtgtgctctgttccaaagagtagtgatggcttctgcctcttctcttggcctattactgatgctcgcggcgctggtctccacggccaccgcgcatttgtcgccgacgttctacgacacgtcgtgcccccgagccatgtccatcatcaagagcaccgtgacggccgccgtgaacaacgagccacgcatgggcgcgtctctgctcaggctgcacttccacgactgcttcgtccaagcacgtttccatctcacaaaccaccctgttttttttttttactttgatttaaggccgaaaagtagctaacaggtttgcctgtctgtcagactacgtgagttagcagcgttgcaagaaaataatcgtggcttaatttttgtctgaatcaacacagggctgtgacgcctcaattttgctggccggaaacgagaggaatgcagccccaaacttttctgtcagaggctacgacgtcatcgacagcatcaagacgcagatcgaggccgtgtgcaagcagaccgtctcctgcgccgacatcctcaccgtcgccgcccgcgactctgtcgtcgcggtaaccatgcatgcatatatcaacgacacaagatatcgagctcgcgattacgaattctgtgatgctgaattgctttatttggtttttaatttggcatgcagcttggaggtccgtcatggagtgttccgctagggagaagggactccaccggagccgctaccgcggcccaggtgattagcagccttgctccttctacagatagcctcgcacagctcatcagcgcgtacgcgagcaagggacttagcgccactgacttggttgctctctcaggtgcacacaatatatataactcctcgatcgatctcctaatcaaccatggaagtgtagtaaacaacagcttgtgttgaaatttgaaaacgatatgtttttgtttcaattatgcaggtgcgcacacgattggtatggcacggtgcaggggcttcaggacgaggctatacaacgagaccaacatcgacgccgcctttgcggcggcgctcaaggccaactgcccggcgacgccgggcagcggcgacggcaacctggcgccgctggacacgacgacgcccaccgcgttcgacaacgcctactaccgcaacctgctgtcgaacaaggggctcctgcactccgaccaggagctgttcagcaacggcagcacggacaacacggtcaggagcttcgcgtccagcgcggcggcgttcggcgccgccttcgcgacggccatggtgaagatggggaacatctcgccgctgaccgggacacagggacagatcaggctcatctgctccgccgtcaactcgtgatctgatcgaccggtttgtatatatccagacgctgggcactcgacaacatgattaattaccagtgcacgaatgcatcaaggaaagaattccagttgcaattaattacaggtgaaacatactactccgtcttagaaagaatccaatcctaacaatgaatcttgacacatgttcgttattaggattggatttttttttttttggaacggaggaggtacgctcgtattagcatacgcaattatagtcctttaaaatcgtagagcattcagtgaagatgtcaccgagaatgtcacggggaatgttactgaatctgcgtccgtttattagcaggtttgcatgcttcttgatctgtaccgacttctctctccaatacaaaatccactcctgttacaagttattttttccctctctctttttttttgagagagagaggactcccgctcttgcaatcttgctagacctgttcgtcctccatcttgcagtagcaagattttttgttttctggattgccgtcggccggtgaccacacgcgcgccgccggcgcgagttaagatatctccaccgcctcggcgatattttgctccacgttgcaaaggcccgtgaaggtgacgatttggcccatctatgccggtgagcgtgctacgtggtggatggggcgtgggccggcttattttcgcggcgcaaaggcctactctttacttggcaggctgccactacttcggcccattaaaattcaccagcggcagaaattgaaatgcttttttttggcgggtagaaaatgaaatgatttgtttttacaggaaaaaaaatgaattgaaaactaaaaaaagctgtcaacgtcgttttaaacattctgaaggtgaaaggaaagcaaaatgactgcacaacggtcagaaaaggagagaattatcttggacaaatgctgaccaatcgattcatctagggttgtgtttcgtctgttagtacggagttccacaccgagtgcacatccggtggattatgttggacctgcacttgtcatgaaatatattgggtgaatgtttctcgtatacgtccttttttcattttcttcgcgaaccctttatgttttttcttcttctaaatcatcattcatatgctgctggacacgatattgtaaatacatgtgtttgtatttccagtatttgatttcagtttaagaatcataatgagtgcttaaattttgactaattgtttctgccattcttctcgaggacagtccatatatttgaactaatctagattctgaacggtgaagttttacctgtatattgaaaattctccaaaaaaaattgacaacattcacaacatatatatgaactactctaaaaaaaatcaagtaaagactcaactcacacattgagaaatgaaattaaaaaacaaatccagcattaattggtactattcacatatgaatttgtctttttatttctcaatgcgcggatcaaatttgaatataatttttggtagaatggtatatgctgtttatactctacattagtaattttttaaataattttacaactatttatattaaatataaaagaaaaggttatacgcgttgatattctctcgggggattagaatccctcttccgtgaaagtaacttacaacttcagattcttctgaatctttgctgatcaactagtataatgtacgggtgtacagattctgattaatcacaaacagatactgagagcagaagaaatatcaatatattgtcattacaacttaattcagtactggccttgattggctgcgattgctgctacagacgctgtggctgaggtagttgaaccgttgcaagctacagccattttgaactgccgcaataacggctgttatggtagcaatcacatccgaacatgcccacgtatgtgatagatcgaaatggcaatggagttcggccccagcttaactgaaatgaactctgcttgattgcatggcagacaaactcattatcatggatgcgagagctgaacattcaactgttacatggtttaaggcgaggcgtggtgtcctaactgttaggacattctcttggatcagtgtcacaacagttactgttctggtgctacctacagtagtagtgcactgtactgttatttgtttcctacgagtatatactggtagcccaaagactgtttagtgaaatggatgaccagggatggtggctgttctgttctcctcactccgttttttaatagatgacaccgttgactttttctcacacgtttaatcattcgtcttattcaaaaattttatacaaatgtataagatataaatcacacttaaaatactatgagtgataaaacaactcataacaaaataaattataattacgtaaattttttgaataagacaaatggtcaaacatgtaagaaaagaaagtcaacggcgtcatctatttaaaaaacggatgtagtattccacacttttccactcacttgctcatagaaagttcacgaacacagctgtaactaaagtgacaaagccatgttacgccattgtttcacagacttttcctgcaagcgatgcctgacaattccaaggatatactataattttgcccggtgaaagagggaagcaggggttagtgttggcggttgcaatttaagttgggcgctgtcacccgatcatgtctctcttgggtgcatgcaagccaaattacttcaccacacaacgtgagcacgtcgaatgccaacacacgttggtcaatactgttcatacccacgatcaaaatggctgcacaacgacagtggattgtgaggactaaccctggactggtaaggcatcaaatctgaatgttttgtctctgctggagaagtacagagatatgcaggtaaccaagtgggctaattaaatctctagctataaatatgcatgggatgcagcactctcctcgcaagccacagccaagtgcagatagctcattgctaggcagagataaacgtatatatctttggttaattgttagcttagcgatggccaaagcaacttgcatttccttgcttgtggtcgtggctctggccaccgcggcgtcggcgcagctgtcggcgacgttctacgacacgtcgtgccccagagccatgtccatcatcaagagcgccgtgaccgccgccgtgaacagcgaaccccgcatgggcgcgtcgctgctcaggctgcacttccatgactgttttgtccaagcaagttccacacataaccagcgcctttgttccattttgacttaaacgttactgcagtatatctctagtcaagcaacttgagtgatatttgaattgaactagaaaagttaaatatatattgtacatgtgtgcatgcagttagatgacatgttcagacaaataaccatatattgtacatgtgtgcatgcagttagatgacaattgacaagcaagacaaataaccatacattcttcctgtttgactaactgtacagggttgtgacgcgtctgttctgttgtcgggaaacgagcaggatgctcctccaaacaaggattctcttagaggctacggcgtcatcgacagcatcaaggcgcagatagaggccgtgtgcaatcagaccgtctcatgcgccgacatccttaccgtcgccgcccgtgactccgtcgtcgctgtaagatcactttccctgcatgcatagcctgcacgcttggtctcgaactctcctctcgatcgattcctgtatggttgtacgtgggaaacggatcctctaacgtgaacttcttcctaacgtgatcactaacagtaacaggtgagcccgtcagtggtggaactcatatatcagttatcacgttcctctggttttacgtcagatgatcccgatccatatatatgacattattaggcttcggcttttgtacttaaccaatggagtaataatcatatgaacgcgcatgcagctgggagggccaacgtggactgtcccgctggggagaagggactctacaggtgcaagcgcggcgctcgcgatcagcgacctccctccttttaccgctagcctccaagaactcgtagacgcattcgccaagaagggccttagcgtaaccgacatggttgctctctcaggtaaagatccaccatatatgctcacaaaccatcaaaccaagcaagcttaattttctgcactcctatttcaggcgcgcacacgatcgggcaggcgcagtgctcaaccttcaggggcaggatctacaacgagaccaacatcgactcggccttcgcgacgcaacgccaggccaactgcccacggacatccggcgacatgaacctggcgccgctggacacgacgacggcgaacgcgttcgacaacgcctactacaccaacctgctgtcgaacaagggcctcctgcactcggaccaggtgctcttcaacaacggcagcacggacaacacggggaggaacttcgcgtccaacgcggcggagttcagcagcgccttcgcgacggccatggtgaacatggggaacatcgcgcccaagacgggaacaaacggccagatcaggctcagctgctccaaggtgaactcgtaagcgagtaccctgcagacactgcagtaagtagtaacaacgtttgtagcagtatatgcagttatgcacgtataagacgatggagtgcgtgaaaaaataaggacccccacaaccactacgactgaatgaatagcaatgtgtacgtggagatgtggtacatgcagatttgccttgctctgtttcttgttccatctgtatgtgcatggaatacagaggacagaggggcatatgcatggcgtatatgtaacgaaatttctggtgcaaaggcacggaggattatactatactcatcttctaaatattattcctacaagctactagtattccacacgagagaccgagagacccatcagaagggatcagaatgcgtgtggctgggctgctgggtcatctccacatgagacattttttattgggccgtgaactttctcgttcgtaacatgtcggtgcttctatgaaaaagcccagtataactgggtcacgtcccattaaggaagtagctcattcacactagtactcctgtgtccaccgtcggatccgagtttcaaaaataaaagggaaaggtctgaacagatattaaatttttggttgaaatggaacataattttcaaaacaattcaaatacaagagcaggccatcacaaaatcagaagtacatgcaagcacacccttcaagaaatcagcagctaccacaggtgccatgcaaattcgtggcgatgactcgtgtcgtgtgtcgcttgaccacaccaggatcgatcgatcactcactggttaacaacccggcagttctccctgatctcgccgtcgtcgccggtgagcgggctgatgttgcccatcttcaccatggcggcgccgaagtcctcccagaacttgtccgggttctcgccgtagtacttgaccagctcgtcgctgtcgccgccgccgccgccctggtacagctgctggtccgtgtgcagcagcgcgcggccctgcgtgaggccctggtagtagtcggtgtccacggtggtcggcgtgtcgtccagcgaggcgagcgcctcgtcgtcgccgacgatggggcactgctcctcgagcgccgcggcgtaggccgggtccagcgtgtcggtctcgttgtagaggcggctgcggaagaagaggcagcgggagtagcccagcgtgtggccgccggagagcacgacgaggtcctgcagcgacaagccgtgggactcgaagttgtcgacgaggtccgggaggtccatgaacgggttcgggatgtcgtcgttcgcgtcgtcgatgctcgccgtcgtcgcgtcgcgccgccccaggagcacctcgtacgagcttcccccgagctgcaaacaaaatgaatcgtacgtgtcacgttgcattgacatcagggtctgtttagttccctaaactcccaaacaaaatttttcgtgctgtcacattaaatgtttgacatatgtatgtagtattaaatgtaaaaaaaatcagttacatagttcgccagaaaattatgagacgaatcttttaagtctaatcgcgtcatgatttgacaatgttgtgctacaataaatatttgctgatgacggattaattaggattaataaattcgtctcgcagtttcctgacataatctacaatacgtaaaagtggttgtgccttatattttacgatggatggagtattagactacgtttaatacttcaaatatatatctatatatccgatgtgacatgcaggggcaaatttttttgccaactaaataaaccctcattttggcctcaccaagtcaacaggatcaggatgtgccgcagtttttcagataagtgaatcacgactcattctcttgtgaaaatgatgtcatgaaagccggttattgggtttaggttgaagaaagattttcaaaaggagcatggtttgtcttatggtcgatgacgttgccctgttcgatagatagctttctactactagtagtacctttcaatcgacagtatgtgtaacgtggataagttttacacttgtactgaacttaccgcgacgattgaatcacgagcagcaactgccaagatatcagcgcaggagacaacattccccaagcaggccgtgttcaccgccaccttgatggcgtcgatcacgtcgaaccctctcaatgacatgttgttcggcttcgccagcttctccccgatcatgtcgtcggtgtcgtccagcagaacggagccatcacaaccctgcatcacgttcgttcatcaccaaaacatctcatctgcttgtaaaatctgcagcaattaaccactaagttgaagcgtgcatgatttagtagctagctcacattgacgaagcagtcatggaagtgcatccggaccaaggacgcgcccatcctcggctccttcaagatggcggcgccgacgacgagcttgatggtcgtcagcgcctgcgggcacgtctcgctgtagaagtccggggtgagctcgccggagccggaggccgacgcaaaagccgcggccatgacggcgaacacaacaagaaatggcgccatttttggcaagctgctactactgcttccagtaccagcgattagctagtgagatggtcgaatgtgctggtttggagtgtgatgctgatgagactgtgtgcttatataatgggctaaatatgtgcgattgacccgtcactattagccaggttaacaaccggtgctttttttcggtgtatgatagagatctaatgcaaatccaggctttcagaatgcgtcaatgcgaggcttgtcaaagaagagatcagtttcttctccatcttatcaattaccaaattgtgacaggcatgtaaagtgctactggtttcttgcgagtaatgccgacctctttacaggatttttctttgtttattttctgaaacataatacaggctttttcttaacaaaatgttacttattacacggatatttacctgatgaacctttttggtaccgaattgaatatgagccatcgtccataagtaaaataatgaggaactacttttgttaagcaagtttgttagcatagttttcttgcagaaaccagcaaaatcgactgatcatatcctcctttataatgagccagtttaacacgataagaaaccatccgaacgctataatctatgctccagcactgcgtataaaatgctttatggaacagctgtttttgggttgttttgcaggttaataaactgccactgctttagaacagaggcatgtatcaaggcgatgcttgacctaatcaatggatcacaatcacacggtttggtcaatcacttgccgcaaatatttaaacgcgtgctttagacataggttgaaacttgaaatatttctctctgtttcctccttggaataagttcactttgggtccctcaatttgtcacccagtctgattttcatccattgatcgtaaaaccgggtacgactggtcccccaacttacgaaaccgtttaaataaggtccctgggcagtatttgacccctgttttggctaaggtggcgcctacgtggctaatttgacttggtcttcatctgacgtggcagtgacgtagcgcttacgtggcaattcgataaaaaaaataataaaacctacaggacccacatgtcagtttcacacacacacacacactaatggaccccacctgtcattctcactaccccttctctctatcccctccctcttctctctccatccggagcggtgggggtggcagcggcggagcggcagggaggagtggcggcggccggagtgggtggggaaggagcggcggccgccgaagtggggtgggcaaggagcggtggcggtcggagtgggacgggcaggagcgggcagggcacctggcggcgacagcccccgcacccgcgacctccctcgtggcgcgtcgatccatgggtcccccgccgccgcgtcgcgaagccagagcacggcggagacgtaggcggcggggaggcagtgctcaggcgcgaggcggtagtcgagggagatgacgatggctggcacggccgcggccatggcctcgcacgaggcgtggtagaagacgctgccggtggagaagaggacgaagccaccgccgtggaagtagacaatgacagggagctttgacgctggcggcggtggcgggacgaggttggggaggtgtcgagggaggcgtcgagcggcccgtcgcgggagaggacaaggccggtggcagacggcggcgcgtcggggacaaaggggcgcgtgatggtgccgcccgggtgaaagaaggggaagggaaagctcctcgctccggcgggcggccgctgacgagcttggtggcggtggaaaaaagaggggcgacggcgaggttttattctcctctctcccctccctctttctctagatccgcgcaccgctccgctgctgccggcggcgtcgaagagcgtgaggaggcgacagtggtggaggctagttgcggcggagggcgtgcgccgcttcctctcccgtcggcgccgccgcgtgccgctccctctccatcacgcgtgagagaggaggggagagagatgaagaaaggggaaagaggaggaagaagggggaggagtgaggatgacatgtggggcccacgtaggtcccactttttttattaatttatgtgtgaaactgatatgtgggtttcacaaggtttattatttttcttagatcaaattgccacgtaagcaccacgtctgtgccacgtcaaatgaagaccgagtcaaattagccatgtatgcgtcacgtcagccaaaaccactatcaaaaccgccgagggacctcgtttacccattttcgtaagttgggggacgggttgtatccagttttacggttcagggacgaaaatcagactggacgacaaatagagggacctaaagtgaacttatcccttctcctttatgttgatttcggaccatcaggcccctgtatcgatactctgtgggccttttatggcctgtcagcaggctcttttacggccgtatatcccgtcccgttgtagggccgaaagcggaacattccggcccatttactgcaaaatctcataatctaaagctggcacttttgctagcttttgattggtccacttggcgcctcttaccttggagaaaaattataaatttatactagagaacaaacacctaacaatcatatgtgagaaaaaatctagagaaaaatatcacatatagattcggcttccagatcttctctttccaaccacacgaacttctactcccttgtcttctataaatataccacgcctactcggtactactcctataactctacaatatataataaacctaaaattattaagaaaaaacaaatctaaaataacgaatttacattcattttccttctttaaatatcctacgtctactcggtactattcatataactctagaatatacggtaaacccaacattattatgcaaaaaaaatccaaaacaaagaaaaaaagaaaatcttgttttcttatatcacagaataggatcattaatacctactcagctaaaaaatgattgtgtttttttgttacacaggatatgttaaaaaaactctaaatataataaataattgatctttcaaaaatttaaatccacaagtaaatatatttgaaccaattaattctgatgaatcttaaaatttattttacttgtttgaattcatcagaatttatgcataaaatgacacattaaatttagtacaactttggcctataaactatgaatagcaggaatcatttgaaaaacacatttttcttacttccaagcaatagaaaaatcaaatagagccgcatatgatcttgctgaatataagtaacttcaattttaggactaaaggcagcactactttacaatttcagagatcaagtactttacaattttagagatcaagcagttcataattatgcagcaacccaaatttagactctcaatgccgtgctttcacatgcgtgtccctgtctcggtcattgcatagtcatgttgtatttgaagtcgcggtatgagtgcagccatgaaatttatgtctctggtgagacgagtattgcggcaatagtgcagcacaaaccaatcgtcaatcgtgctaaaaatacaaacatatttaccccaataaataagataaaaataatataaaaaagttgaactagatttgcatcttacctgcaacgatataccctcatgcacaggcataagttgagttgtagagagaactccataatcgcacattgggaatgttgttattgacctaatatcaaaatagcaatttgtataaaaaaaacttattttctattcaaaacttcattcagtggccattatttaaaaatgtttttctttttaggatagattacataaaaatcgataaattcatagtttgcaaggaattacctaggcgacgactagtacataatcccgtgggcgcatttcttttttagatagattacataaaaatcgataaattgatagtttgtaaggaatcgcctaggcgacgactagtacataatcccatagacgcatttcacgactaaagtattctgtgggccatatacggcccaattatgaggaagttaggccttacggtctaataaatcgacgcgtgcatgatgaactttcatgaaaacgcttcgtgtaagacattcgaccgtgttcggccccaccatcatttacccatctcttatgggatcatctgtacatttgtcgacaaattttctcctaaaaatttcgcatccaattatagtacaatcgtgatgtgattatattgtaacttgtatataactcttaacaatctcttcgtaacatgctattttggtgaaacggagatcgtgggaatgaatcctctcacatgtgtgcgtgtagtgacttttttccttcttcacttgcacatgaaacaaatctaatggttcaaaattgttggaacaaagtctaaaatgcatggcaagggccctctcctctataggagagagcccatgcttgagttctttaggagagaggttgagagaaagaggataaagtttggatggccgagaatggagtgggggtgtgggggggagatcctcttgtccttggagggcttattttattcatatgtaacgggaaattacatctttacccttaatttactatatatgtacaacatcctcttgggggtattttaatccttttatacattagtttatacgacactctaagtatgtggttattccccaacaagaaatatgtgaaagttacatgcaagttgcattatagttacatgtaagttacaatgtaattacatgtaagttacagtgtaattatactatgatagtacttaattacatctgtcaaatttttaagaggaaatttatagacaaatatatagcaaaattgtctctctttcacgcgatttccatctaacacatcaagcctctttgaccccttccctatctctctctatatttttcgtcggcctgacatagggggcccaaggtcgtttgttgccatccccacaatctccggtgagcgaccaaagattgaaagatcttacaataagggagacagatccatttgtcagagtggaggaaggatgcaggaggtaggccatatcttattttttctttttggagctttttgtgaggatgttgcaagctattattttcccatgcatgttacgccttggtgtaattgaatgttttactatattttaattgtatgttgcgcactttaattcttaggtgttgcgactagcttatttaaatattgcatttggttgaacatttttctctaaccgctgaaacatttttaccgaatattgaaacatcttaaatatttttattgtaacatttcggtgaaacatctaaaacatttttgtacggacgtctgggccttgctcctctccggactttcaaggttagtgctgtagaactctggaactaacatgcggctgattaaatgagttgatgggcagcttaattacggcccgcctgtttagccaattgatactcagctcacatacggcctaattaagttagattaactagataaaagaacatccaacacaggggcccagctcccagctagtagtactcagtactcgtctcgatgctacgaaaccccaccttacagaagcgtaaaactgcgtaagcccatcaggactgggcccacatggcagataagcatggcccgagttcgtagtaaatcccccaagtcctgcacggggtgatcacatcaacagtgtgttcctcaaggagcgttgtcacgctacaacgtgatggtggcgcgccacggcggagaaatggcactcactgtttcctcgtgacgtgcgccaaaacaggctcgccacggcacgccccttgccgccggggaaatgaatgatccagggcggcagcagagtaccagaccctaagcttcagacgcggccccatctacagccactgtttcgcaatgcttagaaagatggcagcctgaaataattgaactcgttcggccgggccaacccggcagagaaaaaaagggattattgaactccaaaagtgatcaaatgcggtggagcagagctctcgtgagtctaatcccgcaacgagaacgcatatgaataatggttttgcggcgggtgcgttctgcaatgacaggccaacggtcaaagcatcccaactcccgcctcctcctcgtctaaaaccactcgcttccaaacaatccaaaccttccatgccatttggcatttttggctttgcttctcttctcttcctttgctttggctcttccccaaaatcacaagacccaagaaagaaagagagagagacaaaacaacagatcatctttgcagcactgtattggcactgtaccgctcgacatgaacggcgaggaggctccggccgggagcggcggcggcggcggtggaagggcggagatcgacacgtcggcgcccttcgagtcggtgcgcgaagccgtcgaccacttcggcggcggcgccgccgccgtctggagctcctgcctcgtcaaccgcatgctcactcccccgaaggtgacgcctcctacagtaatcttcccaatattcgtgcttcgttctccatttctcccaagtccaaacaccgtgctgttgagtgtcgaacgaactgttaatgtttcagtacagttgggagtgttttgtactactagttttgtcctcgttgtattagcaaaatcagcttgcaaatctgcatcagtatttgtatgctcccttttgtcttatgctactaatccgattgcaggaacatgaccagatgaatgggcagacctttgcactagagaaggagctcatcatcaaggaaagccagacgcttgatgtgctcaaagaattagagtcctccaaaaggatcatttcggacttgaagctaaaagtgcagaatgattcagccatcactggacacccgggccaaactgaagcaccaggtgcagggcctgaggagaggcgctcttctgaaaatgttgaaactgatggggaattgggtggcctggattcacagaatctgcagcctccaagttcagtgctaatgcagcttgagcaggcaaaagcgtacttgaccagaaccacagctgatctagccgagataagagcctccgttgagtcgctgtgcaatgagatagcaaaagagaaaatcttggtggagagaagtcgagagaaggtttgctccaacacatccttgatctcttcgctggagggtgaattggatcgcactacacataagctgcaaacgctgaatgataggcaaagaaggcgcgaggattcgtcacacattctgatggagatcaagaaggtgacatcagagatagagcagctcaagagcgcatcaaatgcatcgaaatctgaagctacgatgttggctgccgaaattgagcagacaaaggcaagcattgcaaccgctgaggtgaggtgtcttgcagccaagaagatggaagatgcagcaagagcagcagaagctcttgcacttgctgagatcaaggccctacttagcggtgaagcttcagctggagatctccagggtactgatggagtgaacttgtc

SEQ ID NO: 80225 - DNA, 39421 bp, Oryza sativa
gatgggcttgcccaccacctctgcctctctcatatggaggccgggcgagcttgagcttggacaggctcgctggtcgccttcctcttcctcttcctgactctcccgccttcgcttcccttgcatagaggcgccgtgagctcgagcacggataggctcacccattgcctccctcaccgccacccctaaacagcttacgcggttgcagaaaaagataaaagaaagaagtgggacactgacatgtggccctatatgtttttctatttatttttgctggttaggatatcatgttagtgaaaaccagccattcgtaatgtcatgggacctatcttaaacagttttgccaagatgtgatgtgaagatttatagttttacgttttaaagagatgttaattaaactcaatgtaaagataagctacggcaagtggtgttattcctttcatctttctgaaactcctgggacataaatcgatggaccaaacaaaatgggacgcatgtacacacaaaatggccgtcacgtaatcaaaatcccgtttagactaactggtatgggcctcttgtacgtcgaaatcccatttcggcctaatattcataggtcccagtctcgttattgggccgcacgcacgacaaaagatggaataagttcaccggaggtccctcaacttaacaacgagattatttaaagtcccttaaccacaaaatcaaaaatgtgtacccctaagcttacataaaccgtgcactaaaggtcctatggcagtatatctgggtggtttcacgtggcatcctagtcagaaaaaaagaatttaaaaaagtatatggggtccacatgtcagctgcacatatctctctcttctcttttcttctccctcccttctcttttctctcttctctcttctcttctttggtcagggaggccgggggccggcgagcggagcgacgatgggcgggcagcgggcggagcggcgctgggccacgggcgggcggtgggctctgcggccacgaccacggcagttcctacagcggcggcaaccatggcctcgacgggaggagagaaatgtggagaggggaggcggccggcggaagatgggggaggggagaggcgtcgccttcctccagacgggccgacgctgtccgtcgtcgtgcacgacgccgcagccgcgtcgaaactccacctccacaattttactcggataccatgataagagcagaagtaaatttcacatggacattcggcacagctctggatacagacacctcaattaacaaaccaaaatgtacacatttagattccgataccaattaaccgatcaaagagcaaacatatgaactaaaaaacatcgattaaccaatcaaagactgaaaattcagattttctgacaccaattaaccaatcaacgagtttaccttgcggcatgggagctcatcgccgtcgcccctgcccagaccgcgctccatgcgcacaacttcctcgccacgccgccgctccgcggtccaggagcgcctcaccgaggagggaaagagcaaggtaaactcgtcgcttatttccctcaggcaaggcggcaaccaaaccactgttctacctccaagccgtcgtccgtcatcccctatactgctgctccatctcgtcggcgtgcggccagattgccagaagcagcagcttcccggcggtggttcgcgggggcgggcgcctagcctaaaggtcaccggagccgccgctaaccgttgccgacggccgctccgcgtcgagccgtcgactccctcttgagtttgctcgtcgtgccaatgacgacggcgacgttcgctgcgaggcgtgcaggtctagggagtcggcggagcagatgcagacgtccccagccgaggccgccgacgccgcctccttaccgcccctagttggcgtcgcctcctcgccggcccaagccgtcggccgtcgtcggctcgtcgttggcgtggtccccagccgacgcccccacgccacctcctcgccgccccggctgcaacgaccgccgccaccatcaccttgtcgagggaggagccgaggagagaccaagagcaggggagagaggggaggagggagagagagagagagcaggggaagagataccgtgaagaatgaggatgacaggtggggcatgctttcgtttttaccacatcagcacgagtggaccgggtcaaattgccacgtcagcaaaaccacttatctatactgctataggagctagattgaacggttttatactccctccgttttaaaatgtttgacaccgttgactttttagcacatgtttgatcgttcgtcttattaaaaaaaatttatgaaatatgtaaaattatatgtgtacatgaaagtatatttaacaatgattcaaattatatgaaaagaataaataattacttaaattttttgaataagatgaatggtcaaacacatactaaaaagtcaacggtattaaatattttaaaacggagggagtatattttaggggtgaagatttctggtattgaggataagggatgtcacacaaactcggtgtaaagttgagggacggttattccacaaaagatccccgttcaagcccatgggtcagccgagtcgaacaggctgcatcaagtggacgttcatgggccggacattaaatgggccgatttctattcgcagcccacgttgcccgttccgagtgtttgaccggcgtctcgccgtcgccggtttcatcacggaccaaaaaagcagctgaaaaatcggagaaaattcgcccaattttcttccaatctgcttcttaattcttatacaagcagagagatttgattttgaattttttttacagggtattgatcgatgagatctcgtggtgacgtcataggacgtagaccatgccgacctcgagcagcgacgccggcggcacgcgcagcaccacgtccgggccgcggcagtttcgccggaggaagttgtacccgacgccgacggcgagcttcttcagcagcgacgagcccggcttggtctgcacgtgcgagtgccccaggatgaacgccgtgccggcctccctcgcctcgcacagctcctgcagctcctccaccacgcccttctccacctccgggctcgccgcctccaccacgaacctcaccttcttcgtcaccggcgccgccgccgccgccgccgggacctccactatcccgttcgggctgcgcgcggcgtccaccgaggacacgccgtcgtgggaggcctcgtagctgaggcatcgccggagagggttcgtcccgatcaccgtgagcgcgttctcgcgctcgtagcggccgtcgtcgagctgctcgctcccgctgccggcgtcgctgcagcggtggtacagcgcgtccagcttgatgaaggtggcgaggctctcgacgagctccgcctcgaacgagtccacgtcctggtgcacgtcgcggtagccgtaccgcacgatgcaccggtacgaccggtgccccgccgggccgacgcggccgacgaggtagcgctcggcgggaagcacgtgcggtaccgggacggacttgacgcagacgaacaccagcacgcggtggaacgccgggaggttggtgacgaagcgggagaagttggccggcacgccggaggtgaggtcggtgtagacgaggccgatgcccgggacgcgcaccatgcccagcttgtcgcccagggcgagcagccactccagggtcaccttgttgtgcaggtcgaactcgtacttcttgatggtggtgtggtgccagatgaacatgacggccatgaggatgagcgccagcatgatcggcagccacgccccctcccggaacttgatcagcgacgccgagaagtagagcacctcgatggagccgaagaagaggaagaagacgagtgccagcgccggactccggtgccaacacagcatgatcaccaaggatgtcaggcatgtcgtcaccagcatcaccgtgatcactgccaatcctgcacaacaactcacattctaagcaacgcaatgaaattctaatgcatatctgttgcagaagttcagagcatttgtttgatcggattatgaacattgttttaatcatgaaatatatacttgaagtgatcagaaagagctgaaattacagtgaagtatagctgacaggatggtaatggatactcaccggatgcatttcccatatgcttggtatcgcgaaaaccgacagtcacagcaatgcagaggaccatgagcagccagttgatctcagggatgtaaatctggccatggatattctcagatgtgtgcaccactttcactcttgggaagcaactgagtgactggctctggttgatgatggagaatgttccactgatgattgcttggcttccgacgaccgatgccaaaattgccagcacaagcacaggccaccttacactctctgcattttgcataagccaaaagaaatgctgtaacttcagtgtgtctagataggtgcagttcttcagaaccatcaactgctacacatgttcagttcagaagaatagtgatgatgtttcagtacctggaaccgatatatagtaaccaatttggtaggttgagttcagagtgtgatgtttcgataaatacgcagcttggcccatgtatcccaaaatcagtgcagggtatactaatgtagtgaaagcaagctgcaaaaatcaaggttcagagttgtgatttacagaaacaatgaaggaatgaaaccatggaacacatggactgaaaattcaggacaagcgaattacctggattgcactgtaggagaaatggccaagatcagcaaacattgcttcagatcctgcaatgccaaacatttcagagttgctaacttcatccaataatccatttccttacaattttagaacttacaaagggaaaggatgaactttatctcagcatacgcatacttcactttacctgtcatgcagagcaaaattccccccagggacatccacccagacttcttagtcttcctcaagaatttgagcatgtaatagggattaagagcgcgataaacttgagggttccagtggatgatattgtacaagccaagcatgctcatgcaaatcaaccaggctaggactattggtgcaaagagaaatccgacacgatgggtaccgtaatgctggagtgcaaacaggaacactaatatgacacatgttatcggaatgacggcatctgcacagaaaaacgcataaatgagcatggcaaggaagctaaaaaatgtgaaggttacaggtgatgtagaattaatgtattagtacttttgcatttaaagcttccaccttactctctctcagattcagtttatgaaaaaaattcctaatccaatcatgatcattatcagcagtttgtatagtttggggctgttcttacagtttttcattatatcaaccaacaaagatctacccaaagctgaacagtcttgctaggctgtttatatcattaggaagtactacatgaactagctacagctagagtactactcataaaggtgttctgaaacaattgcacttcagaattcagagttgagactttacattcatgctgatccctggacaaggagagttcaagccctgaaaccgctgagaatactgcaaacagacaaatcaaatagcagagagccaaatgtaagcaactcttttctccaaacaaggtacgcaattttcgaagaacagtaaccaaagggggaaaaaaaagctcagtctgaagattaccagatatcgcgggcgtgaggacgccatccccgatgaccatacaggttccaatcatcaccatgatcagcagagcagtctgcagagtcttgtgcttctcaagccactccttgattcgagacctgttagccacttcaggcgggtactccagcttgtacgtggagagctcctcgtcggcgacctgcctgtttgggaggaggctcacattggcgtgcctgcagatcagagagtagagcgcaaacgtccctcctgccaaatccaaatcgcaacaacaacacataagctcaccaagaatcttctgcagactgcagagaggcagagttcagaatcttgcaggcagaaacaaaacagcagcagcttgagagaggttaccttcgccgttgtcgtcggcgcggaggacgatggagacgtacttgatgagggggatgagggtgagggtccagaagacgaaggagaggacgccgaagatctcctcgttggactccgagtgggtgatgtcctccgcgaaggtgctcttgtacacgtacaggggcgagatgctcaggtcgccgtacaccaccccgaggctctggtacgccagcagcagcgtcgtccgccatggctctctctgcagcaacagcaaaggtcactctgcctcagtcacttctgcattggttcgagcttagctgccggattgatatcacctaccacggcttaagctggaaaaagctctctcacctttcgaggcgccatgcctctcccgaactcaggatccattgctcagcaagaaactgatcctcctgctccaagaaaagatgaattagatacaacacactgtcataacttgtatagattctgcaggccaagaacaagattgaacacagatagaggacgcacctgggaacaagcaagagctgacaatgtgaattgcagtagtactaggtaatcaatcgagagaatcagctctaagaaggggaaagggcgaggagagctgggaaaagcaaggatgcaaatatatccaaggtgaaaagttgcagatggagcccctcaagatcactaattggaatgaatgcgaggtgatggaatggaaggaagcgatatagacacgtgtggtggagcagtatcacacttacaatacaaatcctattaatcaactactagtgctcactcctctacctaagcttcaaagagataatcacactaaacttacaaagttgggataacaccaagttgcatcatataaaatcaaatcgatggatggcaaagtgcagcaggtaggggatttaacgagagctttttgggcatatgaccgaatggaacagccaaggcaggccatgtgggtccaaggacaaaagcatgtgaactcacattctcgcatcacagcacaggaagtgccgactcaatgagcttttgctttcagaatgtaatgcagaccagggaagcctcccctagatcatcactattgcgttaatggtggaattcgcactccaacctcttcttcttcttgcctcaaaccaatgcaaaaagatccaaacctttttggtcagttcagagtttggcagggaggagaggataggtccaaatcgaaaagaatagatgataacggatcaccaattctttttgaaagatggactcctaccacttcttatgtctcgagaaaaatgtgatcttactcatgccgaaccttatgtaaacttgtgaaagcgaaagaattgtttacattctaatgcagtgactggtccaaaagtggactcctatttatttttacagagaacagttcttgattaattatagctgcaaagatctcatatttgcttgctgaaagggcaagaacaaggagctagtaacagcacaaaacccaagagatcgtattcccatttttggcttctctactatacacattggtgtgcaagaaacttctgaagaaatcaaagaagcagcagaagacagaaaagcattcccctagttctgcacccaacccatgtctgcatctcaaatgccaaacgagctactactaatcttttaggacgacgaccagaagaggacttgaagaatcgacaaaatatgactctgatgcaacggagaacattaatacagccgtgccggccacacaagtttgagctgtttctttctttctacaatcaaataaagaaaagatggaaagaatcaagcaagtaccaagaacacatggccatctcctcgagcatcccgcgatgtgccatcgatgatccgttccacgccacatggatatgaataaaagcgaagcgaatcgtatccggcactcccaggcttggtaatattttttttagaggagattgtatgctaaattttttttatatattaaaaaaaccattgcagatatacgtaggttacaaaataccatcatactatatgaaaataaccgaatgacatctgagttctagacccacatgccaatgacacgtatcatggtatctttcaactctttgaattttgtacggatatataaacattaacatttgtaatatactgtgaatatacacaagagtaattttcataaaattataaatatttgatcaaattatcacaaaactacagattttatcagaaaactacatatttaagactaagtatcacaaaactacatatttaacaataaaattatcacataattacatatttcggggtttaaatccttagcactaatattatatttgaattataaacatccgagttttgtctaaattgatgctaaatttgtatttttatgataattttgttagtaaatttatagttttacaacactcaaccttaaatctgtagttctataataaagttagtattaaatctgtagttttatgatatattatcttaaaattgtagttatgtgataatttaacaaaagtatttgtagttttatgaaacttaatataaatataatggtatattaacacttttacatgataggatactataagactgagtttggactggccaattagaaacacctctataccatgaaaacgtacgactcattaatacatgattaattaattaattattagcttaaaaaaattttaaaaaaatgattaatatatagaattattttaaagtaatctttatatagaatttattttttataaaatcatattgtttagtagaaaacaaggtgtaaaatttgagaaaaagggtagcatcagtttcattcaaaggacaaggactatccgatccactggtccaatttagttagcagaattaagatgagggatgctgttgggtagtcctccagaaaccagagcgttaacatcagttgcatcgccgcgccgtatcggaccaatcctttccatttccattgtttctatcaacgtggagtgcctacctgctcgtctcaaagagatcgagaggcagcacatggctccgtctgcatgttgccgttgccgccggctgcatcgcaacgcgtgcctccaacgataacgacaatgtaaataacgtttctctcaagactgaaacgaatcctacagcttttggtccccgaaaactcgccaggttttcctgtgcctctcgtccctcgtcgacggtaaggaccggattggcaaaatcgcaatcccggacatgaatgaaagcagtactagcttcattgatgacaacaaccttgtcgtatattttcctctctgctcttcatctcacatggctgcacagaagaaggaacatgcatcgatgcgtgatcagaatgacactttcggcgctatatgcatgctcgatttgcagcatgctgctatccacagtcacacacagcatgggccagtctctaaggtccacagcgatcgtactacgcgtgttggggttggtagctcgggttgtggttttggtttggccgaccacgtgtggagatgcatgcgagtgtgtgtggttagggtgggcatttggtctaaccgaaaatttcggtctcggttttcggtctttttggtttttgaaaagtgaagaccgaatttcagcgtaaaaatgtcaggaccgacaaattcgatctcggtctcggtcctcctgaccaaaattcaacaacattttcatatatgcaaagaaataatgaaaattttaacacaaaaaccacacaaaagttcgtgtgcgcttatgagtaaagaattttattatgttgcatgactagaagaagtagggatatgaaaaaaagagtttaatcctattaaacatagtggattgtaggttgcatttagacattttttaggcaaaattggttatatagcatcgaaagttcacgtttttggttttttagcaccttaagttaccggttcactttaatagcacccaaagttcaccatgttcccatttttaacacttacgtcaattctcgatagttttccgtccgtcttgatctagccacacacgatatgacgtttgtacccctcacaagtacaagtataatgcatattaatgaggagtagaaatgtcatatcatgtgtgtggctggatcaataacgattaagacggacgaaaaaattgacggaagtgctaaaaatgggagcagggtgaactttggatgctattaaagtgaaccggtaactttcagtgctataaaaccaaaaacgtgaactttcgatgctatataaccaattttgccttttttcattattcggtctattcgattaaccaagaagactaaccgaattgactgaacaaaattcggtatttcactgcctaagatcgaattgatgaccgaatttctcggtctcgatcttttcggttcggtctttttctgtccacccctatgtgtcgtgtgtgtccatccatgtgcatgtgaagctttggaaacttgccctgatcctagaggacaagtgatgctcacgtgtcgttgctaacctgcgtactagtggaatatcatttttgtgtttcttctgtacagtgtacagttgggaatcgaccagattaggggtcaaatccgttcaccagcttggctatactttgctgtgtttctgcacgggtgaaattggtagcgtttgttcgtgttaccacctccatgttcagctaccgttgggtcgtctactgcacttaacgaagatgtaatctcgttcaagacatttgatggatcctttaatttccaacttgtcactcacacactcatcacgcatgattatgttcactcaatcattaggcagcctccatatatgacactagtttctacgtctctagtacgatccattgacgtgattgtactagaaatgctcgagtccaagatgaaaaaatgtcttctcgaagatgccaatctgaataaattgtaaggtacgtactaacctccatttgtctacgtctctacgatccatcgacgtccatcaacatattgcactagaaatgctcgagtccactatgaacgcatggctttctaaagatgccaatctgaacgactgtacagtactagctagtattccttccattttatattataagattttttatcattacccatatttatatatatgttaatagattcattaacatatatatatatatatatatgaatgtgggcaatgctagaaagtcttatgatatgaaatagaggaagtagcttttttttttcttttctgaagatgcacgcaacctgccaccggttgctctgcaccaaacctacaaatactactacctccttcccaaattagttgacgttctagattttttggtactacatgctaagatttggagtaaaatattataatgcctttatcaaatttttcatgaacgcacaaaaagttcacgcgtcaatatactagaagaaagcagagttttggttacacaacataaacggctagaaagccattgccaggggacgaggaagaaaaaaccggaaaagaattgtttaaggactagttaaagaggataaaaactcctagagcaagagagggcggagccccactaaactcccagcaagtccccaaaagcagcaatgccagcagatgatcacaaacggtcttccggaaagatggacttcagctccactgaaaccgaagagaacgagtgatcgaaaactataatacaaataatgcatggttgagcatataagcataattgagggtagaataagaataaatttaaataagatatgattgacttaaaaatgataactattatgagataaaatttaaatggtaaaaagacaactaatttagaacgaaaacgaaaggagtacttctgaagcctgcatgtgattctcaggctggcttatcatttgcgatagctgtggcatattaggctgcaacggtacaacggtacaacctagccgccgctctgctgctgctcaaaagccaccataggtcaaggaaaaaaagactgtcctaatttttttttaaatgttcattgtgattcttagaaagaattgacagatagtctaacttatgagaatatgaataaactagaaaattcagtttttgactaatagtttatttttctaaattctataactatattgtcttaaaatctagataaaaaagttagactatttcataaagtctttgattatgagaaaagttgtaatcggtagaaactctctcggacaggtccagtatagcggctgctgctgcaactctaagataaaagctttcttaatttggtcacatatggcttaatcagtgatagttacttcgttagattggttaggtcgatgtcagttgacaagtacaaatcaaacatgtggtcactggtcactacgtatgtgtacaattcgcggtgatttggttatgtaactgtagattgtataaggcccaaacaaaggcccagttaataattgggctctctagttcaagggccacgcgaaggcagacacctgctgaagtctgattccaaggtccaatcaaagcttaagaggatactaggcacagaaaaaaaagttctactcccgttttttaatagatgacaccgttgactttttatcacatgtttaaccattcgtcttattcaaaaaatttacgtaattataatttattttgttatgggttgttttatcactcatagtactttaagtgtgatttatatcttatacatttacataaattttttaaataagacgaatggtcaaacatgtgagaaaaaatcaatggcgtcatttattaaaaaacggaggtagtatcatttttatttctttacctgaaagacgcactgtacactcacatatcaattacgtatctaggatttttaatatgggtggttcaacttatataatatttttaaataccctaaatataacaaggttagagatataaattgatcaaatgtgcatcataacatattaataagggattttttttctttttccaaaagtttcttctcacatatttatatacgtgtattgggcagttgggctagggtttttttcccggaaccaccagtaccactcctgatccgcctatgatacacatacgtgagtgcgagtgcatttcttaacatatgcttaaaggaatagaggccttgacctcatttaaatcctatagaaaagcataatattcatgtgtattaggattttaacaatagtgataacagctgtacacccatgaatctactactcgcatgctttcgtaagaagtttttttcccccttaaatgtgctgagacagaattttgaattaaaaaggtcaaaggtaaaggtacaaaatcccctcgaactggaagttgaaaggtgccatatccttcaccgaaagtgtaatttgacaaggtgatgaaggattttatgatggtgatggacgattttgacgtaggataggcattccacggattgacaaaacacagaaacagcttaaacgaccacaaaaatatccacacccgggtccacctgtcagttggaaagaaaccccagttctgtccgtggatgtcagagagacaaatcctcggagtcggatgacacgtcggtgtcgcggccggagaagaggtccatgcagagctcgccgtagaagcggccgacgagctggacgaacaccggcgacctgagcttctcccagcagcacaggagctcctcgacgtccatgaggtccctcaccttcctctcctccaccagcatctccatcagatgcttctcgaagcttctgcacgcctcctccacgccgtcgtcgccaccgctgctcggcttcgtcgacgccgccgcggcctcgccgagctgggcctgcagcgccagcacccgagcggccgtcgtcgacgcgggcgtgtcgagcgacggcgacggcgcgcgcaggccgccgccgccgctgtcgtcgtcagtggacgacgatgccggcggccggtcagcggcggcgacgtcgttgcggtcggcgtcggagcgcatggacatgagtggccagaacaccgcgcggacggagctgaagctgcccgccgcgcggcggcgccggcgccggctgctgttcatcttgcccacggcgcggcggagcagcgcccgcgggcgcctcttgaagagcgcgagcatcccaccgcatggattgcactgcaagcaacacgacggcgacggcatcgatcgatcgatcaaccgcagcgcatgcgacgcaatgatacgacgccactaacgacacagctcgatcgtgagctttacgccatatctcttcttcttcttcttgttcttgggcgttgcatgcagtagattatcaaggactagtgggctagccaccaattgtgcattcgcaatgtgcgtttgttggttgctggttttgagatcgatttggttgttgatttgattgaatcggttgagttttatgatgaggcgaatgcatagtggatttgcgggtggaggtggagttcacgtagaggcagagcaggcgagcgacagagtgggaggacacgatgaaatgagttcatagctagcacagacggccaaagcaaagcaaattaaaatgcaaaattagacagatcgagtacgtgcatatgcagtatataccaatttaaaacatttaaccagcaggagccatgctgtatatgtgacaaatctaaatgcaaaattttgcgttgaatgttatttgtcgttaggggagtttaaaacgacctgatgatcgatcaataattgatcaacttacatatctatgttagctagcaagctgaacggattgaacggattgtaagaggcttccatgtagcgtgaaagctgtctcgtttatatttgcctattttttttctctagctagctaactacagcttgagaatttgtatatctgtactttgttcgaagcatcatagtttttgcagactatttaaaaaactattagctcgttattaccatcctaaacgtcctctcttctgtgtactctaaaagttaaaaaaaatgccaaagtgaaccccacatttaaatgtgtggcagacagttttcggcatttgaaatgttccgtcataggaaatgttcaccgtaggcccaatggcccataagtgcggctcgtcattcggaactgatgaattggactggtctgaataaagcagacctggtccagggctaagtaggccttggagatgtcttatgcaggaaaaagtctactgtggctccctcaaattaggtaggatttgactggtatacctccataaaaaaaaaccgagtgtatcgctcatctcaactattaaaatcaatataaaataattggggcctagctatccatcgcgccacagatttttgggtccaaatcacacagattttagatagttggattaggctcatttgatcacttgattagaagagtttatatatgtatcaacatatattaattatatatattgcatatattttatttattagatctttacttcgcaaaaaaaatatcaccaactcatctactaaaagttactgtgtaattacactatagttacagtgtaactacactatagttacactgtaactatagtatacttacagtgtaactatactgtaactatagtgtagttacagtgtaaatatagtgtaattacagtgcacttacatatcatatcaactgaacttacaaatgtaattttagttatataggactgtaattttatattttagtttcaaatgtgaatacagtataattatatgtaattacattgtaatttgcacgtaactgtacgcttctcgtgctcagtggaggtcacgggatttctctcatccgtatctaagtagagttaacatttaatcgcttttgttgtatagtaaaaacataaaaagatacgtgcaagacattactgggtcacatacatgcactgcttccccgtacgtatgtatgtatcacttacatgcatgtcacgaaccgctgccaccaacgaggatatcacgtacgaacggcgcgctgcaccgttagaaaaatcgacaaatattaagaaaaaaatttgacgacaaatttctagcaaaaccaaataattgttatctattttaacagtggtttttactaacgtgactcgttaacctactctaatagccttaaaaaaaatagggacaagctcacacggcccaggttccatggaacataagaaaaggtgggtcaatttgttgcggaggcggcgtgaaaagttgaccttgcgggcggcggatggacagcacacagcggcgcgtaataatactgtccttggcagcatcacttagcatgggtcgccaacgaacgacgtgattgtttcggccatagggtcgagcatgatcgcgtcgtactatacgaaccggtggtaaaacagccgtagtacgtacacatactagcgcatcatcggtggccggatgcaagtcggcactagctacttattgctctcgaactcccccaaatcctctctcgaccgccttcattcctccaatcctccgtgcttttgttctctagactcgaatgatcgagatccatatgtgatgtgtgccgttgcgcccactgcatgcagcagaagccccatcatggcacggccggccgatcgatcaagtcatcaaacgccgtagagccggcccgtagagtagaaatcactgtgcactaggtgacactgaatatatatacatgcccagtgcgcgcgttggccaacctcctttctatggcagtgaccagatcggtgcatgcgtcgacgtcgttgcctgcccactgcccaagtctcgcccaaggacaccggaaaaagcccacatctccggccactcgcgagtcgcgatcgagcatcacatgcccacgacaccggagaatatatattatttcctcgcgcgacgacgcagacggctcgtacgtgcggagtaaacgaggccgatcgagtcgatcgtctccgcgcgcggacgcctgaagcggcgggcggtttgcatggcgtgcgcgcggttgcaatgcacacacggcttcgatcgatcggcggatcggcgcatgcatgcatgcggaaagcggcagattttaaagccgagaacgcggtcgggcacccaactgtccgcctaaaactcgctccatcgatccatccatcgcccggtccccgtcgtctcggaatcatgcatgcatgcatgcttgaatgaataatttgatatacgcatgcgtacgcacgatatttcctgaccagccaattaaccagcacacgtatatcactcgacacgacacgtatagatacgttcctacacacatacactcgtatacgcgtgtactgtgtgtacacatgtacacagaagattgatatatgtatgtagtcacatgtgcatggctggacagacagtgttcttcttcggccgaccgtcgttggacagggaattcaatgtcgacattaactcatggccctgcacatgtactattgcatcgtctgtccacaaatttactcctaactccatcgatcagcacatcatcaccactgtacaagtaccatgtagtacgagaaatgcaccacacgccgccgcaaaggtagactctgttttcctttttaagtcgccttcaggaacccaggtcttgcattgttacacatccaatcgatcaatccagcagaaatcgattgaattactactgcttattaagattcaagtagtaacagtgctagctggatttctgctacgtattactaatcgatcaaaccagcagaaagctagcactacgtagtgctatagctggtggtgtgtgtcagcaagataatatatgcatgtaggagagtataagattatccgctgcatgattaccaccaatgatagataaaccccggccatgactgaaagtcttaaactttactttggcatataaacttgtcatccatccggccgctgggtacacacactatagttatatacactagaaaggataatgatgatggcgttcgagtaagatttgcaaagctacaatcatggcacgggtctttcaactatacctactccaacaattatttatctcttcctacctaacgggccgcgcccgaacactatcaatccatctcaattattcattatctacttgcatacctccaaactctgcatctgtactctgtcgctccgatagaggaatttagggtgctgtttttgtttctactagttccccatgctactactatgagttttgatctcatcgatcatagatagctaggtatcgaagctaactcgctagggcggtggttgcttgctcccggcaacttgtaatcgacaattttggcatggaatggtggcaccgcacgaattgaactaaactttggtacgagcagcactgatccgcgcttgtccagtctcttgaaataagctcgccgtgtccccgcaaccactggcagaatgatccccccgtgaggtgagcctcgtcgtcgtcgccccggcaaaacgcgcagcgaaatcatcagcgcgatcatatgccttcctgctcatcctgctcaggatgcgatcgagaaattaagaacggacgattcctctatctgctaatcttggctctcgcaaaactatcatctcttcaggcttcagcagaagaatttagaagacacatgtatacagattatatattcgagaatcgtgaattttatagtacgtgaactgttcgctgcataggagctcctatagtactgtagctgttttactgatccattgcagacaagcgtgggtgagcagtagttctagttcgtcactggagctagctagctgctagtctgcagtaaaaaaaatgtctaccggttgctgtgcgtgcacacatgtctgaacatctgatgagcagttcaatactggtgcattgtagacatcgagaacaacagcctctgtaggttttgtgtaaaaaaaatgcaggttcgaaataatctgttactgttgcagtacatgttctggaatcactacagtgatgaaaaaaaagatgcatttgtctcttccaccgcatgatcaacctcagtatagctgattgtttatgtggatttttcggggatcaccccgtgccaaggtataaaaaacagacggaaatcactcggttttcgtatagaaattgaggtttcgggccagctcaagatcacaaactgttcagtaaaccgatcaagttccaaaataaattagagttttttaagtcggtagtcgatgggtttcaaacgattttcgtaaaacccataaaaatcctcctagctagggcatttttttacgacagtttggttttgtgaacctttcccgtactaatttagagtaccaatttataattgtacagccgtacaggtgacatatccgttcaggggtgggggcaggcctagggcaaggcatacatccaaaaacttgcttaaattttattgattcactatgtaattttttttcagaaaactaatactccattagtcgagctttatcttagctctagtcttatgtaatttttggcttcgcccctgtacccgttggatagcgagacattcacgatgtcttcattaattttaagatatgacggtatattttttttggaggtgtttataaagatagagtgtatgtgtatacgtctatagagttaagcatacacgtgttgtgagcgctttgtgtttgtattatattttttttaaaagaaagggtggtatactgtttttgagagttcaaatacgttctgaaaaaccgaatgatagtacatttgtagttggatttttctcctgcgtacatgcatgttgtcttctgtaagatggaagcaagctacaaatcaaatgcaactgtagagtccatttgggctgcacctgcactacgtggtctctaatacaaccgtaagccaattgcattaattaagttgcccccacatgaggatcaaagcaaatcacttttgatttcaatacagtgattcgtggtagaccaaattttgaccttttgaaatgttcatgtccccttccaaaccctccatggaccatatcatagctctacctagcagctgcctctggaaatgacttggttcacactccataagcaccagcatgcagttgggctctcctgctgcagctcatgtgccaaatcgtcctggactcgaggtttagctgcagcgatggccattagagacaatgagaaacgcctgttacggcaggcttgtctcacaatgccactagcgaaaagctgaatcaccatcttggtctgcaactctgcatcctttcccttgccgtcagagagtcccccacagcttttacgcacacttcctccatttcaaacattttgactttgtgccatgcgtgttgcatgcaatctactaataaggatgaatctctgtcaaagtaaaattggtgtttcatcggtggacaaagcgtcgacaaacacttgaatttctacatttcttattttgctctggagagcagtctgaactctgaactctctgtatcatgcaccaacatatctttttcgttccaacaatttacaagcgtattgattatgattcagaagcacaaatataagagagaatttgtatagtatgtcagattcttgcaagatgccgctgccgcttttccaccgcaacatctctttgctgccactcgcggcaaacttttccgtaataaaaagtggggtgcaacctcgctgcacgcactgcagctcagctcacccccacagtccacgaccacactgcctcactgcagcagcagcagctacgatgccattgctgagctcgtggctgttccacaagctgcggcggaggagaagcgcggcgagaggagaacccgacgtcgtcgaagcggcgagcaagaagcagcaacctcccatggcggcggcggcggcagcggcgccgtgctcgccgtcgccgaacagggcgtcgtactacttcgcgagcagagaacgctgtctccctccggctcgcgccgccacggacaaccacaagctccgggacacccggttcccgcggagcccgcagccgaacgacgacatcgtgttcgacgtcgtcgccgtctcggcgtcgccggcgcgcggccagttcgacgggatgaaggcgatgccggagctcaagctgcggcccatcctcaccaagcgcgccaccgccaagaacgacggcgacgaaggtgacgcgctggacagcggcacgagcgcggccgcgtcgccgacgtcaagggtgcggcggttcgtccaccacgcgaagccgagcagcgggaggcggaaggggcgggtggcggcgctgccggccgacgctaccagccggaggcggcggcggcggcggcggtgccggtggctgtacgagagcctggtggtggtgaaggagtcggccgacccggaggaggacttcctggagagcatggcggagatgatcgccgcgaacgacgtgcgctcgccgcgggacctcgaggagcttctcgcttgctacctcgccctcaacgccgccgagcaccaccgcgccatcgtcggcgcgttccgccgcgcgtggctgcacgccgccgccgccacggcggcgccgccatcacctagcccgatcaagtgatcgagattattactacgtacgtaccagcaaaacgcaagattaattgctacgtgccctgtacagagtgaccatgcatgtgatgatcgaattcggtatgattaagatgatagtcgttgcacaaatcgatcgcaagatggtttgataaaaaatgtttgattcgtttgctcgatcgatcgtgctatgcttcgccgtgatttcgctgcggatgcaaaggtgaaggatggatgagcgcacgcgcgtgtgtcacgggggcatccatcgcgctttatttttcagaagggaatcgacgcatgctgtctttacagattggagtaggcctattcgcgtcagagtttttctctcctctcctctggaaaggctcatcatttatttttttttaagtatgagtattattttttgtttactcgtactaaatgactaccgtacgcataggatcatggcacaaatttctgtgtacttaccgatagtcacgtctactctcgctatctcacgggccattttctgcttaagtcaaaaattcttgcacgtaggagtaggagtagacttttttattattattattttggctgttaaacatctgagaggtgaaccaaacagtaatccaccaagaatccaacaggacaaacatcgttgtcaaccttagcgtcagtccttcagtaatcgtgcttcactacacacctcacctcacttcactgccactagaatgcagagcagcagcagaggccagaggcgcactgtgacataccactgttcaatttcagttttcaccattgctacactccattccacaagggtgcaacgattctgggcagggggccagggtatgcagaaataggctgaagaaacagacgcccagaaaaacctccctgccatgtaaaagattgatctgtcagttttccagggcacaggcctaactgcatggatgatggatgtacctacccgtgggctcctcggagctgaggtgagcccagttgcagaaaggagaaaagatggatcctcctgccaatgggaccctgcctttcttgtgcccagtggatgcaatcaccaagaatgtgttcttgttgtttctttgggacatccacttgtcaaaattcaatagatattgagagcttttctttctttttcgctgaaaggcaatcgaatgtactcaatggattcttgggagaaatttatgagccaaaagtgtctgtaacctaaagtttcaagaattaaattcttctgctagtgcggtgcatagtacaaacgtgctataataagttgttcagttgaaagttgcaatcaatcggcatctcagacgatcgacgccgaggcaatgctgcattgcttacgtgggtggagaaagagaaaggcaggcagggcaatgtgtgtttcagtaatcagtatggtcatggatgcgagaactgcagttgggaagagaccaacagcaacgaacaaaggtttcgccatctgatttttcagagccccgtcagattcctcgcagtcctgcgcagccactcgtgatgatcgtgaagacgtgaaaccaacataggcatgggcgaactggggatgaacaaaggtcaagtactctgcaactctttcgtcagaaattcagaatacacaagcgtttgagatgttccattgaggtgctgttcacctttaagaaatgtattattaaaatttccattgaatgagttagaccggtgaactatgcagaacaaaacactgatataattatatatgtcccttttaaatatttattttaaaaatctgagtagatttttgtatcaggagaggcaagtaggtaagtggtaacgaggtagagtgggctgtacagcgaatcgttcatgtcgtaaacaatatgggcctttgtttcgttctcatataataaggctgcgttcgtttgtatgatataggatgagaaaacacctcgttttccgcgcgcacacttcccaaactactaaacggtgtgttttttgcaaaaaaattctataggaaagttgctttaaaaagtcatattaatctatttttgaaatttaaaatagttaatactcaattaatcatgcgcaaatggctcacctcgttttgcgtatctttctaatctccccaatctactcctcaaacacaccctaagtccactttgagagcgtttggcagggccagctgcagctacggttgcacatagttagtgtcagagcgtggcattaaagcaactgccgaatatgccctttgactctcttaaaatatagatccaatttaattcgtatccttcaatcgtaatactagatatttaaatccccccactatcaaaattaaagagagttattttgcaccgatttaatagttagggagttaagatatttggtattacggttgagggatacgaatcatattataccaataatgagggagtcaagtggacttatttattttctcacaaagtctccatgagtttgcaaggcccataacttaacccaacggtggcccatactcattttaccccaaaaccatgtttgctctcacttcgcttagggggtgtttggatccaatggtaaatttttttggcgtgttacatcggatatacgtatacgtatttaaagtattaaacacaatctaataacaaaacaaattacaaaatccgcctacaaaccgcgagacaaatttattaagcctaattaatcagtcattaacaaatgtttactgtagcatcacattatcaaatcatggagcaattaggcttaaaagattaatctcgtaatttacacgcaatctgtgaaattagttattttttagactatattaatacttcatgcaagtgttcaaacgttcgatgtgatagggtgaaaaattttgaggtgggatctaaacagggtgttaagtgcaatgcaaacctcaaggtcttttatctactaagcaaaaaaatgaaaatccaaaccaaatgcagcccaactggggacttttatctaaactacaccctcgtaggtgcattaggcccattagcaaagttcagtcccaaccttagtacccgaaaacaaagaagagtttttaacgtacagggcataaacttaagaatattccccgaaatatggtcgatgcacaaaggtagactactgtgcacccacgagtgtagttggttggttcatggttgggctgcctggcacgtcacgccccaatgcgtccccggatgctgcgactgcgatgcccgtcgctttcagttcgcgtgcccgcttcacgtatccttccgtaatcgtaatccgcccacctgatcgctgatagcgcgattagcaatagattttacgattgcaactgcgactgatctctgacctgaaacgctacggtcgcgcaagtcacgcgacgtgtgtgttgcttacacatcgaccaaacaaataaaatcagtgcttagattgcattcgacagcggtagatttctcttttttttttctctcgtacgtaagtttctcgaaatgctatgcgctttctaaaagtttttgttacagaacaattacttaaaaagtaaatattaaactattttaaagtttaattaatcaatgcgctaattacttatcttgttatagctgacgacgacattctgatgtgtcgtgttggcaacatccatgtcgacaccaataggagggttctctggactctgctgccacgtgtacttataaaattgtcccctcgagaaactattatttttcgtcgtcaaaacacataatcttgtgactggataaagcagcattatggtacggtcaatggcaggtgggtcccagaagagtgcagagaacactgacatgtgggccccacaatttcgccgcatataaacggcagccgtaacgagctcggaaatcgcctgcacagctgtttcaacgacggctgctcggaattcggagggagggaggaaggaatcggagtgttcggtaagcttcgcgaagcgggatggaggcgccgcgcctccgcctcccgttcctcctactggtggccctcgtcgtctcgccgccggcggtcgccgcggcggcgagccgaatgcggatcgagcccctccccaccgccgcgctgcgccgcctctacgacacctccaactacggcaagctgcagctcaacaacggcctcgccctcaccccgcagatggggtaagttcaatcaatcggcccaatgcttcgcctcttcgcttcgttccccttccgctgctgctttgtccagcgcctgttgcgtgcgcgtgtaattcatcgtcgttcactgcgttgagtgcgtgatttattagtgcctgtggttctgtggcgcagatggaacagctggaatttcttcgcctgcaacatcaacgagacggtcatccgcgacacaggttcagccgcgggatccccttaattttcatggttaaatctgcaattctgcaccgcagttttttttttcctcccctgatatggtggaagtccttgtctgaactggaaattggaggatacatatttccttaattagtgttgtatcttccacacttccactgctcagagtgcaatgatagaatagaacactgttgaggttggatattggaatggaattgttactacccactgttcaagtgacatgttctcatgtcgtgtttggttataacaattgacaagttcctaatgcgttttcggttgttcagacttaagagtagagtttggttagccatgtacttctaatgaaagttttcttctatctgatgaaacagctgacgcactagtctcgacggggctggctgatttgggctacaactatgtaaatatcggtacattacttggctcaagagttatatattactggctgaagcaagtatgttgttatcctctaatttacttgctgttcattgccttttcagatgattgttggtccaatgtaaaaagaggaaaaaaggtaatgcatttcatttgctaatttaggctgtgatttctccaattactttgttcctaaatatgtcaatgctttggtcttttgataattttaacgagcttggacaggacgtcactcagaacagtcttctttggttgtactgatacaaatacaaatgcattactgaccatataaatacatgcattacaagtttacctctttagtttttaatacattgtttcctgtgcatgtaggatcaattgctacctgacccaaaaactttcccttctggcatcaaagatcttgcggactatgtgcatgggaaaggtctaaagcttggtatctactctgatgctgggtgagtaagcagccctctatagatggtttttgttgttaatacaccatgaagaataatattccaaataactaaaaattataacaagctaaagctttcaggatttttacatgtcaagttcgacctggatcgctccatcatgaaaaggacgatgctgcaatatttgcttcatgggtatgagctagaagcaataaattattgatttgaaatactacacagtatgaacatgttaagatttaagagcatattctatggaaattgatttctccagggtgttgattacctgaagtatgacaactgctacaatttgggaataaagcccaaggacaggtaaactaaatgtcttctcattgtgtaagcctctttcatgagtacagttatgtgaactgaatataacgcattaaaattcgtttcatggtgtcatattcttaggtatcctccaatgcgtgatgctttaaattcaactggacgccaaatattctactctctatgtgaatggtatgcacctttatcatacgagagaagctaggggttgtatatcatgttggtttagatgtatatgatgtgctattatactattttttctcttaggggccaggatgatccagccttatgggctggcaaagttggtaacagttggcgcacaacagatgacatacaggatacatggaaaaggtgattcatgtatttcgggttaagtgtttggggttgggtgaaacctatctatacattgatgtgaagctgacttgtgatcttctgtttgaaaacaagcatgactgatattgctgataagaataacaagtgggcatcatatgctggacccggtggatggaatggtaactgtgtagcaaagagcacaagttttccaccagttttcatactgcaagagaacactcgtactatcattcaactgacttttttttatcagacccggatatgctggaagtcgggaatggtggcatgacctttgcagagtatcgtgcacattttagcatctgggcacttatgaaggcaagtactcattgggtgcattctgtaatcactaggatggcacctatattccagtatgttgcatttggtcttcatgactccaacttatttgtgctgttactggatcaagtagtgaaaagggtttctgaaaagaaaaaaaggagttagtttcttttcaagtgtttttccttgtccttatattttatgctacttgacgttaggggaatttcagtaccgttctgtggatagaagtgtagcgcaaatgatgtgatttaaaattatttggctcctgcattattatatttcaggcccctctcttaattggttgcgatgtcagaaacatgactaaagaaacaatggaaatattgagcaacaaagaagtaattcaagtaaatcaaggtattacactgaatcttttttgtttgcgctctctattatgttgacatgtgtaaacttcaagatagttttctattaaaccattctattatttctacaatgtcattgttctcaaagatcatgaatggcattaaaactttgaaagcgaatttgatttcagcagcaaaactttcatcatgcactaagacaattagcatcatagttgctctttggaattcagttttctgcatatcatgtatattttttgaacaagatgcttgaaccaatggacctgagagctcgcaagtttcccttgctttgttccacctgaggacaggaaaaaactgtacagaactaattacgctacatattgtaaatatctgttttagagtagattattttattcgaacaaatttttttttctccttgtatatgctgttgtaataattaattaacacgttaaactgcactcattcgttttctgcagatcctcttggagttcaaggaagaagaattttaggtcaagggaaaaatggatgccaagaggtgatatacatgtccattagtaattatagtatgcaaatataattattactgtgtggtctgccctgatggtttacttccacagtcctttttttcttttccaaaattgcaagacactaactataacagttttgtgcatgagcaatttacacacacaatagtatagcaactgttttaatttgatattgaacagagcatgtttttgtaacatatttgatatttccccaacttgcctaactctagagtccatcgaaatttcatagggacggtagcagccaccccactagctggtgatgggttttcctatgacatccctttgagaatcctgttcagacagggccttgtatgctagttagaagctacttggggtagataatagacttgtagtgttcgggcattgttcagttggaactgcagttctgccatcttaatcatatactcatttgggccgtcggagcatgaataacgcatgcaaccacactaacagcttgagcttttagaatagattagctgctgtgtggaattaaactattacaaatgcatgtttgtgaagttcttcacatcagggcattccttttcactgatatatcatgtttgcaggtgtgggctggccccctctctggtaaccgtctggctgttgttttatggaaccgctgtgaggagtctgccaatattatagtaaaattgccatctgtaggccttgatggttcatctccctattctgttagagatctgtggaaggtaagttaaataatttccggtttaagtggttcaatttacctctgtttcccgttgaaacaagagaggagtggagaaaacaaaggggttaaaatggtgttgcttatcatattaaactatttgggggagagagaggagaaaaatggtcaccacatatatccttttcatccaaccaccaaaacgtgtagcaaattaacatcatagaataagcatgagcatagtgtagtatctactgacgcaacaaagacagatcaaagtttatcaagattccattgtcaaaaccttatcttgtcagcattttgtttattatatgttaactgcattctgaatctgcatttttgcagcatgaaactctatcagagaacgttgttggaacttttggggcgcaagttgacgtgcatgactgcaaaatgtatattttcactcccgccgtcaccgttgcatcaagttgatcatgaagagcatcatgcctgatgctttcctggaagcacccagtatctactcaaattagacctgatgaatcgtccaccattttggtcgaggcaacaggtctactgaaatttgctttgtggagaatgcagttttcccgtttctatggggaagttcgtgcaagcaaaccacgtaaggtttttcttgcaagcttgtggtgtaaatttattggtggcttgacgccgtttgctgtacaggatgcaaataaataatttattctgtccatccagcggctgtgaaaatgagatggtacataaactaaaaaaaaatgttttttaaacttagtttcaataaataaacaaataacatatcttgttcacctcactcgtagtggctatgaaaatagatagtgtagaaaatgtacggaagctaaggccctgtttagtttccatgcaaaaaaaaaaaaacttttcacattgtcatatcaaatgtttaaacacatgcatgaagtattaaatatagacaaaaaaaacactaattacacagattgtgtgtaaattgcgagacaaatattttaagcctaattacgtcatgattggataatgtagtgctacagtaaacatttgctaatgacgaattaattaggcttaataaattcgtctcgcagtttacaaacgaaatctataatttgtttttgtcattagactacaattaatactttaaatatgtgtccgtatatctgatgtgacatatcaaaacttttcatccctgaaaaagaggacctaaatgtgtccggctgattttgttttatcttaagggaattgtattctgctggcttttttttttaataatgcattaaaccggcctctgcagaacttcgccattctgtgcactgcttctttttctctgtttttcttctctgatttgggaaatgaagaagcaggcttttgttgtgttcaaagctggactgttaggtgacaaacttcagcatctgagagactccactggaaagaaatctcaagacgcattgaagaattcactgcaggatgtaatgcaagatggataatttacttccaccacattctgcctcttgtctagggatcagcctcatgcggatggagtagaagtgaggcacttataatcgctgtgccatattgacttgtatacaactatcggttcactagtcagtacactgtacaaagtaaaaggtatcagagaaaattatactccctcctcttttcttttttctttttatttttttttactttggtaagttcaaacatcaaacatttggtgaaggaggtagtacttcaacaaataccatgcaaagggtaaatatatcacgatgaagcacaaagaaacaataggtgcacctaaacactgtactccatcatttttcttctcttaatcttaaaaagttaaaacgacggatctacaaaggtggtagttctttttttgtgagcattttcgtattattttattttttaaacatttttttcgggttataaaagctaaaaagatgagctagttcttttacaattaaggctcctaccaggagttaacacttaaagacctaatgattgtatcactaaggattattggagtttcagacagctgaaagcatgctattacgattggaatagcatccaagctttgtacgatatcagacttctcctgaagcaagctagtaaagcatccttcatcttccaactctatgattaaatccattgcgagcaccagccttgagaggagggaagtcagcttcatctctcagttggtagagcccttctggcctacagatttattcacgacatgatgcaatttaattagaaaaaaaatgcaacagcacgactgtatcatgaaatgcaaaaagaacacgagatcgcaatgtaagaatcacgtacttgcttcctgtttcagcaggcgaagagctcacagtcacaggcgttgaaacagcggctactgcaggccactttctagcaggcagaggtgggaattcttcgcaaaacttttcgcagagaaaactagtacctaagataggttcgaaagatccaaactcaagaccttcgactagtgatgttttgattggagaagaagcctcagttgcaggtgaggatggctgagatgtattggattcttggagaccattgccaacacaatgaggaagctccacactagatgatgatgatgccgtcatttccctgttttgcacttctgatggatggagtgtccgtagttcccttgattcattgtttggtctgacaaggtcttcatcattaccaggtttttggctgtcaaccatgttcatgtttgtgcaaatattccattcctggcttgctggtgctctctcctgagcaaaacttccttcagctgtaactgtacttttgcttgagtgatcctgtttctttgatggtgtatgacttgtattttcaaatgtaataccgccattgcttgaacttgaacatcccatttcaggcgaactgcgccggcgaatgtagccaattgggttagttttaatcttgaacggccgatctggtaacatttctctctggcttcttccattataatagaatatgcgttccttgtaagtatgataattctgtaacaagtgaatagctaaattacatggatttattaagaatgcaccaatacatgatttataatttatactactatggaggttccgtgtgtagcctaaacaaaagctcatttccagctttccatgccaatattgaagcataaggaacaataaaataattagttgatctacacaacacaaaaacttttcaaagtttaaaaacatggagcatgcacaagaaataatacctccattccataatataagcatttctgcacgttttccaaaatgtatctagacatccttccatccagaactccagataaaatgcatagaaacgcttatatttggaacagagggagtagattatgtcccaagagtcctcaccattctgggaatgtatgtgccagttccacccttcccacggtttgttttttgacttgatgtcgcacgattatttgttgtggtataagaccaacaatatttatagtcaactgaattaactgcaggaaatgaaagctgtgcgaatgcattggataatacatctgttccagaaagcaatgatacattctgtgcatatggacaaacaagaatcgagtcaatttattgaaagcgaaactaattcgaaacagtggacaacaaaaagttaatgaacaaagctgcaaaggttcttacattgagagtatgcatgccagctccatgcgtcccaacaatatccactgtgttatggagcggagaaactggagatttctcagaatcagcgacaggagatggaggcaacgccaatctgttatttgttccagagggcaatgccacattctgctgacaaaccgcattcacttggacctcagtgcgtgatactgatttctgagaaatttctcttgtgctatgcgaacagtaaactcgagataggttccctctctgggtataagcagatgaaactaacaatggccttagagcccttccatcagtatttgagaagctgctctgggttggaatattgaaggagtcattgtttactgcgccagaaaaacttgcttcctgaatcaaccaatcaaacatggactccaggtggtactgaacttttcgaaggcattctaagtgcaaatccagatctcctgatagatccaacaaatttgatggtgaaaaatgagaaagtggcagtttttcttcatggagatcgctcctatttgtctcagctgggcaagaattggaaatatccaaagtatttatacgagtagagggagtcaatatttgtgactggttgttcgcataaatatgttgctccatagatgatctaccgaggggtaaatattcctctcttgcacagtcgtagtgtcgtttcatgttgttgcccttctcttgggaaaatggtgagtggctactgaaactgtctcctgagaccttgttgtaaaaacaactatctgaagtcctctgcagatcaggacttctattttcatcttcactcatatcagattcttttacgtctgatgaatcttcccaaagtgcatattcactttcaggatcaagtgacggttcgaatgaaccattattgccaacgtctgatctttttcctcttccatggctcttcaaggtgttcacaaaaaatccaaagatttcagtaggaataaggtcagtaggtaacatgagaatttgactcaggttttgtgcaccaaatgagaaagcacctcgtatgcggtaaaagcttcctgcagaaaataaacatagatgtacaaaacctatgagaaccatccttcaaagagatctcatgtatgtatgtagttagcaacatatgcctatttcacaagcacagtacctgttctacatgagtaagcacacatacaggaacgtggtggtggaatatagaaaggaaaacaacgcacagaataaagaaagataaaatgatgtagcctccaggttattctgacctttgctgacgcttctgccaagattattactggactttattgggtcaattatgtttagatacttcgggcgaaaattcatgttagatccatcagaatcctttttaagtacaataagtctatcacacgagccattagggccaaacagtaattcatcatgtatccctgaaggttcaactgtcacagggattataataattagaccagtaagtacatgcttggcgatcacttgacaaagcaaaagaatacctgagtatgactcaccagttaggttgggcaaggatgacaaaggaacaggaccatttaaacttatgcaatacttatcccagtcaaacttgctaaaatattccaaaaacttatacaagacctgtttgaacaaagaaggtaccatgcaaaaattttagtccctatgtaaattcccttactaaactgctgaaaagccattgggtgtttcatccaaaaaaaaaaagtttagtccacccatctcagaaagaggctgataaaaattgtgaaaaatgttatgctaccaagaagtacctctaagggactatgcagcgatttgtgaaatatattgaatatgtaaagaacaagaacttccaaggcataagtagatattagtccacgatgagctcccagtatgtggctttcatggtaacaccaagccttgattagcataatgctcctcttgaacagatggtcgttcccaacttcatggtcaacctgaagaaggaatatatactcaactttgttatcaattttgcacgctatatttgttgaaattactgggcagtattcaagatgaatacttccaaatggagcagatagttcagatttccatgtattaccagctcaagaagacagagtgtggtcaccccaccaatttggttgaacgagatgtcaacaacaatattgtcaataacacatttgatgagctttacctggatgcaaaagcaacagcagtattttaaaacggtgtataaaaatatatcagtagcgtatgtagaggtaagaactacatagttaaatctctgccttcttaagagatcatgcatgatactaatgtaaagacatggaaaaatgtaaaaaacattgttactgctccatatgaccatatcatactatacccaaactatctctggaataaataactcaacagaagtatgtcatacaaaaatgcacctcagcatcgatgaattgcaaacccgtgattgcaacatcagcaccatcttcctgctcctctaactcaagtataccacgaacctcactaatgaaagtgctgtccggagctgtgttcccaagtatagttatgtcaatatccccatcagggaggtaggtcttcaaaggaacagatccaaatgcaaagacctgaaatcatcaaacagaaacaccatcttagagaatgctgaatgcaacatagtgtaaagtgcaagatcactatgactgcaccggctcaagaatcaaaatcctgctgtatctacaagtacaacatgcagagaggatttcactacggcggcataaacaagtatccattgcttgcttagcccaagcatgtgatgactgatgagtcaccaagaaatgtaacgagctcacagttgaccaaaccacgccgcacccgattgcatgcatgcaagcacatttacgagcaagctagatagccaaccttttccccttcaatagagctagaaatgatacatttgctgtcattaaaataaataaataaaaagctacaaaccacagtgaaaaggaagggtttaaccgttcatgtttgctgaaaagaagcctgtatttacgctaaggtgaaaggtaaaaagttattagatcatctaagctagtaaaaaaagccaccaccaaaaaggccaaagcataatagcttctcttattttataaaacaaaaactgacatgacgacatgatgtcactcgctcagcacagcaatttggagccactcgagtaatagaataggactggttagtcaaacaaatgtcattagaaaaagacctctcgatgcatgagctgatgggtacgagaataagaaccgattaactaccagttagtcctaatcgcaatcaccgaaacggagcaaagacgaaagcgacatatgagctcatcagcaaaactggacgcgaagcgattaattaagcgcacacgcgctcatcaactcatctaacaccaaaccccaaagacgccgcccgcgattgggatcgagaagaagaaaaaacgatcccatccgaaacggaagcgcccatcaactcatcatcccacaagcgagtgcttattctacttttttttttgtttgcggcacggcacttgtttgcgaaaaggaaaaggaaaaaaaaaagtgaatcagcggcggatcatgcggcgcggcggcggcggtcggagtagatccgccgccgccgacaccggccggagaaaacgctcgcgatgagattgggggggaacgaacctcgcagccgagcgcggtgccgaagagcagcttgaggtagccgatgatgccctgccgcgtccgctccgcctcctccgtgggttgcacccgtaacaccacctcgtccgcggccgcctccgccgcccggatcgcctcccgccggataaacgccggccgcggcgccctcgtcgccatcaccgccgccagcgtcatcctccccgagccggccgacgccgaccaccacccgccaccgtagtcccgccggccgcggtacgccgccatcgatcgctagcttactactactactactggttcaagctgccatgtttggggaatcatcagatcatcaaacaagagcgaaatcaaagggggttttgcaagagcgagagatcaaaatcttattacctatttgcttcttacgatttcattttcgatcgatcccttccgtttctcggtggagttttgagttttctcttgtggttttgtgtctcaaaactcaaaagagatctggatttggggcccaatgctctctcctattgtctcgcctttatatagatcagtaggggctacagtgtactttgatatctgccttttctttttctttttttttgtctatgagttatatatatatatatatatatatatatatatatatatatattctttatggctactgcctttattgaagtggatatggatgccaaaactgggggtcattcgaggatgtatggttggtatggatagataggcattcagtttcaaatataagaaaatgaatcctttaattcctgaagagttttggtgtgatcacataaaaaatatttcaaaactgttgtttgcggtgtagatatgtttcttggaattatttattccaaaactccttttaataatatttgagaaaacaaacaccttatcatgttatttttaaaacactagctttgactactctgacaaagttggtattgccgaataataccgttaaatcacatgtgatagcggcaaaaaaaaagggacaattagagtcaaagcatgtctagccacatcatccctacttacactaccaaaatggattactattccatgtgcgacaacgctaaaaagtatgtgtaaggttacaatatgcatgcaacatcagctcaaattgcgcgccaacaacatggcaccaccatgtgtatgcaatggctccaataagtttggatgagtttgtcgcatgctcaatctgccacatcagccctactagtatgccaacaacatggaaacactatgtatgtggttgtatccaaaaagtttaagtaaggttatgacataccctgctacatcagctctactggtgtactacgtcaaaaggtttggataagattacgcatgcgcgccacattagccctattggcgcgtcggtgcgcaatcaatacaatttaggcttcctcctccttcccttctctatcttctctttccttcaccattccgcccaaagccgtgccttactagggttaagaatcacctaacaaagcatggtgtttgttaattaattcgtactagcattactaggggtttccgccttgcgagagtgacgatgacaaatggcaaactatcattgaaacaagttagtttttacgagttgaaactcgatgtatgttgcacatgctagtaataatgatgttaaagatattaaaattttaacactataaatgttggttatatctcggattatgtcattctaaactaaaagaagagtccatgtcaattataacgagctaattattaattttgaaatttagagttggattaatgaaatagcgtatactaaattgagagtccaagattagtatagatttatatttaattctaaatatattaattatttaatttttaaagcaactaaagctaactgagtccaaagtatttctaattatatgttttttatttaacatggattattcatatgatttcatgccatgataatatggaccatgctactaatgataggtgttgctacctatgtgattatgatggaaaaagagtgaagtcatgaaacaattttctaaatcatattggtgtaacaaaggttgtgaaagtagagtgggtgaaagcaatgccaaagaaagggtatactcctagttgttatctagattcaatgttagcaatagtggagaccataggcccctaggtcaatctcagagtctcacacattgtcgagaagctatagttgttaagcatgacactgggaaaaaaactcagtcctaggggaggacctcctaggaggtatttgcagtagaggaaacttctcgctgcagaatcgagaaaaaaactcgaaggcgcctgcaggtgtgtaacactgaaagcaacatggtggtaaggggtctttcttttaatctagccccgaaaatatctatcccacaagaagtagtcaaactcttaacattggaatgctagtaaggcattgtgatcactaggctaaacattgtataggactgctaataactctactagggttctaaaagtggaatgtaaacatttgcacaagaattatatattgtgtggatttttttaataaggcacaataaaataggtactctgtccgatcacaaaagcatgttgttttgggtatggctacagttctcaaaatacaacattgacaaaaaatatatatatggaagaacaaaaaacttgtggaagacaaatatatgagaaatgttaaaatgctgaaaaatatgtgatcttgcaagccaaaatgagttcaacacatttgtgccaacttaagtgtaatttca

SEQ ID NO: 80226 - DNA, 81838 bp, Oryza sativa
  unsure (1)..(81838): unsure at all n locations
aggttggggttggggctccgccccggggagggctgatcgccgggcttgggcggcatcgccattgcttccttctacctgtgagaagagaaccacacacaccacacaccagtggttgaagagaagaggaggagagtgagggggtggcgtggcgtgtgtgcgagtgtggggcttgcttgctcgcctcggtcgccttggttttgagacgccacgccagtgcgggatctggtattccttccttggttgcttgcttccggctatggtggtgaagcatgtgatgtggaatgtgactgccatgcaacatgcattgggctggctggttggcttctcggtgcaggcttgtttttgtgacggaataagttcatctgaggtcccttaacttgccaacgaatctgattttcgtccctcaaccgaaaaaccagacacaacgggtccctcaactaccaaaaccggtgcagatgagatccctcggcggttttgagagcggttttagctgacgtgacgcctacgtggctattttgactcggtcttcatctgacgtggcattgacgtggcgcctacgtggctattttgactcggtcttcatctgacatggcattgacgtggcgcttacgtggcaatttgatccggaaaaacaattaaaactatgggacccacatgtcagtttctcatacaaattaataaaaaattgtggggccaacgtgggccccacatgtcatcatcacccatcctcttcttcctcctctctgcgccatctcctgccgtcttcatctctctcccccatctctctctatcaccggcggagataaggcgcggcctcttccatgggcggcggcgggcgagctcccgtttccccacctgcttccccgccgccgccgaatacgacgacgccgatggcgacgggtttgaggatgccaccggtgcagcgattgggtgtcagctgcgcgggagcagggcggcggcggcgcgctgggccccagggcgcaagcggccgtgactggcggcggaggcacgcgggagcagggcgtcggcggcgcgcggggccacagggcgcaagcggcggcggcgtcgaggagggcgtcggcgcgcggggccatagggtggaagcggcgccgtggaggagggcatcgtcggcgttgggccttctccgtggcggcgaggatctcctccgtcttcgccgcgcgcctcgtcttgagcccaggggcaaatggctcggtatggcgaggtgtggccctctgcccctaccccctacccccttctcgtactcctccggacagagcatggcggcaggcagaagtagcaagtcggcaggttggagcagccaaggggcgccggtcgccggtcgccggggtcctgggagcagctgcggggtgcggtctgtagcacagtagcagccgccaagcggcaaccgtcaaggcggcaagggcaggtggaggcgcagaggggcgccgccgccgggatccagtcccgggtgcagagctgcggcatccgtgccacaacgtacaaggaggagcgcggcgcggtcaccgcattccagagcaggatgatgccgccgccgtggccgacgagggagaaggcggagttcggggatgtcgacgacgtgtgcggcgtatccgccggccagccgctcgtggatgacatgtggggcccacgtgggtcccaccattttttattattttgtgtggaactgacatgtgggtcccatagggttttattattttccggatcgaattgtcacgtaagcgccatgtcagatgaagaccgagtcaaaatagccacgtaagtgccatatcagccaaaaccaccgagggacctcatctgcactagtttcgattgatgaggaatccattgtgtctggtttttttggttgagggacaaaaatcggattcattgacaagttaagggacctaagatgaacttattccttttgtgaccgattttgggctgatgttgtgtgggctttttggtagcctctaagccgtttcatgacttcattcacctcatctccaagatcatcttcggcccggcattcacctttctcaacttatcatttctcgtttttagtaaactagtttcccaagttttcccaaattgctaaacggtggtatgttttttaaaaaaattatagaaaagttattttgaaatgtcatatttatgtatttttaagtttatttaagctaatgcttaattaatcgtgcacgaatagaccgttccgttttacatataggagacagagttctcaaccttcacctctgaacatagcttttttcaaaacctttagattttccaaaccatctaaattcttgtctatattttaggaatatgtagttatgcaattctagaaaaataaacgataagttagaagttgggacttgggaagcctagtttatctaaattcttatcagtcgtttgtcagagtgagcagctgattctacgaatatgtagttatacatttttttaaaaaaaatgaacggtaagtcagaaagcggaaaccagcttttctaaatttacatcagacgtttctcagagttaagcagaagctccaataaacaggacctaagtttcgagaactgtagagccatttgggttttagagcggcaaatcaggtgagttattactggatgtcttggctttggatacatacaacaactagctgcccaccgaggtatgagcaaataaggtgagcctcgtggttaaaaattacaaggtacagtcagtatcatacagccttctacacgtgtgtttacacaagaaagcaagtgaaggactacaagaacacaatgaaaccctatgagattctcaacatcaaaactcaccagctgctgttcctgtaaaaaaagggggaagccgataagatgcacacacaacaaattcaatacccatcctgccatccacacactcaacacggtcagcctcaagctcaagctaaagcagcagcagagtcaccggcagccttgtccggctggttatctccagcctcgtcgacggccatgctctccggctgctctgccgtcgccacacgcccgccgtcgttgttggacgtccgctcttcgctctccaccagagccggctgcggaaccgtggctgcacctgtacatgtgctggagctcccttgctccccagccaagctcgtcaggccgttctgcttcatgtagttctccagtggccggttggccacctccaggaggctgaccatgctcacccgaggctgcccgccatgccgctcctcgtctcggacggcagtagggtggaagttcaggtctatgtggcccttgttgatgtcaaccttgtcgaacatggtcacatctccgtctcgggtagtgtcaaccgtctgtggggatcttgacaggctgcttccctcaggctcatctctgttcatccaagcgatcttcttgctcgcctcggcctcctctcgctccgactgccgttgcttcttcctcatcatcagtgtcttgaagcgacgcctaacggtcatgcagacattgcaggtgcaagctgggttgtgcttcgggcccttcccgctaggtggctggatacacactatgcaggtgcagccagggcgatgccgggggtgctttgtggttgtcgcaacagaaggggaaccttggttcccgacatcaccatagactgcggcagtggcaaaggcatcaaggctgaccgcatccatttcggggatgttctgcttaaaaccaaagctgttccttcgcctcctcatatctgtggtaatattcaagttattgatttttcttttttttttttacaagtttgtcaccagaaatgatgcagtatgtgctacccagtccctatatacttgttatcaatttcaattgtgataagagatgcctattataccagactatccatgttttatttgcccactatcatgctatatgctatatgcaggttcttttttcctagaatgatgtaacatgtcctgaaatgcacgaaattccttttaaataaagtcagagcctccaaatgtccattatggcatgcccagagcatcttgctatcaaggcgtgcatatgaaaagcatggataccttcgtattgctgaagaacaatgtgcaattctttgggggttaattcttcaggtgcagagcaggaacagctgcaaatatgttggaaataattttagttagctaatcatgatgtacaatgaacagttctatcaaatgacgaaagtgtggctagaatgtttttccacaaacagcatacctttttgagtcgattgtgttgtcagcacatgtccacttggatgcaacaataacattaagtggtaaccggcgccattttgagcaatcatcacattgaatccattgatcttgttccctaaaaaatacacagtaaggtattggcaaaaattagtcactggcacagagaatatttgtatggtgtctatgcagagggcaaaccctttaaaatgatatcaataccatacagctccaaggcaatatctattgaaatctaaacaatcgcttaatatttttgttgttttatttccaccacttatggttttcctcatgatgaaaactagagtactaaacggtatcttctgaataaggttcttacccagtagaacggatggtaaaaattgatctctttgcaaacacagggggttcctgcatatgtataatatagttagattaaattcaatcattccaaggcctctcctgagggctgagaaaaaagaagtcagaatttcatgtttcccacaaacgtgaataatgaaatggccagcaaacttacatcatactcttcaatttcgtagtcctcaatcatcacgacagtaggttttgcagttggagcaggacgcaacagctcctgaacctcatcccagtaaagctttagttcccaggcttcttcagcatccattgaaagcctcctgcttttggaaccaatattgcggcctctctttaaaaactgcaaagacccctcatctggcctgctgccgaatttatctgtcttaagccaactaacatccccgtcagctgagttcacatgatgatcgtatatagagcttgtatggagatctgcagccccctttattgactgaagaaatcctgaataaccacttactattgctaaattctcatttgtactagaaaataatgtatccccaagaatggaaccgttggcaatagctgaaatctgtgagtcctgtacagaagtaacataaaaacattgataaaggaagggaaaaaggaaagtgaaacaagcatttgcaggaaaataaattagtaggaagaatgttaggaaaatctaacttactggcaaactgacagtgtttgtggccttccggaagcccataacaagtttccctccaggttctatccgactaaaagtcactgaaaagaaaacaagaatcaccattaagtatgaaaaccttcccagtgagatcacatttaatatggaacaattctacttagcatgtttaaatatattaccacacaaaattcctataacaagtaagatatgaccatgaaatattaatcaggcattgaattttgacctagacgtgacaattaaatgactatgggaggacccctatttgtccctgtcaattccatgtgtaggtcaatttgttctttcaaattctgtacactcaatttagacatttgtgaatacttaaggagattcccctatcaactggcaactttactgccatgagtgctttcccaaatagttttgaagtacttttgaactatgttagatcctttgaaggtatgcaataggaaaatcattgcttatatgtaatcaggcatcagtaataaaattgtaaaaaaagaacaggtgatatcatgtccaaggagatttaacctgtatcaccagcctgtaattgtaatgattgtatgcatggtgtaaccccctccaagacatacattctgctgttgttatttggccagaatctgaactgaaaatgccattctttgccttttgcgtcttgaattgtcaaaggacgaccttctggctgagaaattggagggaaatatgcctacaaaatgtatctcggcaactcaggatgacagcaaacatgaaaagaaatatgttaaaatagttatgctgagaaacaattgtccccactcccagtagttagcaaccattttgcaaagaatgtaaagtagcagtgctctattgcaaaatactgtaaccatgaaaatatttaaataaattatttatataagattattgagcatgttgggaaccaaagaatgtcaagtagcataacaatactaacaagtgtaacaatggcctaggtctctgttgatcaggtattctatgtcagtgtttacgtgaagtagtaaaattaggttccacatcggctgtatttctttctagtcctaactcttgtgcatatactactatataatatagtcacatagatcttgtcaaagcataataaaggttattgttttttgtaacatgtggatgggagggtgttcctgatcctcatttgtatcaaaggatctttaaataatagggaatatgatacaaaaacgataaatcagtaatgaggtaacaacactaaaattttattaacaggaggcagaaccacaaaaggttgtgaacaaaaaaatacctccgcacaggcttttggtagaacaaggcgccctatgcggcctgcatcactggcgcttagaaccttctcaaacagggggacaatggtggaatttgaacttgaagagaaatatagttaaggaaaaccaaaatagcatccagatcagaaataggtatgcacaatatgaaataattcgccctgattgatcagttacagagattgtattatacgcaaagtatgttagctacttatgcataatatcaccaagaagttgataaatataataaggatactctccagaaatttgctgtagctcttggtctgttattctaggccaatatcgaggaagtaattgattgcggcccctaccttctgcaggtggccttgcaacacgaagatgcggaagcatatctttcgttggatcaaaaacagcaccttcaccaacccttggcggtctggtcagaaaatgacgagccctttgtgcatgctgaaatggagataatgcagtggtaagctctcttccttcaggaaatcctgttgttggtgatagcataggtctttccacagttgaagtagcctccaacttgtttccattactagcaattcccaagctcatgttgaggcatgcctcagaaagtgattcacttgtcgtgctttctgtagttgggtctttattttcatctcttcgagactccaatgcactttgagatctagttaggaaaggtatccttcccatgtccccgatactaagggtaggtagttcccatttaatctgcctcgcaccattctctagttctttttgcctcaaaatattactgctttgcccagcttctacgtttttcaccatgaatggaaggttgttcttagcgataatagtaagatcatcgtttctggcatcgaccataagggaggatgtctccagtggtctaccagacaataaatcatcgcttttgccaaaaagtctctggttattttgggatgaaaaaagcttggggacgactggacttggaacctacaaaaaaaaggaacaatcagataatttggaaaagaaatacaaatatgcaacaaacaaacttacagattgaactgctgaatttttaatgcaagtgacacattgaactccaccgctatcaagtagatcaaaggagttcttcgaagcaatacatccacaatggagacgctggaatagtgaagttctttagagttactgttgcagaacaatctagcaccaaaaatgtgcatacatttcacagcataggtcaccatctcaccttcccacaaaatgagcagtccctccagccagattctttttggtgaaatatatcacaaaacacaagctgctcatatgccaacctacataaagcataaatggcataatcaaaatagatagatcaaggaaattggacttcaaattggtataggggattaaagtaacctccttttcagaagaaaacactctttaaccttatgttgttcaactaagcatatgtttttctccatcaccaaaaatcaattgtaagaaaaatcaggttgcataactacaccaatttcacaatacatctattttttaccaagcagcaattttgacaactcatagagctttggcaaacaaattcccccctttttacaccaaagcgcaggaaacgtcatccgggacagcaatccagttacaagtcaccacaaatataattttaattgtgagaagctcatgtgcagcaagtaactgaacgatcatcgaaatcccagttgagcatgatgtccactcaattaactgctagctaatcgcacaacgagccatcaagtcaaccttccaaagtttcaccggattttccactttccaaaaattctacacgcgcaacactgttgcttctaccccggcacagtttcctcataaatcaactaatttgggcgccaatacgagatcaccacaaatggtaatggtaaaaatcacatcaaacaagtaataaacacaagttgtagccgttggaaaaacaaataaatttagggagaaaaagaggggaaatcatcgagacgatatacaggaaacaaccaaaaaaaaaagagcacagcagctaattcatgcagccagccatttcagccgcggcgcgtggaccaccatgggcgcgcacagcaagctagcgcggaggaggaggaaccgagagaggaagaggcggaggcgtacccgcacttgtcgcagagcacggcgaagccaccggatcgcagcggccagcccttcctccactcccctcccgccggggacggggccggggccccgcacgcggcgttcatgcacctcttcgccgccaccaacgccgccgccgccgcagccatccccgccatggccactccgatcaatagaagaagaaaaagaaaagctcaccgcatcaccccacccacacagctcgagcctagtagagagcagtaaagatcgaggcaagaggatgatgcggtgggtaggggaagcgtagttttccggtggatgtggagatggcaccaaaccaaaacgatcgatcgctggcgactcgggtgcggatgcggggaagaaaaggaaaaccaaccagatggggggagcaagaagaggagactgaagaattactcctgctgctgatgctgcagcagccaaggcgcagtaaatacttcagtaaggtattcggttcaccctgtgctgtactactgtagtagtacaaactacggaggaggggacgatgtgactgaaattttcatgattttccacataaatattacactccatagcagcaagtttaatagtatagctaactaaaagttctaaatcatcttaatttaatagataatttatcactaaatatatactactatactattaatatttagtcacattgttatacacacattacgttttgaagtttatgtagcaccgctgttcgtctctctccttttatctactcgatatgtatatataactgctctattatacctgctataaggtaaagattgggagcaaagtgaggaagcttttctctctcttttttgtttcataaaaaaaaggagatatttaaggattgcacagttgcacgcacgcacgacatgctctgctggtttaattaatttttctctcttgggccgggtcctatgctgcggtggcaggggtgtggtgttgtgttcgcgttgcgcgtctccacgactttgcacgcaggtcaggtgtctgcagtgcaggtgcagtacttggctgtcgatctgccctctctggtctctggatgggggtgaactcagtctgtgtccgcaaatgccaatccaccatcccagttgttacagcgacacctgcgttactgtataaacaacgggatcctctctgtctctgcgtcctggttcaagtcaccgctatacagtttcaatgcagaaaatttgcgagaggatacacatgctgaacagagttgaatttttcactggaatttgtagtactgctagtatattctctgggatgaaaacagaggaaatgattcgctgccgctgcgtcgtctgcatgcatgtcgaacgggggcagcagcagcaaaaaaatcgatcgatcgctgcacgagcacgagccgaattgaatgcacaaggaatgccactaccacgacccgaccaatccccaatactagtactagaactactactaggagaggcactgttgcagtccagccttgaataccgtcgccaacccaggcggccaccgcgcgcgctgcatgtccggcggccaaatctcccatgaaacgtcgccgtcggttcaggtgggagcccgcgccgagccacacgttactctgctctgctccacccggcgcggcacacgcacgcacaaccacgcgcgcggcgcacctcacctcgtagcacgcacgcacgcacgcgagcccaagcgcacggtgtgtcgcggtcgaggcggggtggtggcggaggcgcccgcgacgtggacgccgcaaccgccctcgtttctttcctcctccactcccacgtcgcggctttcgctgacgtgcgcgcgaccacgaccgggagagagctcccgtgccggccccgcgagtcaccatgccatacgtgccgctgccgtcatcagcccgatcgatgacatgtgggtcccgcgggggcgtgggtgcggggtggggtccacgggtcaatgtcccgggaccggtaaagcccaggtagagtcctactcgaatcccccgtgagcgtgagagagggagagagagaaacgacgcgagcgcgaggttacgtgcacccggcaacggtggccgtcacgactatgacagctcgggttgttggggcccacgtggaagcgagtggacggtgttggtgggacgagtggaaacgaagggggagaaggaatgatgaggtagttgaatgaatggaatgaggggaataatatactcctactccgtattccgctcaatgggagtgaggaggcaggttgattgattggtcgcctcgcctcgcccgttgggtttgtgcttggttcgagcggtttagtatttttggttggggtaaaaatggtgggctggtagccgtcggccgcacagacggtcacggcaacggcacatggagattagaatgtgacgtaatataagtaccataaatttggacaaacttctgttcaaattcattatactatattacatctcattccaatcctaaattgggttttaccgttttacaggacggagagagtacttaattgtctcctactccctctgtcgaaacatgaattcggcaataataaaacggggtagcgcacgagacctaaaagtggatggatgcagagacaaaggatttagacaggttcagaccctctcaatgagaggtaataccctactcctgtttggggatttgaatccgccgggtgtagtatagatctgacgatcaagttgtctcctgccccctagagggcctcctgcccaccttatataggatggggggcaggattacaagatagaaaccttaaccaacacggtatcggtttcctaaatctactttacaatcttatcaaaccaggactttaggccgttccataatatacagggaaacgtaatacccaagtcataatctgttacatatttcatatatataagttatcccctataactagtcggataaccatgccgtgtgggtatggggtacccataatctccacagtagcccctgagaccttcacagtcgaaaagataatcttctctcgaactagattactccaaaaccgagtacttcaatcatctttgccatggtctcccgagtatttttaccaaatctgaagactgtggagggctgaaaaataaagtcaggtgcatcgactagatgcaccgagtggtttcgataattatagtcaaccaagcgacttaatattaatatgtagcatatgcggtgtgaatccctgaataatatgatccaagtgatataccgactgctttgtaaaatatgatgagtgtaacctaaagttggctacatcattgaaaattcacatagcaaaatagctataaagaagcttgtatgttgtgaataaagaaatttccaaagtattgggcatacgccatgcgcacactgctttaacagatgtgcttaagtccctagaagacacatggttccaccacacctggaaatatatggcatatgtggtataaaatccgagtaaataaactcataaaggatttaccaaccgcctgaaaaatgaccacaatatataatcagcctaagccataatattggtcaataaaaatgcacacttacgtggcaaaaagcaatgatattgtatccaatcaattgcttaaaaacccaaacagcaccatgactatataaaaaagccagcggggcagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgataccctttaaaggatgacacatgtaacatgctcccgggtgatatagaccatgtgatctgagtgattatcccttatgggatactccaaaatagatataacaattgaatcccgactggcgcaagtattcagttgataacccttacggggaataataaatagtccagtctttgagcatataaaatagacccatgatcatgaattcatgttgcatatatccggagcaagtccaaattgaagatataatacttgtatttgagctagtaagcccctgagcacgtagtcacaattgttcattgatggtagctgacgcagttggcatagagacaagacgacctatatagagataatattgcccaacagaggtggcaaaaatattggtggtagtgaagatagtgataccaatcaaaagtgatgaagttgcacagccgtggaggcgaagaaaccagtcggcaacagtcaggtcagccatcaatgaagatgaaggcgcccagcgataaagttgtgtagccatggcagcgaaataatcagtcggtgacagacgaggcagatcaaaggcgatgacgaaatccaccaatcatgaagatgaggaaaatagtcggcgacgacaaacgtaaccgacagtaatgatgataagcatcaacagagatgatcaaacatgatgacgaagttgcctatcaatagcagtagagtaagctatgataaagaggtttgacaggatgttgatgaagatgacgatgtcggtgatccagtcaatagcggtgtaatagccgatgataatgacgaagacgctcatcagcgtttgcatagtaggtcaaccgtgaaggcggaatagcaagttagcaaagtcttagtcatccattagcaacggcggaatgtcagagctgatgaagcagatgtgctggtgatgatgtcagtgacaataatccatcaaactgttgtagatgcttcacttggaggaaagtatatgctgttgttcaactcattgaatctgatatgagttgattggttgatgactccaaactcccagacatgtaaatttaatcttgacctactgctctgaagcgaagacaaaattgatgactcccagagttgacttgttggctgattaattgattgcttcatcttgacataaagcttgtcaaattttgagccatgtatttgtgtagcccccgactctttgattagttgggaaacaactgaacatagagtcgagaattatagcttcttgttgtcgagtagtcatcacttgattgaagatatgtgttgaagatgtccaagtagaaatcctgaatattggagagccacttgttgtagtaaaataacatggcattgcatgccgagatgtcgaggttcacaaagacgtcgtgggtggtgaagtagtaaaacttgcgaagtagcaacaatagagtttgccggtgccgaagataataaagatgaagtcgctccaccatgatgacaaagttgtattgccgtaatgaagtgaacacaagtcggcggcaacagaagcaaaccggtagtgaagacgcgcagttgtgaagataaaagctccagtcggcggcggcataatcagtcggcgacggaagatgatgatgtccatcagtagtggtagctgtataaaccagacgtagaggcgagggcactagtcagcagcagacgagacgaccagcgatgaagatggtaaggccaatcaacactggcagaatcatgcagccatggaagtgaagaaaccagtcggcagccatgacaaacgtaggcagcttgtgttgaagatactgatgcctattagtagtgacagcgatgtagccagccgtgaagaagatagcatcagttggcgttataacaggccagccgtgcaggcggtgacaccagtcagcggcggatgcggcggccggtcggtgaagacgtagacgcccaacaacggcagcataataggccagccgtgcaggcggaaacaccagtcggcggcggtcgaggcggccggtcggtgaagacgtagacgcccaacaacggcggcataaaggccagccgtgcaggcggaaacaccagtcggcagcggacgaggcggccggtcggtgaagacgtagacgcccaacaacggcagcataataggccagccgtgcaggcggaaacaccagtcggcggcggtcgaggcggccggtcggtgaagacgtagacgcccaacaacggcggcataaaggccagccgtgcaggcggaaacaccagtcggtggcggacgaggcggccggtcggtgaagacgtagacgcccaacaacggcggcataaaggccagccgtgcaggcggaaacaccagtcggcagcggacgaggcggccggtcggtgaagacgtagacgcccaacaacggcagcataataggccggccgtgcaggcggaaacaccagtcggcggcggtcgaggcgagccggtggtgacgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcataaccatcaagcaccgggagtcggcctaggcacttcccaaacatgcatatgagtgacatgagttcgtcattaatggaacaaagttttacggatcagaattttctactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgacggcaacgaaggtgagccaacggtgaggatgtagacatccaacaacggcggcataataggccagccgtgtaggcgggggcaccactcggcggcgacggaggcaggccggcggtgaagtcgtagacgcccatgaacggtggtgtgaccaaccaaccgtataggcgaggacaccagtcggcggcgacggaggcaggccggcggtgaagtcgtagacgcccaacagcggtggcataataggccagccgtgtaggcggaggcaccactcggcggcgacggaggcaagccggcggtgaagtcgtagacgcccatgaacggtggtgtgaccaaccaaccgtataggcgaggacaccagtcggcggcaacggaggcaggccggcggtgaagtcgtagacgcccaacagcggcggcataataggccagccgtgtaggcagaaacactagtcggcggcgacggaggcaggccggcggtgaagtcgtagacgcccatgaacggtggtgtgaccaaccaaccgtataggcgaggacaccagtcggcggcgacggaggcaggccggcagtgaagtcgtagacgcccatgaacggtggtgtgaccaaccaaccgtataggcgaggacaccagtcggcggcgacggaggcaggccggcggtgaagtcgtagacgcccaacagcggtggcataataggccagccgtgtaggcagaaacaccagtcggcggcgacggaggcaggccggcggtgtagatgacgatgcccatcaacggtggtgtgaccaaccgaccgtataggcgaggacaccagtcggcggcgacggaggcaggccggcggnnnnnnnnnnnnnnnnnnnngcaacggcagcggcgcacaccaaccgtggaggcgatgaaaccaatcggcagcgacgaaggcggccggcggtacatgtataaaataatagatcaaataataattagtgatctgtgaattaattctaatttatataagaaaatttagaacgataaacctggtttgtgatccaactttgattcgaggcctgtcaatggatgaaccgtagcatgcagccatgtcatgcagccgtgtagacatgtaatcgtcggtagcacatgcacggattagtttggagaccactttgtgcatgtaatagctgatttgtgtatggattaatttccttgaccacagatttgaccaggtatatttaatttgtatcctggactttgtgtcttgccgtacgtatccgagtagtattgacttggtgatgtacaggctcaaccaacggtgatcttcgcatgattttgacggcggctgcttgctgattgcttcaaatcatgccctggtgacgaaaccgacggaccaacagatatggcagcattgtagcgacggatttgatctcactgacggaggtaaaattgacggtaacaagctggttgtagatcgattcgatcggtgattaatctcctggttgattgaccagatccagatagaatttttggcgacgaagaccctgcccttttgttgagaggatcacggccaaagacaagagtagcaccgatgatgccggcacaaagttccatcgcacttctcgacggaaaactcgacgcggcccctacctggcgcgccaactgtcgaaacatgaatttggcaataataaaacggggtagcgcacgagacctaaaagtggatggatgcagagacaaaggatttagacaggttcaggccctctcaatgagaggtaataccctactcctgtttggggatttgaatccgccgggtgtagtatagatctgacgatcaagttgtctcctgccccctagagggcctcctgcccaccttatataggatggggggcatgattacaagatagaaaccttaaccaacacggtatcggtttcctaaatctactttacaatcttatcaaaccaggactttaggccgttccataatatacagggaaacgtaatacccaagtcataatctgttacatatttcatatatataagttatcccctataactagtcggataaccatgccgtgtgggtatggggtacccataatctccacaccctccatcccaaatcaacatagtacatgatgtgacatcttagtactatgaatttagacatatatctgtctaaatttgttgtactaaaatatatcacgttcagttctagattttttttttcgcgcgacggatggagtaactctgtactattactattgatccattttagtctggatatactagttgttcgggaaagctagctagcgcgtgcgcgccgccggcgcatgtttcagtgagttaacctaactaactagttagttaaggataatggcataattaggagaagattatctttttgttgggatatttttactaatagattgaaaacttttaaattagatttgaaaacttttgacttaagatttaaactttgaagtcaaattttaaaatctttcaactcaaactttgaaatttttctcttaaaatttaaatttgcaagacaaattttgaaaattttcaactcaaggtttaaaaacttttaagtcaagatttaaaaatttttaagtcaagctttaaattcaaaacatttgaaaacacgtgtgttgaagattaaaaaaataatcagaaaaagtgtaaaaggtaaagaaaaaatttcatgaaaaaaaagaaaaaaatcgcgtgggggaggggctggcgcgccaattaaccaaaccccctagttgttagtgtatgtcatgtcgaaaagtctcaaaacttacgcttaagcacagaaaaatattgccaactcatcgtgtgacatggttagctgccctttgtgtaatttattttccttatgtatgcacgtctagattgttttttataaaacacgtcaaaatatttaatgctttaaagtttttgtttattataatgatgtagctatcggcctatctctgtttgacgtataagttatttgacgtgtaggaaaataagtttttgtaatttattttccttatgtatgctcgttcacctccagaaaaaaacatgttatcataagaaaatacaagcttataatacatcgtacattcatgcgacaacgcccttgctataactcacaagtcccttgtacacagttggaggtggtgtggtggatttatataaattccccatcaatcaccaacgcaagagagagaaaaaaaagaatccacatcaatcggtgctgcttaaaagtgatggttaaacaaatcttgacatactcgtatactacaggccacaaagtaaatgaatgaatggataaaaatggctcagaatacgattgcctgtcacgattgcaatcttagaatactatattgtgcactattgaccagtgaaacaaatgtattttttcggtatgaatatgagatctttcgatggttaaattaaaagcaaattcagcacaacttaaatgcctttctagaaaaatattgcgcaaaaatggtaaattagtgcaaaagcctgcaggcgttgattttatctcggacggatgcgctggtagttcagttttcatacgaagttattgctcctctcccttatcatctcgcatgcaaggcttcgccttattctccacagcaaaggcagggcagtgaataattttctagtagcatgtcattttactcctccttggtactgctgtcaagaacaaatacatcgatcaaatctgaatggggtagtatatttaattagtaaaacaaattgcattgtgttatttttgtgaggattttgcacggtatactgtaaccgcaatttaaggtattatcacttgctaatacatctactataaggtgacttgcttttttcttaaaagaaacaactaaaaattgcaagaaagcacggagacattggggagccgttaagcttcagcgataggatttcttttactgcttctcaaattgttccaccaacggcttggaggagtaggcagtttttttttttcgaacaaagagtggttggaaaatctacatcgggttgtgttctgggttttgcttttgccaagacaaaattccggaatccaccactgcctttgcgtgagttgtgaccgtgcgtaaaaagcgtagtaaaaaacatcaagagacaaaagcaaatggagtgtcatggtggtgtctagtccgaagaccacggggtaatctcttgtccctgcaaaagaagagggtaaaaggaaagctgcagcaaagctactccatgaccgttgcgctagtcgctgctcctgcgccgaaatggatcgctcaccacgctgcgcggcgtatggctgcaaattatagtagtagtaagcagccaaatagaaaaaacatagcagtaagattttgaaagaaatataaatataaatcagagggttacaaacacacaaaaaaaaacatatgatagtttaattagactacaggaaaaacatagaaatcagatgataaatatacacttaaaggaattttttcaagacattaggacctgttgctaaatttcctctaaaatttctataggaattttatattccatagaaactttaaaggataagataagatttaatcctttgttttaaagtcttcgtagaaattttttttataggattaaagtcctccaaaatttttatattttccctataaattaaaagggtcgtaaaccttcagccaatcttatgtaatgtaaccatcacatgtaacatgattctgaatgttcagattatgatttaaccaagccatttcatgttcatctcgatcgatcggccaaaactgctctttttgtttagctttggaactaatcattgtctcctacacctccttgtggcccacggccactagaggggagcaccattaggacaagtgtgggccactagaggggagcaccattaggacaagtgttatggtagatgtgactaccacatctaaatttatccacatcacactcataaattaagaggcaacttatacaatatgtcttctctagtatataaataccaatgtctcttatactctcacacccctcttgaaatttgtgtggaggttgtctcttcatttaggggtggttcaccatctctctcctcacttctctcctccacctcatcactcaatccaatgtggcatatttaggggtaacatatagagcattatagtacttgctcttataagggcctgtttggtacagctccaactcctaaatttagctctaggagttgggtctggagtggagttgtggagctgcctaaacccagctccacaattctagttcattttgtgagagagcttcacccaactctactcccagttttggtggagctgaaactatttagctgagctccagctccaggaggggtaaagctgaagttggagctgtgccaaacaggccctaagcctgcatctccatgatgctccaatccggtactctagatagtagcggtattattatctttctgtgcccataatactactagtacatgcacacatcatgatgatggatcacgccatcatgggacgaccatttattttcgatggcatccaactaaacaacgctcgttcgtgcagtacgaattagagcaggtacaatagctaagccacctgtaaatatattttaaggagattaataagaagagataaaaatagcggactacagatttttagctagctgtagcacggactctaagacgcagtgtgtgtatgacaggtgggactaaatattaatagtgtagtatgtaactattgtattgatgaactattagattgattatagatgaattagagctagtagttggctatactacgaagcttgctcttagtagttagtagtaagtggaggcaatgagagcagggttgggcaggcctgtctacgtgatgacctttttaattcattgatagaacatacagagactgtaattgcctctcccttttgcccatgatatctgcatccaacgcatcccatgaccgtgtagttgggtttaaccgttgcatcttgagataagaaaatcctcagtcacactctaaaataattttgcatgctcgcactcgactaatgcatgaaactctgattcattgccattgttacagacttacagataggacaattactttttttttcatatggcctatgtggagtttagaaaagaaaaacaaagatagattatgtgtctcaaaaacatgtgactttcaattcaacttatacaaagttgtaacaaaataaactatgaatgtgtatattagttttagtttaatttatatttgatattgcatatttatacactggtataatttgtattaatttatcttgttatttttataattattgagatgacatgagaagacgagaggacgttctctccacgaataaaaactctttacctgtttatgaagatgctgcatgtggattgtggaccatgcggggttgccctaattgagagcatctctgttcctaattgttgcggttattcggagctggtccttcgtcttgaacacagtcgccaactcgccatgattcaacgggaaaaaaaatggggccgagaggtctcagagctgcctgcgacgattcaccactttcagggagcatccagctctcctgtagcaccgaaaacacacacaggccattctttctactgacagtatgtactctaggcctaccgttcaattcgtatactactacgagtacgttgaagctactcccacagtctcccacattcacactctcgctaccctcatactgtactacagtatgagcttgtactccctccgtttcaaaacgtttgacaccgttgactttttaagtacatgtttgaccgttcgtcttattcaaaaaaatttatgaaatatgtaaaaatatatgtgcacatgaaagtatatttaacaatgaatcaaatgatatgaaaagaataaataattacttaatttttttttaataagacgaatggtcaaacacatactaaaaagtcaatggtgtcaaacattttaaaacggagggagtatataagagctgacaccggtgggaacggaggaagcttgacacttcactaccggttctctcgaaccataggattctcgctaaaccctccttaaaacatacttcttccgtttcaaaatgtttgacgccattgattttttagcatatgtttgaccgtttgtcttattcaaaaaatttaagtaattattaatccttttcctatcatttgattcattgttaaatatatttttatgtaggcatataattttacatattttacaaaagtttttgaataagacaaacgattaaacatgtgctaaaaagtcaacggtgtcaaatattttgaaatggagggagtatatactatatctatgaaaaaaaggttgaagctttggcctggtttagttggtaaaattctttgctcctgcgtgtcacatcagatatacggatacatatttgaaatattaaatgtagtctaataacaaaataaattacaaattccgttaggaaattttgagacgaatttattaagcctaattaatatgtcattagcaaatgtttattgtagcaccacattgttaaatcatgacacaattaggcttaaaagattcgtcttgatatttacacgcaaattgtgtaattgatttttttcatatttaatcctccatgtatgtgtccaaacatttgatatgataggtgaagtttttgttttggtaactaaacagctcctttatctctatgttcagccatatactactatttattgctagatttgcctctaacaggtgattatattcacaactaattaaacattttgtacgaggtaaatgcttaaacatttatatacatatagtacttcttccgtcctaaaataacgaattttgacagttcttcagattcgttattctaagatgagatttagtccatctttcttgctatcactatattttggaacgaagttatcatattgtggtccttgctgtatgtactggcaaggtttaccgcacgattatcgtggttatcacgtgtgataactttcttaaattttaacattacgatatatctcgcggtaaccgtacggtttttacaataaccacgtagttatcgcaataaccgttaaactatgggacgatggtaaccacccaaaaatagtttggggagccctgtgtgcaggtcacttggtcagagcaataataattactccaactctggatggaaacaagaggttacagtatagatcatcgtcgcacagttaaggctggacccatcaaccatatgcacgcaccatatatagctgcagcactcaacgcgattattccaaatggacccttgtttcggaccgttgccgatggtagcgaaccgccattttgcgctggctctgagggcctgacgacgtcagagttagggcttccctgggtgcgtttgggccttcaattaccgtacacgataccattaagcccaatattgtttggcccatcaactgctcagcccagagccccaaagaaagccaccaactagacgaagaaggaacaccagcactctttaccatttctaaaaataagcatttctagaattcaaaattgtactactacgatatatataagtatttctaaggtattgattccaatacatgaaaatttgtacattttcaaccaatgaaatgcttgggaaagtaatctaaacgattcaaagtttaaaatttgaccactgaaatgactttagaagatcttttttcaatgcattagtttttactaaaagaccaatctagaaattcctttattttggaaaaggagagcagtacacaaccaattaggtggcctgatcgatgaactcagaaagcctgtcgtggatactattcacttttaaactttgttcgctcgtcttttttacaaaatatttacaaagacaaaaggattccacattatttaaacatattatgtcctaatataaacatgaaactttaactcaatttagtctaacaattttgtagtgcaatgttaaaggcaaaatagtcggttatttgaaaatgtgaaacggatggagtacaatccccagcaagaaggaacatacatatgcttacaaagcctcatcaacagaagtgaacattgctatgctcgtggaatcctcaactcaaatcttgtttaggtgtagaatgctcttccggtctctttattaaggactattgtctgaacaacagtatttacaagcttttaacatataggagtatctcgctgaaaaacaaaaaaacatgtaggagtagagtaagaacaagaccagaagctcataattatgactagaggccaatgaggtgttaattctggggagatcctaatctgtcctgcaagtttcagcaaagagaaaaagaggatatgcaaaaatcttgtcgtttcagaaacataagctatactgaatttttttttatcttctgggcacaaagggtagctccaagcctaccactctgtcaagatggcgaccaccgatactgctgccagctcccagttaagcttgctgcaatttcagatatcagcatgctccacaggacgatgttgattcggtgtttcttgattctccaggggcatgtactgagccatgatcgcacgaatctctgaatccatgtaactctggtttggcatgatggtaacacaaagtatgagttagccgtagattattgcaaacataagaagaactagaaaattacgtgatcattcggagatggattagaatagaaggatgagttgtttacccgtagccgatatttgtatacggcatatgctccaattccagccaaagcgaggccaaagaaaataacccaaaggaagccccagcccactgacgaagaagcaactttgcctgcacagtgattgcgaaaggcgtcacataaaacgttctaaagcgaatgaaattatgtgtgcatcaaagttccactcctgttttgcatcaaatcaacataacataacatacaacattttgaatgaggcatgaaagaattgtgatatctttcaaaaggaatttggttgtgatagtccgttatcaaacatgacaatgatccagatcatggcgcagtcaagcagacttgcattgcatattttcaagccgccagcagatggactatcgcaaaagcaaaactaggaacatctgaaatttctacagaagtttcaaggctgagtaacaagggatgatacaagtgtatgttgggataacaatctcagaacatgatcacaaggtccagaatgccgataagtagaaaattgaacaatataagactacaagggaacaaaaaaaaaggttaggggactcactgatgcaagtgtcatgctctctcatgtataacatattacttccaccacagctgcactcatagcttccccatgtattctcacaagagcagtccttgcactggcagaaaagcttgtctttgcattcatcaatatctgaaaacgccaaccagagatatgttaagtaatcacctaacagtttcaaactattcagggtttgccagtactagtttgtatgggttttacaagatggttggctcaagcagaaatatcaatctttctatatttaaaaggaaagttttgccacatggagtaatattaccttcacaactttttataccatcacccttgaaacctggtgggcatttgcagcctttagattcttcattctgtagagttccatgattagttctgacctcatagaacagccgcaaactagaagacctctggaagagattcttactgagcaggcagaaaccgtcttcccatttttagtttccttccagcagcctccgttgttgatttggcacctaccgacaccagaagctgccaaagggccagccgtaaaccaaacaatgtaatactaatagttgaaataataaaacaattaggatgtgttatgcatagcacagtctatagcaaggaaacagtattgtttcaaacaaatgaaaaaatgattccaaagaaataaatgctgccaacccatcttgacgaaataaaatgcaaatgtgtaccttcacagtgagtgtacccgtcaccaacgaacttcacaccacgggcaatagggcattcacaaactcgcccacggaaggtgtcctacaatatgtaacacagcaaataagaatgtgcacctcaaactgaatagaggtgaatgtcgtaaccagtatcagattatcaataggtagtactacctccgtttcaggttataaaacgttttgactttggtcaatgtcaaactgctttaattttaaccaagtttataaaaaaaagtagtaacattttctattaggaatgtatagccatatatgtataggattcttttgtatccttagtttccttgtatactcctctaattgaggaccctgtatattggaaaggctataatatatggtcaccccccctctttggggagtgtggtgttccctcctattctctctacatggtatcagatttcaggttctactccttccttccgcacccctgatctcccctctgtgttgcgccttgcgccggcgacgtcccctgctggtcgccgccctcctcgtcgccatgtcgacgtcttctgccacctctgctgcgaccgacaactccacagcatcggcctccaccaactccgtcgcgaccgtcttcgtcaacccgtacgcgaccatctccgtcaagactcatgtcccgatctccctcgagcttcgcaaccccaacttcaacaagtggaagaccttcttccgctcgatgtgcggcaagttcggcctcctcgaccacctcgacgactccgcacctcctgcagcccccgacacctcatgggagcaagccgacttctgcatccgcagctggctattcggctcggtcaccgacgacgtcctcgacctcgccatggaaccggatcagacggctcgcgccctttggctcgccatcgccgacctctttcaagcgaacaaggaaccacgtgcaatctttcttcatcatgagttccgctccatgatccaaggcgatctctccatcactgcctactgccagcgcatgaagacggcagccgatgcccttcgcgacgtcgggcaccccgtcacggagtcgcagctggttctcaaccttctgcgcggcgtcaactccaacttcaccagtacggcggacaacatcgcaagtgctcctgtcctcccgtctttcgcttctgcgcggaacacccttgttctcaaggaactccgtctggccaacgacgccaaagttcagacagagaccgcccttgtcgcggcaagcagcgctgctgcctcttgcccctcgggctcctgctcctccactggaggtggcggcaagggtggaaacaagaagaagaatggcggccgcaactacaaccgcaatggcggcggtaacaacagcggcaacaacagcggcagcggtggtggaaatcgtcaaggcggcggcggcggcaccttctcctttgctgtcccgcgccccccaactggaccatgggtctgtgtctcccaatgggccggccagcagcagcagcagcagtggcgcgcccccggcatcctcgggccttttcctcaagcccacaccgcctttgccggcccgtactcgtcgccgaccacctctgcagcgcaaccggcctgggatcaggctagactggtggctgccctcaaccagatgacggtccacagccccaattcttgggtcctcgacaccggcgcgacctcgcacatgtcatccaccgatggtatactcgttacccgcttacccaactctcacacctatattactgtcggcaatggtcacactattccggttttatgtcgtggctcttcctttctacctataggcaccaccaaatttgatctcaaacatgtccttgttgctccttccttggttcgcaatcttctttccgttcgccaattcactcgtgacaaccattgttctattgaatttgatgagtttggtttttctgtcaaggacctccggacccggcgcgtgattcttcgctgcaatagtcatggcgatctctacaccctaccggcagccgcaccacccatcgccgcccactgcttccacgccacctccaccaccatttggcatcgccgccttggccatcccggatctgcagccatcctcgctctatagcgcctctctgccataccctcgtcaaagccagatagttccctttgtcatgcatgtcaattaggcaaacatacccgtcttccctttactagatcaagctccagtacttcctctccttttgaattagttcattgcgatgtatggacatctcctgttttgagtacctctggctacaaattttatttggttattctcgatgacttcagtcatttttgttggacattccctcttcatcataagtctgatgttcaccagcacattgtggattttgttgcatatacacacacacagtttggtcgccatttgaaatgcatacaggcagacaatggcgctgagttcgtcaaccgcagcaccacctccttccttgctagccgcggctgcctgctccgcctttcctgcccatacacatccccgcaaaatggcaaagccgagcgtgtacttcgcaccattaacaactcagtccgcacccttctcctgcaagcctccatgcctcctgcctattgggccgaaggtttagccacagccacatatctcctaaaccgacgtccttcctcatccatacagaactccatcccattccagctcctccacaataaaatcccggactactccctattgcgtgtgtttggatgtctttgctaccctaaccttagtgccaccgctagccacaaactcgcccctcgctctgccgcatgcgttttcttaggctatcccacctcacacaaaggttaccgctgcttcgacctctccactcgccgcatcatcatttctcgccatgttgtcttcgatgagacttgttttccgtttgctcgtcacccggtcgatgtctcttcgtttgattttctgctacaggaagtgactactcccaccgtggtcgctccacccgtcacgggtgtcgagcaaccgcggccctccctgccccgcgccacggatgacccggtgcggtcgtctttggtggctgctccctcggctgaggtcgagcagccgcttcttccctacacgatggtggtcccggctgctgggttggcttggccggctgctggggacccagtgcccacgacccggacggccaccgggcctcttcttccaactacggcacggctggtcgagcccttcccgcacgtctatcgacgacgacaggccacgccaccaccgcgcctcgacgctgcaccggcacctcccctagtcgtgccgcccccgccaagccgcatggtcacgcgctcccagaccggctccctcaggcctgtcgaccgcctcatcctggcggcttcccactccgctatctccccggttctgaccaactaccgcagcgcgctcgccgatcccaactggcgtgctgccatggcggatgagtacaaggccttgatcgacaacggcacttggcgcttggtgccccgccccccgggtgctaacatcgtcatgggcaagtggatcttcaagcacaagtttcactccgacggctctctcgctcggtacaaagcttgttgggtggttcgcggctactcccaacaacacggcatcgactacgacgagaccttcagccccatcgtcaagccgtccacgatccgagtcgtcctcagcattgcgacctcacgatcatggcccatccaccagctcgatgccaagaacgccttccttcatggcacgttggacgagacggtgtactgccagcagccctccggctttgtcgacccggccgcgcccgacgccgtttgtcttcttcagcgttctctctatggcttaaagcaagcccctcgcgcatggtaccagcggttcgccacctacatccgtcagctcggatttgttgcctcgacctccgacacgtccctctttgtctacaaggatcgagaccgcatcgcctacctcctgctctacgtcgacgacatcatcctcactgcctcctccacggatctacttcgcctcatcaccactcggctgcactccgagtttgccatgacggacctcggcgacttgcacttcttcctcggcatctccgtccggcgctcctcagacggcctcttcctgtcccagcgacagtacgccattgatcttcttcagcgagccggcatgtctgaatgccaccccaccgccaccccagttgacgctcgggccaagctctccgcctccgatggcgcccccgtcaaggatccgaccgagtacaggagccttgcaggagctttacagtacctcactctcactcggccggagctcgcctatgctgtccagcaagtctgcctcttcatgcatgatccacgggagccccaccttgccttggtcacgcgcattctgcgctacgtcaaaggctctctctccgccggactccacatcggcaccgggcctgtcaagtctctgacggcttactctgatgctgactgggccggctgtcctgactcacgacgctccacctccggctactgcgttttcctcggcgacaatctgatctcttggtcttccaagcgtcagacgactgtctctcggtctagtgcggaggctgagtaccgcgctgttgcccacgccgtcgccgaatgctgctggcttcgccagcttctccaggagcttcatgcccccatcgcctctgcgaccgttgtttactgtgacaacgtcagcgctgtctacatgacggccaatccagtgcatcaccgtcgcacgaagcacatcgagatcgacattcacttcgttcgggagaaggtggctctcggacaggtctgtgtgctccatgtaccgtcgtcccatcagttcgtcgatatcatgaccaaggggctgcctgtgcagttgttcactgatttcaggtccagtccttgcgttcgtgatcctcccgttgcgactgcaggcgggtattaggaatgtatagccatatatgtataggattcttttgtatccttagtttccttgtatactcctctaattgaggatcctgtatattggaaaggctataatatatggtcaccccccctctttggggagtgtggtgttccctcctattctctctacattttcaacccaaaacaaatttattatcaaaatatattaaattattgatttgatgacactaatttagtattataaatattactatatttgtctataaacttagtcaaacttgaaacagtttgactttgtccaaagttaaaacgtcttataacctgaaacggatggagtagcatttttccattaaaattttataccttgcacgcagtaaaattattagtcttgtcctgccagcaccctccattgctctccaaacattcatttgtttggatctctataaacgagagagcaaggtaataaaaggagagaaaaatcagtacagcatcgatcaaaatcagtaaacttcataaaatgaaacataaaaatttacaaaccttgactcaaacaaacatcaggttcagttgtctcctcaaatcctgagcatactgcttttaacacagcacttttctccagcttacctaaagagagactattatatgacataacaggctacagcatcgagctaaagaaaaattgcgcaatagatactactagtgcacctctgtactgcttgttgttaacgacaagggtcggcaatatagtgacatctcctcgagagccttgaccaatctgaaaggacaaaatccacaaagatcaacctaccacagaactattgaataatttatgaatgaacagactctacataacaaaaacattatgattagtaatcaatagtctttacttgagcatcttgttccgctttaagcacgggattttcttcatcagcttcagggtctcccacacacttgttgatcctctcaaggtccaatcctgtgaaatgacatatcaaatggttcaaatcaaccatttggttcaaacaataaagcaattatgctgaacaaagttaactacaccaaccaagtgacttgataacaccattagcgcattcacgcgtgtatttcttctccttcattgggcacctaattgaaaaatcgtgtacataatcccaccacacccatggtttgtgagtttcattgccaaccttgaacaagcaaatctgaatcaggttctgaagcacaacatcttttccatcatatccaatgttgaaatcctgctctggatctggagcgcagtatctcccatgattgatacactgagatctgcactgcttgctcaggacaaaagcttccggacaataccatgtaatgtagtgaggggtgaactgagtgtaaccccttttctcaagaacctgtgctgttcctctgaagttcctcacaaaattcatttgcatgtcacatttggcaccacattcatcgttgctgtttgtccagaattcatactctacacgctcatcaggatgagggagagattccctccaatccagaaggacattgaccatatcaccgttttccagtgctttcttaaggtcgtccccaaacttcttcgttacaagtgctgaaggaacagtaattttctctatgtaatctgtgccactagactctggagagtccattgttatcaaaggctccaatctatcatcggcaacaagaacagctgcagctccagcggtttgagcattccatccctttgttgtgaagtagcagtctgcacatcacaaagaattaaagatccccactttgaacaataaaatctgctttaacagttacattacgcctaagaaacaggagaaaagaagttacagccaaacatacaaatggcatgactacattatttttatggaacacaaagatactgatatttcttcttccataaaatgtaattaccaacaaataatgcagagttgagaactttcacctcctgtttaacctaatattcagaatgaaatccactaggctggttcacatatttatactgatggccatatatacagttctatgtatagtgtccatttctagctctaaatcgccttctatgtgcagcttttctaccaataaaactgtagccaaagcagtgacataagttgtagagcaagacctttgaaattgcaaagaaagaaaataaatcctttttgaaatagcagtagccgcaaaagctaaataatttggacagtcaaagcacatgattttattccctgactcactcaaaaagcacaacaactaaacgtaagcgtgcacaatctttctctaaacaagatttgaccatggaacccagctacttacccaaaattccaacaaaccatgtaccgaacttacaagcagatagagaactgcactatatgccaactaccaaatcaggtaccctactaattaggacaaaattgcatatgaaatgacaaatagcgtgtatcgaattatcctagttaaggaaaaatccatgataaaccattagacaataaaaaagaactaaagcagcttgtaatgacagtgcacccctctgccaaacttattcactgacagaatatggctacagagtacaaaatgaatcgttttccttaaatggactgcagagtacatagacttccaagttccaaatcattttgtttgggttaggagttaagagtagaacaattcaagaacatgttgttattaacattaggtgcaaactttcagtcaaaagaaaaaaaaacattaggtgcaaactgctagttaggacaaaatgagaaaaaaaatgcgagtaacattattaaatttctcatatcctagaactagaagtgactgttagctaggaccacattcaataaataaaataaattaaaagatgcgatatttaaaatcactcacgagagggaaaataaatctcccccaataataaataaaaactgaaacgggttcgaataaatcaagaaagggggaggacctccgcgatcgacgaggaggaagatggggaggccgccgggcttgggcttgaaggagaggtcgaagtcgtcgaaggacctgcaggccttcttgttggccttggggtagacgacgaccccgtgcatggtgcccccgtactgcggcatcccgaagttgccgatggcgcactcgtagacgccccggagccccgccggcgacgtcacccgcaggctgttcttctccaccacgaacctccccgccgcctcccccgccatggacgccaccaccacgagcagcacggcacaccccatcatcgtcatcttctcccaattaatcctcggcaaaagaggattggggatcaaagaaaagatgggttcttggatcgagctaacgatcgatcgatcagaaatcgcggtttgggtggcgtggtggcttggtagggagaaaaggcgaggcgaggctttcgcgggagcaggagtgcaataaaggaagcctgccctacgaaggatttgaccgggagctatcggtatcgctattgctaatttgctaggattgctaaagctagcggagtgagatgagatccggagatagagatgtactccctccatccaaaatatttgacgccattgactttttaaaaaatgtttgaccgttagtcttattcaaaaaatttaagtaattattaattctattccaatcatttgatttattgttaaatatacttttatgtatatatatagatttacatatttcaaaaaaaaatttaaataagataaacggttaaatttgtttaaaaaaatcaacggcattaaacatttagggaagtagggagtatgtacgtggcgagtgctcgtgggcattggggttggaagttggaacgcttccaatgcagatgtgtcactgtacatgttctattctcttcttgctcgtctcgtcttttctttgcttttgcgtctcgtgttcgtgagcgtgagtatcgatatcgtgagggctcggcgaccgggcgcctttatgctagaaaattgacgcgccttatggcgcgataagcatctaacccgtatacattttatagaacacatgtaaaaaaatatataaaaaaattaaaaatatatttttacaacatatatatttgtattgctaagatggctcgaaaaaggttatcattttcgctctagatggtagaaatttccacattagtcactaagaaataaaaaagatttggaccattagattcaaaacaaaaaactagcagttgtatatgagatccaatcatattttaaaaatcttttgattagaaaatacaattttattttaaaaatagaatttatattgaatatagttctacttttaaaatttagcatcatgcaatttacagaacaatccgctagtttttaataaaacatgaagtaaatcatattattatggaatccttcaaattccactatttttcatccaaactgtttaaggctcctttgtttgtgtaaaattataattgaattgtctactgaactaaattatataatacatgattttttgaacacttggaaaaaaatatatctcaaatgtgatacaaatcacgaatctatcgttagcgcccatatttctaaccacattatttatattttagaccgggccatatattttgttgtcttttcctttttatggccataccggtgaactctgtcaaccaaatctgcatccaaccagcctgcaagtagtaatacactcacttatgtttcttctagaaatcaccagggtcctctcaaaaataaaaatcatcgcatggattgatccactggacttttctggattttttttctcaccaaatagatacgtgtcaaataattagaggggaactaatcagctgacaataaagattatatagagagagataggaaggatcacctctctatgtttctcaaagagaggtaaatttctagaaattgtaccagattgacacgtggcaatttttggagatggttagctaattttttcaggctgccaggtggcccaataatatgccacgatcagcaccctgcaatcgatatgtaagatatcattaatctggaaaagctgtctgtccaaatatatactttattttaatttttatgtaggattgtggatttatgtccaacgcttacgtccatttaattaaaaaaattattaatatttttatacagttattagatgaataatattttatatatggcttatttttctaatttttttatgattttaataaataagacggataattaaactttagaaataagatctacggatagttacggatagatagattcggggatagcctagatgagtcaatggctcgccgtgtagtacgaggataaacctttttagatggtcaacggcaggtgacagcgacagcacgatcgccatccgacggtaagtgtcaggcaatccaggtgcccaattctcagcatccaaggtgccaattttttcagcctcttttcaacaactaaccggagactaatttgcgtcaataaatgaagacagtaacagataaaacgacgccaagacgataaaacagtaaatggttcgatactcaggagctagatatgatatatatccatcgatggatcaattcatatgaaggcagtcagcacgcatacggcagtctgaaagcatgcatctacgacaaacaatcatcaggaccacgaatttatatcactgctaaaccaagaaaaaggtttcgctgagatgagaaaaaaccaagaaaaaggtttcgctgagatgagaaataactcaatataatcatcattcccctcctggggtttacatgcaagagaaacctacattaaaatcaaacaagggaacatgactgtcttttatattatttgcagggtcatccaagttctcttcactcagaaatcatcccggaaacgtaaatgtatcaaaagttgcagccttccatatgcctggcagacttatgcctctggttcgggtttctcaaagaaagttttcttaatccagtcaaatggctgcacaagaaatcaaaagaatattcagaaccggaaagatcatcacatttaagaatttaattgttcacaacaaaaaggtagaagacaacacattaactgcaaaactataacttcaacacagatcaaagttaagagcggaaatcccagattatgtatcttgtaaccagttgtgtaactcaagttacatgttaacaggtagagtaaccccatacataacagatcacataggtataaacgaatattctattcgcatgtttcaacaatgcagcaaaggcctcccagattctaatcacaagaggctaaaggaaagtaaggaacaaagttttattcgctacaaggagcaaagtgcaggtttcagcccaacggaattccacgtcttaggcttaaaaaactaggaacatattccatgaaccataatgaacaagttatatcatgtgctgaagctctctcagataaagaaataaagcacccagacagaaaactgtgttggaacccaagacagtgctaacaggccatgtagggtacatttagctacacaagttagtcacacagcaaggaatcaaatctcagtaaaagtaatcaggaatagtgtagtacataagtcggtcaattaaaattcaataaccggtttgcacagaggtcttgaaagagcaattgctggggaaagctcacccaaaaacatagactcttgccttgcccaagggccatatcacaaagtacaggtaaaaataaattgactgatccaaaatggcgaatttgtttggctgtatctaggggctcctatggtgagtttatgggcatatattggttatgttgaactgtcaaagattttatcagatattcctcctaggagagaacaggaaattatacatcttcactacaaaaaagcccatcagggtaaagcaaatcaaggtagtgagcagaaaactagcaggatctcgtgaaagcaaaattatattacacaactacgataactaaaagtttattatgttatccatcaaatgttgcaaaattcaaataatgggatgtatacttgcattagttaccgaattgtacaatgtaccgagtttaactgtcaatcaaagtttgtgtttttgctaaactttcttctaatatatgcctattaatcatcaggcaaaatatttaatggtatgaatatcatcacaaagttatataaggcatggtagacacagccaaacagcaattcctgtagataaagttgtggccttagtctccacagaatcatttcttcttcccccatcaatttctctatcagatcaagcggcaaatttgactgcaacctacaaaccatatacgtaatccgtgtaacgcgcagaaatcataaggtagcaaatcgaacagaggagccctacgaccgatccaacacgccacgcagatctagggaccgacaacatgccaaacaaacatgacagatcctacctacaaaaaccaaaccctaacgtcgatggggcaaaacatatctacggatcaagacatccctacaagctggggggggggggtataaaaaggcgtcgtggatcgaaccccctgacctggacgaggtagatggcggcggtgccggcgaagacgccccaggtggcggcggcggcgatgtcggtggactgggggcggcgccgtggagagatgaagcggaagaggccggagctcgacgccgggagagccatcgccgccgcaaatctcgtcgcgtcgactcgacctagggcaaggtaaggaggaggaatgcgagaggaaggagacgacaagggttgcggaattttgttgcttgttctcatccttcttccgcgtgtatatgggcctaagtgggccgacgggctgaagagctcgtggtagatgggccggatacactatgggcctgaaacagtacgggcctaaaggccttaggtggtgggttcatctggccttattgggggacagaataactcttgtcatttattcaggcaaattttgttcagtttttctctgaaaaagtaactgtaggtaaattatttttttttgagaattatacggtacaacgcagacactcacaacgcacgcacactcacccctatgaacgcacgcactcaaattctacccttatgagcatcttcgaagactaggccggcaaatccatcttggagattgacgaagtcaccacagacgcctcgctgtcgacggatacgtcgcctaccactgaaagcacaaattaaagccgttaaatcctggaaagacctaaggttctactgaggctcttataagcactagactacaggctctttcgcaactgtaggtaaattattgtgtccaattggattataaaaagtaggaaaagttgctgcactctcagataaacataatcaaattaatacaggttctaattgagcaccaacttgctatatgaaaactgaacttcttcgcttgccgtcttaaaatgtgttgccttttggaattgagtatatatatcacgacaatacagtatgaattagctttacaacaattctccttacaagttgtagtgagtcttgacgatgaaggtgaatcgagacaaaaacacccaatagtgaaaggagttgaatgaaacgtacatgcacgcatgcattcagattcagttggcgaccaaagacaaattcagtagtaaactctcgtagtgtcgatacctatcaagcccagaattattgagccatactttgagctcgtgccacagaaatgtttaatctgatcgagctgatcttaacttttttgcattgtttttgtggacggatcagagtcggtgaagtgaaaaaagggaagaaaattcagcagcacacagtcactagctgagtgtacttgcgtggcaggtggtttttatcggcaagtaaaatccctcgacctaaaaagcatgctcttagttgagaataaacaagtagacagcacatcgttctaactcgcatatccatagttccaaaccggcagattcactgaaaggaacctatgatatacaactaactaacgattccattatatgtgttgcttaatttaattgtaaaggtcatgggagtgatcattagaacaggctttcgacgtaagaaatacacttgaatcgtattatttatatttacgaggaaaagcagaaggatccaaagttcagaacagtaatgcactatctagggaatgttcggaatgctttcagaatctctgttagccaaatcaaacagctttatgatctttagatcgactttcattagccttgagtgtgttgataaccatgcatgtccttttactgatcactagctagctagcacatgccaaagaaaaaaagcaccaaggctttaattttacacgtgtaaattcatggatagaaaactggaaatggatacaaaaaatattctaaactatttgtgaaagagatcgagatcgatcgatcgatcgacttcagaccacgacttggtcacgaagttttcactgctttcgctcgctagctacatggttatcgataacttggagagaattattggatttgttgacttaattgagacaaaaacatggacgagttttgtatatgatctatctaaccgaaagaatagttcgtcgttggggtccatacaagcacgtgctaccttgcttccgctgttgaaatgatcaaagtgtgtgtattatatgtgtagctagagccatgcgacctaatgatcgacaatgtcaacttcaacctattaatgtaggcactatacaacaaacaagagactcaacttgactctctagatatatttatatgagggtcgacttatgttcttacgcgctgcaagttgagaattaaatttcctctatgttttccaattaatcgttcgtgcaaataatccatatatatgcacggtctagaactgtagatcaagtcatcgcaagtgaaaaacaaaagaccaatcaatatctattccattatctaaatatcaactgcttcctgagttccaataactagttactgagctaatatatacctccgtatcagaatatctccctccgtccgtatcagaatctaaaaatcaccctagatgtgtcccatccaaccaaaacttattatattttgagatggaggagtaatttttagctatttatctgaattattttaggatgaatggagcaattaacttgatctaatacttttattaaaattaacttatgttgataattctaaaactacaattacacgtacgtacaggagaccatacactgtatgcatcttgaccatacattggatgcaggtagacacatgtaacaagaggctgaatgaatgccacgtacgtgatggatatatgcagtaattaattaacgcagtcttccgcaggatcttaatttgtttccgatgtgaagtgttttgtctccttgcatgtgtcgattgattgagccatttttcaagtacatgacagtacctataaacgcatgcactagctagctactccctccgtttgtatatcataagtcattttgattttttatagttaattttatttaaatttaattaagtttatagaaaaatatagtagcattttcaactcaaaacaaacatgctatcaaaatatgttaaatgttagatttaatgaaactaatttagctttttagatgctactaagtttttataaacttaatcaaactaaataaagtttgactgaaaaataagttaaaacgatttataacataaaacaaaaacaaactgaaggagtaattttaagtagaatgtaagtcaatagtctaagtcttcggggtgaaagactttgataggtggaaatggacttggatggatcggagggagtagtgggccgctaatacgaaagtttgttgtgacagcaacttctgaattctgaaaaaactaaaaagcttttccaaacttttgttgtcacgggggggcaacgtggatatccatgggtccaggcaagcatctattcagagaaaggccttttagagcttgcaagaggttagtggcatgagtgcacaatctaaacaaagccacatataaaaaatattatgtgtagttcaagaaaattataaattatgtgcagtagcttaaagggcataaattaaaggctaaccacgaactggattgataccagccggcaaaaccatgtacaataaataactacttcatcaaatagttgttaactaaactatgctttaaattaaactatgctttcaaattaatcttatcaaaatcttgccatttcctctaagatatagaaaggcgttgtcattggcatgatactaaatctgttaagattcgattcacacatgtgcaataatgctaatctaattctgcaaattcagcagcaagctatactatgcatacatgatcgtaactaattgacagagcagcaacattcttgttccatatgccatgcatatggtagatttttccctcgaatccaaggaggaatgacacatatagagttaattacactatggtccaccttttgttaccaaagttttattttgggctatcctctaactcatattttcactttggacctttggtgcacttttaaccacccaaagtcattttatgtagctgcatctactctataatattgtaaagaattgcccgtgtaagttgaaaaagattaccggtttacaggttgctgatgtgtttaaagttggaaaattcatttatgtattcctaaaaagtttatggggtggtccaaagtgaaagaaaggtaaagtaacctagcccaaagtgaaaaaatgtgttaaagggtggtccaaagtgaaactttggtaataaaaggtggccctaaacgcaatttactcacacacatatatataccatgaaacttttcaccatacatctatggtgtcacatatgcacattaatttatcactaagaaaattcaaacccacgaaataaaaaaaagataaatttagctgtaaattcttttccacaacttttataatctgtttgaataacattatattttggggggtgaggaacatatgcatgcaagggacatcttgctccctataaaatgaccactctgaacaaaaaaaaagtaacagcatgagtttattggagtttttatctagacataaatttgttgtcaaatactccctccatacttgtaaagaaagtcgttttggacagcgatatggtctctaaaacataactttgacttcttgtttctataaaagtatttattgaaaaggtgatatacgtatacttttatgaaagtatttttcaagacaaatctattcatataatttttacattttcaaactcaacaaattgagagttatttatgatttatattcccaaggtttgacttaaacattgttctaaacgacttcttttataagtacagagggagcgtacgttgagcacacacacttcaatttaaagttggtttatgcgtaaaatttccccgctagctagctagattctttcttgcattttatatattgattgttatgttccaaatccaattggacaaactaaattaaattagattagatctttcatctagttatttttggagcattaaatgacctatatataggtagcgcaaaaggtaacacggagtatatattactttcactactatatattaatttcaaattatgtttcaatacttacaaaatcacatacacacaactcactagtacagcgatcaactaatacacatatttactacgtaccgtatatatattggatttcctccaatagcagtacacacatgtactacaagtattgctaatttgctatagcctcacagcaatagtattatgcatgcatgcatacacttctgcatgcaaatagcggacttgtttttcttgaatattagtagtagcaataattagcatggcaagaatgtatgcatgcacagcccttgttaaggatcgaagccaaacatgtcgtcgtcatccccaggaagattcccaaaggagccagtcatgaacccgaggctgctgggagaggacgggaagctgccggccatgtcacctccggcgagccctgacggccagtcgtaatccgcaggcgctgaacccacgatcgacgtcgacggcgttgtcaccgccgatcccaccacggcggagagcggcaggctgctgctgagcgccgccgcctcgctggcgcactccgaggacagtaccggagagtggcagttggcgaagctgcaggacggcgtcggatcaacggcttctgccatcaaacgatggcggctctgacgaagagggtcgactctgcttgtgctcgcgccgccgctggatccgaagctgatgaggttcgcgtagtctgcagcgggagcttcggcctcgacgacgaacgggatggtggaagggtcgctgcaggtgtgctcaccgtagtagctgatgacgaactccgacgagttagactcggaggtctgtacttgctttgtggccatacaaccttggtctggcctatgcgtgcacctgtagtagctcctgcagagagatcaacaactagatctttaattaaggaatgcaagctgcaaaattgcatcgtatgatgctcctgaatagataacatgttacagcaacgatttggtgctaactatgctatgttgctatctaataataaatacacagttcaagttgagcagtattttcctactctttttagtaattgcaacaactaactaatacagttcaattgaattaagcacatgtgtattggagtagtatatatctaactatgtgaagctaaccatgatccggccggaaccggaagatcggaacactattctccaattaactggagtagctaagcgagttgtccagttgcattggcaagtgttcgatcggccggtacaagggcctttaatttcttgctgggttaatcatcattacgtactagctaactaccatgcacaagggcgaagaatctggtcatgttactgcagaattagttgaataatctatacgtacataccttggattatttggggagtcctgtatatgtttctgcccgtactttcgccattgcctgccgtcctccagctccttggtcgtgaccatcctgacaaaaggacttttcgatctgccacatgttacagcagataggagcaactatcatatccagagacacacacccaaatctccactagcatgctcggcagaccacggtatgtacgtatacaagagtgtcatatatatagctagttgctcatagcttttggtcttttcaatataagaaacaggaaatgatcttttgtgagagaagaaagctactggtagtaaaaattcccccctgatcattggcacgtaaagttaagattaaaccccactgctagacaaggcaatatactcccaacgtactctccaagttgcataaaggaggtagctagcatgatgtgtgaatcgctatcatatatatgggtaatagtattactaccgcatgtggtaagcatagctagctagttgcgcatccagttgcagatgattattgagaaaaaagggttttaactttcttcaccttcttctaccggagctgctccgcctgtgcggcccggccacggccttggcgcctttcttcttcctcccgcccgatcctcttcttcctcctcctcctccaggcgacatcaccgacagcgagctggactgcagcctgctcatcaccccgtctatcagctgattcagctgcctggtgctcgccgccgccgcacagctcgacggcgatgtcccatgtagcatgctgtggagcatcgccgcttgctcgcgcatctcgagcaggtcgtccataacttcatgtggctccgcgccgccgtctccaacgccaccatcaggagacgccatgggaggagccgctactatagctaattgctgctgctagcagtctagtattactaggaaagctagcaaagtaggaactagatattctcagctttgctactcttgtattgacacctgctcatcagccgtagctagactgctagagtagataggttattgggcagcagctgcagtttttattggtgtgctcggtgggaagttgagaggaaaagtagacgacgagggcgatcgggagggggggaagaggaagaacaactcaccaaaggaaatggcttggaacatggaaggaggggcccagctggatgtgtgtcgcctgtacgtcatcgccgtgacgaggccgtgagctcatggacggtcggttcatgctccatgcacggcccggctggtgctagtgaacccctgagaaaaaaaatggcagtactggaaatcgtatataattaagatgattgtttaatcactgggaaaatgtggaatggtcctagctagctcccaactgtggtggagaaattcatgcttggttcttttcatttatatatggtatatggaatgcatagttatattgcaagtgcagcagttgtttaatttcaagccattgcatgcgttagatgcctatcttcttgtagatctgatggcagacaatttttcactactacttgcctagtgatgatgctagcactacagctgttattagttgatgtatagttgtcactcatacattttctaagtggcatgttggcacttgaatattagaagttttcacttagcatgcagtgcaagctaactgaaggacaagtagaagatatacacgtgttacctttgctccttcactggtcatgcatacaagtcatcacacatccggtacaggacgttgagggataagcaatatatcgatcatagcaactataaactctctcccctgctccctgaaaataatgtttctccatccattttgtgcactgtacgtgcacacagcagcaaattgtccaagtggagagcatctgctatctgccaaaacaacaactgctcaaagcaattttcttacgaaaacatttccatctaggtaggatgactggaaacaaggataacggaaacacccatggagaccacccccacattagtttattctagggcaaaagcccctgcctgtagtttcatttcttattatatgtgtgggaaacactttctcccacgtactttttcgttccaaaaagaatcggtttttagatgcttgtaagactactgtaagtacatattcaaggagaagctctgaacttaaaaaaaaacgggggaaacaatgaagcaggagaagagaaaatattgcccagctgcctgtcaacttgcatagccgaatagcactcgacgcaagccgacatgggaaacacaggcttaccacaggcatagaagaataattaggaccccaaccacttcctaaataatgaaagtaaataccccccatcggtaacagaaacagtatatgtgtccataaatctatgtatgaagacaaacatatagtggaccacaaatgacaaaagaaatggcacttctcggcatgtgagtatgtgacaactgtcttccagtaagaacaatagcttgaccaaaaatgatctgaactgatctttcatttactaaagcaatgttcataaacatgtacacatgttaaggatatttattacctatcaaaaatcaaaaggaaaataagacggcgggttttatacaatgatacacatgcttctgtcaggctaactaactaaatttcacaacatctccttaagtacatacccgatgctcgggggtgtcctaaacattctatcactgatgccagattctaatataatgatccgagaagctccagaccatagtatatccctaccttctgtaattttaacataatttagaactaagaaggcaatcgataaatccaattaactaaaatatctacagcatcaattatttcaacctctttcattgcctctccgagttccagttgaaagaataagtcagctgataacttaatgctggttgtcatgttgctccaataacctcctttcagcagctaagccagctgcaacagatggaggtaaacttctcatatgcccaccggccccaccgtaattcttattctcctgttctgaaggctgatcaagtgttgccacaggaaataaagactcaatatccttcagtgtcaaaacaagctcatctttgaaattttttgatttacggtgtatcgtggagcaaacagctctgcccctgtttaatttgtagatgctctcttcaatagtattcttcacctaaaaacaatataatgctttaggaatttctccatggatggtttaaatgagatgaagtagctcaggatttggtgcttacaataaaacggtggataaacgtgcttttgtcttgcccaactctatggatcctgctgatagcttgcgcctcagctgcagggtttaacaacggctccactaatattacatgttgtgcttccaaaagattaagaccatttgcaccatgctggataagcattagcaatacttgagcaggttgcatcttggaaaatgacttctttgctttctctccacttatactacttgccagacctttgaactgggcaagcgctgtttgcgattttctgtgaaaagtaacacactttcagtaaccccattgtcattgtccacaagattcaagcatatagaagaggaccctccttggtgataatcatctagcaataggactagaagcagagtagggggaaaaaatcaagttttaacttaaagaaatactccctccgttcagaaatataaggcatattatgtttcatcaggataaggctttgactaacaattgctttactaatatactccctccatcccaaaatatattaacttctagcattcaaaatttgtcccaaaataaaacaactcctccacctacttcttctcaaccaatcaaaaccctccccattgaatttctccacttactccatcttcttaactaatcacggcattctcccatttaattccacctatttcttaatatatgtgcccaaccctaaaagttcttatgggacggaagggaacattatttatgcgacacaaaagcataatcataagtaagtctgaatacgaatctaacaacatcaattttgtcacaaaaattatatcctaatagagtaattgttgatcaaatccttgtcctaacaaaacaaaggaacaaaatacaatttatatttttgaatggagaggagtataatcttgtatgcactttgcgctaccttcaaaaaatgtgtataaacagatatacaatatcattactcagctcagcatagtgagaaaactcagccttggttacgagtatctcaccttcctcctttcatccgaacataagagatattgttagcggcaagggagtgctctagcacatcaagaacatcattccagcttgaaaaaacaagtattttggctgctccgtcagttgaagtgatcctcaaaatccttcttgtcacagcttcaatcttaattacaataaatcaccaaaataaattaatcagttattgcacccaacctgaagatagaactactaaggagcatgagtttggtagtttggtcagtgattgcacgtgcattcacattgcaccaacttttatgctctgtagaaaaattgtgacaatataggcaggtctgtgcctatcttatcagggataaaaaaacaattgtataattaggaacttactttgtgttatgagcatgggtcagaatttctctggcagcggttttgttcacgctgaacagtaccacacagtacgccattaatttaggtatcaggataaatggtttttatattgtatattcccattaaatttttatggatatactcgtttctatatttgataattgcaagtaccaagcaatttaagatgacatgaaatctatcgtatacatgttattatattaaaatagggtaaatatggattaatataatgatgttgattgatttgattctgctatgattgtatgagaaataaacctaagagttgtatattaaatacaattctactttcaatgcaattttatttagctctgcgcaaacgcatgggaaattcacctggttagttaattcaaaaggcaattacttgctttatgcaaaacagtaactattgccttctatgcaaaaccagtacaaacagacatgtgaagtctaaacaaagttgctatgcagtatctgccttctaaatgtaatatagcaggttgtaactcaataagcagtaatcagatatttgaaatgcgggacatataaacaattacaaggaaattaaataaaacctttgttccatatgaaccttggacagaaatagcgctttctgccaaatcctcaatttctctatcagcatttcctctctggttttcaactacaaaagcaacattttcaagatctgtacgttgacggcaagtagggcacataatccattttttgctcctcccaaagtgggctgcagcttgttctgtcatgtaaagacagcctgagagcagtgaatagataaattcagtaaagatcaagagtttagtatacatcagatgaataaaattgtcatggatagatcagcatggaacttggagttggaaaattgaaagatcaacagaaccaatctataatacaaaacataggcacatgtgttgcatgcttacaacagaacagaaacagtagaaacattaactacgtgacaagttgtctttcttccactgaaataaatttaagaaaaatagcataaaagtataagttgtaaataaaatagaagacaactcttgggatactcacacttgcagcaaacgaaatggccacattggaaaaccattttctggtcaaagatcttctcctgacaaattgggcatggttcattgataatatcagaagcagtttgccctgtggcagggatggaagttgctatagcaacactgttgcctgactcgggcagtgattcaccatgcttgcccagtggtttcttgttggatagcaccaatccctaaaagtaaataaaatacaatgagaatttctaaaataacagataagatgggttatggattcttatgggaaaattaagaaagataatgcctgataataaagtagattctgtattgaaaggaggcagttatatacttttatccaagtaaatgatgagagctgtccaggtggaaattatacagttgagcagtgtttagaaataaatggaatgtagaatatgtaaaatagaatatcaaattcacggcagagtgcaacccatgatagcaagtattgacctttaagtatctgagttggcctcttatacgagctaaagatgacaaagacaagaatttttcacttgtaaactgcacattgtatggtataagctcttctctagtaacaatattgactgcactgggttcatcatctttctccttgagctgcaggcgtgagagagacatcttgatctcatcatgggcacgcagtaactgggtctgtgctattgatagattccttgcttgagagaactccttgcgcatagcctacattagcacataatggtcagacaatatcctatctcgtggtatttttgaaccttcacattttagactaaaacatatggatcacttagtaaacaaagattataaggtttgacatgtggaaaggttcctaattagattcacctccatctttccatatgttctctagacattacaaatgcaagtgatctaacaagacaatagtaaattttacattgatgcaggttaatgataacaaaaagaagttctgctgcaggggggaaaataccaagacacagtaaaatagagataagatactcatgttttatcattccgactcaataataatgttttgtttgcttttaatttactacaaaaatcaagacacagcaaaatagagataagatgctcatgttttatcattccaactcaaataataatgttttatttgcttttaatttactacaaaaatcaagacacagcaaaatagagataagatactcatgttttatcattccaactcaaataataatgttttatctgcttttaatatactacggtgataaaatttatttcagcaactgcaattaccagctaaaacatgtcagaagagaaggcagtgacattaaaaatattttctgtacctcaaaaagcagcaaattctttttagcaattttagcagattgctctcccattattgtctttgagtgggttagaataacccttaaggaagtctcaattcgagaaggatgcctgtagacctgtaaacagcaaccatataaaaacataaaaatggtagataaaacataaatggatcactatatatgcacttttaattgccatagaaaatccaagaaatttataaaccatttcaaagtaatttccgacaaatgaaaagttgaacgaaatcatatctgacacttgataatatacaaaagcgagttgatctatacaggcagtagtgcagtacagtcttttttgacagaaataagtcattaaccatttcaatttgataaatagaaataacctagttacaggaacagagtggtgggggcgaaagtccaggaaccagaagcaaataagatgtggtctaactaccagatctctagtagtttagactaagaagggaagtttaagaaacaaaaatataagacccccaggcacaggtatggattaatcaaatgaaagcctgaaaggtgacatctgcttagctatatttcaatataaaagacatgacaagatgataccagaaaaccttctcgagcagatcttggattcttattgtcgtcaccaggttcagatccctcgttagttttagtattacgaaaaaactgattcaactcatattttcgcctttgcaagtcccttgcttcctctactgaggcaataacagaatcattatttgatttcttaacaagaaacagacgtgcttcatacccctacaagaattgatgaaataaatgcatgatcaacaagcagaagtagggaggtacctcaaaaaacattagcatataaaactacctgaaacagatcatccaattcacattggatgcataaagaaccattaccatcatagcaatttggacaatatcgctgacactcaatgtcttcatcctttgggctatccattgttttgtcaagttctaaaagtctgtccatcacttgttgccttgaactttgcagagaatcaataccagtttgaatggtatacttcaacccagcaatggtttgaaccctaagcagagaacaagacaaccaagttatccatcaattgccataaaaggttttaatttatacaacctctaaacaattaaatcactgcaaacaggaaggacaacaaattgaatggacaaactgaacataattttctgctgacctggaagacatccctgttgaacccaagccagtggtgcttttattggaagaaatatcaatcttcctaatgagctcatcagcagaatccttgttctgttcaatgcaatccaaagcatacagccaccaattcatattttgattctgtaactccatactgagagttgagacctagaagcagaacagcagaatttcattatataaatagtgatgacttctacattctacaacactgaaaatacttaggtggagagattattgttatagagcattacaaaggagacatagaacattccaaagggggaagcatggaataggagacgagaaaataaataagttaaaatcgctaggtgcaactaaaatatagcagtaaaaaaacaacctctgtgaatgatgcactgaaatctttctgtgctattagtagctttgaagtaaaaactgacagatacttttctctgattgaattgcaagtatttttcaaacaaccatcagctaagcatacagatgacgtgtggcatccagaatcattctctacatccatctcttcacttccacatacttgtgtattgatgtttttgtcttccttggatgtttctggattatcagtcatcaaacttgacctgctattctcacaaattttctttcgctttatgccacacagacctgagtcagcgggactagtttcctttctttttcgcgcaccatggacttcagaggtttgttcttttagtgggcattcttgcaaatactcagaactagctctgagcagctccgcaagattgtggttgatatgaagattcaacaaagggtcaacacggaaatcatcaaaattttcacaggccaaagctagtgcttctttatacagagagatggcctcttgattattttgttcaatgacagcaagtccagcaagaccattcagggcgacaacaattttcctgagctcttcctccccttcgacttttgctttcccaataagaacctgcataaaaaggataactaacaaccttgagcacattatcatgtaattacactgaaaattatatggtaaggtacataaaatcattagttgtttacctgtaaaatttcacccattgataaaggagtacgctgcagggagcagagaccgaaactccccacttgcgggtggcaacaagcttgtcgaagtttgagcagtgggactaggagtttggcaatgtcatcattggagaggtacaaatttgatacaacattcgagtctgagagagaaagggagtggcgttgtggtatttttttaaataaaggaaatacagggtggtattgtggtaactgttcagcaactaaaccacatgtttagctgtattttgattttgtatccaaataaaatctttaaggagtttaagagcattgtagacattattactttgttagaaagcaaagcgtaaataaagatgaaaatttcagacagcacatttttttcattggctggtcatatgagagaaaactaaaacaagaaagagaaaggcagacacaaaagtaatggatgaacatcctgtccccacggtatcaatctagcaagcagtaatgtgtgaagtacctgatattggctcgcttttgttggcatcatctctgatacgtcttataatttcatgtgcatggtccatgcaagtggcatgctgcttctgatagaaatattcttcaattgatgaaaagatgagccacgaaaagcactcttcttgtggaggcagctgtaactcccgtgaaacatgaattttagaggagcgccacatgatttccttgaagaacttgtgtgcataattcatagctaccatgtcccccttctgcaggtcaatttgatgaaaacacaagagagggattaatcaatccaaccatcaagaagagaatgttatcaaagcccacaatggcgtaacacagacaacacagaaaaaaaattggtgcactaagcaacgaatttgcagtgtctttgttttttcagggttttaagttcttagtatatgccctgtcacatcctcattttagccatccaaccattagtactcccttctcctcctcgttctctctgcattaatggaggcatgatagttgtttagcctcttgtttgatatgcctttgatttctaaaacaacagtctttttgggatggagagagtagtaattagccaaacagtaagatctatagtaatccagaattagattatgtaaatccatcattactactatgtatataatattcaagttctgttactatagataaagtgatcaatatttacacaagtggtgaacaatgcagcgtgacaatcttccattttcaataggtggcgcaacctctaaattaggtagcatgtaataaatacccatagttactggtagtagtcaacgtacctcatatgggtccctaataatatccacccaccatctatatgtgtcaaaaggatgagttttgagaaagcgaagaagcccaaaaagatcatcaagccggcgttgtattggagttcccgtgatacaccagcggtgttgagcatttagcctcattgccatctcagtcacagaagttttgctggactctaccatctgagcttcatccaaacatagccgccaccagtggacccttgttaggacagttggagtgacagggtacctagagagttgaagacagttcagcaggagttaagacagctattttcacactgatgcatcaatggtatatctaatgggctaacaatgggcatgatggggtacccggaacaaatatgttagtttgcctatctcagtttatacaaactagaataatcagtaaatgatacctcttttgatatctcaaaaaacggcgatcaccatcatgccgatcagaatcatgtgatagatcttctttcaggacatcataagttgtcaaaacaatgtcagctgtgcttatctcagccatatcacttttttgggtagatgttaagtccgtgttctttgcaccttcataaatgcaaactttcagagatcctggtcttgtgtgtctaagagcaaaaggagaaaccggtgagcattacaatcatcatttgcagagagtcatattaagtaagagtaaatgccgaacatttgaaaaaaaaatcaagttttgcaattagcattcaataaaaagctgggtgatcatgctgccgatatattgaggataatgacctagcattacctgcttaaacaagtctagtgaactagattacaagtttggtaacatgcaccacgatttgctcaaaattggacttattctagataaaaggcattttatcacgagtgtccttaattcttatagaagcatgagaagaacttgaattcaagtttgctaaactctccaatgctcagaatcaagcagaggtaaagaggacattatgtggcttacacagagaaatcaaaacaaggaaaatatgtggcttacacagaaatcaaaagttcaaaactatctttctacattctaatttgggagaaataggagcataaagaatggtaatgcaagaagtttctgatatagtaatgtgtatatttaaaacatagaaaatactatatcacaatactgttcaactactgtacaggtaaaagaaatcataccggattatctcagagtgccactgtgccaatattggtgatgggcatactatcagcgtagcattactagatatattagtttgggcggcttcaataagctccaagcacaatgtgcaaatatatttttcttctgtctctgcaatgcaatacctgtctttcttcttccttctattttttgactttagggttcctttttcattgtttgatgcttcatcaccatcatcatcatcaacatgcatttcctcctttggtgagtaaccaacacaactagcgtgttgccaagcgtcacatatgtcacactggatccatatcccctggtatgcagaggttacacttgcagctccacaaatgcactcaactctttctcttttatgcctctttatctgatctgctccttttatattcgaagagacagaacagtctgctgaatatggcctgcgatgtgcaaaaatgcaagccaaaagctcaacagttttccctaagcccatttcatctgtatttaattaagcacaccaaaagcatcctcattagtgacaaaaaaataaatgcatttgatttatcttaacaaacttaatatcaacataccagccaaaatgcccccagagacataaggtggagaaggttctggatgcatcgagacatttccactgtgaagaaacagatttgatgaaatttgaggatactcatacaaagaacgatttaaaattcagataaatgaaaagaaagtgtttaagacacattacattctggatgcaaaagacacttccactgtgaagtaacagatttgataaaaattgaggatgctcataagaagattacaaaatcccagtaatggaaacattgtatttagataaaaggatatacagagtaagaaaataaaatgcaaaacaaacaaaaaatgtgtctagggtaggtatataatgtgtttccaattgtctgaaaagaaccaaatagaaccttgacatcaactaagcataactgacaacaaacacaaagccaacaccatcatacatgaaaccaaattatcatttatttccttgcatccatgatggcaaaagctgatagatagttaacataatattgtcttcatatcagtcattataattaaatgaagcagtgaaaaggatggtcaatatagtgtttcacacatagtagggtctttactagcatttaaggaaaacgtagcaaaatcatgggaagtgtatgtgatatgtattaaactcttacttgaatggattgtagaacatcctagatttcttgtgcataaaatctatgggaacacaataaggtgcagaatgaacataatgttgatttggtgatgaaatcattgtgtttcccttttcacgttgaaccatccaattcgctgcacgaagttgataggttctgagatgaggaagcaaatcgggaagctcctcttccaacagtccagcctccctgtcaacaagtaaaagaaaagaaaatcataaggtaacagcaataaatagtagctacatgttttgtacaacttaagataatagaaaatcatatgcatttgcctgaagacagaatatgtttgtaataaaaataaagcatttatctcatgttggtataaatgcttcacacacaacgtcaaaaaaaatgcttcacacacaacgtcaaaaaaaatgcttcacacacttcttgaagtgcgcaattgtggttttagaccacccacaacaatttattcctaataacttgtgagataatgagatgtataaatgtaagggaacatacattgagggcttaacggcttcgtagaaagcagcaagatcaaactgagaatccttctttggggtaaaatcaccattagcacctccatttataggccgggcaagaccatccatcccatatattgcagccgaggtcatgacctcaggacgaacccaagccatcatattcatgaaactcttcctccacggatgccttgtcacctccaacaatgattcgcatgtagcaaaagcctgctccatcaaccccaatctaactctaaatgatgcaaccgacacggaatcagcagaccgagatacagcaaaggcatgaacacgcaatgtcacgaatctcaatctaaccaaatgggcgaggcctgatacaccttcatcgggaccatcaaaacatccagagaaaaccataccggcgatggcatactccaggatcacacaatctgaaggtaccacaggccactggccaagccggaaaccctcctccggcgcgtcgcgcacccgcaggcgcaacgagcacctcttctccctctctgcctcgtgcagagccgctacgtccaacgccccctctccctcgccggagatcctcacgtcgcgcatgaccaactccgcgaggtcccggcggtcgccgtcgctcaaacaccacgtgctatcatccacctcgaagcacacatcctctctcctcctagcctcgcccttcgccgcgcgcctcgatttggaggcgccgccgctgccgctagggctcggcgcgtcgggctccgcggcagcggcagcgccggggcctaggcctaccgcccgggccggccgcgatttcctcctccccatgcgcgatcccagcagattaatcgagcatccgatccgggttttagctctccggaagtagaattggggggagcctcacgccctcaccaaatcaaaacaaaaaaaaatctccaaaacctagcaatgattcgtggattggagctcgcgaggtcgagcaggaatggaattcgagggatgagatgatgggtggatgaggcgtcgctcgagagattggatggtggcggaggattggaggagctcgccgctgttatcttctcgcgaggggttttaggacgaactgaagaggaagggggaatggggacgaagggtagtcccggtaaatttttgaaagtgtcaaggttttttagtctcgatggtgttatgttgtgaaaatgcaaaattattagtgctaaaagtgttaaaggaaagaaggtggccttaaattggtgaataataatcctctaaataccaagaatgcccttcgctaattaaatcaagaagcaatcagcaaggtttcggagtgcgagcgggttctagggttctagcactgcaacggcagcgggagagagatgaaaaatcaaatggataaaagttgtgcactattagcaaggaaaataacattgccttgtctataatatacatttgattctaataaaatctatcacttcacaacacttgattttgtaaaccccggatgtgataccggtttaaaacagcagtatatgcataaatagacgtcatatactttctttacaaaataaaaaaaatgattttctcgcatatcatctacttcctacctccatctcccttctcccttaatgttatatctcatcttttcattgagaaggttttcaatccattttcaacaaaaaaaatcttagatgcacaacctaaaatcaacttaacaccctcttttctattacaaaacatggtcctcgtatattaccttgttttagcggtgatggtatactatgagtctatccccgaaaaaaactgagtctacaacaaataacaaaagaaagaagaaaatcaccttcttctcaaacagagtatttgagagtcatctgacttcagtgtttacccaataccttgaaaataggagaaagacatagagtaaagaaggagaagttatagaggagtcgtgatgacgtacaggttaagaaaaggataagcaataaggttgtgtttagatccaagggtgaaaagttttggcatgtcacataggtgttgacagaaaacacgtggcctgggagatctgcttaactccagtgcaggtccaaagctcgtctttggatgtattagcgtgccagttgatttgatcctgtaatcaacaagaaatagaagcaaagaaaccgtagttaaatctataaatgatagccgatcggctagatgccgatgacatatcatttatctttgggccgatgtcatccatgtatcgatcggcagtcatgaatacgtaaagaagaactaaatctactcgatcggctgtagatattaacaatatataatccttatatcgatatatacttaaatcaagtgattgggatagatcggtcgccataccgagacagtataaatcacttggatcgaaatatatattaataattagactatatacgttcatagcatagccgatcagatagatctagcatgtatcggctaatactccgataccactctatgttaagatgttaaagcaagtagaatatactaaacaaaagcctaatatacttaaatgcggcaagatcttaacgcaaagggcagatttaacatgtcaatcaagcatataggataaagagtagttaaatcagatacgatcggctgaaactccgatgctattctaatcggcaactagaaggcaggctagggattgatattctaagcacgacttaatagatcaaacttaactgatgcagcattaagtatgaaaagaaaaataatatctagacaatcaagccgctagaagtctcatggaacggtagatgtctcatataatctagaccaatatcaatatttaacctaatcggctaccctctattgacagatattaaccgacggtaggttagatgatgatattgctagagattatgtaaaacatatgataactcgacgaattacataaacaagattagaatgtcataaagatggaagcactaatcccgagaacgcaagccgccataacaagtttacctcttgttgaagatagaaaccgatgcagctcaacccgaaagcaagaactcgtcgaaataaaatgaaagtaaaaaagggtggcgatgcgccgaaattgtattaaacatgtgtgttttattacatagggctcagggtccatttatacccgaggattacaagatatgcccatatcggacacaaccattatctctaacaaactctaagacaccacaagtctttgcggcagacttttgcccacacttatctataaggaattcacataaaatatcctagttaatagatacaattgccttcccaggactctatccatgcgtggcaatcatcttgaagtacattaacttgaacccgatgtcgcgcacaagtcgtattgtcggaatcggcaatatcggcttatttagctcgactcagactcagccgatcttgtcgtagccgatctggacttcagccgattcctgccctgttttcaaactcgatctccgcttccgactttgcttcgatctaatcttctctccgatgctgatgttaccaaatttggttgtcaacaataggatatacggacacacgtttgaagtattaaacgtagactaataacaaaacaaattacagattccgcctgtaaactgcgagacgaacttattaagcctaattaatctgtcgttagcaaatgtctactgtagcacacattgttaaatcatggagcaattgggcttaaaagattcatctcgcaatttacacgtaatttgtgtaattagttttttttactatatttaatactccatgcatattttcaaacattcgatgtgacggggtgaaaaatttttgcgtgggaactaaacatggcctaacactagccttctcccctatcctttactgacattgaggaggtggagagtagtagagagaaaaaagaaggcggagagtgggctgtgtttgagggtgaggggattgagaagattgggaagatatgcaaaacgaggtgagccattagcgcatgattaattgagtattaactattttaaatttcaaaaatggactaatatgaatttttaaagcaactttcatatagaaatttttttgcaaaaaaatacaccgtttagtagtttgggaagcgtgcgcgcggaaaacgagtgacaatctccccaatctctccccaatctcctttgaggaggaggggattgaggagattgggaagatacgtaaaacgaggtgagccattagctcatgattaattgattattaactattttaaatttcaaaaatggattaatgtgattttttaaaagaactttcctatagaaaatttttacaaaaaacgcaccatttggttgtttgggaagcttgcacacggaaaacgatgtgctaagtacataggaggaagagggattggcaggagtttctattactacaggataaatttctactattacatgtgtcacatgactcacatgtagggtttaaaaaaaagtagatgtaactcatccatttttttaaaaaaaaagagttgaaggacattaaatgtctaggtttgaagttcatgataaattccatcatacatcattttttttccctctacgtgagcagcatttaaattataaaagctattaaactatatttatatccatgttttctaaaccttttaaagaaattctctttcgccataatgacaatgctgagtattcacacttgaaacacaaacaaacaaataaacaagagtggtgatggcggacaagattaagaaatggcatctataatggcactccttaacttacttatcatatccattgccatcaaggagttggagagaggtagagaggaaagtggagtgggagagaatatattctaggaagaatatggatgtgcttagttatttagaagccaacgctaaaaaacaaattgcgatgaaaaaaatatcataaaatcaaattttaaaatttaaattctggtatctgtttataagctatgaggcaaacgatgtaaccttagagttttaaagagaacgatgataatttgtccgattaaatattcctatctaggtttagagttcgtaataaatttgtccataaatcaaactttcccctttctgtagcatcactggagttcaaattgtaacgcagatatttaaccatatttatgttgtgtacttaaagttttaccaaaagaaagttccttttcaccgggatcgtaaagtgttgtatttacatttagatgcagcaccattacacccgaaaatgaacaaaacaaacaacctgttgatccaccaatatgaaacctacctaaatgaatccgaatgaaattcactctacctataagaattccaacgactgaaaattctgtcaaaattccagcacctgaatctatctctagttctctacactactatgacttgatcctgattgctcccattccagtcgtccccttgctgttgagtatccccggcaatggccaaccggaccctctcagcctcgacctcttcagcgcgccgctgcaatcctcgtctgagtcatcgtcgccgccgtcgtcgtcgaggtcgacgcagacgcctttccctttccggtcgtacagcgcggcggcctccggcgtcgtcctctcggagaagctctcgtacaggtcaggcgagtgctgccggaacagcaggtcgctcgccgagccgtaccccatcagccggtgcaggctggagccatgctgctgcgtcgccgccgccgccatctcgtcgacggtgttgaacgacgagttcctcgacacgtgcagcggctgctcgtcctccgtggagtagctcacgtcgacgtggccgaagtcgtccaggaacgcgaacttgtcgcctcgccgcccgtggccgcgcggcgccgccggtgagccgtcggcgctgtactgatcgccgtgcttcttcctgtcggggtcccggtaggagtagctgaggacggcggagcacgagccgcaacgcagcttgcgcaccgtcttggtcgagacggcgaagtcggcgggcacctggaccagcttgaagcagctggagcagatgatgaacgcgcgcccttgagcaccggccggcaatggttcctgggtggcgcccgccgcttgacgacctcctttgccgccgccgccgccggccgccgcggcgcaggagattcttgcgttcttggcctgcagcaatgttgtccccggcagctggtgcacgcttgcttgccatggtgaggggggcagcaaccgtgatggcatgacggcccatggcgcgcgtcgtggcagcacgggtgatcagccctgcaccggcggtagcgccgcgacggcaagccacgtggtggaggtggagcagcgagctgaccaggcttgcctgcacgagctatgtagccgggacggtggacagctgcgtgacgcgctctgatggcttggatgctcgccgccgccgccatggccgcgtcgcgaggagcgtagccttcttgcctgggaagacgaggagggcgcgcgtgcgtcctcggcttgttcagttcaggagatttactgaaaagttcagagaggtcgtctttcaggttgtccactgtcttcaggatcctcttctgaagcggcgccaagctttctggtgatcgacgcgcatggccatgaggaggactcgtcgccggatcatcctcccgtttcaacacagccggtgcaggttgtgagtctggggtttgaactgaacttggtggaagctcgacgacatcgcggcgtggagattgggatgtttcctctgaacttttcttgccttcagcatcagattcagtctggtcgcttcgttgaacatcttgcagttcggtgttactgtcttctctactctctgaaaattgcaccttgccttcagatgctctgtcactgcactgtgcatcagctgcagtagctgcatctcctcttgtgagatcttcagaattgccaacagcttgctgactggtactctgaacatgctcttcctccttctcagctggcaccactcgctctggctcaggagcattgttcctcgccgacacgagatcatcagtctcgcgtcggcttgtcatgtcagctccttgctgcccactgctgatttgagcttcaggagtggatccactggtgcttgcaacatcactggagcccaggtgcttgctgtgaggaggcaggccactccccaaagaggagggagcactgatcacctcctgtgagttgccggtgcggtttttcgctgcgtaaaaaaagcaacaaaatccgtcagagactgaccaaaaggcaaaaatccaagatcaaattctcgatcatgagcagtcatggagcttgaattcttacctcggagggtagtgccgcatccaccgcattggtacaccggcgcgccggtgggctcctgaagaacactgaagcatttgggacacctcacatggcgaaccactctggcgtctgagattgccatgagccgacaaggccacagaacatcactcgcatgcagcaaaaggtgtatccggcaggtgctaaccgatcaagctcgatgtctgtgttgggagacagttacaagaaaaatactcgtcagtgttctgcttcatcgaatctgcagtttctgacggaagaagagaggaaatccaggaaatttgtactacttgtgtggaattttgttgactgataatatatactaatacatagaacttagtttacatgcgaatacaatagtaaaggaaaatgcccggtaagccttaagcacgtaagcatcaagaagcgacatgtatgtttgaactttgaactgttcgtcgagggcattatgtaattttctaaatttaaaaactagtggtgtatcagaactctgatgatgtcattagtcctaattaacacaataactatagctactagtagtagtggagtactatacaagacgaagtacaggatttagacagaatcttcctcaacagaaagtcacggtttttgtgtgtgaccacgcacacaaggtgtaagccacagcaaatgaacgaacagaacagaaagagccggctattggacactacaagctggtagaagatgcttgcccatttccagttaatttccaaaacccttggtaatcctaggtacgttatctttcgcatgatgaaaaacaattaagaaaccaaaaaacatttctgaaaccttaagagagaaaaaaaaaagaacttgctgagctgatgcctaaaaacttgaagtagatgaagaaagcagaggaggaagaagacagtcgggtacaggagcacccactcacctatcttttgttttttttggtttctcgctttccccttcagttccagacgcttctcctagctcctgcttcgatctctcctgttcccaatcctcagaaactactcaatccgatcctcaagctccaaatttccaaaatcaatcctcagaagctccacgcttctcctgctccaactccaattcttccggctctctctcagatgcagagagaaagagagagagagagagagagagagagagagagagagagagagagagagggagaagagacagctccaattcttggcagttatgggtgcagtgacgccaggagaaacgatgctgatatatataaataaaaatgggagcgtcgtgtgaagaggaaggaggaagaagcagctgaggaagcaagaaatgatggggtttggggtgatgtaaaaatgaagcggcgtggtggagaaatatttatatgcgatggggtggagaagaagtctgaccgcttccgcgatagcgagtggctggctttggactcctcctcctcttggagaagaagaggagggcagggagggccaggtcgtttggtgcgaccgtgtcgccgacgccagtcgcgagtgccaccgcgtcgtcatatccagcgcccgcccgccgctgcctgctgctgctgtggcctactggctcgctcgctcgctgtggacttctggatgccaccgtggctactggcgcgcgtgtagagcgagggttttctggatgcctcatgacgcgtgtggtggggtagcgggagcggttgccgtcacgcggccacacggcacgcggcgcggatggggaagggatcgtgcgtgcgctgccttgtatcgtctttttctatgcccttttctctggctcgtgtaatcgtacgtgttggcggctgcagacgaggagtaaggccatccacaatgggtagcctcagagcgtgcccctgctcacggcgtccgcctcccgtccgcacaccgtgcccttggagggggggcgcgacccccacgagggggacggccggctcgggctcctccaatctccttttcctgaggcacggctcgaaggaacccgttgtggcgacctcggtgccccattccccgcctcattcccctgcattttcccttcttgcccccccctctctcacctgggcgtggtgacggagccggcgcggcctcgtcggtgtggtggatggcgacgagagagagaagcggcgccggccagatctagcccaccggcagccggatctggaaagagaggcggcagcttggacgccatcggccaccgcaccgcgctcctgctcccgctcccgcgctcgcgcgccgtccagcctcccaccgctcgccgtcggccagatcgcccctcgcgccgctcgcccgtcgaccagctctccggcgtgcgcggagacgggcggcggccggcggcagccgaagggcgcggagggagcagcgacgagagagagggagggaggcagccctccttatcgcctcgcggccgccggcgacgagagagaggcgagcagcgagagggagacagagaggcgggcgacagcggtggctggggagagagggagatggatgcagggctggggatggcgaggagggaggcggcggcggtggctggggagggcgaggaggaaagcggcggcggcgagcggcaggggaagagaggagggaggtggcggcggcaagctgggaggaggcggcgacgaatgggcgacgaggatagcgataagaagaagctagaagccaaaagtgggggaggaagaaaagagaaggaaaaaaaaaagaatgagctggggaggggtatttggggatttttcacctgggactccattgggccaagacacccattgtgggctatagtactctcaccgggttgttttagattttgaggaacccatttagggataccttctattgcgaattgagtttcctacgagtgtcctcagttagtgaggatactctatgagtgtctcacattgtatatgtgagtactcctactttattctcctgttttaaacaggtcaagaaaataaaattggttagtacgagaactatttatttgcaacaaattgtactagtgtgtaccaactggagtccggaatcgtgtgcatagcacagacaaagcaagttttgcagacacacgcaatcattagaaaaaaaaaacgccgcggccaaacagaacagcaataaccgcatgaagcatgttccttgcttaaacaaagaagaaaagcgcaagcatgccgtttcacatccatacgtggagcaagcgagctagagagaccaacccactttcaatgggcagcgatcacttacacgaggaaaataaaaaggcaacgatatgtgtatgatggtctttgacctcgtgcagagctagctagctctatctatctcttggcatcgtacctgtgtactataggactatctacgtgtgtgcgcagtgagcatagaaaacgaagtgccgttgatagttttggtcgtgatgttgttgccgcatgccggtgcgacaaatatcacataggaggctcaggaaggcatggaccgatggacggttcggccaaatgaatgagccgatagccacagcgttcggctatcatgatcatgaaacgaaaaaggcgtttcttggctgcaggtaggcaccgtcggtgtacacatggcagctagagcggctcgttctcgtacggcctcgtactagtacgcaacgtacgtgtggccgcgggcggcgccggtgccggccgcctctgcgactgcacggtgcgactgtgcgagcttcaccaacctgcagctatcgacctacttctccttaccaaccggttcgcgcgcggcatggcacgaggaaaaatagttttaattacttgtttactagtatcttttctaaaagaaaaagaagatagattaatgtgcaacatttatataaattataacaaacatataaattagactttaatagtatatgtatattcatcttttttataacttgtaaatgccgaatttaaacttatacttcctccgtcccaaaatataagggattctgggtggatgtgatacttcttagtactacgaatctgattaagaaacctgttaagattcgtagtgctaggatatgtcacatccacccaaaatcccttatattatgtggcggagggagtatgtttttacaataatatattagtacatactagtaatatactccttccgtattttaatgtataacgccgttgacttttcgaccaacgtttgatcattcgttttatttaaaaattttgtgtgaatatgaaaatatttatgtcatgcttaaagaacatttgatgacgaatcaaatcacaataaaataaatgataattatataaattttttgaataagacgaatggtcaaacgttgaaaaaaagtaaacggcgtcatacattaaaatatggagggaatatttcttaaaattaagtacacgagtgtacgttcactgagttttcctactcctatatgctttcctagcgaatacgcctatcaggatagaggtgaaagtgaaacgtgagcggggcccaaagatgctgggcttggcgactcggttttccggctctgaagtgacggttttttacgcgccaattctctcgcgcggatcacagaaacacgcgggcagatagagaagagaaagagacccggctgcgacgagtctaactgccaacctggcagcacttccagcaagcggaagagggtcggtcatatttatcccataatatggctaattttttttagaaaaaaagggaaatgagtaaacgacctggcggcgcggttagtcgggcccaccacccacccactggggagtgggccctccctcccgcatacacgttgcagctggacgcggcgttcacaccaactcaacgtgcgccaattcggaaggagcacccatctttcccctttctccttctcctcctcctactcccagccgctcactcgaacccccccccccaccttccttgccgccgctgccccgagggcgcgggagataacctcgccggagcaccgccaccgccgctgtcgatcttcttccccgaggcaaagccaggaggtctctacctctctctctctctctctctctgaattcgtcgccccgtttctcagcttgctttaatttgtgtgaaatttgagttgatcgatattgcttcgtgtttcggtttcttgatgtggatttggtcctttaggatgattcttctccctttttttttgtcagtggaaatgttgtgctttcctcccgcatctcatgtgcttctcctgaatgaatcctagggttgatttgtcgagccaggttttccagttttccatttttgttttgagcaatcggttaaattcaggtcggaagggagctcccctaccgccgattcctcaagcttcttacattgaacagatgatttcgatgtggagatgtggttgggagagggagaagagcttgtgccttttagactgagctttgcatgcttaatgggaatatcaattggatgaaaatgatccctgatcgggacaccattctcggttgattttttgttcaggcgttcagcaaaatgctggtagcgaactattgtttatgaattatgagattaactagggattagtgtgtacaattatcagtaacaggaggcgttgaccatcatagtgtagctacgatgaccatcatagtgtagctacgattatagtagattcttgagctaatttttaggctgaatgcatagtccctgctttattagaggtaggacattggttgaagcagggcggaagctttttactctagaaatttagaggtagactttatgaatctaaaggtcaactggaacccaaaggtttaggttgtaaagttagatgctctttgattgcttttctatgactctaatatgtgcattctgatagactgcaacggccagctgactggcattttttactttgaaacatatttctactagatactgtgattgattgtgattttgctttattgtgccattcagaactaaatgcaatatttagcatcagatatctgcatatgtataattccaaacaaagtaaaaactgaaaggaaaaatgttcccaaaagaattcagaataactttctaaacttcccatgcaaatgatttttttcccctgtaaattaactagttccacaaaaaagaatccctgtctagcccttataaaacctgttgttcagtatgttctctctttcctatagagataagactaacaccatattcattttgcttccagtctagacaaactcagcttcatgagttcaagttcaggaaaagcactggcatccagcatctcctattcagcaggaaagagcagcattttcttgctctgcctctttgcaggatacttgggaattcctggccgaaaattccacttgctcaagaccgtttgcagcactgcatctccttccatcattggaagttgtggagggaaccttctttagactactttagcacaagtcttcagtttctattagtgtggaagcttggcctgcaaaaccagcaaccttagctacgtagtaggcctttggatgatggtttcttctcagacatcctctctgacaagaactatcgcacaggaccccgagctcttcacagcaaaaataattctcccaatgggtcccccggatgttatctctgaaaatgatgagtttgatttctctgatgtttttggcaccactccagttcagacgccaacaggcatttcggtagctggtccagacagtcctgcacctttggctgagtccaatgagggggtttacaatgatcctattgtcatcatcaagcgatctcattctcttgttggtccaacatcacttgttagccagtccctgcgacttagcaatctcactctaaataaaacagaggggtcatcagaacctgcagaagaaaaggaaaggaacctagggcagctcagtgatgaagagtttgacaatgccacaacagaaaatgaaggtattgggcttgatgactttgaaatcttgaagcttgtaggccaaggggcatttgggaaagtctttcaggtgagaaagaaaggtacttcagagatatacgcgatgaaagttatgaggaaggataagatcttggaaaagaaccatgcggagtacatgaaagccgaaagagatatattaacaaaagttgaccatccttttgtagtgcagctcaggtactcctttcaggtacgtgtgtacatcaatgttcttatctctatgttgaaatcacttttagtgatatcttagtacctatgtttgaacacagacaaaatatcgactttatcttgtcctggacttcataaatgggggacatctcttcttccagctctacaagcaaggattgttcaggtgactgtatacttctagctagtacttttgtctgtcaaaagaaaatgtttccggccctataactcaaccgttttgtttaacagggaggaacttgcacggatctatactgctgaaattgtatctgctgtagctcaccttcacgacaacgggattatgcatagagatctcaagcctgaaaatatccttttggatgctgatggccatgtaagaatgccttcttcaacaatctcctcctgctacttcttttccattttgctgatatcttttttgttgcctcatttcaaggccatgctcactgactttggccttgccaaagaatttaatgagaatacaagatcaaactcgatgtgtggaacagttgagtatatggccccagagattattcttggtcgggggcatgataaggcagctgactggtggagtgttggaatcctcctctttgaaatgctcacgggaaaggtgtgctgccaacttgcatgagagggtaatcttcccatttgcattcattcattgctaaataatcccttactctttgcaacacgctgcagcctccgtttgttgggaacagggataaagttcagcagaagatagtgaaagagaagctgaagcttccatcgtttttgtccagtgaagctcattccctcttgaaaggagtaagtttcttaatgcattcgatcacagtatcaaattcctatgttgtgtttcttatctgaaaaagatggcaatccgttgtccatttcagctgctccacaaagaaggtggcaagcggctaggaagcggtccgggcggcagcgatgagataaagaggcacaaatggctcaaaccgatcaactggaggaagctggaggcccggcagatccagccgagcttccgacccaacgtgagcgggctcacctgcatcgccaacttcgacgagtgctggaccagcatgccggtgctggactcgccggtggccacccctgtcgccggcggcgccggccacagcagcttcgccgggttcacctacgtcaggccggctccgttcctccaggatgtcaagcctccctcttcctctaggctgaaagactagctagcagccagtgcgagtgaagaaacggatgaaccaagagcaaggggaaagaggcgaagggtaggaagttactactaaaatatctgtaaaaggacaactggtccatgtgaatgcacttccggagctaatctacccaggagatatgatccatttgctcagaccctgaaactgatacccaatttcaatcacaagttcacaacacacaacctagtttgcttggtcgtgttgttgcattcgcggtcaaaatcaccctatgatagactaaatgccatcggcatttacatgaccaaaactaggtccaaaactggccacacaagagtacaagatagagcaaaatcatttctcacacaatatagcagctcactgaatagacaaatccaaagcttcgacttatgttcaggccttccgccgaccaacttgtgcgacaaatccagccttgattggagcaacagacctcgacgatccacactagacagaataggcaaatgttgattcagtggcaagcaaaataacgagagaatattcggttttcatccaacaaatgttttaaaatgtttcagtggcaaagtgttttttagtcctccctctaattctactatctgttgtactctccttaaaccccgtgactttgagcaatgaaattcaggtggggaatctctcccctgcggtgacttgttaaaaaaatgttttaaaatgaagattgccttagaagtcagaactttgcagataatatcatattcctttactcaaacaatgtaggctaggcaaactattatgcagctcatcataggctaacaagcaaagagtgaaagttgacagcagctagcaggtacaaagaatgagggtaacaaattgttttctgtgcactatagaaaattcagatgctcgcaagtctgtttctgtagtcaaacagaaagcaagaatatacttatgtacagaggagattggcgaaaaaactactacctcctatccagattcattgtattaggatgtgtcacatccacccgaaatcccttatattataggatggagggagcagtaaacaataggagataatagatgtcacaaatttgcaacgttgtttaagcctcagttgttgcttttttatcatgaatttgtttgtcaaacaatgtaggcaataatgttgcaactcatcattggcagaaccatagggaatagatggtaaaatgaaattttaaaaaacaaaaggcaattaactaatgttttcacagaggagtgatcgctcatgccgaagcaaactggatgtaactgaacatgcacaagcagataatcagacggcatttacctgttcgcagcgaaggaagaacagacgattttccttggatagaatggtatcagggcttttgcaaccattgcaaatgacgtactcatctgaaaggtttaaagacgcaataagttgcatataacccttgaaatcttaagtcaactaacactaacaaaacagtaaacaacaaacgtacaacttatgatagtttaccacacatgaaaaaggggaagctcatctgttcaaccaagggaatgaagtaggataacttactgatatatctccgcaggattgcttcgaagtttttcggagcaaatcttcctttgatcaccaacctttgctgcccatcaagtgatccacttgtccccatttcagcaagcaaaaacatcatcacatgctcaggttgcctatgcatcctggtaaataatttccggttagttcatcacagctttatccattgtaagagcattcaatagaatatcaaatacaaaatacaatccaaatggtgaaaaagcgcacgttttgcacaagtccataaaattcacaaaaactgtcttcttcgtgccctctcgaagaacctgtggcggcctcatgacagttctgcgtctgtctccagcaagatctggattgttttcacgcagaatattgaacactctgcccagaagctgcaacaaaaatacccaaatcaggttttcacacgcactacagtaatttggtcattctgtgctagttctggatgacagttgtttctgtttcacaatgttgtttgagactaaaggatattgagttgcatgctagttcagtatagaattagacccacaaagccagaggaaaaagtaagtaaaattaataaagattatccaaagcaaattttaatgctctcaaaacatcgcgtgacagcagtacatgaacaatacattggaacaaataggtgtggttgtaagagcatgaaaacagtcaaaacacaaaattatggtgcatgcaaagctttggaaaatttaccaaaagattactgaataatgtgttgtctgcacaaggaaataatgaaaagaggaaaataaatgaggagaaatatataatagtagaagcacctcatcataattgtagtccctatcagttccctcccacgggtacctaggggcacctccaagcacaattccttccccttcttcctcctctacaacttggtcatctggaaagcaggagtcagtaaggacaaagaataaactgtcaagagtaagtaatcaaggattaatcctatacctaaaatgtcctccccatcaccaatgtcattaatagacaaatcaagatccacctgaaattttcagtaatgtgaagctcaattcaatctgtacctctcaaacacacacaaataatacaaaatgttgatctcacaggttcaagcacaaataatacaaaatgttaatctcacaggtttcttcttcttctttttcatcccagtgaagttgagctcaccaggctctgtgactaaggaataaaatggtacaaattagcaaagatattcccgtggcataatatttttttctacgctacattaagaatacctgtcaggttttctgtcttctctgccagcttgtccacctcatcagaaggatcttggataacaaccttcttctttttcttcttcttggttgggtcaaaaggagtaagctgtagaatatgaacaatgcaaataaataaacggagcaacggagaagacgtggaaaatctatagaagttttacacaaccatcagtaagaaatataagatatagcacttaataacttctcagacaacgtaatctatcacaacttttttaatatttactccatgaagaaggggaaagaagctgaggagtaagcactggctggtatcctggtactggtttcagataaggccggtagcctctggacaggcagaacatgatataatgctgttcgttcgtcaaatatataatcacttatcacgaaaccagagtcaaaatgcgccccttatatcatgctatgttgttgcaatgcgttgttcatatgctacgaatccctcgcccatgcgttctgaaatggtgactacacataaaacaaatgaacatcccctgatgctagtgtctcttaccctctaaaagaactcaagtccaacccttattccaatcaacagcaaacttctagctcgaaacccttcgaatggaaccgctcttaacgaaaccccaaatccgcatgaaccgcacccaaccgattaggggcgattggggagcacgttgcctcacctcggagacctcctcccgcttctccgcgtgctcctcgtccgccatggttgccgcccgccaagcctcacctcacctcacctcctccgccggtcgcgatcgaatcccctgcaaggcacgaacacgacggcagaaggatcagatccaaccgaaggaagaaagcgcgcggcgccgacgatcctatcgatgcgcgactcgcaccctgagctctcgccggaggagagcgcggcggcgacggcggcggcggcgtggattcgggtggtagggtttttcccggaggaatccttgcgcctttagctttactactggtctcgcccgtgcaaaattatgggaacacagggactctagtgagaaaagtcactccgtgtgatcaatcctggccgtctaaatttgatccaacggttcgctgtcaatggtggcgatctaagttgagcgtggagctttgtacagtgggaaaatttttgggaaaatgcgaggggcttaagagaaatagttcactttggatcgaacgaatgcaagattctacactgatttgaaaggaagggtgtgcttagttcacgtcaaaattggaagtttggttaaaattgaaatgatgtgatgaaaaagttgaaagtttgtgtgtgtgtaagaaagttttgatgtgatggaaaagttgaaagttaaagtttggaactaaactcggccgaaataatgaaatcacaccacaaaatgcacaattccaacaatcaaaattcccagagaaaaaaatcctacacttgtcaagaatcaagaattcaagactcataagttccaatcagaatatgctcagctttctgaggctgcatctaatgtcgaccatgtttagcatgaactcaatcacaaattagctaagaatcaaatgatctgcaactcgcagcttggtgaggcatatgaacacaggagcacataactaaaccgatggtggattggagtccttcatcttttcatcagaggaagctcggctctctgaagcagaatggcgcagtccctcgatcatcctgatcacatcctccatcgatgggcgtcgatctggagaccttgatgtgcaagccattgctatctggagcatctgaacaagctcctcctcgatgttttgctgcttgatcagctcgacgtcgaacacctcggctgtccactcctctctgaccaccgagtgcacccatcttggtaggtcgacgacatcgtcattgccctgcgactggagtggagctttaccggtaagcatctccatgaggaggacgccgaagctgtagacgtcggatttctgggtgatcttgcggttctcgatggtctcaggagcgcgataaccgaccacaacgcgagatgcattggctggaacactcatcagggcagttagaccatagtctgaaacataagaactgtaatcttgatcgaggaggatatttgtagacttaatattgccatgggtgagcttggcgccaccttctgcatgaacgtgtgcaatgccgtatgctgttccaaggattatcttcactctggtgctccagtctaatggtgtcttttcagtaacacccctgatacctgccgaatgttcatcagcaaatcagtacaaaatactaccaactgaaagttaactattcacatttatttaacacaagtttcatttctgagtatgagcatttttttagtgtgcaggagggctgtacaactttctattgatacaagaaaatatgattagactccctacttaagctagctacagaaggaatatggatgcagctttaggcaagttcagctgtagtgaaaaattaaaatcactaatatcctgtgttagtttaaactttattaacatcgcatggatatatcagtttacaaattttaaacttaatcagtgtaggcgttcaccttttaactaatgtgggactcttcttatgtttactcattagccaccgcagctatgagtctatacatgtaccagtgtcttgcaaaaaggatgaaaggaagaaaagcataccatgtaacttggttgagaaactgccattggtgagataatcgtagacgatgagcttctcgtccttagaatagtagtaagcacgaagtgggactaagtttgcatgtttacctaacctaccaattagttccatctgttgctcaaactctttttttcctgccacgacatcttttagtctcttgacaacaacaacggtaccatcctcaagtatagctttgtaagcagttccataacttcccttgccaaggacttctgcagaagctctcagtagatcctccaaatcgaaggtataggagcaaccctccaagaaaaccaacttgtttttctcggcgatctgaacgccactactgaactcctgttttggcttctcacttctgacaccagtgcccttacccttgtagtccacaccactctctttcttgcctttcctctttgaattacacacaaccaacacaaccacaacaaacatcagtactgcgaagcccccaacagcaactgcaattatgaatccggcgccaaactttttctcatgatgcgctgacattggagttggtgctgatgaaggggatgctggtgaaggcgtcggtgaatcaggaagcaagcatttagctagaggtggcccacataatccaggattccccaagaatgagccatttggaaatgtttgaagcgactgaggaatttggcctttcaaatcattgttgctcagattcaatagtctcagacttggaagcttgagatcagggatggatccagagagagaattttcttgtaaattcaggactgataactgagaaaggttttgtaagcttataggaatttcaccggtaaaggaattgtaggagaggtccactacactgaggttaggattcaaaaaggaaggcaaatctcctgaaaagttattgtgctgaaggtatatggatcgtaaggaaggaagcgtagtcacatcagatggaaggcttccagctaaacgattagaccgtaagctcagaacttggagagagtcaagctttccaagagtgtttggaggaattgctccaatgagaccagcacctggtacccttaattcaaatatgtgtgactgatctcctgagcattttacgccatgccaagaacacaatgatgtgctttgactccagttgagcctgttgccacgatacactgcagaggcaaagtctagaagggcttgcttttcagaggttaagtctgctacagacaagggattgaacaacaaaagtgacaactgcagtgagagcagaagagacaaaggatttctaatactgagatgatccatttgatgaatctccaaatcaggaactagacgagcagcatcttcgtttgtttatgtcaaataagtagccgatcctgttgaaataaaagtagcgagcattcagtgataacagttaaaacaactgcactaagatttcaatcgtagctccaaataagaaccgcatttcatcagaagatagcaaataaaggttaccaatcattccttgtatgcttctaaagtgcccaaa

SEQ ID NO: 80227 - DNA, 13229 bp, Oryza sativa
aaacatccattagctgctactaagattacaaatacggtagaatagaacgatggcttacagtagttcctgcatcttgctgtcatagtgcttagcatcaaactgggagccttcgggtgccattcctgccatggctgtattcaagggaaaaaaaagagcaggttacaaaggatgaatggcaataatgtttgaaggacacaaagtagtagtaaactcagttgtaaaagcagtcttgacccgcacaataaatgttagtacatttatagctttctgctgcacacaaggaacatagcacccatagttgaagtctatgcacgacacaacatgatctcttcgaacagggtttatgcacaacacacaacatgaaatcttcgaaccgggaaacacaaactcgcaacagtccagaatttacttaatcgacctaacaggttagagatcaagctcagtatacaatggatactgcatgtggagcttaatctaaggaatcctcctaacacagcatactcaataagcgaacagaccaaactagttggcccaaaaaagaccttcgtttggtccataaagaccttcgacttcctatggttcctccactgtccttggcatacaaaggataataatctaacagtcatcaaagtacaaagcaggacatcgaagtgcttagcaggacaaataatctaacgcagtcattaaaaaaaagtacatatactagcatgttacaaattttagatttgcaaacactaggacacccaaaacatcaattactattgtcaagcaccacataccacttctatagctgctcaaaaggataacaaacatgccaacggagatataacaatctaaacatcattaaagcaatcaaagtcacgcatctcccacccaaacccctctctctcacagactcgccaaaatcacatcgaaccaacccagatccacgcccccaccacccggcgacacccagatcgagccagcgccaagccggaccaacccgaatccagatcgagcacaaacaaaacagaaaaaaaaaagcatcctcagcgggatcccatcccatcccatcgttcattgttacctgaagaggagcggatcgatccggaggagggcttgtgttggttgaaatcaacggtctcgaatccgagatcggcgtctcggactcgattcgattcgtcgggatcgcgtgggcgctgggaggcgctggctttttcgctgcgagcggcgagaggaggaggaggcgatgcgacgattgagggtttgggaggagagagagagaaagagagagagaggttataaaggggacccgacggaggcggagcgcggctcgacctcttctctcttctcttctcctcgtctcgtctcccccttcccgttccgttccgttctacgggccggctgctactgtggagtgtggagtatgagtaagacggggggtagggtttgcttccgttccgttccgttacgagcacgagtggtgggcttgccttgggcctagtgtccgtgtgggcctttcctttttttaaaaaaaaattataagcacagttacaccaccctcatcctaaaatgtagcaattagagagataacgtactaaggtgtgttcgggaggacgcaaaacgaaacttgtattattgcatgattaattaagtattaactatttttttaaaaaatagattaatatgattttttttaaaacaactttcatatagaaagtttttgcatatgtcacaccgtttagcagtttgaaaagcgtacgcgcggaaaacgaaagaggtgggttcggaaaatggggggaagaacacagcctaattttttttacaaaagtcatactaacaaattttttataaccgtttaatttaattagatggatgaaagttacaagagatctagatttacttagagctcatcacatcatagtctataagtattttgtaaggaaattttagtacgtatggacatttcctttctgtgtgtgtttgtgggatggttggttgccaaaggtggttcgaaattctgcgaaattcggctggagtttgattaggtttcgttgtgtttttggtctagacgtacttgaattgaatacttactgttttctgtgaagtttctgtgattgcgacgatgactcccggggtttccttgggtaacaaggtggtgttgtttgacacggtgagaaaaggaaaagaaggaaactatgcaaaattcagtactttttggatggaccggatgtgaacttgagcagagttgcagtatgtcatgttgcgttgcgggcaagtaattaattagtcggcacgacagcaatcgcgcaagaacatggagcatgggtgcgttgcgagttccaacgcggacagctcaacgcaaccgacatggggcttggatcatagaagttcatgttaagataattgaattcattttggcctatgcattctgacattagaataccatattaaggacatggattattttcatcagcttgatttgaaaaaaaaactacttagaataccatattaaagactactgactgaacttttgttcaattagacaattaggcaaggatcatctgactgaacttgacacagcaagtcggcaggtggaggtatcctgatagataaacagatcacacaaacaactcaaacatcgcaaacctgccaatctcacaataagagaacattaatttgcagctttgcttacttcgatttcattttttctcaggtcaagaacaaaatttacatcaatgcgcggttgcaatctgagtagtgatcttttactccgtacagtgatgacgcaaaacttacaggagattagctactacaactaattacacttcgcatgtccatggaaataaggtaccatatacattaattctgaaccaagtctccgtatttcaggctccttgcagcatatggctttactctcagcttgctattcttgcccaactgcttgtggagttgtggggtgaaataggtctcaccacctgcagaagaagttctggttctgaaagacaacataccttccatgatacattgatgcctccagataggctcagaagtctatcataccaaagatgctctctactgaaggattcactaaacaacctttcatattttcatctttatttcctaaacctaaactcaactttttagtaatggacacaatttctcggtccaggaatacagagaatgcgaccaataagaggatttaaaaaaaaaattcgaagggctatacctatactgtactgcactagtcactagatattagtaatggtaagaatagggcctcaaggtagtttgatgtacaattggttgctcctatagacataggaggctatagaagacaaggggtatgaaagcgttgtcgagttgggctgtatatgcttccaataaaccgctcaatgtcacagctaccaaaagtgatatccaatgctgtgttaatataaaagagatggtcaggatttatgcttgcttagtatattgtagaataaaagcttcaaatggtttaatgccagggggggaagtaaaacctgtgaaagtatgtatccacttgaagctaagagtgacagcaggattgagcaggctgctaatacagaagttatgcctgctgctgtgccctcaattgttttctctaacatttcaaaagtatgtgcataagagatcaattatcaatcatggaataaataataatggaaattaaactcacttcctgtcttgctccatcttaggacaccatacttataacctatcattgatgcctaggtaaaacaagagaattcatcatactgaacgcagctaacataagaaaatattaactgatcacgcactggacatagaacctaccatggtatcaccaatacccaagctgagaattccagcaaatggtgtaagaggtcggtcattgaatcctgatgacatccatttaggaagtgcacatcccagcaagagtgagaaatgactgaacaaaacaaatatagtattaggcctatccaagcactgaacatgtaaatgagttaaaatctggaaaacaacgaccattaatccagacctacctaacaattagaatttccgaatcgcgatgatcagtgaaggcactcatgaactgatgcacaatatgcccaagagggtatatttcccaaacctgaggtcagagtgaaacatttcgtcggagaaattagcacatgtgggcatacaaactgccaaaaaacagaaagaggggggaaaagaaagggacacaaataaagaaaatgcttactcgaaccatctccaatattaagaaaacggcaaatgctgcaccaaatgctaagtccaagaaatcaggctgcaaagagaaacaatttattgagagtgtgtttcaaacaatctgatggggatcgaatatcgaaaacatatattacctgaaatattactgcaggagagaaaattaggacagcaacgagatggtaatacttgcgcaaaagaatcctctccgttttgctttgttttgatatactgtagaaccttctaattgatacatatatcacaaatatccagtatgcgcataaagcaagccgttcacgtgaatcggtgaaaatatagttaaaaaccctgtgaatataaaccattaagtgaaccaaaattcaatacgtacaaaaatgcacaaggtttagaagcaacacaggaagaaatttttcaatatttgactaacagagtgcatgcttttatgcccttccaatgaaatgcaaacttatatgctcaccaaacaaatggatgcacttcaaaaccttgaataagacgcgtccatgatggcactaacaacaatagtgctaccaacaatgaaacataaaatacaccacagtcaattctcttctgtgtgcattcctcaactgtttgtgttctttgactctccagttttctacagtaagccaaaacttgaagggagcttttgtataacaaggggagaagaaaaagaccaagcaaaaccccctgcagaaaagaaaaaaaagggaagggtattatgcactaagaaactgaagccagagaacgcaatagcttctacctgaataactgtgcctatctcgcttcgagttccaggtgcgcgaataaatgcttctgatgatacggagaactccatctgccagcagcacggttgcaaatgtgcaggcaacaaaataagtatcagatttgctaccattttgctggtaaaacatagttcgaggaataaatcacacctttgaaagagtatgagccagcatatcaccacagtaaagaacaagaccacttgagaccaaaatggcctcccctaagttcacagaaaatgtaaagataagttaaaaaaagcaatagcttcaagtcatgatgaaaaggagacatatacattgcatcggccaataggaaccacacaaattagctgaatttaaattttaaaaaatgaacagtgtagatataatgcactatgcctgcatggaaaactggtaggataactagcaatcgtatggatagctctaaagtctaaacatatgcagtcagatataaacaaaaaaataaagatctaactacatcttagacttcaggtacaaaccaaaagatgaacatgaagggaacttctctagaatatgctggattaagatcacagcagccactccatgacacagcaaatacaccaaattactcatcaccagcagacctgttaagacaacctagattagtttgtaattccttgcttctgatgaacttccaccagattttggaaagaaagggtgagattatgtttgcatgcagataaaatatgcatgtacctccatcagtcttcagtaaaaggtggaacaagtatgccaggggatataaaatgatgagcaacaagccgtatttcgaagctatagaatttccattgctgggagactgccgtagatgccaaacaaaaaatgataacatgccaaggcagctaacagatactgcccagtactgcatttcaaggtatgcatattctgacaatgaacacatatgtagttagtaaaccagatgcgtcaccgaaaatcttagtgtcaaacaagatttgaaatgttgatgaagatttagggaaatttccatttagcagtggatctgataaatttgacaaaatagaaaaatggataccttcacgtccattaggatctgctagtaagaccctataaagttgaattaaccgtgaaagcatgacactaggcagagtagtggcaccaagaagtatgcctgatgaagcacccggcctggagcatatcaatatatcatcatcaagcacttaacaatttttttaaaaaaacatgcccaagagcatcaagccaccacaagaaggtgaagtcctcacaacacaagacgtgataaaatcttacagtaagcaactaggattgcacatcacagaacccatataaattttttgactaactcaccgggggggggggggggggggggagagattccccacctgaattgtcattgcataaaagaacccatataaatgacagtgggagcaacgttttagctgaaaatgcaatggaacattattttggccatcaaaatgagagcaatattttgactggctgtatgatagaagcacctctgaatttaccatttgtgaaatgggtcaactaagaaatgctgaaacccaattattcaagagtgatatttgtcccttggattcttggaaccaccaaaacctgaccattttacacactactgaaccaaaagaaaattcagtaagcctcaagtacaagtaaaatcgcattcctgcggaatgctgaatccgactgatgtcgtttccccaattgcatgatcctcacagggaggcagccagcactgaaccaacaaatggatcaattcgcctcagattctacggctgcgccaacgaattttgcaaaacactgcacctcgcaggttccctgacatcacagggagctcctcgaacacttaattcgtggagtttgaaactcgaacactggtatcaagatcgcgcaatcccccgagctaaccaaatcgcgcgaactagcagcccagctccgtggagatgcggcggaagaagatacggataagagcgggggggaggatataacgtcgcacctggtcctgaaccggcggagcggggatgaggacgcggaggcggagccatccacggcgagctcgacggcaagggcggccgcggcgaggaccgcgagcggggcggcgagctgggccggcgccgcgagcgcgacgcgggcgacgaagaggaacacgacgagcctctcgcccgagaccaccgccggcgccatcgccatcgccatcgccggcgaccgaggaagcgcacgaacgaagggagcgcggcgcgaaccggacggaggaggagaggtgggctctgtagcctgggtcgggccttggtggctctgactgacaggtgggtcaaagcggttgagccgtcgcgtccgacacgggtgtgggtgtggtgcaccgtgcacgcgcaccggaccgacctggtcctcttgcgtggcgtgtgcgcgacgcggagagaaacgattttgtgcctcgtatctgtgggcgtttgcgtcgacgtcgtcgtctactgatgggcgttgggttggatgggaatatggaatgattcctgagcattttgtaccacctctccaggcaaaattcacaagtgttgcaatgttcaagcaaaattcgtgttctgtactatcaaatataagttcgacatccacaactcatgttctcagataggtacagaatttaaagcaactttaggtaactagtgactgatgaggagcttgtctgatggatcacaaaccacaacatacgcaatacaatttaaaacattttctaaagtaacaactaacagtccgggaagaaaacagacactatacgatctaaccatccatccattgatccatcaactcagagcagggtagtaatactaataccacgttccagacatacataagtgacgttccaggcatagtaataacattaataatacagactctaataataagacaagttcacaatctcgatagtagcttataacatttttttgctaataatacagttattgggacagcagtaatactatgttgatcattttctcttcagagcggaggggatcatgcaacggcaacaaagtaaacattcaggacagatatcatctccttgggatctttaatctaagggaactcctcagcaaaccgggtcaaaataccctgaacacaaaaccagtaacaaaaacgtcagtacatcagaacaggtagcaatttatcattacattacacaagtaaaccagggggaaatatatcctaaacattgcacccccttcagaagcaacaagcctgcaaataaagaaaaaagaaatgcaacttcaatgaaaatgcatccatcacaagtaaacaccataaattgaatatcagctaactcaaataccaccgagttcaagcttcacagttcacacgcatatattggatgacggtacatggaaatgtacatcctgcctgccaatgcgttctcacatcagatgtgttctttgcatagagggaagaaaaaggcagaacataaagcaaatttgcagaaagaaacatgaaaggaaaaacgaactagtgcctgcacactatgggtcatatgataacaataaccaaggctttggcaccactgaaaaggagcaaaccgaacaaaatagctgttggtgcaacctagtccattcaatataggcagctcgtgatagatgttcactgaaaccaagtaaccaagaagaccatagaattctaacatatcaatgtaaatgtaaagtgagttataaaaagctgagctctatttttctaagttgtttcaagttaacattattccaacaggtcaaactgcctaaggcctaataacatacagtagcccaggctaaggatgcccatttgttgaggaacagtacaaactgataaaacacttgcaaggacagcagtaaaccaaaaggaatcatacatacgagtaatgcaatggttgctctttagaaaaagaaagcacctgaatgaacaaatatgaacccatgatacaatatcacaacttacttcgtaactaacagcagaagtttcaataatatatgccacaaaatttaagcaaaataataggaaagaaacaacacttacattgatcagacaaacatcgccagctctggacggctgtagatattatccccatcgtcatccagtgcaggataagcagcaacaagcgcatcttgtgcaccaatatatagtgagttgtagattttccaatatacttcacgtactttccttgctggatggaaaaggccttgaaggcagtaattcaagatcacagctggaccaagagcaactctcatcccctcaatcgcctccatgacagcattgatgacatggggagatgtctcaaatatgtttggccagacatagttaagcaaatggacaagagcatcctcacagcccaagccagcaacaccaagagccatgtgcttcacagcagaggcagcagtttgccggtgaacaagatctctgtccattagagcatcttcaagcaagggagtaacagcatatatgtaatccttgcccatctcaccaatatactcaaagaggaaagagagagacttcaggacaccattctgaacattgagttctgggactcggtactcattcatcagggcaggcagaaccgtaaaaggtgagcaggtttcagcaacaatggcaattgcgacagttgtgcagacacggttttgccgttcctgcaccttcaagttattcaacagagtagccaacacatcctgtggcccaatagccttcgcaatataaccaaatgtgttcacagtcgctcttctaatacccttcttgtgagccttcaacatttcaagaagctcaaagcaaatcctcatccactccctagcaggcacaaattctgctccgcgatcagcaatcctaccaactagatcaatgcagttctcctggaccttctcatgcctattcttcaagataggagtcagccgaggaagaagatccttgattggcggtgtcatcttagtcataccaatgacattcacaatagctttcaatgctccaagaatcgaacccaacacctcagggtactcctctcccaaatactcatacagcacaacacccaaatgacccataagctgctcctcctgacattgtttcatcacaatagctatccttgagatcagatcagcagcttgctgcctaacttttgcactcttgttgttcaaccgccacttaatggtaccacaaatctgaggaaggtaaggcttgaccctctgtcccagtgcattgacaacagctccaaaaccattaagcatgacatttgcatcatcacttgtctgctcttggaaagcatacaggatgccatcaataagcagctcctccaaacgagcatcaatatctgaagcacccaaattagccaccaccttctcaattgtttccatcaccattctcctgtaaggctcgctttcatctttcagatcctcaacaatcctcccaacaatatcagcaactccaaccttatttgccatctctacagttgtttccacaagctgcttatagttcctgcggtccagagccattctcctaacccagaagtgacggaaaaactcaggaaggatgtcattccggatataatcagcctctacaccctctgtactgacacactgtttaacaaccttcaggacaatcttcttcatttcttcatctggtgactggaactcccttatcaggatttgcatgacctccttcgtgtagtaactggcatacagcgcatccataagagggatgatgaaaccaatagctttcaagaaggcagcaagaacctttccacggtgagatctgatacccttccacagaggcttcaaaacagtatcaaaactttctataccatatggtgcagcagcctcagcaagtgtagcaagagaaagggcagtgattgtccgcactttctggttctcatcactaagaccatgctcaatgatctcgactagggacttgagatgtggcagaacagcgcagcccataagaatagcaatctgctgaacaatcttgataccagtgtgccgagcttgccaggacttcttactctgacagacagcctttaagaatggcaggagagcaggggtacccaaagcagaagccaccacgctaaatgctctagcagtggtatttctcacatactcatcaatgttatcaatatctggtctcatggcggcaatcatagtagcaagaccagcagctttgctaagatttgagataatctcccggccctcaacacgagcatagtagtcctcatcaatcagaagtggctcaatgaccacaagaatcttatggacaaacggacggactagctcatccagcttatacagtaccctgtcaatgaccttcaccagaagatgccgctcctggtcctcaattgttggctgcatgagcaagggtagaatcttgttgaacaaagggccagcaccaaattcccttgctttgtctgtcagctgtcgaagtgcgtataggctggtatgaagctggaggttcaagaatcttgtacccttcctgcgggaacatagtatcaagctcctcatccgtaagaggcctgttccgctcctcaatgtcccgctcccaccgcaagagctggtactgctctggagtcattggaccacgagaagcaatctggccgggtgttggcgtcgcaaggttgtcaccaccaaatggcgtcggaccaggagtgtaacctgcaggcgtcgcagcaccagtgcctccaggtgtagcactacccatacttgcaggagtctcatcccatctcgatctctgcttcttgggtgttggcgtgacaagcccaccaggcagcttaggagtagcatcccaagctccagaaggtgtggcacctggagtaatgccaccagctgcaggtgttgcatccgcatcggccatcctcccaggagttggggtctcatcccaacgattccttctcaccgacggtgtcgcatccccgacacgaccaggggtggcatcccagcgcccaatcccaggagttgcatcaggagcatcccaatcggaggaggtcttcgccttcttggatccagcagcagcagaagcatcaccatcctgcgactgatcccatctattgcggcgcttcggcgctgccactggctgctgctcgggcacggccttcttctccttggccttctcctcctcttccttcttcttctgagctatgtcacgcagcagctgctccttctgcttctgcaggtcattctcgcgcatggcatcggcataggtccgcacggaagggtccggggtggcctcaccggcggcgaagggatcatggcgctccggcgagatgatgcgggccagccggcggcggcgatagtcatcctcgcggtcgatgatgcgctgcgacttcttggggaggccgtcgtcctcggcggcgcgggggatgtcggcggcggcgacggcgtggccggtgtaagaggcgaggcggcgggcggcggggttgacggccgcctcggattcgtcctcgggcgcgtcgtcctcggaggcggggatggaggtgtcgtagccggcgaagcggttggggtcggagccgccgccgccgtagagatcagtgtcgaaggtgacggaggagacggccatgggcgcgccggcggcaagggcctcctccatcttcttgcgctcctcctgcgcccgcgcaagctccgcgtcgatgccgtccatggcgccggcgcggcgggggagaagcggttagggtttcgggggtggagagattagacctggatttttcacattttggtccttttaaaaaacttatttcgcaagtagacccctagaaaaacttatcccaaaaatggtcctttttggggcgccagagtggctggcgccgtcgttcaacaggacggcgccagactatttggcgccgtccccctgccgacgtggcggggcgatgctgaggtggctaggggggaaccttttaggaatggacacaaattctcgggtccgggatacagaaagtgcgaccaatatgaggattctaaaaaaaaatttgggaaggctatacctatactggactgcactagtgactacataagtcatggtaagaataaggccttaagggttattctggagtacaaccggttgcctccttataatagggggctttaaaaaacaaagggtaaaaaaacgttttttaaaatggggctggatttgtttccaaaaaccgctgaatgttgcgaaataccaaaaagtgatatctcacaatgtgggttaatatataag

SEQ ID NO: 80228 - DNA, 1619 bp, Oryza sativa
acacatgagcctcgtcccaacacatgagacgcgtcacggcaaagcttttcgataacctcgcattggcagtacccgctccatgaacttaaatcctcatgcactctaggcgtccatgtttctagcagtgagtggagttctggcgctcccgggaaagagaagtctcacacgcatattaaattatggttcaagttaagttccctctctcacacactcatggcagtcctaccaatggcgacaccgatgtagggcacgcctctcggccctacctcaacagctgtcccaccgtagcgcacctgcctcactcaggggtgaaccatctatgcagggatactgcctctgctcggctatctaatccgctagttctatacccatacgagaagtgcggatgtacgggggtcgtttcatgcttaacttcatggctcggtccttaattgaccggggacggtactagccttttccagataccacccaaatcctccgtccgccccagtcgaaaacagttgtttaattttatttttcctttcacaaatcatgtcatcaacatcatggcaatgtggcgctcatgtctccacatgccgcatctcaattaccttcccaaaggtaattgcccaagcatatagcatttgataaatatgattatgcataattctagaatagcatttctaagcaattgtcatagttgactagggactcatacgtaaacatggttacaaagatttaagggtaaacaataatcaaggcatggcataatcacaagtgggatgttcatcattgcatgcaattttatttgtaaacaaaacaatttcgcaattgggatcaacatgttcaaggaatagtgatgacttgccttgctcaaagtcttgcgggtcttggccttcgcttggatccgcaactccctcgggctctatagttacgtgcgaaaattgatttgaattcggttagaattcaaataagaatccgaataaatccaaatgacagtcgaatgcgaaagtcgtttcctttttattaacttcactatccgcgaactacggcaaacccaatttcgatttaaactattttgcgggtataaatattttgttgtcataagttttcaatttaatctacccgagcattatatccatataataggttagaaatttctatcgcgagctaaatgtcggacggaatcctaaaattatcttataatattatacgttttaatttagtctatgactaaacgattaaatataatatacgtctaaaattcctagcgattaagtccgaatttctaccgtgaatcgattacttatagagattatccaaaaatgatctatagtagtctataaagattcatctaattgttaattatatctaaattactactgcgaattgatttcttttagaaattaccaagaataattaaattttgcaattctgggaccatgattattctataattaaattttaattattttaaattttctaaactattaaccttcctaattttcttccaaatttttctatttatttttccttttcctttttccccctttcctttttcttttctttttctctttttctctcttttccttttcttttctttcctctctttctttttctctcttcctctcggctctatc

SEQ ID NO: 80229 - DNA, 2507 bp, Oryza sativa
acagttggggtcatcagcccttggttgaacaaaaaggcattaatggcactagaccagaagtaagaggcagctgccattaggggctcatccttagctgaattggctatagtgagggcgagtacctggccgattccaatttcatcccaatgaacctgcttgctagccgatacgcgcttataccatgtggtccagcttttctcaggggaggttttctcgagggatggccaagacttgaaggtgttcttccaatcgctcagattagggttcgctaatctaaaggggattctgttggttttggcaatgatgaattcagtagggtcggaatcaccaattggaccaaggaaatagtggttgtcatgcgacagacttggaattgcaacaagattggacagatgctacggatgcaatcaggaatagagaagaagaaaacaatataaggcaggagaaaactaatctgttgcaaaagagagagatctagccgatgagaacttacctcagtgtactcggctaatggcgcggcagatgggctggcggaacaagacatcgccgcaggcggagatctggccggagatgaagtcgcctgggaatcgccttgtgtgtcggagaaatcgccggagagagagaaagcatagttggtttcggcggtgaaaacgggagaagacggtgtgatttctcgggggtaacggttagtatttaaagcgctggaataacggtcgggaaaaggcaagagcggatcctctctcggaatcgacatatggcaaatccgaaacattaccaaatattccggacttgggggtcatgtgttaatgatcaaatttggtaattcaaagtatcggagattaagataaaatcgaagcggaatccaagagatagatcgttccggaaatagagcaagaatcggctgaagtccgaatcggctgcgaccaggtcagtagagtttgagtcggacaaggtagccgattgagccgatttcgacaatgtgactcgatacacatcgtcgggttgagctaatgtgcttcatatggattgccacacatggattgagtcctaaaaatggcaattgtatctattaattaggatattttatgtaatttccttagagataagtttgggcaaaagtctgccgtaaagacttatggtatcttagagtttattagagataagagtcatgtccgacaaggacatatcttgtatctcgggtataaatatgacccgaacccatgtaatcaaataacacacgttctatacaatctcggcgcatcgccaccctttttactttcgtttcatctcgacgatttcttactttcgagttgagctgcatcgtttcgatcttcaactagaggtaaacttgtcatggcggcttgcgttctcgggattagtgcttacatctttatgacattctaatcttgtttatgcaagttgtcgatttatcatatatcctatataatctctggcaatattgctatttaaccctcagtcggctaacgtctatcactggagggcagccgattaagttaaatatcaacgttgacttagattatatagggtatccaccaccctatgaaatatccaacggcatgattgtctagatattgttattcttttcatacttatagctgcatcagttgagtttgaccatataagtcgtgattagaatctcaatctctagcctgcttttggctgccgattagggtttcatcagggtttcagccaatcttacctgatttaactactttatatcccatatgcttgattgatatgttaaatcttatgttaagatctcatcacatttaggtatattaagcttcttgtttggtatattttgcttgccttaatatcttaatatagagtggtatcggagtattagccgatacatgctagatctatcttatcggctatgctatgaatgcttataatctccttgttaatgtatatttcgatctaagtgatttatactgtctcggcatggcgaccgatctatcccaatcacttgatttaagtatatatcgacagaagtattatataccgttaatatctacagccgatcgagtagatttagttctttcttgtttatttatgactgccgatcgattcaaatatgacatcggctcagagataaatgatatgtcatcggcgactggccgatcggctatcatttatggatttaatcgcggtttctttgtatttatttcttgttgattgcaggatcaaatcaactggcacgctcacgaacctaaaggaaagatttttggacctgcactaaagttaagcagatcttccaggccactgtgtgtttttcgcatcaacaagtacaagtggcctaacttatagaattaattgctgtacccaatgctaatttaatctatggacttcaaagtactagacacactatttatatggactcatttttcgaatttactaaaattatgtgatggttctgcgttttgttttgttaacaaaattggtgatatttttgaattcaatgttcacctacagagattattgca

SEQ ID NO: 80230 - DNA, 3436 bp, Oryza sativa
aagcaagaactcgtcgaaacaaaacgaaagtaaaagggtggcgatgcgccgagattgtattgaacgtgtgtttattcgattacatggggttcgggtctatttatacccgagaattacaaaatatgtccataccagacacgactcttatctgtaacaaactctaagataccataagtcttcgcggcagacttttgcccaaacttatctctaaggaaattacataaaatatcctaattaatagatacaattgacttctcaggactctatccatacgccgcaatcatcatgaagcacatcaacctaaaccgacaacgtttgctgcatcatattgtcggattcggctcaatcggctaacactgtccgactcgaactctgccggtcttagccgtagccgattcaaacttcagccgattcttactctgttttcgcgacgctcttcatctttgattccgctttgatctaatcttctttttcgatgctgacattaccaaatttggtcgttaacacatgccccccaagtccggaatattggataatgtttcggatttgccatatgtcgattccgagagaaatccgctcttgccttttcccgaccgttattccagcgctttaaatactaaccgttacccccgagaaatcacaccgtcttctcccgttttcaccgccgaaaccaactatgctttctctctctccggcgatttctccgacacacaaggcgattcccaggcgacttcatctccggccagatctccgcctgcggcgatgtcttgttccgccagcccatctgccgcgccattagccgagtacactgaggtaagttctcatcggctagatctctctcttttgcaacagattagttttctcctgccttatattgttttcttcttctctattcctgattgcatccgtagcatctgtccaatcttgttgcaattccaagtctgtcgcatgacaaccactatttccttggtccaattggtgattccgaccctactgaattcatcattgccaaaaccaacagaatcccctttagattagcgaaccctaatctgagcgattggaagaacaccttcaagtcttggccatccctcgagaaaacctcccctgagaaaagctggaccacatggtataagcgcgtatcggctagcaagcaggttcattgggatgaaattggaatcggccaggtactcgccctcactatagccaattcagctaaggatgagcccctaatggcagctgcctcttacttctggtctagtgccattaatgcctttttgttcaaccaagggctgatgaccccaactgtgatcgacatcaccatgatcactagattagatgtgacttcatcggctaaccctatgagtttgaacaccaagaaccagtttgatttcaaaaccaaaagcataggtggttggtctggttatgtggcagcatatatgggccaaggatctgtcactcctagggaacatgtggctttcctgctcatgtggttagaaaaattcctcttctgcggaccaggttgtggtcccaccaccaactggcaattcttagccgaagcccttgaaacaaaaaggcaattccctttgggtaaaacccttctcggctacttataccaaatgttgaacaatgcatcggccaaaatagctatcggctcagtggttggagcaggaggaccatggtggttattgcaatcttggctaaatctggtagttatgaaagccgttaatcggccatctgtgacagaagctgaatttccaagactagagccgattgcagatgatgatggagaagaacgcacccaccgcaggtgtatgtcctatggggaatatgcatccacaccagccaatgcaggagcaaagttatcggctgagctgctcaaggactggttctgcagcttttatgaaagctttcaaaaagatgcacgtgtttggttcttctatgagaattcagccgacttggatctcccatcggactttagattcgaagacatcaatcatgagagataccaaaaatctatagaagttttctcaacttcaatcagcccatgtatccttcctgttggcattcatcaaggaagaaatatacaagtttcttatgaattctactatccgatgagctctgccagacagttcggaatgggacagctaccgggagaactccatcggtttctcctaagcaaactcctccaactccttctgctctagcccatttttcaagggtaagcaaccgcctctgattctttttgcaactttctcacttatagccgattgctcacagattttatagttgcaaaaaaagaaaaccgctgtaaagaagaaatcggcagcaccatttcccaaatcggctccaccagtgagatattcttaattcttttagtagttgatcccagctgatttttcctaatacttatctttttgcagcctcctcctcctccttctcctcctgttcagcaactatcaagcgatcaaaccccatcggctgcagggagtcaccatgttgaagaagaagtacaaccaaccactcctgtcatcccagtaagtcttgtctataaaaatcttgaatcggctgaacaactcatcttgataatcaactgtcttcaaatttcctcctgcagatttagccgatttattctcttttgacatcaaggattactttgatgaggaagcaaaagaagaaacatcaagcaaaactctagcccctctaaatgaagatgtcaagaaaatccttgaagacatatgtcatcggctagggtcatcactggacagtctggtggccgattgtggttcaatccaggcacgatttgcagaaatccaagctttaatcccagatgatctagcgaacaccatcactccagctgcgtaccttgagcaacatcaattcaagctggagaaagctaagcaacggatagccgatcgatgggagcgaaaagacattgaagccactatccaagccaatcggcaacttgtacatgaagaaaaattcaagcttgatcaactgtctgaaggtccgatcaagtccaatattgatcggctcgaagcccgcaagattgagctcttggctcaacttcaagaatgtaatgccgaactggacctggaacacaagaagctagccgatctcccgcgagttattgaagaacacaagacaaggctgaaatcggtcataaaaaacgttgctgatatgaccaagtccttgaaaatcatccctggaatcgatgctcaagatgcccaagctattgaggaggtagaacaaattaggcaaagggctatatcgctatccagcaatatttgtctcagtgacttcttgtgtaataggccttaggaaatttttgtaatcggctaagatgctttggtactatattcaactgtcttgacgatcctttgtgccgattaatataacttcttaacttgctcaaaaattttccaaatttgcaacttgt

SEQ ID NO: 80231 - DNA, 13756 bp, Oryza sativa
  unsure (1)..(13756): unsure at all n locations
ttactcattctcgcatgcccgcacgtcgactttagaggatcccctgtctggcccaacatatttgagacatctccccatgtcatcaatgctgtcatggttgcgattgaggggatgagagttgctcttggtccagctgtgatcttgaattactgccttcaaggccttttccatccagcaaggaaagtacgtgaagtatattggaaaatctacaactcattatatataggtgcacaagatgcacttgttgctgcttatcctgcactagatgatgatggggataacatctacagccgtccagagctggcgatgtttgtctgatcaatgtaagtgttgtttctttcctattattttacttaaatttcgcggcaaatattattgaaacttctgctgtgatattgtatcatgggttcacatttgttcattcaggtgatttctttttctaaagagcaaccattgcattactcgtatgtatgattccttttggtttactgctgtccttgcaagtgttttatcagttagcactgttccttgacaaatgggtatccttagcctgggctactgtatgttattaggccttaggcagtttgacctgctggagtaattgtaacttgaaacaactcagaaaaatagagctgcagctttttataaatcactttacattgatatgttagaattgtatggtcttgttggttacttggtttcagtgaacatctatcacgagctgcctatattgaatggactaggttgcaccaacagctgatttgttctgtttgctcattttcagtggcgccaacgctttggttattgttatcatatgaaccatagtgtgcaggcactagttcgtatttcctttcatgtttctttctgcaaatttgctttatgttctgcctttttcttccctctatgcaaagaacacatctgatgtgagaacgcattggcaggcaggatgtacatttccatgtaccgtcatccaatatatgcgtgtgaagcttgaactaggtggtatttgagttggctgatattcatatggtgtttacttgtgatggaagcattttcattgaagttgcatttcttttttctgtatttgcaggcttgttgcttctgaagggggtgcaatgtttaggatatatttccccctggtttacttgtgtaatgtaatgataaattgctacctgttctgatgtactgacgtttttgttactggttttgtgttcagggtattttgacccggtttgctgaggagttcccttagattaaagatcccaaggagatgatatctgtcctgcatgtcacactttgttgccgttgcatgatcccctccgctctgaagagaaaatgatcaaacatagtattactgctgtcccaaattcccaataactgtattattagcaaaaaactgttataagctacggtcgagattgtgatcttgtcttattattagcgtctgtattagtaatgttattactatgcctggaacgtcacttatgtatgtttggaacgtggtattagtattactaccctgctctgagtctcagatggatcaatggatggatggttttatcttggtgtctgttttcttcccggattgttagttgttactctagaaaatattttaaattgtattgtacctgtatctaccccatccaacctgagaatatgttgtggtttgtggtccatcagacaagctcctcatcagtcactagttacctatctgagaacaagaattgtggatgtcgaacttatatttgatactacctctgtcccattttaagtttttaggtgcaaccataatttttcgtgtctaattttgatcgtccgtcttatttgaattttttttaaaaaaaaagttcaaaaatataagccatgcataaagtactacttatgttttatcatctaataatgataaaaatactaatcataaaaaaaatcaaataagatggatgatcaaagatagatatggaaactcatgactgaacttataatgggacgaatggagtagcatagaacatgaattttgcttgaacattgcggcacttgtgaattttgcctggagcggtggtacaaaatactcaggaatcattccatattcccatccaactcaacgcccagacgacgacgtcgacgcaaacgcccacatatacgagagcgagtcacaaaaccaaaaagaagaagaagaagaaaaaaaaaaacagcagtagcagcggcggccactgtttctctccgcgtcgcgcacacgcttgacgccacgcaagaggaccaggtcaggtccggtgcgcgtgcgtgcacggtgcaccacacccacacccgtgtcggacgcggcggctcaaccgctttgacccaccacccgcgtctggtttatgcgggccccacctgtcagtcagaaccaccaaggcccgtccggttcgcgccgcgctcccttcgttcgtgcgcttcctcggtcgccggcgatgccgatggcgccggcggtggtctcgggcaagaggctcgtcgtgttcctcttcgtcgcccgcgtcgcgctcgcggcgccggcccagctcgccgccccgctcgcagtccttgccgcggccgccctcgccgtcgagctcgccgtggatgcctccgcctccgcctccgcctccgcgtcctcatccccgctccgccggttcaggaccaggtgcgacgttatatcctcccccgttcttatccgtattttcttccgccgcatctccacggagctgggctgctagttcgcgcgatttggttagcttgggggattgcgtgatctttgataccagtgttcgagtttcgaaccccccacgaattaagtcttagaggagctccctgtgatgccagggaacctgcaaggtgcagtgtttttgcaaaattcgttggcgcagccgtagaatctgaggcgaatttatccatttgttggttcaatgctggctgcctccctgtgaggatcatgcaattggggaaacgacatcagtcggattcagcataccgcaggaatgtgattttacttgtacttgaggcttagtggattttattttggttcagtagtgtgtaaaatggggtcagatattggtggttccaacaatccaagggacaaatatcactcttgaataattgggtttcagcatttcttagttaacccatttcacaaatgggaaattcagaggtgcttttatcataaagccagtcaaaatattgctcccattttgatggccaaaatactgttccattgcattttcagctgaaacgttgctcccactgtcatttatatgggttctgtgatgtgcaatcctagttgcttactgtaagattttgtcacgtcttgtgttgtgaggacttcaccttcttgtggtggcttgatgctcttgtgcatgtttctgtaaaagattgttcagtgcttgatgatgatatatgtatatgctccaggccgggtgcttcatcaggcatacttcttggtgccactactctgcctagtgtcatgctttcacggttaattcaactttatagggtcttactagccgatcctaatggacgtgaaggtatccatttttctattttgtcaaatttatcagttccattactaaatggaaatttccccaagtcttcatcaacatttcaaatcttgtttgacactaagattttcggtgacgcatctggtttactaactacatatgtggttcattgtcagaatatgcataccttgaaatgcagtactgggcagtatctgttagctgcctcagcatgttagcattttttgtttggcatctacggcagtctcccagcaatggaaattctatagcttcgaaatacggcttgttgctcatcattttatatcccctggcatacttgtttcaccttttactgaagactgatggaggtacatgcatattttatctgcatgcaaagatagtctcaccctttctttccaaaatctggtggaagttcatcagaagcaaggaattacaaactaatctaggttgtcttaacaggtctgctggtgatgagtaatttggtgtatttgctgtgtcatggagtggctgctgtgatcttaatccagcatattctagagaagttcccttcatgttcatcttttggtttgtacctgaagtctaagatgtagatcttcttttttttttgtttatatcagactgcatatgtttagactttagagctatccatacgattgctagttatcctaccagtttccatgcaggcatggtgcattatgtctacactgttcattttttaaaatttaaattcagctaatttgtgtggttcctattggccgatgcaatgtatatgtctccttttcatcatgacttgaagctattgctttttttaacttatctttacattttctgtgaacttaggggaggccattttggtctcaagtggtcttgtttctttactgtggtgatatgctggctcatactctttcaaaggtgtgatttattcctcgaactatgttttaccagcaaaatggtagcaaatctgatacttattttgttgcctgcacatttgcaaccgtgctgctggcagatggagttctccgtatcatcagaagcatttattcgcgcacctggaactcgaaacgagataggcacagttattcaggtagaagctattgcgttgtctggcttcagtttcttagtgcataatacccttcccttttttttcttttctgcagggggttttgcttggtctttttcttctccccttgttatacaaaagctcccttcaagttttggcttactgtagaaaactggagagtcaaagaacacaaacagttgaggaatgcacacagaagagaattgactgtggtgtattttatgtttcattgttgatagcactattgttgttagtgccatcatggacgcgtcttattcaaggttttgaagtgcatccatttgtttggtgagcatataagtttgcatttcattggaagggcataaaagcatgcactttgttagtcaaatattgaatttttttttcctgtgttgcttctaaaccttgtgcatttttgtacatattgaattttggttcacttaatggtttattatttcacagggtttttaactatattttcaccgattcacgtgaacggcttgctttatgcgcaaactggatatttgtgatatatgtatcaattagaaggttctacagtatatcaaaacaaagcaaaacggagaggattcttttgcgcaagtattaccatctcgttgctgtcctaattttctctcctgcagtaatatttcaggtaatatatgttttcgttattcgatccctatcagattgtttgaaacacactcccaataaattttttctctttgcagcctgatttcttggacttggcatttggtgcagcatttgctgttttcttaatattggagatggttcgagtaagcattttctttatttgtatccctttctttctcccgtttctctgttttttggcagtttgtatgccaacatgtgctaatttctccaacgaaatgtttcaccctgacctcaggtttgggaaatataccctcttgggcatattgtgcatcagttcatgagtgctttcactgatcaccgcgattcggagattctaattgttaggtaggtctggatgaatggtcgttgttttccagattttaactcatttacatgctcaatacttggataggcctaatactatatttgttttgttcagtcatttctcactcttgctgggatgtgcacttcctaaatggatgtcatcaggattcaatgaccgacctcttacaccatttgctggaattctcagcttgggtattggtgataccatggtaggttctatgtccagtgtgtgatcagttaatattttcttatgttagctgcgttcagtatgatgaattctcttgttttacctaggcatcaatgataggttataagtatggtgtcctaagatggagcaagacaggaagtgagtttgatttccattattatttattccatggttgataattgatctcttatgcacatacttttgaaatgttagagaaaacaattaagggcacagcagcaggcataacttctgtattagcagcctgctcaatcctgctgtcactcttagcttcaagtggatacatactttcacaggttttactttcccccctggcattaaaccatttgaagcttttattctacaatacactaagcaagcataaatcctgaccatctcttttatattaacacagcattggatatcacttttggtagctgtgacattgagcggtttattggaagcatatacagcccaactcgacaacgctttcataccccttgtcttctatagcctcctatgtctataggagcaaccagttgtacatcaaactataccttgaggccctattcttaccatgacttatctagtgactagtgcagtacagtataggtatagcccttcgaaatttttttttaaaatcctcttattggtcgcattctctgtattcctggaccgagaaattgtgtccattactaaaaggttgagtttaggtttaggaaataaagatgaaaatatgaaaggttgtttagtgaatccttcagtagagagcatctttggtatgatagacttctgagcctatctggaggcaacaaggcatcaatgtatcatggaaggtatgttgtctttcagaactagaacttcttctgcaggtggtgatacctgtttcaccccacaactccacaagcagttgggcaagaatagcaagctgagagtaaagccatatgctgcaaggagcctgaaatacggagacttggttcagaattaatgtatatatatatgctaccttatttccatggacatgcgaagggtaattagttgtagtagctaatctcctgtaagttttgcgtcatcactgtacggagtaaaagataactactcagattgcaaccgcgcattgatgtaaattttgttcttgacctgagaaaaaatgaaatcgaagtaagcaaagctgcaaattaatgttctcctattatgagattggcaggtttgcgatgtttgagttgtttatgtgatctgtttatctatcaggatacctccacctgccgacttgccgtgtcaagttcagtcagatgattcttgcctaattgtctaattgaacaaaagtttagtcagaagttcaattagacaatggatgtgcagattctcacatcagtagtctttaatatggtattctaagtagttcttttttttttcaaatcaagctgatgaaaataatccgtgtcctcaatatggtattctaagtagttcattttttggacttcgatcgtcctataacttctatgataatcaaatgtcacaacgcataggccaaaatgaattcaattatcttaacatgaacttctatgatccaagcctgtcacaccttaaaaatcctaaatatataaattgttgtttaattggaattattagaatttattttaaaaagccttgaaaagaagatctagttttaattaataaattccaatataaaatggggccagataaaatttcattaaatactttgcttaactctataattcctagatttttctggaatttatttgagctaaggaagtatttttaataaatggaattgcatttcatgaataatttaaattgaaaaaggtttttaaaagtctcttttggctttgggccgaaagtcggcccaaaaccctctctctctcctcctcggcccaagccggcccagtccgcagccgagccgcccgctcgcgcgcgcgcgctcgctgccgctgacaggtggggcccacctgtcagtcttcgtcttcctcgcgccgctgccgccgcccgaaccctagcgccgcgccgccgtcgtctcctttcaaatccaaccgcccctttctgtttccggtgaaattaatagaggggaaatgatcctcgggatcccctctaccttttcccttttggaaacatcgtctaaatcgttttggaactcgcggattcgagttcgattcggatcaatctctctcctctgaaccctagactttccttcgcgtcgccggtcgccgtgggccttcgccgcagcctccttgcccctataaaaggacccccaagtccaccgctacctgctgccaccctcgccttcgtctctcgccgtcggtagcgccctagccccgtgagacctcgcgccgccgtcgtcgccgccgtcgctccagtcgtcgccgtcgctcggggaggtcgccatcgtggtcgccgtcgcgtcgccgtcctcgtccgccccttcgccgtcgctgtcaaccgccggagcaccgtcgccgtcgtcaagccgaagagtgccgccgccttctcctcgtcgccgatgtcgtccggtcatcgtccgccgtcgctttggtcaccggtgagttcgccgtgccgtccgctacccgtaggagccctccgttcgcgctgtcgtgccgtcgttcgccggcgagcatgcacgcccgagccgccgccggtggtgacgtcaccgccgacgtcgtcgtcgtcgtctctcgtggtccgaccgtggaccggtcgatctcggccgtccgttttggatggaaagatctcggccattcgtttccgtaagccgccgccgtgcacccggtccaccgaaaaccctagccgctgacgcaataattcccttttccttttcaaaaataattcattattgcgtcataattcaattaaaatccatataagtgttttaatccgatttaatctttaaaaattcataactaattcatcttagctcggatttagttggttcaagtctctaaatttttctaaaattgagatctacatgttaaaaatatccacatgtactgttcatgcttgtttatgtgctgtttggtgattttgctcctttttgtttagattccgacgtttccggagagtctgttttcgcaggagaagaatttgaagagttccaaggccagcaaggcaagtcacacagatcctaaacacaatcctttgagcatgttgatcctatatttaaattctctatttatttcaattgtgcatttattttcgaatgtcactgggtagtgtgaatctattcctttgttatggcctgtttgcattgattactttattccttgataccttgggttattataacttgactagttgggctatatatattggttcagctagatattagataagattgcttagccatgcttagaaacattagcacactattgggataacttatgactcactattatttaatgatggcttaatgatagttcacgatggtcaatcgtgattggttaattaattacttgccaactaaaacttgataatggtgggttgtgagcacatggttttgagagtcgtgctcatgacaaataaggaccggttcacgagtttcggttgtgaaacattaaccgtgccaaccacaagccagcgtgggcaacggctttaccttttgtatagcatggttcattgcggagcaccagactgagaagtggcggagataagcccacgggggtcgctggggagtccatgccttgtttataagggggtgattatgatccaggaaaggtgcgctgtggtggattgtgttgtgcgaggggtactgtcacagctcctttccgaggtaccgtggtggtattgaggcacatggtgacatgttgtggggctgtgtcttgtgggtacagtggtacacctctggccagagtaaaactattcgaatagccgtgcccgcggttatgggcgggtctaacaatgtctttcgtgattagtctcacacttctcaccataataaaagatgctataactggtaataatttgattagctcctggtttggaatggtatattcctggtttggagatagatctgtacagccgggtatggttgttcaggatggttgggcctgagcagcatgggtgtgctgtttagtgttgattaaaattggtgattaattactctactgttttataattctcaaatgtttgctaaatgctgcttttgcaaatgagccctatattatgccattctttggtatccttgtgcacttgcatatttgctgcgtggcttgctgagtatgtcatatactcaccttgcaatcattcatcagaggaagagttctacagtgatgctgatggtgtggaggattaggtgtagccctggtcaagctgcctgtggagtggagtcgtctgcgccgtttatcttatctttccgctgcttagatctttattgattgagaggaactatctacctctgtaatgacattttattcgcttattaattagagtaataattgtactctattatcaatttgttattgtgtgcctcggctgattcctgtacgagggttcacacacatgtaagcatttggaattttggatagaaattccgggcgtgacaagttggtatcagagccccttgaccctaggttatgccaaatggttacccatagaagccctctaaaaatattggaaaagtagaactgttctcctccccttctcttttaattaaaccaaactaatagcacatgcacttcataatctcttttagtggttctcattcaaaatttattccagtgttattagtactgtacatctattactgtactaatggctcatttaccagcaaaagttttacaatattgttttatttaatcttgctgcaatgaaataaatttagcatgttgattttataactttcttttatttcttttggaacctgttgttcaaaagtacaaaatttgtgaccttgtttccaactgtttcaacttatcttgcaagcttggtttactttatttacttaccttttactttgattttctaactttattcaaattaatccaaaaacttgtgctattaattggataaatgtcttaactccctcctttcacttgtctttagatgccgcgctacaagcctgagtacttgtttggtgttgagggatttgtccaggagttgcgtacgatgtcctttgccataggatttgggactgcccctttgtatgcccagattcctcacgatcgtcacgaaaagaagtgccgagtcaaagtcaccttgaacagtaatagtgaagatatctcctcagtgatgttcgaagctggaggaggaaactacatccatgcatgtcaggaggtggcaaggatcgccataggagagctccgcgatcgctacagtgatcagttggccgacaccttatcgctaccatcctcgccaaccacagggaagtgaccatggcagctaccttgagactgagggaattgagaatgatgctaccacaaggcatttggttgagatgctgtgggctatggatgaaacccgtgcgaagactgtgttagcggctcaagatcgtgaagaccagaatcgtggtaagatttgcaagctagaggacaaagtggatcgtttggagaaggaactagccgcattgaagggagaagcaccaccgcagaaggccaggattcgtcttaccgcaaggaagagagctctatttgtccctcgctaccaattggcgccaaaggtccgtgtggtggagaaagaagttaccccagccctagcggatcctccggtcgtcaacgtaagtgatgatgaaggagaagaatccaagcgcacccattccaagatcgagtggggagccactcaagatgatggagacgagccgaacgagccttcaatcaactccgatgcccggaagacctagaatgccttgtcaaaccgttgtcttagatcgttgtgttagtttgcttgttttaagtttggttgtgtgtttctcgcatgtgatttacatcagtggtgggatgtaagtgcatgcgtttgtttgttttcgagtgttaggtagttggtgagtttagtggtgtgagagtcttcagttttgtaataatgaaactcacttaagatcaataaaagttaaattaattctctgtcctaagtagttttccccggtttctcttcttgtgctcctgcccatgccagatggtgctcactcgcagcgacgggaatggccccaacatcaacaataacaacaacaatggagagaatcccacacttgcccaagtcctggctcaacaggcacagcttatgaacatgatgatgcagcaactccagaaccagcagaaccagggaaataactatgcacctccccagaacaagttagcagaatttcttcgtgtgaggccgcccactttctctagcaccactaatcctgttgaagctggtgattggctgcatgccatagaaaagaagttggatttgcttcagtgcactgatcaagagaaggtctcgtttgcatcacaccagctgcatggccctgcctctgaatggtgggatcacttccgccttaacaggactaccgctgaacctatcacttggcttgaattccccgctgctttccggaagacgcatataccatcgggagtggtgtctctcaagaagaaggaattcaggtcgctcacctagggatctcgcacggtcaccgagtatctgcacgagttcaatcgtctggctcgttatgctccggaagatgtgcgcactgatgaagagcgccaggagaggttcttggaaggacttaatgatgagctttcttacccactcatgactggggattatcatgatttccagaagttagtggataaggctattcgccaggaggacaagtacaatcgtgtcacgcccaggaattcacgaaccagaatttttaagctgaatgtgtattaaacccctgtccaggaccagccagggtacacaaacgacaattgttgacatacagattcacgtcttacaaaaatataaaagattacaaatgcagcggaaaaggtaaagcgagctaagcctgaagacttgactcctgcagcgggcgattccattccacaggcaacccttgacggcagcgacgaaaccaacctcttcaagacatctccaactgagaagaacttcaactctggtgagggggaaaagagagcaagactgagtactacccactgtactcagcaagtcataccggaagagggggggtatgatgcagggtatatccaagggaggctaaaggttcttttgcataaagccggcatttcaaagcagtagttgaaagcagtaaaacagtagtagtaattaatccatattaaccaatcactgtccaacgttacaccacgttgcaacaggcccaaaccaccacctgaactaaccagttccaaaagctaactagggtgaaactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcctgggtacgtcggctagagaaaagctacactacaagcccagccgttgcccacgctggcttgtggtaagtacgataagttcttccagggcatcccgcgaaccggtccttagtcgccatgggcacgactagcaaaaccatgcacccacagcccaccatgtagtgtattttaattaaccaacaccattgcggtggcactaatccaaagctattgccaataatcaaagtctatgctttaatgtgatccccttttgtgcagggtacgaggtgtacatcatnnnaacacg

SEQ ID NO: 80232 - DNA, 1515 bp, Oryza sativa
caacgccattcgcaaccggacgccgccgcctcgactcgacgtccttcttcggatcttgctcgcccgccgcgccttcatcctccgcgaccagctcgtcgctgccctcgtcaggagctcgcctatgaagttctcgtggagctcgccgggccagacggggtgtggcctgagcttgcagcacatctcccatcagatatacttacacgcttgtggggacgctgacgacgccgaagcggtacgagcgtcgcaacatcgtgcatctcgatagcgtacgcgctgcagccggcgatgcccgcgcatgtggacgtccgcttcgtgttctgctccgtgacggatgtttgacgatattttgtcattttacgttaagcaaacaagattactatttataaaagaagctagctcgctggtttttatgagatgcatgggccatgcaaactctcgctggcggcggcgctggacgcaatggtgggacgaggtgggggaggtggctggggctcgtgacggctgtgtgggtgcagtgcatctacggcaagaactacaccatcttcaactaatcccactccatcaagacgctcatgggcctcacccaacagctgctcaaaacagcctctccgtcgccaaggaagcgtcgggccgtcgctgaggccggccagctctgcgccctccccgacaccgtcgcccagttcttccgccaccgccgccttccagtttcttccccgttggccgccggccgcgccaagctcctcccccgccgccgccgtcagttcttccccgtaagccgccggccacgccaagcgtcgtcgccgcgtcacgtcctcgtcagcctccgcgcccaacggccgtggcacccgcccgcgcgggaccgcttctccgccggcggtgacgcagcgtcaccgacgccattcgcgaccggcctccgcctcgccccgacggcctcctccccagccgccgacgggcttgccaaaagaagagtgagagagagataggaggaagggtgaagatatagttggccatgtgggccgcccggcacggcacggcccaggcccggccgtgcctgggccgaggcttgtcgggccggcacggcccgaccgacgcaccgggccgtgccgtgccagcccacgtgccgcgctcacggcccaggcacggcccaacacgcctcgggccgtgccgggccggcccgaaggcacgatgggccgtcgtgcttttcctcagaataagtctaaatttcctccctcctattgggctgtgacatatgtacagctacaaaaagtctattttacctccctcttctttgggctggggtatataaatagctaaaataagtctatttaaggtccctattctttagacagttacatttatatgtctatttttagtccctatactttatgtaccgggcctggcctgccggcccatcgtgccgggccggcgcccccgccgggccagcccagcgtgccggcggggaggcccaggcacggcccgacggtcgggccgggccagcacgggcccgacccaagt

SEQ ID NO: 80233 - DNA, 2097 bp, Oryza sativa
  unsure (1)..(2097): unsure at all n locations
gggtggagagattggacgatgcgagaatgggggaggaagagtaaaaattcgtgacacgttgtcacgttcatgtcaatctggcacgttacgaatagagtctcgggtccacgttacacgtttgatacatgggacccaccaaggaataataattaactaatttaccaaagtaactaagaatttaccacggggtccacatgtcatagacatgtaatgacccacatgtcatagatagccaaatcttcaaagtggcaaaaaaattaaatacccaaaacccccctccgttaaacccgaagaaaaaaaaccgcaccaccagcgtggcgccgatcggagccaccggataaatgtggaaggtcgccgccgacgcggcagaggggtggggcggctggatctgcgcgtcaatcctgctgccgaagacggcgtccgtcgtcgccaacctcgtgcgtcatcttcgaggtccaaagtcggcgacgccgccgacactcgcggcacctagaatgctcaacctcgttgtcgacgcggtgacggcgcagttggcttcgcgctccgccgacggcgtgccccactctcaccgcgaggccagtttcccctcctcctcagctgtcgtggaggacgtcgcctaaaaccctcaccttcaacgcgttggcggtgtggcgtcactggctgtcgacggaaaccctcgcctccgatgccgtagaggtggaggatcgagcgccactaacaaatccatggattccaccaacgaaggcaatggcctctatcgcggcgcctcctctgccagcgtcgcggactacacccgcaggcccggctaaggggcctcgggctgctacttggtcggcatcgacaactttctcacgtggctactcgacaaatcaattcatgaaggtccaccaacgatgacaagagtcacaagatagattctcaagtcctttttaggccctgtttagttcacaccaaacttcccccaaactccaaactttccatcacatcacatcacattacatccaaaactttcctactcacataaactcctaacttttttttttccaaactaccaaacttctccccaaacttcggaactaaacacagccttagtcaaatactagtacaatcttaggcctagctccattaggcaatttatcttatgttttcggtggcatgtcaaacaagcggagcgattagcaaatgactaatcgagtgttaattactattcctatcaatttaagaattaaattcatttaactatttgataaagatatttttatatagaaaatttttagacgaaatacactatttaatagtatggaaagcgtgatcacattaaacgagtgatttcttttagccaaaactccgttaagaactcaatgttgggctagattcgaaagtgagtttggattggaccactttttcattaaggcgttaaccatgagcacgtttacaaactatttaaacaatgtgtttttaagtacaagtttctaaaaaaaaatcaaacacatttttaagttctaaatcttaattaattgtgtgttaatgactacttttgttttgttttacgtgaattggaaatctcaatcaaatagtagtagagcacttcagaacttagcctaatattttttttggagtgcttcctatttttgaagtttaattttatacgagagatttaacagcccacctcgcaaaccccaaacccccccccccnccnccccccttacagaataccaaaaaaaaaaaaaaaacgatcaccccacaaaccccccgttccattttaagaatccccaaaccaaaatcatcagttcatcacccccaaatgctaaaggccgccaggttgcctagggttttccccgcccgggtttcggcgccggggggggtttttttcatcgtcgcccctgttcaggttatcgccgttataccactttagttttccccgtgggttgtttccgcgctaatacgttttattttacaggagttttttcggccttggttagggtggtcgttttcgtcctcgggggttcgtgcgctccttcttaatttgatttttcacttagggggcccatttcccttcttggagcgtttctcccttacttccgctggatcgtttcc

SEQ ID NO: 80234 - DNA, 6594 bp, Oryza sativa
tccccacctgaattgtcattgcataaaagaacccatataaatgacagtgggagcaacgttttagctgaaaatgcaatggaacattattttggccatcaaaatgagagcaatattttgactggctgtatgatagaagcacctctgaatttaccatttgtgaaatgggtcaactaagaaatgctgaaacccaattattcaagagtgatatttgtcccttggattcttggaaccaccaaaacctgaccattttacacactactgaaccaaaagaaaattcagtaagcctcaagtacaagtaaaatcgcattcctgcggaatgctgaatccgactgatgtcgtttccccaattgcatgatcctcacagggaggcagccagcactgaaccaacaaatggatcaattcgcctcagattctacggctgcgccaacgaattttgcaaaacactgcacctcgcaggttccctgacatcacagggagctcctcgaacacttaattcgtggagtttgaaactcgaacactggtatcaagatcgcgcaatcccccgagctaaccaaatcgcgcgaactagcagcccagctccgtggagatgcggcggaagaagatacggataagagcgggggggaggatataacgtcgcacctggtcctgaaccggcggagcggcgatgaggacgcggaggcggagccatccacggcgagctcgacggcgagggcggccgcggcgaggaccgcgagcggggcggcgagctgggccggcgccgcgagcgcgacgcgggcgacgaagaggaacacgacgagcctctcgcccgagaccaccgccggcgccatcgccatcgccatcgccggcgaccgaggaagcgcacgaacgaagggagcgcggcgcgaaccggacggaggaggagaggtgggctctgtagcctgggtcgggccttggtggctctgactgacaggtgggtcaaagcggttgagccgtcgcgtccgacacgggtgtgggtgtggtgcaccgtgcacgcgcaccggaccgacctggtcctcttgcgtggcgtgtgcgcgacgcggagagaaacgattttgtgcctcgtatctgtgggcgtttgcgtcgacgtcgtcgtctactgatgggcgttgggttggatgggaatatggaatgattcctgagcattttgtaccacctctccaggcaaaattcacaagtgttgcaatgttcaagcaaaattcgtgttctgtactatcaaatataagttcgacatccacaactcatgttctcagataggtacagaatttaaagcaactttaggtaactagtgactgatgaggagcttgtctgatggatcacaaaccacaacatacgcaatacaatttaaaacattttctaaagtaacaactaacagtccgggaagaaaacagacactatacgatctaaccatccatccattgatccatcaactcagagcagggtagtaatactaataccacgttccagacatacataagtgacgttccaggcatagtaataacattaataatacagactctaataataagacaagttcacaatctcgatagtagcttataacatttttttgctaataatacagttattgggacagcagtaatactatgttgatcattttctcttcagagcggaggggatcatgcaacggcaacaaagtaaacattcaggacagatatcatctccttgggatctttaatctaagggaactcctcagcaaaccgggtcaaaataccctgaacacaaaaccagtaacaaaaacgtcagtacatcagaacaggtagcaatttatcattacattacacaagtaaaccagggggaaatatatcctaaacattgcacccccttcagaagcaacaagcctgcaaataaagaaaaaagaaatgcaacttcaatgaaaatgcatccatcacaagtaaacaccataaattgaatatcagctaactcaaataccaccgagttcaagcttcacagttcacacgcatatattggatgacggtacatggaaatgtacatcctgcctgccaatgcgttctcacatcagatgtgttctttgcatagagggaagaaaaaggcagaacataaagcaaatttgcagaaagaaacatgaaaggaaaaacgaactagtgcctgcacactatgggtcatatgataacaataaccaaggctttggcaccactgaaaaggagcaaaccgaacaaaatagctgttggtgcaacctagtccattcaatataggcagctcgtgatagatgttcactgaaaccaagtaaccaagaagaccatagaattctaacatatcaatgtaaatgtaaagtgagttataaaaagctgagctctatttttctaagttgtttcaagttaacattattccaacaggtcaaactgcctaaggcctaataacatacagtagcccaggctaaggatgcccatttgttgaggaacagtacaaactgataaaacacttgcaaggacagcagtaaaccaaaaggaatcatacatacgagtaatgcaatggttgctctttagaaaaagaaagcacctgaatgaacaaatatgaacccatgatacaatatcacaacttacttcgtaactaacagcagaagtttcaataatatatgccacaaaatttaagcaaaataataggaaagaaacaacacttacattgatcagacaaacatcgccagctctggacggctgtagatattatccccatcgtcatccagtgcaggataagcagcaacaagcgcatcttgtgcaccaatatatagtgagttgtagattttccaatatacttcacgtactttccttgctggatggaaaaggccttgaaggcagtaattcaagatcacagctggaccaagagcaactctcatcccctcaatcgcctccatgacagcattgatgacatggggagatgtctcaaatatgtttggccagacatagttaagcaaatggacaagagcatcctcacagcccaagccagcaacaccaagagccatgtgcttcacagcagaggcagcagtttgccggtgaacaagatctctgtccattagagcatcttcaagcaagggagtaacagcatatatgtaatccttgcccatctcaccaatatactcaaagaggaaagagagagacttcaggacaccattctgaacattgagttctgggactcggtactcattcatcagggcaggcagaaccgtaaaaggtgagcaggtttcagcaacaatggcaattgcgacagttgtgcagacacggttttgccgttcctgcaccttcaagttattcaacagagtagccaacacatcctgcggcccaatagccttcgcaatataaccaaatgtgttcacggtggctcttctaatacccttcttgtgagccttcaacatttcaagaagctcaaaacaaatcctcatccactccctagcaggcacaaattctgctccacgatcagcaatcctaccaactagatcaatgcagttctcctggaccttctcatgcctattcttcaagataggagtcagccgaggaagaagatccttgattggcggtgtcatcttagtcataccaatgacattcacaatagctttcaatgctccaagaatcgaacccaacacctcagggtactcttctcccaaatactcatacagcacaacacccaaatgacccataagctgctcctcctgacactgtttcatcacaatagctatcctcgagatcagatcagcagcttgttgcctaacttttgcactcttgttgttcaaccgccacttaatggtaccacaaatctgaggaaggtaaggcttgaccctctgtcccagtgcattgacaacagctccaaaaccattaagcatgacatttgcatcatcacttgtctgctcttggaaagcatacaggatgccatcaataagcagctcctccaaacgagcatcaatatctgaagcacccaaattagccacaaccttctcaattgtttccatcaccattctcctgtaaggctcgctttcatctttcagatcctcaacaatcctcccaacaatatcagcaactccaaccttatttgccatctctaccgttgtttccacaagctgcttatagttcctgcggtccagagccattctcctaacccagaagtgacggaaaaactcaggaaggatgtcattccggatataatcagcctctacaccctctgtactgacacactgtttaacaaccttcaggacaatcttcttcatctcttcatctggtgactggaactccctaatcaggatttgcatgacctccttcgtgtagtaactggcatacagcgcatccataagagggatgatgaaaccaatagctttcaagaaggcagcaagaacctttccacggtgagatctgatacccttccacagaggcttcaaaacagtatcaaaactttctataccatatggtgcagcagcctcagcaagtgcagcaagagaaagggcagtgattgtccgcactttctggttctcgtcactaagaccatgctcaatgatctcaactagggacttgagatgtggcagaacagcgcagcccataagaatagcaatctgctgaacaatcttgataccagtgtgccgagcttgccaggacttcttactctgacagacagcctttaagaatggcaggagagcagggatacccaaagcagaagccaccacgctaaatgctctagcagtggtatttctcacatactcatcaatgttatcaatatctggtctcatggcggcaatcatggtagcaagaccagcagctttgctaagatttgagataatctcccggccctcaacacgagcatagtagtcctcatcaatcagaagtggctcaatgaccacaagaatcttatgcacaaacggacggactagctcatccagcttatacagtaccctgtcaatgaccttcaccagaagatgccgctcctggtcctcaagtgttggctgcatgagcaagggtagaatcttgttgaacaatgggccagcaccaaattcccttgctttgtctgtcagttgtcgaagtgctgtcttccgctgtgggggtgtgccattcttcaccttgagcaggagcttcatgatcttcctctccttctgctcttctggagatagctgctcctcctcctcctcattcagcaatgttccaaagtactggtaatcctctggcttcatgaggggcaacccaccaggcaactccttgggcacatcaaactgctgcccacgattctcctcaggaatagcatacaatggtgtgcccaatggtgttggtgtagcgagcagctttcttgctggtgtgcgtatgggttggtatgaagctggaggttcaagaatcttgtacccttcctgcgggaacatagtatcaagctcctcatccgtaagaggcctgttccgctcctcaatgtcccgctcccaccgcaagagctggtactgctctggagtcattggaccacgagaagcaatctggccgggtgttggcgtcgcaaggttgtcaccaccaaatggcgtcggaccaggagtgtaacctgcaggcgtcgcagcaccagtgcctccaggtgtagcactacccatacttgcaggagtctcatcccatctcgatctctgcttcttgggtgttggcgtgacaagcccaccaggcagcttaggagtagcatcccaagctccagaaggtgtggcacctggagtaatgccaccagctgcaggtgttgcatccgcatcggccatcctcccaggagttggtgtctcatcccaacgattccttctcaccgacggtgtcgcatccccgacacgaccaggggtggcatcccagcgcccaatcccaggagttgcatcaggagcatcccaatcggaggaggtcttcgccttcttggatccagcagcagcagaagcatcaccatcctgcgactgatcccatctattgcggcgcttcggcgctgccactggctgctgctcgggcacggccttcttctccttggccttctcctcctcttccttcttcttctgagctatgtcacgcagcagctgctccttctgcttctgcaggtcattttcgcgcatggcatcggcataggtccgcacggaagggtccggggtggcctcaccggcggcgaagggatcatggcgctccggcgagatgatgcgggccagccggcggcggcgatagtcatcctcgcggtcgatgatgcgctgcgacttcttggggaggccgtcgtcctcggcggcgcgggggatgtcggcggcggcgacggcgtggccggtgtaggaggcgaggcggcgggcggcggggttgacggccgcctcggagtcgtcctcgggcgcgtcgtcctcggaggcggggatggaggtgtcgtagccggcgaagcggttggggtcggagccgccgccgccgtagagatcggtgtcgaaggtgacggaggagacggccatgggcgcgccggcggcaagggcctcctccatcttcttgcgctcctcctgcgcccgcgcgagctccgcgtcgatggcgtccatggcgacggcgcggcggggggagaggcggttagggtttggggggtgcgggggggggggggggg

SEQ ID NO: 80235 - DNA, 13200 bp, Oryza sativa
  unsure (1)..(13200): unsure at all n locations
atatgaaaaacaactaagggcgatataacaatatcggccactgtagatcggcaaaccataaccgattacaacataaaaaaacaactaagggtgatataacaatatcggccatctcaaggcgatgcaaacacatcggctatcacgtatcggcaacactaaccgatcatgcattaacccaaacacttgggtaatatttcttcaaatattttccatttagcgctcgtccatatacttctccatcgagtccttgcagcatgtatgctcccttagacacaaccttatgaatctgaaacggtccttcccaattcggcgaccacttgccgaatttattatcccgagtcccaatcggtaaaaaaaacttccatacaagttcaccttccgaaaaagtcttaggcaccactttcttgttgtaatgccgagcaattcgttccttatccctggtacctttgcaagggcccttaatctagactgaacaagtcttccctttcatcggccatgaggttataatactcatcggctgttaaatcattttgcaattccgttctccttgagcggattctaacttcccatggcaaaacagccttatgtccataaacaagcttataaggcgggacttggatcgatccatgacaagccatccgataagacaacaatgcttcggccaaccaagtatgccattgccgaagataatcggaaatcttcctcttaatcaacttgatcaaactcttgttagacgcctcggcctactcattagcttgtgcataatatggtgaggaattcaacaatctgatacccatgctatcggcaaactgaacaaactcatcggacacgaaaattgaaccttgatcggttgtaatggtttgagggataccaaatcgatagattatatgttcttgaacaaattgtatagcgtccccagaatcaaccgtcttcaaaggaatcgcctctacccacttggtaaaataatcggttgccaccaatataaacttatgtcctttactcgacggtggattaatcataccgatcatatcaattccccaacctctaaatggccatggtttaatgataggattcatagccgatgccggtgccctttgaatcgccccaaatttctaacaatcttgacaccccttataatatttgaaataatcctctagcattgtcggccaaaaataccctgcacgtcgaagcaaccacttcatcttatgagccgattgatgagtgccacaaatcccctcatgaacttctccgattgcgaccttggcctgatcggcatccaaacacttaagcaacaccccatcaattgtccgataatagagctcattgtccaataaagtatacttcaacgccttatatcgcaacttgcgagaagccgattgagatggattttgtaaatattgatgtacatcatacctccaatcatcggatgtcaacacaacaacctcaattttaacatccttgatcatcggcttatatcccgatgccccttgggccaaatcattagcttcaatattttgctcgcgagatacatgcttcaaagtcaccagccgaaattccttcatcagttcttggcacttttcattataaactattaacgtatcattcttgcactcatattctcctgccaattgactaattactagcaaagaatcccccataatctcgatagcatcggcttcaactttcttgaataactgcaaccctttgagaactgcctcatactcagcttgattattggtcgcataaggtttaatagtataagcaaactcaaaacatacccctcgagggaaaattataactaagccgataccacaaccatgagtacatatggatccatcaaagaataaagtccatggcacaatctccactgagtcgattgaatcatcacgatgatcaactatgaaatcggctatagcttgccctttgaccgccttcggtgactcataccgaagatcaaactcagttaaagaaaatatccattttccaacccttactttcaaaattggagccgataacatgtatttgacaacatcggccttgcatatgacagtgcattcgttggacagtagataatgcattaaccttgtacaggaaaaatacaagcacaagcacaacttctccacaggagagtatctggtttctgcatccaaaagccgacgacttaagtaaaatacaaccctctcctttccttcaagctcctgaatcagaaccgagccgattgacttctctccggccgacagatataatctaaaaggtattcccttctgtggaggaatcaaaaccggaggagagctaagatattccttaatgtcatccaaagctttctattgctctaccccccaagtaaactgttgatcggctttcaacctcaataatggtgtaaaaggctctaaccgtccagacaaattagaaataaaccttctgacaaaatttatcttgtcgatcatctcttgcaacttggttttattttctggaggctgaattttcttgattgcattaacactcctctgagttatctcaatcctcctctcatgaacaagaaatcccaaaaactgaccagccgatacgccaaaagcacactttgtcggattcattttcaagccatatttccttgttctctcaaaaacctttctcagatcggctatgtggtcctctatttccttagacttaacaaccacatcatcaatgtagacctcaaccaaccagccgattagatcatgatatatataatccatagcccgttgataagtagctccagcactttttaagccaaaagtcattacaacccacacaaataagccgattgcaccaggacacctaaaagccgttttatggatatcttcttcggccataaagatttgattgtatcccgtattaccatccataaagcttaaaatcttgtgccctgaagcagcatcaactagctgatcggcaactggcattggatattcatcctttggggtagcgttatttaaatctctaaagtcaatacacacccttaccttaccatttttcttgataacaggaactatactagaaacccactcggcatatcggcaagtacgaataaaaccagcatcatatagacgtttaaactcagccttgacaggttcaagcatatcggctttgcatcttctcggaggttgttgatgtggtctaacccccggtttgataggtaaccgatgttcaacaattgatcggctgagtccgggcatctcataatattcccaagcgaagcaatctctgaattcctttaacagctttatcaacttggttctgaattctgaagataaattcttgctaataaatgtcggccttggtcgatcacctggacctatgacaatttcttccaaatcatcggccgacatgaaaccctgtccttgcttgttatcgagatcatctactatgtccttggtgtagacctttgaaccctccacgatgccctcaaaataatagcttgggttctccatcttcaattggttgtatatcagaatcggacacttttagaaaatctccatcccaaacttttccagacaaacaatccaaatcatccatctcccaaagagctaaatcggcactggcaacgttgactgacctgtcagctggtacaatctcaatcttgtcgccttgccactgaatcaagcattgatgcatggttgaaggaatataacaattagcatgaatccaatcccttccgagcaacatgctgtaagaacccttcccatcgatgacaaagaaagttgtacggatagttttgttgccgacggtcagctccacattcaaaactcctttggtttctgatggattgccaccaaaatccttaagcaccatatttgtcttgatgagatccttagcgtctctgcccaactttctgaatgtagcataagacatcaaattcactacagccccaccatcgaccatcatcttggacatcggcttcccattgatataaccatttatatacaacggcttgagatgccgattttctgtaccctctggcttctcgaagactgcctgttctggtgacaatgtcaatttagccgattcttcttcaacttcatcaacatcggcctgcttgaccccaaactctgcaggcaacgtgaaaaccatgttaaccgatgcaattacaacactttttcctttggccaatctttttgcttcatcagctgtggcttcatcggctgcaggaacctaattcataacacgccactcctgctttggctttgttttctttaaccgatgatcgatttcctgttcgacctcctgaaaatgctcccgactcctcaatctttgaacccttctcttttgattctttgtaaaaataccagaaggacaccattgagttttcctgttttcattgtcctcctggctacgatcttggtttactggacccaatctttgatgaacaggaactcttttctgcctcagccgattgcctctattacatgatcggcttgaactctttgttatatcactgcatccaggacagtcctcaatagatggcagcctcataccttcattccaacaaaatcgaaaaaactcacaaccccaatgaggatcaaagccgtcatcgttttcctcataatgtttctcctgctgcctgtcatatcttttctgatacttcctaataattttagccgaatttgactgaaaacctcttgcacgtcctccattggctgtttgaccagttgtatgcaccatattaacaggaaaaggattgccatcaaccttcatcggcctcttagaatcatcaaacctaattttaccgtcctcaatagctgcttggatttgctgcctgatgaccttgcaatcattggtagtatgagacccggaattatgctacttgcaataccttttcttgcccaactctttggccgatggaattgtatgaccagcaggaagttgaatctgtttctctcggagtaacaaatcaaaaatcttgtcagccttggtaatatcaaagtcatacctctcctctttcccagagttctttacccattggcatagtataacctttttgcttctcacccattcggctgttgctatctcagagtcatcaccatcatcatccaatccatacatgtaaggacaaacgtgattaacctttctagagtttttcctggactctgcaaacctctgttcatgcagggttaccttctgtgtaagatgtgacaagctatcaaagtctttagacgagaatttctccctaatcggaggaatcataccctgaaaagccaaatcgtctaactgggcatcagtcaaactcaagctataacacttattcctcatctctctaaatctctgaatatactcatgcacaggctcatcatgtctttgcttgattgctgttaaatcggacaatttcatctcatgtaccccattgtagaaatagctataaaaatgcttctccaaatcggcccaactgttaattgatccatatggtaaagaagaaaaccaagtaaaggccgatccagacaaagacagtcggaacaatctaacccttaaagcgtccacagccgatgcttcaccgcactgggccaaaaatcggctgatgtgttcataagtcgatgtactatcctgccccgagaattttgagaaatctggaactttgaaccggttaggtaaaggaactctctcaaaccattcagggtaaggctgtcggtataaatttccagcatctttcggcctaagcccgaactgttccttcattacacccgcaatcatatcggcccatggttgttgctgaggtgttccttgaggctgttgtgtcatgggctcgaattgattgtattgaggaacaaactaaggttgagccgatcccccctactgatattgaacttgtggtgatggaggctgatactgataattcaaattgcctccctggtaactctggaaatttggcttaatattgcgtaccaaatgctcgggaacaacttgaggtatcaccgtttgatctggctgtacatgatgaactaggtgctctgggacaactcgattcacagcgtgctgtcctagctgattgttagatgttgcaaacccagccgatgcattcatcaaaccttgctgttgaatcggctgaacaatctcctgttgtcttaacggtgtttgctgaattggttgcaaaacctgccgtcttggagggatctgctgaattgactacacaacttgctggttgggggtgtttgttgaatcggctgtgcaacctgctgccttggtggtgtctgctgaatcggctgctgctgggtcgggtcaacattaggttgaagaggtaagaacatagctacaacctgatcttgcgttagccgattcacattttgtccactatgctgtggttgctctcataccaacaaccgaggattgaccaattgacccggtgctgatggcaatgcagcaggtgcaggagccgataccggtgccgtcgactgagccgatggtgcattaggaggaattgactgagcagctggctgattatcagtaattaatggccgataattttggaatactcctcccagtagataaaccgaccctgtagcttgatactcagccattgaaccatcaaccatttttttcaccatattcgacaaagtgttgactaatattccagattgattgatcaaagcatggtgcacaacatagtcaacctgatcttggaagttgttaaactgtaactgtgctgcgttaccatcttggttaagattaccgccttgaactccctgggaaccatcaccttgaactccaacaccttggaccccttgagagccatcaccttgaattccttgaaaaccatctgcaacacctttatcacacggttgggttgtgccatctggaacttgctgtacttctccatccttagaagaacctgttccgggaatatcagcaactaccttcaccttatacttctgcaccactgtccccttgcgggtctgcatgaatgagtttaagaactggttccgtgcttgctgcatcattgagtcaaaatccttctgttgatcaggtgtcaacttgtctggagtaatggtcacgatgttgccttcattaatctcagataagcctagctgctggatcttttctttaagagaacctggactagccgaggacggcgatgctggcggcttctcggccatggagaaaactgctattgtgattctaacttcttaatgaatcccaccaggcgtgccaaaagcgtgttgatgtaaaacacgaggcctgggacatctgcttaactccagtgcaggttcaaaactcgccttcgggtatgctagcgtgccagttgatttgatcctgtaatcaacaagaaacaaagacaaagaaaccgcggttaaatccataaacgatagccgatcggctaggtgccgatgacatatcatttatatttgagccgatgtcatatatgcatcgatcgacggtcattaataaataagaaggaactaaatcttattcgatcggctgtagatattaacgatatatagtccttacatcgatatatacttaaatcaagtgattgggatagatcagtcgccatgccgagacagtataaatcacttagatcgaaatatatattaataataagactatatatgttcatagcatagccgatcagatagatctagcatgtatcggccaatactccgatactactctatattaagatattagagcaagtagaatatactaaacaaaagcctaatatacttaaatgaaacaagatcttaatataaatggcagattcaacatatcaatgaagcatataagggaaatatagttaaatcaggtaagatcggctgaaaccccgatgctaccctaatcgataaccaagaagcaggcaagagattgagattctaatcacgactcataagatcaaactcaactgatgcagctataaatatgaaaagaaggacaatatctaaacaatcaagccgttggatgtgtcatagagtggtggatatcttatataatctaagtcaacataggtatttaacctaatcggctgccttctatcgacagatgttagccgattgtaggttagatatcgatatcgccagagattatgtatggtatatgataactcgacgaattacataaacaagattagagtgtcataaagatggaagcactaatcccgagaacacaagccgccataacaagttttacctcttgttgaagatcgaaaccgatgcagctcaacccgaaagcaagaactcgtcgaaacaaaacgaaagtaaaagggtggcgatgcgccgagattgtattgaacgtgtgtttattcgattacatggggttcgggtctatttatacccgagaattacaagatatgtccataccagacacgactcttatctctaacaaactctaagataccataagtcttcgcggcagacttttgcccaaacttatctctaaggaaattacataaaatatcctaattaatagatacaattgacttctcaggactctatccatacgcggcaatcatcatgaagcacatcaacctaaaccgacaacgtttgctgcatcatattgtcggattcggctcaatcggctaacactgtccgactcgaactctgccggtcttagctgtagccgattcagacttcagccaattcttactctgttttcgcgacactcttcatctttgattctgcttcgatctaatcttcttttccgatgctgacattaccaaatttggccgttaacaaggtgacggctttttatagcatgaggaatgacggttgcgacggttggaaaggtctgtaataccctccaacgaccattgggagtgaatccccaccgtcagattgaaatctttcatccagcggcgcaaagggggttcggccgaaccaatggcccaaccggccccgctcttcagcaggccgtctcctcgtgggctcctcaatccagatcagtgaattatgggcctatttgatcgtgtcaattctgagtttctggcctatctctccacaagtctgattcttgacagcgtctgattgattgtccgagtgttttgctgtcggttctcctccattttgtacctctttctctaaggtagatagaattcatgtacaaatggaaatagattattctaaaacaaaatatacattgcaagcatagctagttctcctttattttagctatattgacagtcggaattggtcaataacgaccgtcaacaattttcaaaaatgactgtgaacccaaaaacgcttctggaaattttcggatttgtccgaaacattttcggaatctcctaaaaatcttcggttgacttcactgttttgctgttctggaaattttcggatatgtccgaaattaattttcagaattttcgaaaaatgcaattattgggcataacaggcaaatctggagttgtggctataaatagcccactccccttacttgtgagggctgctggtcacattggatattttcatgcccttggcttgttcatcttcagattcacttttgagtcttgctttcttgtttccctctcacttgtgtttgattcggattttggtctgtgtttgagagttgtggattcgagtttgtgtgtgtgcttgttgtaggcttcgtgaagatttgtgagcacttgcatcatctccgggagttcctttgattatttattactcttggaggttgaggactcctaggcggctaggtgtcagtctcgagtcaccgatctacgtgtggtaggccaggagaagtttgtgaagatcggatctcacctccgaaagggaagagataccactagtgaaaggaggagtgctttgtgcaacctcttgagcaaagggttagtggatacccgactctttgtgagctcgtcaacgtagagtagaatcccctcaaggatttgaactcagggaacaactcatcgtgcaacaactttggtgatattacttccccctctcctctagctttgcttgattgtgtcgctaaaggtctagttgcttttcgtgatagcatattcttgttgtaggcagctaaatctagaatttactttgttttgcgcatactctgctattttcggaaattccgaaaatccctacttccgtatttacttgagtttttgaattagcctattccccaggcctaattgaccctttcataaacctcagcgccattttagctagcgctaagtgcccagccagggaccccgcaacagggttgtttggcgagccgggcggcagcggctaagtgccgaatgtcagcgccaaggaaagtggcgctgagctgtagatgtcagcgccaagctccttggcgatgagacccctgccacgttggctgggccatgctggcagcgctcagcgccaaagcggttggcacggatatggccaagctccgcgccaggaggcttggcgctgagcccatggcctatttttggttaaagttctttgcgcgggctaatttcgtaataagtttttcaaaagggtcaatttgtaaaaaaaaagaatggcaaaaactgccatgtcggacgaaaccgcctcctaaaccacggaaggagatcatttacaccggttttcaaagatggaacagacgttatacccggttttgttttgtagttgagggatagattcgaagcaagagttgagggtggtaaaataaacttattcctgctaggctagggaaaggcgcattatgctggacttgggactgggccaccgcccaccgcagtccaataattacggcgttaaagacctagacgaaggagtggtggaaaggaagcagcctcccagattcccacccccccaccatctctccgtaaagctgacggctttgggaaggcgatgatccggcgattcctgtatatggtcgacatcttcgacaaatcacacggccctatctcccgcaggctacgccgcatcaacccatcacatctcttctaccccaatgatgcactgcccgtgccccaatcgtcgtcgtcggcgacggtggtggaggacgcccccctgcctccaatagacatgaccttctgcgggtcgactgagttcatgcgtaggagcgacgacaagatcgtcagcgtcgacaggactactcgccgcgccatcctctacgaccccgccgagcacaccgtccgcgtcttgccctccatggtggagtacaagttctggaccaagtcgttcgccgtcggcgacgatctctacgtcatggagacgataccgctgcctgacaaggtggatctcggccgcgatgcacggccgggccgttctttcgaggcgctcatccaccgtgaaccacgccccgtcgatggcgacaggatagaggacgagtgctactggcgaccactgccgccgcctccgtacgtgcacgccgccggcataagaaccgacggccagatctgcgggtacgcggtggtcggcgagtcccacatcttggtgtccacccacagctacggcgcctactccttcgacacggcgagcgccgcttggagcaaggtcggcgactgggcgctgcccttctgcggccgcgccgagttcgtccccgagcacggcctctggctcggcctctccgtcgcggacgacggcgtcctcggcgcgtgggacctgtcctccaccatccaccaccagcagccgccgccggtggcccaccacgggtgtaagggctttgcggtgccggaggtgccatacgcctcacacgtcgtgcaccttggcgccggcaaactgtgcgttgctaagctgttcatggtcgctcaccaccgggagacctgcagccattcttgttgcgactttgacagtgataaaaggtacttcgccattctcaccggtgtggaggtggtgcgctgcaatggcgacaaggttgacatcatcaagcacaagtcctgccgttatagctttggtgaacactacatccccatttatctactctaactagtagagtactcctacctactgttttaataaacctttatttggttaatcctgctgtttttcttgtaaactcttttattgtacatgcatgatttgaaggaatcaattaattatattttgaagcacctgaaataaaaatataacatttctaacctgaataatcatcacaacatagtgttcaaagtggcagaacctatggtactggagacaacatatgacagtaaccataacagataagcatgagaccaacaagtcagcttcctttttgttaatcaggaatggtactttaggatctgcttatgtggtttagctcgtgtgtctctataattttcattcctttaacagtccgcataagcgcatacagcattgaatcatctcaggcaacgagaataacctattgcttcaatcatcattgcataaatgtgcattacagtgaataacccagattgctgcaaataaaactatgcactttttatctgttaacatagcctacactgttaaaccccctcctcatgtaaaaatcagttggaaataaaataaaaatataatctctggtgaatcgttttatgctctgttgattatggcagtccaaaaacatgttgtcaccattgtccatgtgcttaacttgaagaaagtctactggtatttgtctggctcaaatcctttatccagtaatcttttctttttgatgatagttataaagttagtcaccgttgtcatactcgatacgtttggcaaacacaatggatttgataacaatcaactctttgaaggtttgttcttcagctttattctaacttaggcttaactgaacatcctacttcagagtctttttaatgtgcttggagtattatatatgagatccgttgttcacttctaatctaatggtcaatgataaaaggtaccaattaggagtagttaaaatgtgggccaggtattaatctaaaattttagtggaaggttagataagtaatttgatcctaatatcaaaacacaatttacctctttaaggccggcgcctcaggccgcctctcgtgctgtacacgtaggatagctacagtacgcagggtggaaattttgcaaaaaattcctttgcttttgtataatttgatcaaggtccctcccgaacagtttctctgaggtggtattttacgtgtagggcctgcataaagccggatatttcatgcaaaggagggaaaaatcgcgaattagggctgcgatctaaaatggctctaaaatgtggaagaggaggggctttttcgcaaaaatacgcgcactaatccactcccccccgccccanntgtcaaacgctagccgtcactccccgcattccctctcccct

SEQ ID NO: 80236 - DNA, 11897 bp, Oryza sativa
gcctaccctcctcctcgtcgtctcaccctctcgcgccgccgccgcctccacttccgccgccgtcgtgttgctgtctcctcgcccctccgtgtccgcctcttcctcgcgccgtcgcccgagcgcaaccgtctccgcctccgccactgccgtcgctgtcgccgagtgctgccacttccgctttcgcctcgctccgcccatacctagcaccgcgccgcagctgccgccgttgccgagcaccgccggagcgccgtcctccatttctgtcgctatcgccgagcgccaccgatgcatccttcgccgccatggctgacgactgctgcgccaagttctcctcgagcagctcgccgcagttgtcgatgaggaagtggcgtcgaatccggcaacatctgacctgctgctgcgcctgcgccactgtcaacaatcgatttcacctgccatgaaaaaacaaaagaaaggtcagttattccggttccctgccttattcgagaggaaaaggaagtattggtgtaggcgtttagctacaaatatggtcatgcagcggcgagagcagagctgaggcatcaggcgtggtgcgcgtcgcttgatggtgcttgccggcactgtcagcaaacctggcaagaggaccactcgatgatcttgtgaacatttacagacggcttttgcatcattaagggaacttgttgcatcatggatgactaggatatcagaagagtgcaagttgtggacttcttctgctctatccaaacaaggaagacttcagatatcctaatatgcatattaatggaatttttagaaataaaattttcagctcctttaactttctgcttcaaatgcatatttcccattccaatgctcctaatggattgtattttgtctcaagcagttgttttagtaaaaaaattgtatgtaatacatgagatagcctgggacagtaatagctcaagaaacaaaactctctttgagcacaaagagaaaagtcctttcaagccgtgagaaacttttgggtacctttttggcctcctatcatatgagctcctttttcttctcccctgtaaatttgtcaagttctacctcactgtaagagagaggagatagagagagatgtactaactgatgaactgatcaatacaagtcctaactgatgaactgtacaaattatatgtgttgcgggagcgagaagttgtgcacagctgagttgggatcagatcatctaatgcttactggagttcaatgtggttattttctatccacgcgatctcaagactttgcttaggggctattacaaacacgagctaggtgggcgacggacctcatattatgacatcgaagtcacttctgactgaggtgtgttttgtcaaccttcagtactcatgtttcatatttaaggtcaatgtgtaatgtcttttacatggctgtttatatctcaggcaagatagtttttgcacttgtaccagcatttgccaccacttattcaattcataagatcccactagccatagtggcaatctcaaaaccactatacatcagtgaatttccatcttatatagctagcttgctggaagatgaggaggtgaacaaatccttcccagatctgtacagttggttctgaccctgagccgcttctagacactacggcgggagttctgcttccattgcctccagattcctgcaactccatatacggcacatattctgttggtgtattccaggtataagtttgttctttgctctggcctagatttgcagttgtttcagcttctgccttatcttagttattcgttttctttagtgtgattcaattctgtagctaccattcctaaagtttgcgttggctccccttttttttcaattggtacatgcagcaggctaggatatcaaggaaacaaggggttgatgaggtgatggacaacagtgcaggatcaacaatgagaacaggatggagcggagagatggatcagtagttcctccaatctacaagtgcatactataccgaacgccacacatgatctccgtttaggatcctcagtagtggtatgtctaacatgatgtggtgatctttgtggaacaggcataggtttgtgtcttaggtgaaaaatagcacatatattattctgatgagaatatatttgttggtgctattttcagcaacacctatgcatttggtggattaatgtttgccaagcagttctattcacctaaaagtcttgatgataccaaaagttggttaatggttatagtagtgtacatggacaacgttgcatagattatcttatctgtttttgcaaggggatattcataccaaattttcttatggatacttctctaacaagaaaaatagtgaattaatttgccctgacaatgatttatctggtatttcctgccatgcgtgtagctgtatatgcggttactctcaggaaaattgtctttgtttgggatgaaaatatgctatactccagatctaaggtgagaagagtagtcacattttttattctctgatttctcaagcagtatatttcactggcagaactagatcccaatacaatttcagtcctattcttttcttcctagactcagctcatttatatgttacttggaacagatatcagtacaatatcaatattttttcatttgattttcgttgtcccgtcaatgtttatatgttagcttatgggacaagcatatatatgaacaggtttaataaagcctcataaaggaaagttgcttcatgattttaagtcccaatggtatttttggggaaacgcttcacatcgagcgtccggagtgaaacaaaatatcgaaccaaaatgtctggtggggcctactattgatttaacccattctttacctccctcctctaatcctgcaaccaactaaccctaatcccatttcctcctcgatccaaatgccctccgtcggcgactatccatctgcccaaccatgttcttccctgacgcggacgacgagtctgacgacagcgacttcatcgacgccctcatcaacccctccgatcccaccttccctaacctgacccccgtcgccgctgccgtcgccatggcttccgctgtgggggggcgggagtgggaggggtcggctcctcccgcagcggtggcggcgagaggcggcgcggctccctccttctatgacgacgaccaggcccgcgtctcctcgggcccctccctctccatctctgtagcgggcacgccttggtcgcgcaaccttcctccctcgccgatccgctcggccagccggagtagaaaaagacagaggtgggtttcgttgggaattttagtgaagttgcagattatttgcatttttgttgcactttgttctatgaagttgtttcgttccgttttgattcattattgcatacattgatttttggtgttgcaatcagtatgttcaattattgattttgttgaaacaaattttgctcaagcaccgaaacatttttttctctgctagtggaactttggactcattgttgcatgcatcgatttttggtgttgcaatcaatatgttgatttagttgaaacaattttgctaaacactgaaacattgttctctgctagtgaaacatttggaacttttttattgaaacaatttttaacaagagatgaaacatgtgaaacatttctcaacaacatggtgcaacaccgtccgatgattttcacaggatcggacgtccgatccgtagcagccttcgtatttttgcaatgcaacagtgaaatcacctttccctgtcctaccaagcgaactcccttcctgatcctcatcaaaaattcgtttctttcctttcttttttgttcagaattgaacaaagaatttggggaagaaaacatcttcccccacttatcatgatagcctgctccagtccccttacgaaactttcgttattgggttgttattgggttagccatacacttcacatgtttctagtgattcacatgacatcatcaaatgatacaagtcttggataagaatctacaacgcactagaacgcccttgttgacgattctttactgagacagcatctagggctcctcgaataatgtgatctcacaccgggtaaatccttaacccttcctcctttggtagaacatatgcgcctttggttgattaatacataagctagtcatggttatatccgagctagttgtgttctcatcatcctccccttcttgattggaaaccgtcctcggtttcaccttgtcatggagcgtattgaatttatctttatctatcacaacatccggtgaggaacatttattgatggccatatggttggatcctgaaatctttatagtcgaaaaccacaacattccccttcttgcaaaccaacatgtaactcatttaaaccactagaggaactagatagagaattacttatacgcatgtgttcctctagacaatacatttcatcatgaaaaggaggtatagttaaattcgaacaaatatatactcgatgcacattacattctcaagtatttaaagaagatagaaatttatgctcttcattcttgctagcaatgtgaataacatgtttaaactcaacacatggcaattcaacaacataactaacatgtttattcactagttgtggcatggatataagtgaagcatcgcacaactcttctttatcacaagaaacattaagcaacttgttttgtgacaaaggtatttcaacaattgtttccactatgggttgctctaatgtagcgcaagtagtggacatagttggcacatcataaatatgcataccttgattagttgtagcaccatcaccattacctttattctcatcttcataaattataggtgcttggccaattgaacattcttcaagcatgcatggagctatggataggtctttttgctcttcgtctttcttctcttcctcctcatcatcttcaacatcggaggtgctgatgtagccatcttccgtagcagcgtatgcccgttgactagggcaaaccttctgcacatggtcaaatccatggcagcggtggcactgaatcctgggcgtgcgtcccgttgaagcaacagatgaggcactcttggtggatacctgtgaagaacctttacctgaatctacaggtcgtgaggaaggtggttttggcgctgcagaaactccatacgcaactggtcacttgctcgttggtgggggcgcccagaaataggtgggcttgggcagccccggagatggcttcgcccgcggcgtgtacgtgcttgccttgttcttgacctgttgatcacgcccctgcaattccttctctccaaacatagcaaactgaaacaactggttcacagtgttaaattccatataatcaactatgtcctgaatatcgcgcctcaatctcgagtaaaaacgacaaatagaatcttcggttccctccactatgctacatcgcatcaatcccttttgtagctcgccatagtaatcatgtacagatttatcctcttgttctaaacacataagtttcttgcttaaatctctaagataagatggaggaacaaatctatcacgcatagctaccttaagttctttccaagtagtaggtaaagctctcccacatctaacccagtccaccaaatataagaaaaatctttaaacttactagtagcttgtcgaactctatgctgctcaggcacaaggtgggcactaaacttttgctctactgtcatctcccaatcaaagtatttctcagcatcataataacccaaaacagatggtattttaaacttaaccttagaataaggatcatcaggcacgcgattattgttaccttgttggtatcgttgattttgagcaccactcatacttgtcattgcaaacacaaaaacaacagcaaacagtgaaggttatccctaataatctgctacgcggtgtagtggtgcctctcaacaactcagccaaatggagcaccttaccaagctcttacaagtgtcttaccagcactgctaaggacggtacaaccggtggctggttcgtgacaccttgaaggacgtgatgtggcgattgcaaggatcaaagtggtgctgaccagaagtatatatgtgaagcttaggaggcacaatatatagtagcaaaggaacgcaattgtgctaatcagaaaatgcaaagttgaataataattcaaagtactagtcaatgtgctggcctagcttagactcaactctagctcaaggaagcacccgacaacactaaggactagatatgaatcaatgcacaactctacactctgaaaacatactcaaaggatgaatgatttttttttctttcttggtgcggctttttttaagcacatttctgccttttttttctttttctaaggtgcagttttttctttccttttctttgcacctttctgccttttctttcttttttttattttttactatttttttcaacaagaactgaccattgacctcaaacagggtctcaaatgtaaatatgaatattacaggtacttaaatgctaagtgcaaaactaaaattagatcacctcaaaaatggaatgctcatgtcatgtaggttccgtttttataaaaatatctcaaatcggcaaccactaaaatacccaacaatgtgatgtaatgccctagaaaaaaagtagaataccgtagaggatatattggaagtccctaaggttttggtgtttgaaattagaagaaaaacaatagttatacgctagctgggctagctttcggccagcccaaggcccaggtgccccctccacaccccctcaaaaccctagaagatcccctcacctccccctagccgtcatttggtaccctgggcgcccacctccccctaggggtgggcagaaaaagaccgaaccgaactaaccgagaccgagaccgaaaaattcggtcacaaattcggtcatcagttgtaactaaccgaattttatacagtcttttcggtcatctcgctcggttaaccgaaataaccgaactggccgaatcactgtaaaggcccaataccagcccaatagcccattagctagagaaaaccctaaccttccttcccacatcacacgatccttcccagtccccacaaccccacatgcgcgtgcagatgcaccgcctcttactcgctctttctcctcctcctccccgcctcctctccgctttctcctcctcgcaccgctcctctccgccttcttctcgcgtcgcgccgccgccttcctcgcaccgtgcctctccgtcttctcctcgcgccgtgccgccttctcctcctcgcgccatgtcgccaccctctacccacacatctgcgcgcccacgacctgactcctgaggcctcgatgacggaaggctaatgggagacacaagatggatgggatctggaccgtggagtggttgagatcgacgggatcaatggctggattgatttgcttgatttgattttttttccatgaatcatgctctacttgctacttgttgtggcatcatcaaattttagtccttcatcccagttgctttttcattcatcatgtacagagttctttttttgcaattattttttgggctgagttcggtctttgaccgagaccaaaccgaattaaccgaagaccgaaatactctatcttgagttttcttgaagaccgatcagtcttgtgatcgtaaagaccgaatttttcaaaagactgaagaacctaaccgaaattttcggttagaccgaatgcccacccctacctccccctctggtcgacctcccccatgcctgccctactgcagacctgggaagaagaagaagggaaggagaagaaagggaaagaaggaagcggagggaatcgaggtgaagatggaaatgaagggtttgattaccgctgcccatggaggctttccccctgttttggttttctattagggtttagatcaagtgttggaagcgagtaagtttgggatccaccgatttattcctcagccaggttttcgctgatctgccccctgcgcagttctgttttggatgccttttcggccaagataataggatttccttcgaaaagtctctatacaaaagttgtaaataacgtgtagatctatcttctgaccaaatggcatgattttatatcaagtggtttaggaggtatcaatttctgaagttggctgtctgaatgtcgatgcatttatctgtagtcgaggttcagagggattttagaggatcttaatgatggaatccgagaatcttgtatttacagaagttgtagcatatgttgtgatctacctcctacataaaaattgttagcttttatcttgtagtttgttgtcagtgctcttttgaatggttgttgcacagttttctgggcagatgcacttttctgttttgtgccatgttttaggccagctaaatggaagaattcagttttgttatctaaatgaaagttataactcttgttctgtagatgtcagaaatgatatattttgctatgttatgtgatgtagaattggaggtatcgagttgttaatctatgctgcttttataggaagattatcggtaattttctttatgttgtttggggtgggttcccagcgtagaaagtgaatgtgtgattcttgaatgattatatgtgtgttgtttgaggctgagtcggtgtttattcaggtggtgccacttcggaacgcaactagagttcatctcgccatcggagaaggcaagtaacgtagcggtggtttgctataactttgacttgttatttgattttacctccacgttgaaattatatatcatcaaccaagattattatatgttatacataggatttacctatatgaatcatacttattgattccttcttgtagcataaatcaaaccttcaccctgaacacaagaaaacactttcggcgccaaatagcctcttgggctaaaccattataccaactaagcttgggcaaagctcaaccttagcaacgggaactggctttgtcatcatatcagcaggattatcatgagtgtttatcttgcatacctttagcttaccttgtgcgactacatcacgaccataatggtacttgatatcagtgtgttttgtcctctgatggaacatctgatctttagtgaggtattgttgatgcaaaaaacacacgctggcctggaagatctgcttagctccagtgcaggtccaaaggttggtaagatgcaggcgtgctagtcagtttgatcctgcaactgacaagatatgaaaatagcagatcaatgaaccgatcggctgacaagccgatggagcaattccagccgatgccgataccagccgatagcgatagggttttgagctatcggttgtatgtccaatgtagattctgatacttgatgtgaataacaatataaaggcaatcagctaataatgataaataacaataatataatccagtagaaaccaatcggctaacaatatgatataatagaacaagtattgatctgaaggttaaagcatacatcggctggaggtccgatgtcataaaatccacaagattagatagatcaatgaaacctttgttgtcattggctaaatccgacttatatgtatatccaatccttataagccgatgcaacgtctagataccttatcagttagcaccccaataaaacattagcatgaacctatcggcttagcaagatttatattatcaacaacaatctagtacgtcgaacctaaccgatgcagcacgagattgtatatgataatctaatactcgatgagccgatagatctgtctaatgtgatggatataacaaatctatttagaacagcattataattgtagagatatattggctaagacagaagatcggacctaaccgagatagtcccaactaaaccaatgcgtctctaaacgcaatgcaactagagatagaattaagatatcaggtaggcaaatatatcaaccgaaccagagcgcgatccaagagatcgaagcgatgcagccttgaacaacaccaatgtagccgacagattcaccagggccggcggaacgtaggacttaccctttcgccggagatcgaactgaaccgatgcagccccacgtcaggtgccaaattccgtcggttgataagtaaaaacctcaggaaagagggtggcgacgcgccgagagtagttttattgattgtgatattgattacaatgaccccgggtgtacatatttatacccatgggtagatactagtccttgtaggactagaaagaaactttcctaaaaataaaaggaaaacataaagtccttaccggacactaaacacactttcctaaaaataaaaggaaactaaaccctgcctaattaatagataaactgccatgttgtatccttcttgaacttggactcttctagataagcttcctttaattgatccgactccaccaagaacacaactgttggactcttctagataagcttcctttaattgatccgactccaccaagaacacaactgctggtgacttgacaactcacatcgaccgattccgagactctgaagccgatattgactctaggccgatgatgattttgggcttacctaattttggcgttaacaggtatatggcactttgattgtcacaaaataggttaatgcaagaatcaactccacaaatctcagcaaacaatcctttcagccaaactgattccttacatgcttcagcaatagccatgtatcctgcttcagtggtagactgggcaacaacaggctgcaatgttgccttccaacttacagcacaactaccaatagtaaacacataacctatgagtgaccttcgcttatctaaatcagcaataaaatctgaatccacatagccaataagtcccttagcagccctgccaaatttcaaacaagcatatgttgtgcctcaaaggtatcagaaaatccactgaacagccttccaatgttctttgacaggattagccatgtatctactgaccaaactcatagcatgagataaatccggatgagagcaaaccatggcatacatcaaagaaccaacagcacaggaatatggaacccttgacatgaattcaacctcctcatcagtactagcacattgtaaagctgataatttaaaatgaggtgcaatctaagtactaacagactttgcatcatgcatgttgaaatgatgaagaaccttcttaatgtaactttgctgactaagaaaaaacaaaccagaatttcggtctctagtaatttccataccggcgacaggcctccacttcgcttatgctagagtgggttggattatgtttcttgggttccctttggattttcgtacccaaagctatgtcagccgtgttattagtctttttgggaggcttgattattggcagtagatggatgtagtcccgggaagagttatgctgcgagctttttatgatgatgttgatatggttcctagaacaatagtgatcaagcaaatacccaatcagggtggtcagggggagtcttggactttctctgtttttgtcctcaacaatgattttgccggcattcaggctccggatgaagatttaccaccaatgggtgccctagatcctgatcttgaaaataatcatagcaatgggccggttcaggaggagcatcttgataatcatgctggtggttggggagattgggagcagcaaggggagaatcaggatcagcatgtgataggggattctggagtgagtcagcagaatcagaatcagaatcagaattcagattctaatggtaatatgcagatagtgccttttgtccctttggttgatcctgctttggaggttgtgttcactgttgctgaagaaggccctttatattttatttctgatgaaacacaaggaaggattcaagaatttttcctcaggaaggagcttctggaaaagttggttaatagtttatcttcctcttttattccgggtttggtgaccccctctgctcc
